United States Patent 6,812,339 (POLYMORPHISMS IN KNOWN GENES ASSOCIATED WITH HUMAN DISEASE, METHODS OF DETECTION AND USES THEREOF) - sequence listing, part 60

SEQ ID NO: 15841 - DNA, 177251 bp, Human
gacatataacaattgtacatatttatggggtgcatagtgatgttttgatgtgtataatatgtcttgtgatcagatgagagtaattagcatatccatcatctcaaacatcatttctttgtgttgggaacattcaatatcctccttctcgctatttgaaactataggttattcttaactatagttatcctacagtggtatagaacaagggtccccaaccacccccacccggcccggccacaaaccggtaccggttcatgggctattagaaactgggtcgcacagcaggaggtaagcggcgggcaagtgagcatgactgcctgtgctccacctcctgtcagatcaacggcggcatgagattctcagaggagggcgaaccctattgtgaactgaactgtgcatttgagggatcaaggttgtgcgctgcttatgtgaatctaaagcatcctgtgacccccgtccatggaaaaattgtcttccatgaaaccagtccctggtgccaaaaaggctggggaccactggtatagatcactaacacttagtcctcctacctggctataattttgtgtcctttagcaaatccatccctatcctcttctccttacccttcccagcctctagtatcctccattctgctttcacttctctgaggtcagctttattttagtttccatgtatgtgtgagaacatgtggtgccttctcatattgtttaatgtgcttattataggcatcgagtaatattgatgagaatgagcattcttgttttgctgttttgttttttaatgagacatcctctggttttcaccactaagtcgcatgcctttttagactgagtataaaaacataattttaagctgttcttggtgactcaagataatgattgtaaagacttgcctttggatagacataattatgcagtggcttttggggtctgctggtctatttgtctttaagtcaggcagccttacactgctatgcttttgtagtttttctctttgtctttccccccttggaccatcatctgctgctgaccagaatctgcttgctcttggggggctttctgacactgcttgttttctccagatcccattgctcacttcagccaggtgctttcatttatctttagctgcagccctcaggattggccactgctctagcaggaaaagtatcaaagtccctgataaggcagggacagaaagagggttttattctttcttttctcactgttgagcccatgccaagcagtatccacatactgcctgccccgctttcagtcctcttttttggtccaaatgatgttggatctgtcattcgactctggatgaatgagagctcctgaagggacaaccctttcagtgaaggggtgagggtggggcatgctcagaccacttttattaccttttctggggcagaaattgtaggttaaggtgacatcctctcacagtttctttatgacttcatcaggatacaaagaatacaagcttctccccttctcattttctgtctccctctctcttctatagataagtatagagacagaaaagtagacgtagataaaaacgtggatatcagagagagggagcaatcaagaaaggagataggcagtgtattgtttttagaagagcagagagacctttgggaagccctgttcaagaacaagcagataataaagagttcctttgcttttcttgagaaagaaaaatcgttgcatggaagtatccaatagtctcaggccctctgtagaaaaatttcctaaccatcttctataacacacatatagttcaacaaatggtagccagtattttaatcatcattaatctatctactttgaaataattaaatattaacggttaaaactttaactgtttccctcctttgggagtgaagaaatgcaagtcaatctcatttttagtttaaaatgtgaataagtgaccaccaaattttattgcagatgtgctttaaatatttggcaaattttaatatttttctgctggatctgtaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaggtatctttttttttaatttagtgtactaactaataatgaacagctaagaattgtatatgttgcctaacttacatgaactttccatttacttggtcctttttcataactgtccatcaatatcgtgtccacagtattgtatttctgtattggatggcttaaacaaccatattatatattcatttggcactctgaaagtttggaaccaactgatgtgatatgagccagctaattgttccattaaaccaaataaccaggaacatgatataatttaggtcataagctatgctgggtcgattggaaaaggagcacagatggaacggaatcaggcttcagagcactctcacggctgttcgtccagttgatggtgatcatgggcttgatttaggcaaagttctgtagggtgggactaagaaggataagtgtttgaattcctttagaaatgggactctaaccagtggccttgaccaaggccaacttctcctaaagcaaggatttttctattacaggtggttttgaaatgccactatttgataatctttacctcccatttaactcctattgctttagtctacttgatttgatacattttaaaggtatctctttccttcatcagagacacataattcatgcaggttgggtcctgttttagagaatgtgatcacagactgcctgttttgaagttttaccaaaagttctgatcagatagtttgtatttattgaagattatttgaaggacatccagtcagtccgtccatccccctgcaacccagatccttgcttctcaaagtattacatgctgaccagtgctttggtatcacctggaagttggtgaaaagagcagaatctccagcctccctcctcccatccaagacctactgaatcagaatctgcattttatcaagattcttaggagattcatatgcatattgaagtttgaggaaaaactgctctaggatttatctctggattaagctactatcagaaagctgcacacttatattgttttggccttccacggactagcttttactaattgcagttactattatactttgactttaattgatgtccacctcaagaagcactagtatggagttcattattgtatctgctgtcagcatacgtttgaggatgttgtctatacgtctctcactggctcctaaaactgaagtcctgtgaaagaaatttcttttaaaattaagtgctgagcaaactttactttacatccagagggattaaaaaaaataaacctgtacataaggaaaactatgaaaccattttcttttatcttaatcaccattgaactgtttgcatcccaactaaatgagatgtcatggccaacatatatgcattttatttttccatgtacaattattagaacaacctgatatacagcaagaactcaataaatatattaactattcttcttttcttctccacctcctccttaccatcttaacagatggttgaaagtagctggccgagagcatccccatggccttgagtcctgtgttacagagcattccctgtgggtggggccagactgtgttacctgaaagtaactcaagatgatgaatacaaactgtgctttaggtgggaagccagtccttaactagaggaggaagcaagatcataaccaaacaacaaacaacaatagcaaaaagcaggactgtaaatagcaaggaatatggaggcctggtcagatggagatctgaacattgtatagtagccacgagtccattttttagtgtcagttgaatgacctggaagtgggcctactggatttaagagcagtgaaggggaccacttgccacttcctgtgttgattcctctgaatgggcaggactggtgtttcaccagtttcactggaaagtcacgaagctcctcagaatgtggttatgatggaatggaattcctaagtttgcttacctggtttctgtctctttgaacagaccaggtactagagcttgcatccatggctatgagagcccagtacctcttgcctcacttgtatatgctgatgactaggcagattgagtggcttggctatagtgctggtgcagggagacatgggcatatataaccatgtgtttccctgcttaatccctttagtggcttccgactgctatgaagacaattcctaaaccccttcccatggccctgtgaaccctcaactctcatgctttctctagatcccgggatgcccctagctgtactgaccttttttcaattccttgaagatgccaatcagatcttctagacatttgcctatagcacttactcttcccacaccctcatgatcccttttgttccccgctcctggtggccctggctaattcctactatttatctgggttttagttgagatgttttcttcctctgagtgcccctctcagatatcctggagtagttaggtcctcctgctccatatattcatgagccctgaatttcggtggtggtgccctttgtactttattgcaatgatttgtttcactgtttgccttttgcccttttctgtaagctctggaagcctggaaccatctctgtctttgtttgcctagcacagtgtcaagcataggaagaaactcaataaatatttgttaataagaatcagttcatcaaagagtgaattttaaaaactgcccacatgcttatgttttatgctattgcaattcagtatataatttttttgtattttatgtttttaaggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagataggtaggaaacccagttttcgttttttattttgtaattttaaaatgtgcataacattatttatagttgaatttgaaatattaacaaaagcagatttctgtcatgctgggtagatgctagctcattaaagtcagcctaacaatgaaataaccacttaaatatacatgtgcattgaatttttatgaagtagaaaaagataaaagaataaaagcaagcttgaatgttgactgtgagtgatttaatggtgaattttagattgcaagatggaaaaatattcctagaatcccaaaagaagttaaaattgcaaagaaggaaggtcccttggagatcatttaatttagtctttttttcagatgtggaaattggcacctaacgtacattttcatggccaatatgaataattagtcaatggcagatcccgtcacaattctttccattatatgacactaggcaattactaggtcttttttatcccatgacacccagttaagtatgctgtgcatagaaaacattcaataaatgttgttagaattgacttaaattgcgttctttaatattaagtgctgctgttactttaagtagggctgcctccaggtgaaattatatcaaatcacatcttcagcctccttttgatttattgaacctatcccttttatatgcccagtgccatagcaacataaatttgtcagtgttttctcttctattggtgtttacatattaagcatcgtgtctcatgaagctttactaagatctttactaagttttacttagatccaaaacaaatacaacagaagctggatcatggatacaaagagatttattatattagtattctttgcacttttctaaatgagcgaattatttcatagtgaaactatttatttacagtggtgtgctggagctgacttgcatcagcctgtggtgcttacctggtttctttttttgttttgagacagagtcttgctctgtcgcccaggctggagtgcagtggcgcgatcttggctcactgcaacctccacctctacctcacaagtagctgggactacaggcgcatgccaccacgcctggctaatttttgtgttttttaaatagagacagggtttcaccgtattggccaggctggtcttgaactcctgacctcatgatccgcccgcctcagcttcccaaagtgttgggattacaggcgtgagccaccatgcccagccttacctggtttctgtctatgtgcattttgccccgactttgtgatatcacattggtagcttgccattgaccacagtggaagaatttatacaatagaaattggcaaacatgaaaaccaggtttttttttttttttttttttttctggagagccagttgttaaacatttgccagcacaatactgctcatttggttctcctgactgtaatgggaggaaggcctgagggttttaagtcagggttgaggagttttgaaattagtctcaagaaatctttgggctcactgtagtacttttaatgaatatcaagtaccctaaccttgtttgttcacttcttttatgtgggctactcagactctaaaataaataggcccattccaatcacattggatttttgcttgcgccatcctgtaacgtgtcatcccatactcacaatgctttattggatgaacatttgcagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggcaagtgtcaaataatgtagattattttaggtgaatttatttttattgccttttaatgttattttctgatataaatccaaagtgacgtgatctcatataatctacattagtatgggttgatccgtatgatattgccatttttctaggtcaaaaatggctggatatcaacagtttcatatggttcaatactattgctagtgttatagtctatgcatggaatgtgtgttagattacgaaaatggaatcaatctataattgcctgaaataatagtagagaggatcaaaatagcaaacaggggacacatgtggcttccctcccacagaaatgaaagaattttagaaagcatagcaacactggaaaataagaagggggtggccatcagcagatggaaaattttgagaaaatcctgaaaggtacgtagaacatgttttcagatggacagagaaaaaaatatttgaagacacatcaacctcagagctcagtacttggcgatcttctcttttctatctacatgcattctcttggtgatcttatgtaggtccaaactttaaatgccatctgtatgatgactccagaattatatctctagctcggacttcttgaaactctagattcattacgtacaactgttgatttagcatgtccacttaaatgtctagcaggtgcagattcactatgtttaaaaccaaactcccggccgggcacggctcacgcttgtaatcccagcactttgggaggccgaggcaggcggatcatgaggtcgggagttcaaccatcctggccaacatggtgaaaccccatctctactaaaaatacaaaaattagctgggcatggtggtgcgtgcctgtagtcccagctactcaggaggctgagctagaattgcttgaacccgggaggcggaggttgcagtgagccgagatcttgccactgcactccagcctgggctacagagcaagactctaccaaaaaaaacaaaacaaaacaacaaaaacaaaaacaaaaaaccccaaaactcctgatctctaggtgctcagacacaacaacaacaacaacaacaacaacaaacaaaacaaccatccccaaacaacttcgacctatcctttactccgctctttctcttatactcagatccaatctgtcagcaaacactgttggttctactttcaaaatacccccaaaatttgtactttcatcttagcagtgtactgtttccattgttttgatgaaaatatacaaataattaaacctctctttatcactggaattaaatatgtatttatcaacagccagatatgaaactttacataatcccgtttcaatgtataatggtttgggagcactggagaaatgattgttatcaagaaggtatattatagagtaaaactttacaaattaactgtttttcatgccaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatggtgagaaaaaaggctttaaatgcaatttaattagtttaattgttacagacataaataaaacaaagcatgtgttaatgggtagatgaccaactatccaggagttataagctgttctctcttaccatatgattttttttatgtcattataacccagacagaagataaaatagtaatttttttcaattaaaaaaaattcagatccagacctacagaggtaatatgctaaggataataatagatactgtttattgaccacatagtataatatgtgtaaggtgcaggctaaatgttctatgtgctatatcagatggcataactcatgtggttctgcagtaacaaacaatccctaaatcttaattgcttaaagccacaaggtttatctctctgtcatgccacatgtccactgtgggttgactagggtagaagtaggaggccagggctgctttgtatgtctttactctagtactcggcctgacgaggtacctactatctcaatcattgctctttgctgtagcaaaggaaaaagagaacatgaagaattgtgctctgactcttagagtttctttccagaagtgacacaagtcctaagacattggctaaagcaagtttcacgacctaacttcagggggtggtggggtgggggaaaacgtgccatcctatcgtgtaactagaaacaggaaggacctgaaatattctctcacatgtacactgtatcttatagctatgatagccctctgaagtggatattatatagctgacttacctgaggctcagcgagacttaaaaacttcctaggtcacccagccagtaagagaaagaagaagttgttgtctctctaacataaaaatctgactgcttaacctccacacttggtttttctttgacaccgaataaaaggaaataaaaataaaatttctgcaataatttaacaaggtcctatacgaaagaattgtaacaaattcagttaccatgtgattaagggtgagctttgagattcagtgttgtaaagataggaaaccaaaggcatgaataaacgggagtttttatgcttttatgtatcaccagttttaaagcttttatgtgttttccataaagttaaatctcgaagttgcaagataacacaaagcactctgagtttttaaatgtccccatggataaagatgataaattataggaagcaaaatcagaaatgtttctgatacactttattgtaagcaaacatccagtaaagcagttagggggaaataagaataatctgaagtattgattataagtcaggaagtgggatgaagaaatgtactcagtgtaaaactgtggtctagaattttacaaaaagcttaacatgctccctggattaagaataatattggaaatagcaattagatattgcattaagctgtgagtaactgaaacctaaaaaaaattgtagtttaacatgtaaggattctcttaagatccttttatggttctactccatcatgaattccatcttcaaggtcaccttatgaaccaagatgctacagaaagcatctctattgtgttgcagccaattgactgagtcaactctcttcaaaaaaacatcaaggatatttagtacagtgtgcccctttgcatctcgcagtgtagaatataatcacagcagctgcaaggcaggctgggaaatgtagtttttaatctaggtgttgctgtacccagcttgcaggtgggctcctgtggctcaggaaggttaagaggagtattgagaggcagcctcaatttctgtatttccagcccctagcaaggtacctggcctattgacagtgcccagtaaatggtcagggactgaaggtttttaacaaacttgcctaaaataactcattcctgttggccttacttgtctttgaatctccaaccttcctttgagacttgggtctgacctctgttcaacctgttgcttcttaggaggacttcatttcctgtctgtctctacttttgtccatttcagtgtttttcccatcattcccttctttatttcccctcactgccatctttatttctcctcacttccatgggtttttgttagccaaagagctctgtaactgtggctgcaaagaataattgaagagatggaataaaaaaaatgcccaaggaagctcatcagtataaaatccttagtttttttcttctttcaataacatactttagaccataattatcaggtatctattcagttttctcttgtattatttcacgttcttttctatttttaagccagcagacacaattttctattttttaagccagtagacaattttgccacacaaaattgtgtgtgactttattaatatcatgaaaatggaaatatataaaagggcatataaatattaatatacatggtctaatacatattgttttgagaaaacaagagtattttatgaatctaatattttcaataccatcttaaaatctgaattaggggtttgaaatatatttgtattcagaaatgaaaattgttttagcaattaaaaattaaacatattttaacttttagaaccctggatatgctgggcgccaggaactaccagaaaacctaaaaatccagtttagaactgttgctatgatggttcctgatagacaggtatgcactaggatttaaaagcataatgtgctttatgttctttacttgtttttcactaaagttgaaaaaaactcactatattaattttcagatcattatgagagttaaacttgcaagctgtggttttcttgaaaatgttatcttggctcaaaaattttacgttctttacaaactctgtgaagagcaacttactaaacaggtaactttatagatctgctttcctcctagcaatagtatttggtttttttgctttgtaattttcccttgataaatactcatcagtgagttaaaatctcattgactcttttctaaaatgcttttagaattaattttacctattggttgtgtatttttaagacccttttattttgaaataattgtagattcacaggaagttgcaaaggaatgtacagggaggcatgtacccttcaccctgccttgcctggtggttgacatcttgtaactgtagcgcaataacaaaactggaaatggacactgaagcagtccacagagtttaaggtttcatcagttatacatgcactggtgtgtgtatatgtgtgtgtgtgtgtgtgtgtgtgtgtgtagttgtatggaatatgtaagatacggctctgttccatcaccacaaggttccctcatgctactttatagccacacccacctctctcccaaatccctaacccattaaccttttctccatgtctagaattttattgcaagaatgttatgtaaacggaatcacatagtatgtaacctcttggttatgcatttaaaaatctattgtttgggccgggtgccgtggctcacgtctgtaatcccagcattctgggaggccgaggcgagtggatcatgaggtcgggagatcgagaccatcctggctaacatggtgaaaccctgtctctactaaaaatacaaaaaaaaaaaaaaattagccaggcgtggtggcacgcgcctataatcccagctactggggaggctgaggcaggagaattgcttgaacccgggaggtggtggttgcagtgagccgaggtcccgccactgcacttcagcctggatgacagagtgagactccatctcaaaaaaaaaaaaaaaaaaaacaaaaaagaaactattgtttgttgctcagactgtatcagactatattattctcaaaagatatttaaggtgtgaatacttacttgatcttgcagcttggattttcccatggaatgatcatatttcagtcaaaggaaaggcaggaagttgagctaataaacctttgtggcttagtcaccccaaaactatcccatataagtatcagaatcgacctatatgcatagagtgagccgtgagtctatgtttagtttttcaattaaaccatctttttgccctcttctcccatctcaggttcattatgactttggattgagaaatattctgtctgtattgaggactcttggatctcaaaaaagagccagaccagaagatagtgaattaagcattgtcatgagaggactaagagatatgaacctttccaaactggtatcttctctgaattctcttcttttccacaattttaatattgtttctttctatttggtggacaagtagaggtaggctgatgttgagctgtgagcacccataattacagggataataagtgtgcaaagctaccactgtgcttccagaagaaagcaaaagaccccatgacctgtgtgaccaacatggactataagtgcctccttttatcagctgtgtgcagtgaaacaggtcatcagtgggcttcagctccaagactcaacctagttgtctaccattattcacaaagtgacacaaattctcagcataagaatctggattcacagggaaccatgagaactttttgctttctctgtatgtgactagcttatctcagatatatctctcccaaaacataaacatcatttctattttccaaaaacacattgaaaatttgctgtggagagcatgctgctttcatgcttgtcatggttacagcctgatttttttttttttctttgaaacagactctcagtcacccaggctggagtgcagtggtgcaatcttggctcactgcaacctcctcattccaggctcaagctatttccctgccccagcctcctgagtagctgggactactggcacacaccaccatgcctggctaatttttgtactgttttgtagagatagggttttgccatgtcacccaggctggtctcaaactcctggactcaagtgatccaccccacctcagcctcccaaagtgctgggattacaggcataagccaccaagcccagcccagcccagccaggttgttttgaatagctgatggacaggttcatgtgacatataaggatttctacatgccacatattgtgcccatgccatgggtgtacaaagttgaagaagaagtggttcaggaagctacattctagttacaaaaactaacatctgtggagttcattagtgttacaaagtcttttcaggtgtatcgtcttatttgagcctcacagcaactctgtggggtctggatggctagcttgtttattgtcacttcacttattggggaatggagactagaggttgcaggattcccccataatcaccatcagctgagaagaggggacaaaaatttataagattttctggtgccaaatccactgctcctgccagtatacctcactgcctgtatgaccaacatggactgtaatggaggcttagactccctaagtcacccaggctggagtgcagtctaagcctcccttagataatggtattttggaaattcctagacaagtactcaagaaagcatcagcaaagccctagagaataaagagaaatcataaggggtcagatgttgggaacagggcaatctatgcattaaagacattgcaagcaaggattggagtcagtgtactcaaacctactgcttataagaaaggctcagaacactgccctgatggacttttgcagccattgttggatgaagtcatgcagggttatggctatttccccaatttaaataaaatatccgttctttaatttcatggggttgggactacaaattatcatttttaaggttaatgcaaatgccactgtgagaagcaaagattcatgtgataaagtaatgaggtcgtactttggagcagtagactggggcaggattgtagaacacattgaatgctaacgaactttgggtacaatatagattcagtggtgattgtattagtctgttctcacactgttaataaagacaatttataaaggaaagaggtttgatgaactcacagttccacatggctggggaggcctcacaatcatgctgggaggtgaatgaggagcaaagtcacgtctttacatggcggcaggcaagagagcatgtgcaagggaactcccgtttacaaaaccatcagatcttgtgagacttattcactatcataagaacagcagggaaagacttgcccccatgatacaattacctctcactgggtccctcccacgacacgtgggagttatgggagctacgattccagatgagatttgggtagggacacagccaaaccatatcagtgatattctggagaaagtactagagaatacaagcctgattaggagagtaataaatggttctctggggatgaagtgataagtactatgcacatcccagctagctgataaatgtttgttgactgaatgagtaaatttattttaaactatgccaccttaggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcaggtaaagacattttaatctattattagtataatgataagtatgtgttaaacattcctgtctgaatagaaaaactcatagttagtcttacttgatgtaaatgttaaatgaaaacatcatatatacatcattgcaaaaagaatacttggaaggatgtggtggtcctaggaagatagtatggatttaccctgcctcacagtaatcaagcagtaatttactgcagtttttacttatacctggtgacaatgttgggcggaaatagtaggttataaaaactctaggggaacggaacaacgcagatgtcttcttgtgccaatctgatagtactggctgcagctgggtgcctcagtggagtgcagagcctgaggaatctgggagtgctattttgctcctgctttgtgtgtggacatgttatatccttcacctacactaaaacctgaatcttttgactgcatatgttggtgtctttctgttcatcacatttcatccttgtgacaaccatctaaccacttgattggattaccagtagaatcaagaacttgtagcagagacacaggattaaatctctatgagcttgatgctttgggaatattttccagagcttttggaaaattaaggagctgaaattgtggacattgttgaaaactgcatttgaaatattaatataacgattcttattttaacttactgttcttgccagattataagatgtgcaagtatctgagatacatccaaatcttacaaagaaatatgtgcatgggggaaaagtctttttcatcattcatgtactggaaaccattttaagagtttaaaaaatttctgggaaaacatgattttatatatgatatgcatacagtatactgagttttaaaattcttgccatctcaatgggtggcgactagaattttgggttctttgttgatgtcaataacattgctcttgaacatgtcaggaacagtgcctctgttgcttttaaactatagtttacaatggtaatacatttctgtccaaaatgttaggagaataactcactctccctctgatcagctgtcagacctttgacttcttaatttttttaatgagaaaactgcagacgggatgttatagcagcggctgtccatgatcctagcatgtctcctcgaatctcttgtaccatttccacgtgcccctgcccagcttctgtgtgttttcgcttctaatagcaaaaggaggcctggagccattttgttggcaggcacaaagagtaggtgctgcacgggagtttatttcccatccacccccaaacaaacgtctctaagagttgatggagtaggaaagtcaagcttgcctggttccaggtggagcaatctttgaggtgtaagttacactccagtctcccgagggatcaggctcaagtctgtcctctacagggctttgtcctcaatcacaccttgcttggcttcttcccattcctgtcctgctttcctcttctcttactggtttctcctgggagcactacctgaataaatcacttgcacaggaatcctcattcatgatgtacttctggggaattagaaggcccctttgaaacggatcttcactgtgatgctctgcgttgctgctttccaccactaaggggcgatatcatcacattggatgccgagaaagtttgcgcatggaacaactgctggttatagaccaacaagccaaaatcacagggaatcatcacgcaagaagcaaaaactagatgctgagttaattatttccaaaatgtaattcaagctccacattgttattactttagcacatatcgttttataacgtggtgctcatttgctatgcacatctagtaaaacaacattttttacaacttaaaaatagtgaactagttacgttaatgaagagcttattaaagcctttaatcttcaagtagctactatgaatgtcagcaagagactcataaattacatattttaatttactggttaattgtgtagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtatacacaaacctcctttgtgatcattttttccctgctagcgtattaacacagtatttttttgatttttccattttaattacttgcaagtgaaaagtgattttctgttttaattattttcaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggtggggcagagagatgggaagaagaaccctcagagtctctccacgtttcactttctcaataaacacagattctgtttctttgttgcaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaagtaagatttttttttgtacatttactacttcgattttgatttttttttcactcagttgcagtttacagccatctgaaatagaaagttcagacagtccataaaaatcatttgatgatgtggctgtaaaagctctgataattttgatttctattaaagatcttcttaatgatcttactgttttctctattattttcacttcccagagggatgttgtcagaggaaggggaatgaactatctttcccattgtcaggtttagtgacctgtcccataaagtgtgtataataatgacagtcaataaaatatagtaattaattaaattttaaaataaataaaaaataacacatacacctacacacacacacacacacacacacacacacctgcactccagctggggcgacagagtgagaccctgtctcaaaataaataaataagtaaataaaaataaagttggtagcttcgtgggaaagaacagaaaggggcctgttgcaatcaagaaaacttgggaggcaattttggctttggaaatttagcatataacaggtaaggaaaatctttaaataaaaattatctgacaagtagttgtagcattgttttttccctttcttccttcctttcctctttctttccctttttcttttctttctttctttctttctttctttctttctttctttctttctttctttctctttctccttccttccttcctccttctctctttctttctttctctttctccttccttccttcctccttctctctttctttctttctctctctctttctttctctctttctttctttctctctcgctctctctttctcccctccctccccttcccttcccttcccttccctccccttccctcccctcccctcccctccccttcccttcccttccctccctctctctctcttcttttcttttcctttcttttctttccttttctttcttttctttcaacaaggtcttgcctgttgcccaggctggagtgtagtggtgcaatcaatcataactcactgcaaccttgaagtcctgggctcgagctgtcctcctgccttagcctttgaagttgttggggctacaggcacacaccaccatgcccagctaatttttagattttttatagagacagggtctctgtatgttgcccaggctggtctaggctcctggactcaagcagtcctcctgcctcagcctcctaaagtgctaggattgcaggcatgagccaccatgcccagccagcattctttatttcctactcggttttccttattagtctttgagttaaaacagaattaatcatagatcttcaagggctctcctaattctgatctataggtgatctctccttacacattctagagcttcaattctcagttaagagagtcagtcatttgtgggtaggttagaaacaatatataaggccgaaatcagtgaattatttagtaattactttaaaatggatcatagaagacaatattttattttgaagtaattttgttttgaaagaccgaggatgtcctactgtacttgtctttctgatgctatagggcattggcacactttttcttaaagggccaggtagtattaataaatattttaggctttgcacaactctctgtctcaaccactcagctttgctgttgtagcacaaaagcagctagagacaatgcataggtgaatgagtgtgactgtgtgtgtgttccagtaaaactttatttaccaaacaggtggccagcctctagggccacagtttgctaagtcctgcaaaattttacaaagaaatagaatctttgatctggaaaatttagataacttaactttagaaccagtagctaccttagctgcttacatcgagtctaggccttttgctttcccagtaggaaattgagactcagagaggtcagtgggatgagctgagggttgaaaccacaggagcagattttcagttcagcatcctttctgctagaccatgctgcctgtctaaaacaggatagcctttcttctacgtgctgttggctgtaggacggtgatcaagcaatagcttgagatatatctatttttcttctctcttccttcctccttttaattttactattatttacaattttttattttcaaaattttaatttaaaaatttattttatttgaaacattttcagtctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtaagcccactgaactataccttaaatgaaatgacttttttcaaatgagaaaatataagctttcataaactcttctatgagagaatattaaaacaattatgaaaacataattgttaataccattttgaaaagagcatgtatttgaaagagagtggaattttgcatatgaattgtgcccgaaactgatattgagactcttgacttctccttttggagtgggctcagtaaaatctggcataaataagttagtaataccttgtacaacatctactttctaatgctggaataggaaaggtagcagcgtggagaacacagattcttcatgatgcaaagcatgctaatacacataacggatcagccccacacttcccctgttgggaatgccagaatgagtagagaatgaacgtagcagattcctcaaggtccagcgctgtcaccttagccccccagccttccatgtatggccgggcccagctcactgctccttaaaagaaatgcctttgaacttggtgctttcatccagagcccaggccctgattcttcaaagttccaaagaggaaaaatatgcttcctaaaaactctaattacctctggttcttcctaaaaactcaaaaacagcaatagtcttttgtttgtttgttttaatgaataaactgaaggacaactggagcaggagagtagacagcaatagccaaattttgaaagcaagaaagcagtaaggtaagcggcagtcgatttagcacactggcagtgggaagagctgagaagtaattgagaagcgcacgccacaggacattcaaagggctcaggaagtggaaactggggcaaaagttgagctaaaaaccacagggctggttataagtctgtttgagaaaaagacctcctgggccgctttccaaagccctgctgccagacaatcggccttccccacactggcaagactaaagagttactgtttgaatcgtgtaaaatagagggtttcctagacttggggacaccaggcacatttaagagtgggagaatcataccaaaactggggattaagtggaaatttgtgtttgaaagggactgagataaataaattttttcagtgggccatctttaaccagaatggccaataattgtattacatgtgttagatgctgctaaaggtttgagatggcaaaagggcactctaactcaaaatgcaaactaacaaaggaatctttaaatctagatatgcactcccttagaatccagagccaagctcctccacagcgctgctttctgagcagccggagttctatgatgtttaaaggttcagattgcctccctctgagtgccttgtccttattcagaggccgggccccaagttactcagagagtgaaattcatcagcagcaattttccaaccatggcagagccttggttaggggattgagatggcatctaataaggaagccaataaaataattaccttcctctgtgccatcaaaaatatgtattgccacatttcttaaagagcagtccagtgatgtttgtgacattttcttccaagtagctaggactggttctgtaagtttagacaatgatgttttcttatttttaatggagatgttaacaaaaggttgacaacaatctagactcatattccttcttcaaggtggtcctgaagtggtctgttgactaaaatattgaggggttgcaggcattcagtcttgccatcctaagtaactacttttgacgaaatttatttgcccgagcctttgtggccacgaaatgaactaagatattatgcacttagtggttatttagggccctaacatgtccactcagctgacttctagccagccctttcttaactcattcttcatccatccttttaatttttttatggacattaacatctttggagaagacttcattcatagatttaaaatgaagtaaggagacttatgcttccagcgaagatggagtaatggggactgggtttaacctcttatattaaaaatatagaaaactggacaaaatgtgtaagacggttttttttcagagattggacaataggcactactggactgaaatcaccgagggaagtgaaacaaggtgattgcattagtttattgcatggatgcagtttctagaagcagctcagggaggggaagatcaaatagaattggctgtctcaccaaatgagaaggcagaggttgatttgggagaggccaaggtggctggaatttgcagggcagagcaccagagaggagaaatctgcacaaggaggaagtgtcagagaacaacagaaacagaaagacaaatccacagttatactaaaggtgtcaatattttgaataattgatagaacaaatagacaaaattagtaaatatatggaagactttaacaacactatcaataccctgaattcaaaattatagaatgcttcagcccaaaacagcagaatatacatttttttccagtgcacggaaaacacttaccaagatattctgggtcatataacaattctcgatagggagactttacagcactttatgtctttactagaaaagaagaaaggtctcaaaacaatgatttcaacttcttccttaataagttaggaaaagaaaagcaaattaaacccaaagtaagcagaagaaagaaccatgatcaaagcagaaatcaatgaaacaaaaaatagaacagcaacagaaaaaaatcaatgaaacaaaaagatggatctgaaaagatcaataaaaagaataaatctcttattagagacatcagaacaaaagagaagacatacattaccatagtcaaggatgaaagagagaacatcactacagtcctcacaaacattagaaacatgacgtgagtatattagaaacaactttgcaagaacacatttgacaatgaagatgaaatggacaaatttcttgaaagatataaactaccagccatcatcaagaagaactagatattgcacagcatgctgaatatagttaataactgtgttgtacatttcaaaattgctaagagagtaaatttcaaatattttcaacacaaaaaaatgataagcatttgaggtgatagatatgttaattcgcttgtaataattccacatgatacgttaattcgcttgtaataattccatattgtatccataaaccataacattttgttccccataaatatatacaattgtaaattgtcaatttacaataaaatttaaaaagaagaaatagatatcctaaatagccctatatctactaaagaaattgaatttgtagttaaaaaccttcccacaaagaaaaacaccaggccaagatgattttattggtgaattcgactaaatatttaaggaagaaataataccaactgtacacaaactcttccaaaagatataaaacgtacaataggaagaaacacttcccagtccatttcataaggacagtgttatgctgatgccaaaaccagagaaagacattccaagaaaaaaacaaaaacaaaaaaaactatagaccaatattcctcaggaacattgacgaaaatttcttaataaaattataacaaatccaatagtatacaaaagtccaactgtggcttttattctagaaatggaagatcaacattcaaaaactgatcaatataatctgccatattagactaaaaactaagcaagccataaacagtcatctaaatgaatgaagaaaagcatttggcaaaatttgacactcttttgtgatgaaataggaactttatcatctgacaacatctacaaaatacctacagctaacgttatacggaatggtaaacaactaaatacttccttcccaatatcaagaacacaacaaggacgtctttctcacctctattcaatttcatttctattcaacattgtactagaggttctagccagtgcagtggggggcaaatcaaatgtctatagattagaaaagaacaagtaaaattctctttatttgcagatgacatgaccatctgtggaatcttcaaaaagttattagaactactaaaggattttagcaaggtcacaggacaaaagggccatacatttgataagttatatttctatatgctcacaacaaacaattgaaaattgaattttaagaataccagttaaaatagaatgcaaggctgggtgcaggggctcacatcttcacacctgtaatcccagccctttgggaggccgagtggggcagctcacctgaggtcaggagttcaagaccagcctggccaacatggagaaaccccgtatctactaaaaaaaaacaaaaaaattagccaggtgttgtggtatatgcctgtaagcacagctactcaggaggctgaggcatgagaatagcttgaatctgggaggcggaggttgcagtgagctgagattgtgccactgcactccggcctgggagacagagtgagactctgtcttaaaaacacacaaacaaaaatagaatccaaaaaaagaatacttaggaataaatttaataaaatacgtgtaagatctgtatactaaaactgtaaaactgcgctgagagaagctatagaaggcccaaataaggggacagatcttatttaaacattatttaaagattattttgctatttgaaatagcaaaatctagccagtgcgatggggggaaaaatctcttttgctgtttaaaagtcactattaagaaaatgaaaaacccagccacagactgtaaagaactatttgaaacatatatatctgataaaaaaaatttatccagaatatgtaaagaactcctataatccaataactatcaataggcaaccaatctaaattttaaaatggggaggaaatttcagttgatactttgctaaataagataagtgaaaggtgaaaaaagcatgtgaaagatatttaacatcattggtcgtcagggaaatgcaaattaaaactccaatggggtctgggtgcagtggctcatgcctgtaatcccaacactttgggaggccaaggcgagtagatcacttgaagtcagcacttcgagaccagcctggccaacatggtgaaaccccgtctctactaaaaatacaaaaatcagctgtgcgtggtggcgggtgcctgtaatcccagctactcaggaggctgaggcaggaaaattgcttgaacccggagatggaggctgcagtgagctgagatcgcaccactacactccagtctgggccacagaggcagaccttgcttcaaaaaaaacaaaaacaaaaccccgcacaatggatatcatcacatagccactggaatgtctacagttaaaaaggttaataatgccaaatattggtgccgtaatagagcacctagagccctcatatgctacagaatggcacagccactttggaaaatagtttggcagtgttttagaagttaaacatactcatttttgcttactttctcaagaaaacatgaaattggggttattactccaatgatgagtatttgttcatcattgtttcaccaatatcaatgtatgctttctttccatgcattctgtgtacacagtaacttttgggtataattctgaatcattgtataatctttttgaagacatttaaaatagaggctaaacgtatcaatgaaagtaattcaatttgaatggcaatgataggaataacgccaatacaagtttgcctagcaacagcaatggtacagtaccacaggttgtaaggaacatccagagatgctaaaatgtaaataaatttttgaaatcaatgttttttttttttttttttgagacggagtttcgctctttgttgcccacgctggagtgcaatggcgcgatcttggctcaccacaacctccgcctcccgggttcaagtgattctcctgcctcagcctcccgagtagctgggattacaggcatgcaccaccaggcctggctaattttgtatttttagtagagacagggtttctccacgttggtcaggctggtcgcgaacttccaacctcagctgatccacccacctcagcctcccaaagtgctgggtttacagacgtcagccactgtgcccggacttgaaatcaatttcttatggcaaatactctatatctagtaaacggttgactctttttttggtcttttccgtcttttcagttgatgtggcttttctgctaggcatccattacattactggttttaccaccggctgattttaattccatttcaggcaaggtttctccagatgggtgagttagcaatttaaaagccaatttacaaaaaataacagatgctggagaggttgtggagaaaaggaaatgcttctacactgctagtgggaatgtaaattagtgcagccattacggaaagcagtttggtgatttctcaaagaacttaaacttagacctaccatctgacccaccaatctcattattgggtattatactcaaaggaacgtatatcattctaccataaagacacatgcatgcatatgttcattgcagcactattcacaatagcaaagacatggaatcaacttacatgcccatcagtgttagactggataaagaaaatttggtacacatataccatggaatactatgcagccataaaaaatatgagattatgtcctttgaagaaacatggatggagctggaagccattatcctaagcagactaactcaggaatagaaaatcaaatactgcgtattttcaattataagtgggagctaaatattgagtacacagggatgcaaagaaaggaacaacagacactggggcctacttgagggttgggggtgggagaagggtgaggatcaaaacactacttattgggtactatgcttatcacctggtgatgaaataatctgtacgacaaacccctgtatatctaacagacctgcacatgtatccctgaacctaaaagtttttttaaaagctgactttataaaaaaaggcaaaacaaattatcaaatgctgtagacataagataagcagatatattaacatgttttaggaaaacattttgaatgtttatacgattctattgattgtttattgcacttaacatttttgtattatgagataactttcacagaatatggttctattaagatgaaattttacttattatataggtgattgggagcactggaataagaaacttcagccttattattatccaactgacagtattccggaatattcatcaattttggttccaaatgttgacaatattagaacaaattttttgatagacaccattgcaaaacaacataaagtaagtttaatagatagttccttaaatgatcacaaaccatccatggccacgggaatatgcacccatattttcttccagcacttttatagtacacattttacatttaaatctgtaatacaactgggacttattttgatggtagatgcaattctaaaaagttattaaaaattagttgtattaatttatagaagactagcccatagaatcataagatatttgaaactaaataagttgtaacacatttcaacactattatcctatgattgcaggctgttttgctcacaggagagcagggaactgcaaaaactgtcatggttaaggcctatttgaaaaaatatgatcctgaagtacagctatccaaaagtctaaacttttcatctgccacagaaccaatgatgtttcaggtgaaatccatcatttgctgtaatattataaacataatacattttaaattagtggttacaataaaatgtgtacgcatataaaatgtgaaaatattatatattcaaaagaaatcatgctgcacttggcattcagctgtttagctttcctaaggctaaggttgaaggcaaatccaaatagcatactttgacctaatattgagactgcagctgaactttggagcatatctactgtaatgtaaatgaaggataaaactccaatgccttatttttaaaaatttaacaacatatattttaataattatatgtatacttattaaatgcgtaagtaaattatattctactctgacaagaatgctcattatttttagaagtatggattaaaatctaatgcataagacaaaacgtttccttctctctagagaacaattgaaagctacgtggataagcgaattggaagcacatatgggccaccaggagggagaaaaatgactgtatttattgatgatattaatatgcctgtgattaatgagtggggagatcaggtatggctgaaatatctcatatagatgatcctgaatttgtatttttatgtatatatattatatatatgtaaatgttaataactttgttaaaaactttatgtttttaagtctactgccaatcctcagtctttttctgacttctctgttatagctgagtttctcctttcttaaatccctatgtgtttttttgtttttgtttttttattaaactttaagttttagggtacatgtgcacaacatgcaggtttgttacatatgtatacatgtgccatgttggtgtgctgcacccattaactcgtcatttaacattttgagacggagtcttgctctctcacccaagctcgagtgcagtggcatgatctcagctcactgcaagctccacctcccgggctcaagcaattctcccttcctcagccacctgagtagctgggataacatgtgcccgccaccacgcctggctaatttttgtatttttagtagagacacggtttcaccatgttggccaggctggtcttgaactcctgacttcagatgatccgcccacctcggcctcccaaagtgctgggattacaggcatgagccatcacacctgtctcctacgtggttttctacagcaaatgcctcctctctctttggctacttgacttcagtgtcctttcttagctcctctcttctgcctttctgcagggttacatccttgctctaacctcttattgtgcataatttctgaggagtacgtgatgttcaaaaaaacaaaaacaaaaaatgaaaaaccaaacaactatttatttatttatttaactgtgccacacaccgtggttctagttgtggtcatctatccacccaggtcattccccattagaagacttcaccggtgttgccagaagtccgcatgctcctggtgggatccccaacactttcctcccaccgacctacactgcttcattgacaccatctactttggctctaccaggacaagtcccattttgctctttatccctattcgcctcagacaccactagaagctcagtactcatcctgtggcgaaaaaccaaacagttctgtatggcctgcgtctgctccaaggcagatagacctcagcagttcctggaaggagaggagggtgaaggcatgtttagatcaggttcatgcttatcttccataagctgaagcgctcctgaattccgaactcacgtatccaactagggatgtctggttggatcgcaaacttaacacctccaacacctgctcctccaacagtcttctctctctcagcaaatagcacctccacagtcactctgtcagaaaatcaagttggctctatcttcacactgtatctgaaatttgaccactactcatcacctccactgctaccacctggcgccacccaccaccagctctcttcttgatcattacaaatgcctcctcactgcctcctgtctcccttacccttctcagcttgttctcacatcatcaacaaatgaaaacaagagttagatcacgacacactcttctggtcaacatcctccaaagagacttgtagaatataaataccaaaatccttaccatgatccaagactctacacattttgaccgcctctccctcttcccgtgactctttgcttccaccacatttactgatctttgtatacgctggatatggtgttcactcagtacctctgcatttgcagtttcctctgcctagagtgctcttcccctaggtatcgaactggcttactttctcaccttcttcaggtcttggcttatatatcatgtcaggtgaagcctcccctgctctccttgagtcacacccttgagcccctcctatattctacaaaagtcttagagtataccattttatttacatatcaacatgcatctgtacatcttgtctctcaccactagaatgtgtgcttcatgaggacagaaaattttgtctatgctacaagagaggctggcacacagtagtcattcatgaaatgttggttaattgaaagacggttatatttgaggtgcttgtgtgatatgcactaagagatgctcaatagagacttgaatatacaggtgtagagcttagaagagaatttgaagctagagttatagatatgagattctttagaatatagggttgagatagcatttcctggaacaatgagaagaggaaagagcccaggatggaaccctggagaacagttacatgtgagggatgagtggacaatgagtggcttaggaagtgatcccagagccctgagatggacctggaaaaaaaacaagcctctgaaaccaagagaggtaacatttccaaggaggggggttggcagtgttggaggatgcagagaagataagatgagaacataaaaccaacaaccaaaacagttagtaatataatattgaaaactcaggacagaaaccatcctacattctgatctaaaggtttttaagtgttgaatattgagtatgaaagatgtctacagtaaaacttgttgtaacttggagtattaatgtaatttaaccaaatatcttataactcacatatctaaatttatttggaaattagtttgatcaatgtggtgaaaggcaccttggacttggaccatgcatgtgttatgatctagagttcatgggtgacatcatttaagtcaaattaccttgaaggtgatcatcgacattcacaaacacttcattgataagagtttaatgttttcttctaatctcatttgtactattttattgaagttatggaggaatatgatagtgatatgttacaaaaatattgctgtgtgaaatttcagataactaatgagattgtgcgacagatgatggaaatggaaggaatgtacagcttggacaagcctggagacttcactactattgttgatgtgcagctcatagcagcaatgatccaccctggaggtggtcgaaatgatattccacaacgtttaaaaagacaatttactgtgtttaattgtacattgccttcaaatgcttcaatagacaaaatttttggtatgaatattcttagcgtttattttattgcattacataatggacataaaccacacaaaatttcatttaagagacaaaaaggctctgtctaaagtggggttaggtatgtgaaatggagagctaaacactaggaaagagggactaaatactaaggtgacctatgcttatagcctattctcagactcagagatatttaaaaataggcttgttgaaagttaacattagacgtaaaggaaccttggtgttttggttttcaggacatggttaatcagagaaatttgggccaataaatgatagcacaaagatcacagattaacgatatattatacaaagtcaaatgtagcacttcaatatgttaatgaaaatgagattcttgacatcaaatgtaacatcgaatcacataaattatgccatcaaaacttatgtgtaggtcagcccatgcctataatcttagcactttggaagaccaaggtgagagaattgctggaggccaggagatcaagagcagcctgggctcatagagagaccccatttctacaaaaaatttaaaacattagctgggcatggtggcacacgtctgtagtcctagctgcgtggaaggctgaggccagaggattgcttgagcctaggaggtcaaggctgcagtgagctatgatcacattgctgcattcgagcctgggtaacagagtaagaacctgtctaaaaaaccaaaaaacaaacccccaatccaccccaaaacctcttacatacacgagaaacagacccttgcatataagaacattaattatttgatatagcaagtactgtagtcagaagggaaagggcagacttttttttttttttttttttgagatggagtgtcactcttgtcacccaggctggagtgcagtggcgcgatctcagctcactgcaaccgctgactcctgggttcaagcgattctcctgcctcagcctcccaattagctgggattacaggcgcctgccaccacacccggctaatttttttgtatttttagtagagacggggtttcaccacattgacagggttggtctcgaactcctgacctcaggtgatctgcctgcctcgggctcccaaagtgctgggattacaggcatgagccaccgtgcccatccgggaaagggcagacttttaataagtagttctgggatacttagtaattcttataggaaaataattaaatttggacagctacctcatgccaatgacatgatcaactacagatgagataaggacctaaatatggaaggcaaggctgtaaaacatttggaagaaaatgtagagaaatagttgagtgacctctgagtaggaaaggatttcataaatgagactcagaaagcacaaaaataaagaaaaaaaataccaatttgactagattgaaatgtaaaatttctcttcattaaaaaataacattaagagagtgaaaagcctcaaagtggaagaaaaaattttaacacatataataacaacaaaaatgtcatattctgaatatttagagaaatcctataaatcagtcagtcaagaaaaggaaacaacctgatataaaaatgggcaaacaactaaggcactttaaaaagaggaagctaaatagccaataaacaaagtaaagatggtaaacatcatcagtattctggaaaatacaaatgagaaacaccaagcgataccatttcatacccactagatttgcaaaaataaaaaattctgacaaaaatcaagcattagtgagaatgtgaagcaactgagactctcattgcctgctggccgtagtgtcagttgctacaaaccctttggataacaattttgcatccctgctggtaaagtagggcgtgtgcccatccctagcagtaccacttctaggtttatgccaaattgtcatttttttcctttatggtttgggttttctgagtctcaagaagtccttttctatccggacatcatacaagtattcttttatgttttcttccagacattgtatagttttgccttccatatctggggcctcaatccatctgtagttgattttgcacatgcatgccagcagacttatacaaaaatgctcatagtgcagcgtacacaatggcaaaaacgtgaaataatccagatatttatcactagtaaaactggataaatacatcctgtcacaggcacacagtggcctgctgtgcagcagtgaaaatgaatgaatatagctacatgctttcaccatggatgaagcccagaaatacaatgctgaattgaaagaagcaaatcacaggaaaaatataattccattaaactgaatttcaaaaattttttttttttaccagttcagaagttcaaaaacctaagtggtgaagctataaagaaaagcaagttactgattatattaaagagaggtggcgacctctggagaagggaggaattgtgaacaaggatgaacgtacaagggcttctaatgtgctgggcaaggttgtagttttcaatctggtggtctgtacatgagcgtttgttatttgttaagctatttgacatactcttcagtatgactgacacatttaaacaaatacggaaaacaaaccaaccagaaactgagcctcagagaagtgagataactgcccaatcaaggccttttagctagtgcttggcagatgggtgttgctaatccctatctcatgcttcttataacatggttgtcccacaggaaggtggaaatctagaatataggatttcaggaagcaaacggactttacaggcacttagcacaaccaaccatgatttggaggaaaatttcatgtttccccagggcaattcttcaattagtgtgaacaaactccagtttctttagtctccactcttcatcaacctgttctgcatctctgagcagatattcatattcctctgagaataccatgctcagaactgaacacactctgcagtgtgtagtctcactggagtgaagcagagtaaatctttcttcggtctaaatcaaagacattctgagactttgagaacagtctctaaacctacaccccagtctttctgagagtcataatgatggtcagaccatcactttgctgggtgttccctaggaatgttgcatgtctagcccaggccagagtggtgactgactgtaggctggaaaaagtggtcctgattccagttctgccaataccagtccatgtgaccttgaacaatcggcttcacctgtctgggcctggtctccttctctgtaagatgagggagtactctctaagctcacatatgcttcagggtgaatgctgatgtacagactctagggccaggttgcttgggttcacatctcagatttgtctgcatgcaagctgtgtaactttgagcaagttactaagctcatgttaaaatgggactagtaataataatacctaccttgtatttttttcttgtagggtgctgggtgggggattaaatgagtcaatacatataaaacacttatcactgcgtactaagcttggctggatccactactgactcccagtcttagctgatcccttgagagaaattctgaacaacacccagcttagtcagccttgtaatgatttgtttactgggataaacatatacttggaaatcttttggtaagcttataccttcaatcttgcttatctttcaggaattattggatgtggatactttgatccttgtagaagtttcaagcctcaaatatgtgagatgattgtgaatttagtctcagtgggtagagtgctgtggcaatggactaaggtacagaatggtttgtcaataatttttaaaaaggcaactattattcagccctagatcacacctcgtggctcattaagttatcataatatcatatatagtggtgttttttggaaaagacaaattacgtgctcaaatagatttacaacaccttttccttccagggagcaaatgatctgactaaatgatgctttccgtatgtatgagatgttactgtaaaccagacatgacatccaagacaaagtagaattttgctgaaatgagaacactgcatttccacttgttactctgatttgtaaatctttatttgtattatctgtctccttctaccaaactatgtcagacactcagatgcttattgactgacttaatacatggatttccagatattctcagccaactaggacttgaagtctaacttgtgtatttctctgagcaggagcgtgagttagtaaatggatggaaatgttcttaacaaaaattggctagatttgcatacacaagtcagtgtcctaagtaaagctcagcaaacctgcagctgtccccagatgacttagggcagtactcatgaaaaggcaattaagtgtaggtatgagataaaaatgaggttgatatatttgacaaaaagccatgaaggagataaggattagttgtcgtaattcactacacatccattaggccaattatacacatgtgggcacgcacttgtctcctgggaaacctgagtgtgccagcctttcagattcctgggtagactgggggatttctagatacacaattattggaagaggaatttgggggtttcttatgagatgctcttccatgtggccaccttcagtgatgagtgtggggccctgttccttgccaacacagggcctttgcacatgccattgcacctcttttaaagaaactcagaaatgagttgcaaggactgagcgtctgagatagttttccgtggtaagatacatgtggtttccaataggattattgctcaatttactgtgcttatatacatagttctctgaaaagctttgcccttgcagctgtcttccatcagtttcttttggtatttggatgtttcctggctccatttcctcagtgtcttttctttacctctttaatccattctgcacaagctttcattcccactgttcatgtcaaggccaccaaagaccttgatcttgccacatctcaaggttaattttcctctccctcttacttgactttttagcagcatttgacctaaatgatcctttagcagcatttgacctaaatgatccctctaaatattttcttcacttggcttcagagggtccccatagtcttgattttcttcctagtgcactggctacctcattaaagtcccccttcttctttccctcctctaaacactgaaatgcacctggtctcgatgccaggccctcttctctatctacattctttccctaggtggcctcatcaagcttcaaggctctaaacatcatccctgtgctgatgacttcaaaatggatatctccatcccaggcctctctacctggctccaggccgattgctaactacttaatagacatcagtgtttgatgtctgatactcatctcaaagttaccatgtccaaacagaactcctaaatgtctttaaatacaatcctctctcagacttctgcatcttagtagcagcaccagttatcctgcttcttaggttaaaattactgggcaccatccttgatttatgtcttcctcatggcctacatcgagtccatcagtgaatctcagtgacctccccttcaaaatctaccccaaagctgaaccttcctcaccatccccccgtgaccaccctgataagtggtccgatcacctgtcccctggaccatgcagtaacttcctaaccaatctccttgctttcttcttgctctcttggagtctgttcttttcacagtcctagatgatattttttaaaaagtaaagcagaaatctttactccttcttaaaaccaccagtagactcccagttccacttacaatgtcagcagactccgcttacttcccttgcctgccatcaacctgctccagccgatggccctgctcaccattccttgagtaccccaggtttattgcgttgctgggccaccatacgttggctcattctcatcactcttaccttcagagcgactgttccaatcatcctctaaagtgactgcacttgtccctatcctagtcattatctgtctcctggccctggttttttttaaaccatggcttctatcattatttgcatatttacatatatatttgttccctgttcattctcaggctctccccactggaataaaagcccgcttgatggcagcagagttagctgtcctctgtttaccactgtgtcttcttaagaaccaaggaggtgctcagtcattgaaaaatgaatgaatcttcctcctctgcccacctctacataagcagccttctttgtatcttttcttcaaatctcccatcttcacaaagcactcttttgatccattcatgccttgtctatcagcccacctttgtattactttatatagctttaaggcagaagcagttcagaaaagaaagaaggtgatgaaaagtagagggaaatattagaagagaaggaaagaagcaggttaacaaataatgagaagaagaaggaaagaaaggaatttttttttacagaattctctttaatgactgcctcagttaccaatggctgccgtcatggctggagtgttatactataaaaaaagcaatattcacataaccttaccgctttgagtatttttacatacttgtaatataactatatgttttacattttagtgggtaggatgaacattttagtttgcaatggaactgagcaaagagggaagttgataggtgattgataaaatacacttcttttattttcatctccccatgctacttgctgttttaaatagcactgtgaattagcctgtaaaaattacaaactcaatagggtaatttttcagtatagaaagggcttaatttatgaacagatgctaaagaaagcatctgctttgctgaaataggcgtatggggtgtttgtatcaccagaattatcattattttcactttcaaaaatgatgctaatgatatcaattatgatctttatacatgaccatcaatgctttccatatctagagtacctcgaggttatctcttaacgggtatctctctgggtaagaatgtggtattgttacagctttgcctttttatatcctagaagttggtagaaatagtaaattagcatataatacagtctttgtgctcaaacagaaaaaacatctattactatacgtatagctgcatgtcagacttgcctgtccacttattatggatatacagatacatgaaagactgttgactgagtttggatccacacagtaaaatccaggttatgatatgcagatatatttatggaaatcctaacacattaaggaccctaatcaaagcaatttatagaagatagccattattaactttaaaggtgaacattcgttgttcttacctgcatgacaaccaactcacgttcagtttttgttatgacatatttccacatatactaccaataattagggatgattattcccacagttcatatagtccttaagaattcaggggaggtgacttgttcaaagccaactgatggtagtagaacaaggtgttggaatctgcatccagtgccttggtcttgaatccatcctatccaagagattatggtcttttaaatcctaagttggtttatttatgatttttttctgtccgtgttgtcacaaaatgtgaacttaatcttgatttatttactcagcagattttatctaaaataggatttgtgagacagttgtaaaagtaattctacttttagttgtatctgaaaactaactgagagtattacattttttcatctctaggtgaagatgctgccaactccttctaaatttcattacatcttcaatcttcgagatctttccagaatttggcaaggaatgttgaccataaaagctgaggagtgcgcttcaatccctactctcctgtcccttttcaaacacgagtgcagcagagtaattgcagacaggtgcgtgttgcggcactagagtttaaatgtatgacctgagaagtttatactacttggttaattttttttatttttatttttgagatggagttttgctcttgttgcccaggctggagtgcaatggtgcgatctcagctgaccacaacctctgcctcccgggttcaagtgattctccaacttcagcctcccccgtagctgggatcacaggcatgcaccaccatggccggctattttgttgttgttgttgtatttttagtagagatggggtttctccatgttgatcaggctggtcttgaactcctgacctcaggagatcctcctgtctcagtctcccaaagtgctgggattacaggcatgagccaccctgcccagccggttacttcttgcattacctactaggataagtagagtaaggagcattgtcatcatttgctgtggggcttgtgaagcattgatggcatctctcacctgcccactgtcttaaaaaaatgctctgccgatttattccagtatgacttcaacaatacatctttataaatcaccagatcatcagaggtgataacattcggaggcacattttcattgtatatattttctacaaattttgtgagctctttgtaggttttctgtggggaaatctggtttcatccctttaaagttaaacaatcccattaaagttaaattcagtcatcttttggagcctccattccctcatctataaatcatagatgataatgccagtttcacaaagttgtaaagtgtctaccatgtctcacacaagggtgatacttgtcaaatgttactcccctttgtcctctcttccctctgttatattgtcaatctgaaaaggtcctttgtgtactgaatccaccaacccagaaagaggacgctcgtccactaccgaccatcacttctgctctcctatcgcaagttttagggacctttgatctcacctaagtgattcatctgtgttttctataagtagtgctgttaatgttataactttcttggatggggttatgcccttcttatcaaaaggcagaacatattgtttccctgtcctgaattgagaaggtccagggtggggctgagaagaggcgaagggacatgttcagttagaaaagatgctttcatatttaacattcttactactacattttcctttcagatttataactcctgaagatgagcagtggtttaatgcacatcttactcgtgcagttgaagaaaatattggctctgatgcagcgtcgtgtattcttcctgaaccatactttgtggattttcttcgtgagatgccagaaccaactggtgatgaacctgaagactctgtgtttgaagtacccaaaatatatgaattggtatttattttcatctcttaaaagaggttttcagattgctcacctgactagatctttctctctgcaccagagtcctaccatggagttgctataattccagcactttgggaggctgaggtgggaggattgcttgagcctgggagtttgagaccagcctgagcaacataatgagaccctgtctctataaaaaataagaaaaattagtcgggtgtggtggcatgctgctgtactcccaattactcagcaggtggaggtgggaggattacttgagcccaggagtttgagactgcagtgagctgtgattgtgtcactgcactctagcctgggtgacagaatgagaccctgtctcaaaaaaacaaacaaacaaacaaacaaacaaacaaaaaaacaaaaaagagagagagagagttcagtaagatgaccaagcattatataaatgtgaaataactatcctctatacctataccaagggttggcaaattatagtttctgggccagatccagccagcccactgcctgtttttattagacttactagctaagaaggatatttatttgtttatttatttatttattttgagatggagtctctctctgtcaccccaggctggagcacagtggcacgatctcggctcactgcaacctccgcctcccagttcaagcaattctcctgcctcagcctcccgagtagctgggattacaggtgccccccaccatgcctggctaattttttgtatttttagtagagacgaggtttcaccgtgttggtcctgtgattacaggtgctcgctaccatgcctggctaattttttgtatttttagtagagatgaggttttatcatgttggtcaggctggttttgaacttctgacctcaagtgatccacccatctcggcctcccaaattctggagtgacaggcgtgagccaccatgcccggctgatttttcatttttaaatagttaccaaaaaataaaaataagcaaaagaataatattgtgtgacatgtaaaaataatatagaattcaaatttcattgttcataaataaggttttattgaaacacccattggtttaaatattggccatagctgcttttgcactacaatggcaggggtgagtagagactgaatgggccttaaagcctgaaatatttactatcttgccctttacagaaaaaatttaccaacacttgccaacaatcacaagacagaaaatataacataaaagtatttcatttaacagcaacaacaatattaacatgtaggaattaacatgataaaactttacttaaacagcaacatgtcattctttctaaattaatatataggtttaatgaaatttgaaacaagatttcaaagggacttttaaaaacagggttatataacaaagtaattctaaagttatatagagccgggcgaggtggtttatgcctgtaatacccgcgacttgggggagttgaggtaggaggagccatagagccaaggaagtcgaggctgcagtgagctatgattggaccactgcactccagtccgggtgacagagtaccttgactctaaaaaataaaaataaaaataaagtgtatgcagatcaaagaattagatggggaggaacaatttgcaaaacaaagaaagtgggtgtggatttatttcagaacaacaaagacttgtggatttaactccataaataatgtaaaacctttttatatttttgaaagctgcaaacaatattaaaaagtaagtaaaaaccaagaaaaatatttcctatattaatgtgttaattactatggataggagttggtagggaaaggtcagaaatgattttgcactagaaaccaactaatacagttaagtttcaggccttagaaaatggaaataactaaaagtagactaatacgtgagaaacctctggaaatccataacgtttaaaaaaagatatgtatattttaaaattacttttgagtgtctttacaattgctactttaatacatacttggatcttaaatattatttttttatctttctctccacccatagatgccatcctttgactttctggctgaaaaactccagttttaccagagacagttcaatgaaatcattagaggaacatctcttgatctggtgttttttaaagatgcaatgactcatcttattaaggtcctaactattgcctatttactgatataaatagatgatttaaaagcttcgtatatttcatagataaattttttgagagaataactatatactatcaggtaccgtatagaagactgtacataggttgggtcaattcactgtcccagaaaataaaggcttaataggaaaccctttatttgaatccatctacatggcagcaaatgtctttcaagggcaaatagatggttttctgttcagagcttttggcacactgagtcaacaagaaagtatggagaacctttagaaagtatggagaaccctgtgaaaaaatatacttccctcaaattatattttgatattatgggaattctgttgcccatggaggaaaagatgttgcttttaaaagtgtcaatgttatgattgacttacaggtgatgggacaggggtaaggttgatatataggactggtgagagaatagaagccagttagaggtaacacgaaaaaggggtgttttcacactaatctattcaacaagtaattattgaccattcaccgtggctagatcttgaggttctgagatcctattctgagtgcaaagccataagtgattaatatattttaaaatatactgatagaatttacacataccagggtgtcattattgatccaccatctgcaaaacttgtatttttttaaaaattatttttagtggtgatagtgaatttactgatccatctagactttctccctaattggtgacaataatataaaagacagctttttagcaatgtcttcaattggcctgcatgagatttgacccacaatttgagtcttatcttcactgaggaaatcaaccatagaaaagcaacacaacatgaaaggctgtctctccaagttggcttctagaaacatcctcctaccccactgtaaatagaattatggtacttaaaaaaatttgttggcagagatatgatagagttagtgttcattgttgagttaggtgtctacatgattcagtgtgtcaggctgatgaataataaaaaaacaattgtaaacatttcttatatcttctgcagattgggaagagcagctccactatccattgggtctaaaaataataaaattctacatgcgtgcacacgcatgaacacacacacagaatagttttaaaatagaagggagtaaatccagtttgttctgttcttcatgatgtaaacatagatggtcaaggaaagattcgagctgaacaaatcagtattaaactttaattttaaaaattctgtcatagaccattaacgaggaaaaagtctaatatcatctagaaacatatgatcaaaacttgggctcatttagtgcaagaaaatgtaaacattgcattcttttttcaaataagcacgttttaaatctcaaaacagatttcacgaataattcgaacgtcgtgtggaaatgcattgctggtgggtgttggtggttccggaaaacaaagtctttcaagattggcctcttttattgctggctatcaaatattccagataacattaaccaggtaggatgaaataaaacacaatatgtttttctatagttaatttctctatagttaaatgtttagaaaaaaaggaagcacaacagtttcctgtatttctttttaaggtaaactttaagtattatatatataaggatatttacgcaagtgtcacaaagtaaatacatctatgtagccagtctacagatgaagaaataaaacacttcttgtatcccagaagtgcctccatgttacgttgcagtcattaccctcccaagggtaaccatattcaaagggtaagcccattgattagttttgcccagttttgaattttgtatcaattgaactatacaggatttgctctttgcatcctatttctattactgcattgtttgtgagattcatccatgatgctacatgtagcaagaattgttcattctttttgctgcatgatcttcaacttaatcagatactaccacagtctatttatccattgtactcttgataaacatttggtttggggcaaatagagctactgtaaatattcttgtacatgtctgagtacacatctagagttaaaattgctggatgtaggttatctgtatatttagctttagttgatctgcttagtagttttccatgtggttgtaccaatttacacttccaccaacatgtcatgagagttgctccgcatccttgctcccacttggcattgtgtgtctttttcattttagcaaatctttttttttttttgaaatgtagtcttgctctgtcgcccaggctggagtgcaatggcatgatctctgctcactgcaaactccacctcccaggttcaagcgattctcttgcctcagctcacgagtagctgggatcacaggagtgtgccaccatgcccagccaatttttgtatttttagtagagacggggtttcaccatgttggccaggcttctcttgaactcctgacctcaagtgatcaacccgcgtcggcctcccaaaattataggcgtgagccaccgcgcctggccgattttagcaattctgtgtgtggagtggtagctcactgtgtttcagtttgcgtttcccagatggctaatgatgttgagcacctttttatctctcattggccatttggataggctcttttgtgaattataaaagccctttctccatttttttttcaatttgtttgcgattctttcttattgattgttaggaattctatatgtgttttggatataaagggtgtatattgcaaatacctttgctcagttattgatttgccttttcattctcttagcggatcttaattttaatgaaacattcatttttttctatttagtccttttttgtattatattttaaaatctttgtttaccctaagggcacatagatattttcctatgattttcttcacatttacacataaaatttactactttctcatttagtactataactgacctagaattcattttcttataatgtctgacataggagttgtgattattattttcaatattgatatccagttgatccagctccatttattaaaaaagtcatcttttccctgccacatcacagtgccattttttgtcttaagtcatctgatcatatatgtgactatatagtctcctccactggtttccttatctatctttgtatcattacctactatattaattgctgtagcttctttagtatatatatttaaatttaacatatgtatatttggtagtgtcagatctctaactttgttgttcttcaaaacgtcttgtccatttggccttttatttccgtataaaatttagatcactttgccaatttataaacaaacacacaaatcattctgctgccaaacaaaagaaaaataaaaattgaacaaaatacaatttatagaagtattttaaaaacataaaatatcaaataagtaggtattaatttaattttacttcaaaaaattaaattagttgtcagcatttaaaaatcgggaggtttcatgttttagaaaagcgtatttctgactttttgaaataattggaagatctggcaacctagggcctacactcccaggtggcagagctcagtagcagctgcctccttggatgggacatgcaatcctccaatccacaggccccaacagcactgcttcactcactggcattatctgtctgattcctgtaggcatctaaatttgggatcctgagataggtggtgttgcactgattgtagttaggaatgacggaggcttaaattaaggcaaatttattcactatattttcttaatttctgtattcttgataccctggcatctgagactctgctgactggggagagactgacccttctaggttagccaattcttagagattcaaacagctcctccaggagagtacctttcatatgcaaaccaaccaatccagagtccttactcccaaccaccacctctatctggtgggtgtgtggtggcatctcatggtggattagaatattcctctgccctaatcaccccagggccacataccagtcaacaagggaccactcctatgccccagaggctgctgaaattattcaaactagcaaatcctaattctgcttacctgccttgcctttctcatggaaaccacaataaagactcttgcccgtgttttcccatcactccttttgcctcctgattgactctggtgtttccccatgtcaccctacctagcatgtcaagcccccttctgtttctggggatccttgagtataaacatcttgcttcatgacagtcgttcctgtgtcattgtgtcttaccacacttgattacaacaaattctggatacattttataacagcagatgaagtgggaatagagaggaagactcagcagggacagtttaaagtatgcaggattgataggacttagtaactgacccaatattcaggaagaggaggaaagaacaggaaggctaggatgacactctaatttctctagtggtacagttgtgtgccccataaggacattttggtcaacaacagacaacatatatgatggtggtcacatgagattataatggagctgccctatacacgagtagcattttaaaaatcttttatactgtatttttactgtaccttttctatggttaggtagatacacaaatatggaccattgcattagaattgcctatggtattcattcagtgcagtaacatgttgttcaggtttgtagcttaggagcaataggccattccatatagcctaggtatgtgtaggcatactctacgctgttctgtattagtcagtttttgcattgctatgaatacctgaggctgtgtaatttatttaaaaacaggtttgttttggctcaaggttctgcaggctgtacaggaagtgtgatgctggcacctgcttctggtgagggtctcaggaagctttcaatcatggcaggaggcaaaggggcagcaggtggtcatattgtgagagctggagtgagagagtgagggtgcaggtcccagactcctttaaacaaccagatcttatatgaactcagagttagaactcactcattaccaaggggatagtgctaagccattcatgagggatctgcctccatgacccagacacctcccaccaagccccgcctccaacattggtggttacatttcaacacgagatttggaggggacaaacatccaaactatattatgctcccacagttacaatgttttctttttctttctttcttccttttttttttttttttttgagaaggagtctcactctgtcacacaggctggagtgcagtggtgcaatctctgctcactgcaacctccacctcccgggttcaagcagttatctgcctcagcctcccgagtagctgggattacaggcgagcaccaccacgcctggctcatttttgtatttttagtagaggcagggtttcaccatgctggccaggctggtcttgaactcctgaccttgtgatccacctgcctcagcctcccaaagtgctgggattacaagcatgagccaccgcgcccagccacagtgacaatattttctaaggatgcatttatcaaaatgtaaccccattgttaagcaatgcatgactgtacttaccacactgcattaaaaaaaagtgcttgttcacatacatttctatctccttcactaagctgtaagctccctgagaatgggccactgtaatctttgtcttttttacttttattattaaatgcttacttttaaccaattctgtaaaaggatgtgttgaataaataaaaaaatgaccagctttgaagggtaaagtgagaatttagttcagtacatttgagtctgaggtgtctgcagaacacagtgtccatagataataagactcatggatgtggagttcaggagaggggttctggttctggagatagcaatatagaagtctcagtagagaggaaccttttgtggtcatggggagtacgaatagggtgcgtcatggaaagaaaagatggctgtggaaagaattctggggtctcccaacatagagaaagggggcttgcgatggagagtgagaagaagaggcaagacagagaggaggaaatccagagtggtttccagaaactaagcaggtagataattaatctgaaaatgctggccgggcgccctggctcacgcctgtaatcccagcactttgggaggccgaggtgggcggatcacctgaggtgaggagttcgagactggctggccaacatggtgaaaccccatctgtactaaaaatacaaaaaaattagctgggcatagtgacaggcgcctgtaatcccagctactcaagaggctgaggcaggagaatcgcttgtaccctgatggtggaggttgcagtgagccgagatcatgccattgcactccagcctgggcaagaagagtgaaactccgtctcaaaaaaaaaaaaaaaaaaaagaaagaatctgaaaatgttaagacatgaaaagtggcaactgatatgcatgacgacactttcagtgaagtggatgggtgcacaagccacattgcattaggaagagaagaagcacagagaatacttttggaaaacttgaaagaaagaaacaagagaggtcaggatctggacaaggggtgtgttgtgactgtctctatgtattgcaaaagcaatacatcacagtcagtctaattctttaaaaaatcagccaaattgacctctttggctgattagttcagagactggccagtcagtgagaggattactctgacagcatcaggccactagatctttctggttccagtgctcatagtctttctgtgagaccccatggcctactgcccattacttgcattgtaacacctccttccagtgaggattaccttttagtccttgtcattagcttacccatgaggatttacatacaacatttcagataatgtctgctttatttttacacatctcatcacctctggtagcacatacatttaaccggaaacagagtgaaccaaaaaacaaagaccaagatcttttcattccataatttgtagccatctaacatttctattatttataccttattgcacaatgcatctttttctgtgggttttctttgtatctagccacttaatgagctgtgcaaattgccactatatacaatttatgactaattttattcataacgtattttgaatttttcaccaaatcaaactcatccaaatttcagatgagttttagatattatatatatatttactcggacaaaatctgttgctgaggactgtcagattgcagggactaaaagttcatttctctattcccacttatgctttgtggatcacttttggtaagttccctgtttctcagttctcagcttaaacgaaatatttgttttgaatggtaacatatcactctttagctctaatctctgtgttttctagcaggcaccattacttagtatctattggagcaggtacagattatgctctaataatcacaggctattattatgttttgggataaattatgactatggttttttttgttgttgttgtttgtttgtttatttgttttaagaaggagtctcactctgtcgcccaggctggagtgcagtggcatgatctcggctcactgcaacctctgcctcccgggttcaagcgattctcctgcctcagcctcccaagtagctgggattataggcacacaccacacacttggcttttttttttgtatttttttagtagagatggggtttcaccatgttggtcaggatggtctcgatctcctgacctcgtgatccacccgccttggcctcccaaagtgctgggattacaggtgtgagccaccgcgcccagccgactatatattttttaatctaaaactttctatcatttttcttcttaggtcttacaatgtgactaatctaacagatgatttaaaagctttgtacaaagttgctggtgctgatggaaaaggcatcactttcatctttactgacagtgaaataaaagatgaggcatttctagaataccttaacaacttgctatcttcaggggaggtaagtctcaaaagtagagaaaaagcccatattgtaaaaatataaattatattggaatagaaaaagcagcaacctttcaaaaatgaggctatttagtacattttttattttagacatggttaatgtacgagatttagcagattttctgaagttcctgtgaaatgaatgctgcccatctccagatgctttgtttaattttgaacatggttccttacttgtctcttcagtcttcactttggtcttataatttattttaggagaagcaaagtatctgtccatctatctgcatactagtgaggagtatagaatggttgaaagagttctgttagttgtaaatggatgtctgtactgccacttctgaaaccgcttgtatcagcacttccgtgagcactcacatctttagtacttcatcagaaagactcaccagactcagcatatacaggtcgagcttctcaaatccaaaactctggaatccaaaatgctccaaaatctgaaactttttgagcacggacatgatgctcaaaggacatgctcattattggagcattttagatttcagattttttgatttgggggtgctcaaccagtaagtgaaatgcaaacattccaaaatctgaaaaaaatctgaaatctgaaacattgtggtcccaagcattttgaataagggatgttcaacttatagttatactcatggctgagatttattgtggcaacacagtaaggatacagagccagatcagtagagaaaaagactcatcttgtggagtcatcgatgttccaggaacatggaattgatgttccagcttcctatgcttttgccaaggggccatgcagaacgtcctctccatccagtatgaagggcagtaacatatgcactgtttccattcagggaagcccacttgagattcagagtccagtggtttttttttaggtttggtcacttcctgcctagctacaactaccaaagttccagattcctagaaggaaagcagatagatgtttgccatgtatcacaaggtttgtgtaaacagtctagttggcactgcaaaacaaccttatcaattactaatggaggagacattccaaaagccaagttccctgataacagacaagggtcagctctgcaagcatacccttttcaagattaggcctgctgtgttaactcttccctacaccatggtatacagatgcttaatggtgcaaaaattagttaagtattttggagccagagttgattagactgactctgagtcaaagtacagagggcacccctggacattttaaagagatgattgagtggtggtggagatagctttttggtgatagctattggagcacaggaaaacacaattagttcttgattgagctgctcaataaaaagttgcagtcttgatcatctctggcaaatcagggatttgactgtggagatgctgaaagaaaatatgaaacaagatgacatgcaaattaaaaaagggactggactttggcagtgaattgactgtggagaactcttaaaacacagaacacttccttgtccattccttaaagatctccaacttgtttgcacgagatgagatggatgaaatcacccaaggtctgatttcagtgatgaagagggagctacctcgccatcctcctacctttgataatttgtatgaatacttcatttcaagatcaaggaagaacttacatgttgttctctgcttttctccagtaagtttttatttttatttatatctacgtagaaagagttccttatttaaaggtgcttagtttgccttctctgattagaaaatgatcttagaaattaatatttttacattgaattaaaattaacacttttgtaccacacaatctccattgaccaaattctcatttccagtgtaatttaaaatattcatattattaaaaaatactgcataacctgcaattttcattaattacctagagacatgggttgtttgaattgtaagggacttggtgatgtaacctcgtccagctccacctcccatgtagacatattagctttactataatgtctctgatgtaggtttgaaaatctctatctcattgtgcttcccaatatagtagccattaggcatatatggctacttaagttttgattaattagcctcatttctacttactatttggtttatttttggtacagggtcttgctctgttgcctaggctgaagtgcagtggcatgatcatggctcactgcagcatcaacctcccaggctcaagccatcctctcaccttagactcccaagtagctgagactacaagcatgtgccaccatgcccagttaatttttgtattttttgtagagacaaggttttgccatgttgtccaggctggtctggaactcctgaactcaagcgattcacctgcctgggcctcgcaaagtgctgggattacaggcatgagctaccgtgcctggcttagctccattcctggtgcttagtagtcatgtgtggctaatagctaccacactggaaagcatatatataaagcatttttattatcacttaaagttctattgacagctctgctctagggagtctcactaatttataaggcagcctgcttcattcttggatagtctaattgccaaaaagctcttatttataatcaatagaattttgtctctgtacttttctgattctaactctgccctatacaaggaactcaatccctcttccgtgtaaagtttttcagatatttggagaaggtttttgcaaggctgtctaagttgtttcctttttagaccaaacaactgttcctgcagctgttctcacttgtcccagtgtccaggccttttgctgtcctggccctctctctaaaagagtactagtttatcagtttcctcttaaaagaaagttcctagaattgaacgcaataatgtagatgtagtcccaggacagggaagagtgtggagtatatttcctcccttcatcacaacattaaatttatatatgactgcagcccaagaagattcattttcaaatctgtgatgtcacactcttgggtcagattgcgtaaatctctctctggctgacttataacccctctgtgtttctaatgtttgttgactttgctatcaataggttggtgagaagttccgtgcccgttctttgaaatttcctggcttgatatcaggttgcactatggactggttcagccgctggccaagggaggctctgattgctgtggcctcctacttcctttcagactataatattgtctgctctagtgaaattaaaagacaagttgtagaaacaatgggcctgtttcatgacatggtttcagagagctgtgaaagttatttccaaaggtaagtgatattacataagcaccatcgctatggaaccacagcatgtattcccaagaggaatgcattgtaacatccagcagaagactctttctattcattgagcacgagctgtatttttagatctttcttgctttgattttctagtgactatgtatgaagagatggcaagtaaacaagatttaaaaacgaactagtgtccacacttaaatacctttttatcctccaagcctcagagtaacagatgcttaatgaattactttatttcatctgcttaattttgttttgaaaatgacttaactaattcatcaccaactgtttaaaattagtttcttattcaaatgtattatttattttgattaaagtacactgcttctaatgtttctttattgccttatgttaaaggagtatttagaatttgtatttgcattacttagtcttaccaatgtttctatgccagacaactatgaaacaaaatatcaattgactatgggaaaaccactcactaaaagcagcaatggcatgttcattatgtgaaagctggtgtcaaccatgcaaaaacacagcttttttccccaaagcatgacagtcactgtgtaagattgacaaatgggccaacgtggatccccagaaaagctatgcctgtttttctgcatagagagtttgcgtaacactttcattgattttcagtgaggttcctacttcacaaaagtttatttattccataccttttcctttacttaaaaccattcccagaccacccttttagataagatctcccaaattctcttggtgaatcagtgtatactaattcttactgttaagaagattttctttctatttgaacgcctgctaatgtcatccatggagataaatttttacctttgtgcagctacaaaaatctgtttctttactttgaaaatttgggtatatttttcaaaattttttatatgttcttaggttgttgaagtttattctgaatgtaatatttttacaacactttaatgatagtcacatatatgcccaagatcttaaaaaaaactcaaaagcattaaaaatcttcaaaactacaaaagtttaaattaatataaaaggttaaataattttatagtacgtgaagaactcttttttcacttgagcttcttctgtataaaattatgccttttgtaataaagccacaataaagtggacatttgaatcgagtgtggttgccttgatttcaaggccaatccagtgaacttgggagacattggtttttgcttctgtaaacccacccagctggtatccagcagtgaagaggttgtaacaaatatcacttgaatgaaaatggatcacagcacaaattcatttcaaccacttatccctaatatttgtccagaaccttaaagttttgcactgttgacaccagctttcacatagattcatatatgcgattttatttgatcttcacaaaattctgggaggggtagagcagatattcttttctctattttccagatgaggaaacagagttggagttaagggtgaagtcaaagacccctcagggttgaaacatcagacagatttagtcctttttccacctcacctctgagaaaccttgctcaagtcctgtcttcctgctagtgaatcactctacatgatcacactgatttcaccttgggaaaggtgtcgttttatgggagtacgcacaatgattgaaatggtccttttaatgttctgctttcagataccgccgaagagcacatgtgactcccaaatcttacctctcatttataaatggttataaaaacatttatgctgaaaaggtgaagttcattaatgaacaggctgaacgtatgaatattggtaagaggaatggaatggaatgggatggaatagaaatagggtttatttgatagggatctcaatattttgtttggtggacattttgtctgaaaatgaaatactcactttgttagtagtagataattttaaaggatggccttgagggtattttgacctgtcgagaaactctgaacagaagaaaatctaaacagaagtggcctattttctctgcagaaccatttctcctggctctttcaactctgggtcccctgtgctgagtcactgagccattgctggcagatggggacaagccagcttttgggaatggacaacaatttcagtttttggtttcattttgatttgccttgatttgtataaactttgccatgttaattttccctacatttctaataaagaaaaaggcaaaatagaagcaaaaacaaataaaaacaaaaagagattgtgtacctaagcaagagttttccaagtgtctgctatatgtagtataactagcaaaagtaaacattggaagagattatatgtccagaaagcatgtggcccaaacaatctaaaacaccttagttcttatttttcaagttctaaataaaacttgaggggctgagtatggtggctgatgcctgtaattccacactttgagaggccaacgcaagcggatcacttgagcccaggagttcaagagcagcctgggcaacatggtgaaaccctgtctctacaaaaatataaaaattagtcaggcattgtggtggtgcatgcctgtagaccaagctacttgggaggctgaggtgggaggatcacttgagccctggaggtcaaggctgcagtgaactgagattgcaccactacactccagcctaggtgacagagtgggaccctgtctcaagaaaaaatcaaaacaaaaaccacttggtcacatagcataacagcgccaaggtctgtgaagtcatagttatgagagaagactgtgaaagaaggcttcttctgcggttttctcatgattcagcttcttgcagctttcctatatgatgctttagatcagtagtgtgctgaagccaactcatagtggcttttgagaacacaatgttaaatttttaggaattttgtgatctccttgttaaacagaacttttattaaaaattaactcatgtatacttacaattaaacaaattggatttaaaataaaggcaataaatgctcaaactcatcccttcttagttttactctttttttttttctttttctttgagacagagttttgctctgttgcccaggttggagtgcaatggcgtgatctctgttcactgcaacctctgcctcccaggttcaaggaattctcctgcctcagcctcccaagtaactgggattacaggcatgcgccaccatgcccagcttgttttgtatttttagtagagacagggttttgccatgttggccaggctggtttcgaactgacctcaggtgatccacccgccttggcctcccaaagttctgggattacaggggtgagccaccgtacccggcctactctattttcttatatcaatgttcttgaggttatttacttctgtctgtatggtaggaatattacataacagtgtggtactgagaatcttttggtagcctgaaatcagccatggtgggagtgtttacactacagaaattggacaatatacagatgagggcttccccttttcccagtgacccagatttaaatatttaccaacatcccactacctagaacccgttggaatgtgagcaattcagttaaccagttctttttctctacggtgctaaaagttgcaaagtccattacataagttttcacagttattttcatttttataacaaagagaaccacaaaaatgttaatatattttctatttcatttgccacctcagctgcaatatgattcaaaggcaaaaaatgatagctacaaactgtttacaaagccacagagagcataaatttgtcaaataagtttcttggccaaactaatcttattcaataggacattgtgactttcccttaaatgtagctacgtgatattcttcggtcagagctattttctttgccttcctgttgaaactcagaaatatggtcaatattgttgcttttaagacatgtatatttttaaagcttttgtctacaattttgtgtttgttatattacatgtacagtgcctaataaatagtaaacattgaataaatatttgatgaaggcatatacctgtactcagtaaaggtatatatgtgtgtatttgtaaaggtcttgataaactaatggaggcaagtgaatctgttgctaaactctctcaggatcttgcagtcaaggagaaggagttggcagtggcttccataaaagcagacgaagtgagtttgcatttattttatcactgatgaggaatatttttccatattaaaatgcattgttttaaaatggtactaaagaacaagcagggtataaacccatggacaattcctgataagatagtgttcacaaagaccattagacatttttgtttaacttataccagcatatacctgaactattaattttgctacttggcctaagactattatttcttctctcactctgtctgtctctcttgttctttttcatctgtttatgaaatttctgcttgactatgagttatatttggtcttctgtttaaggtccctgtatgttccaggtttctgggatggcccaaatcgaggaagagttggtagagtttttttttttaaaagaaagaaagaggaaaaatccatactcctctcaaggagataggtatatatgtgtgctgctttttctcttttttttttttttttttttttttttgagacagagtcttgctctgttgcccaggctggagtgcagtggcgtgatctcggctcactgcaacctccacctcctgggttcaagcgattctcctgcctaatttttgtatttttagtagagacggggtttcaccatgttggccaggatggtctcaatctcttgactttgtgatccgcctgcctcggcctcccaaagtgctgggattacaggcatgagccatggtgcccggcctatgtgctgcttttttatctattatacagccttctagtctcagactttcagcttccagtcaccaagagtcagttaagaatagatacttcagtcttgatccttagccagttgctgaaatgagtgaactaacataggggaggcacttaagcatagtcctggcatatatggtaagcactcaataaacattagcttcttttattgttattatacaaggcttaaaatggttttttgcccttattctatgatacttacttgaattgttttaattttctagaaatttgtagagtgaaaatactatttcttctgaaagctttaaatatttatttatatatatattctaagcctaagaaaagcttagaaaatggaagactgcgaggaactgctcaaaggaatttactttaatataccttaaaatatagacaacttaggaaataagtttgttcttattcgtgttttatattatgttgaataaatatttgctcactattcagatctataaattttgcttgaaaggtttctattggctttcatgtgtttcctcaacttaacaggtattagcagaagtcacagtaagcgctcaggcttcagccaaaattaaaaatgaagtacaggaggtaaaggacaaagcccaaaaaattgtggatgaaattgatagtgaaaaagtgaaagctgaaagcaagcttgaggcagctaaacctgcactggaagaagcagaagcagccctgaatgtgagcagtgcattgttaccccttccaacacaagtcctagaaggcttcatgtttcattacatgaaattaactcatcagaaaactgaattgaattcttaatgtgattgataatctctgagtctggaaacaaatgtgtcaattaattcagttttctaagttctaatttttttaaagtcttcccctcttatattattttcatcccacaaattggtcttccatgagaactgagaaataatgctagtggttagtggcctaaactgtgagaaattcagattacgcagagagcctgctcagtttctccagcatcccttccagattatgtcatgctcccttttaaaatcttcctgtggttcccactgctcttaggataaagtcctgagctagacatccacagctgtgaggcaaaaggggcacagctttggaggcaggcagacctgcattcaacctctatatataatacacacacacacacacatacacacacacacacatacatacacatatatgtgcatgtatatatatgtggatatatacacacatatatacacacgtgtatatacttacacactgctaatacacacacatataagtatgtatgtacatatagatgatctggagtaaatttgcttaactttcttgggtttctatggggattataatttctcattgatccttaaagaatcaatgtgagcattaaaattaattaatacaaaatgctaggcacatagaaagcactcaataaatattagtgcttctgttcctgctgatgacctggctcctgtctgtctcttcaactttatctcttgtcattttgtccctacacacaatgcgatccagtcatacagaaaaatgtataggattctggaagaatggtcaggatctgttacctttaaacgtgcctccacctctgctgggaatgcttttcctaactttcattgcctaattagagtcattctttaaatctgggcccagacctcactcctcccaggaagttttcagttcttcttcgaggccttcctttgttttcctatcactcacatgcttctgtcatggcagaaatccttatgtagggtaattgtatttgctttgccattttcagaggttatgaggacaagactattttggtttgctttgttttatatgggagaatgcctgcaattgttaaatgaatgaataaatctatgataatcatttaataaaattttcacaatgaccaggacacattctgcacccccacttcctttatgggtcttactgtaacgtacaaaaggaagagatcaccgaaccgaaggagtcttagaacatgttattgatcatatggtctcccagtccttgccttgatggtcaggcaatgtcttaatccaaacccagccaatggatagaaattttcaaaaatgtttttatgagccatatattacagtaattttcttgtctccttctaattcctctccctgccatagacagggaagccctcacaatgaaggctaaaggtgaggtttctgatattcagggctttgtatcctctcttaatatccacacctaatatagaccctgtgctttgaagatgcaagttatctaaatgttacatatcagtgggacttattaacagaggtctatgatggcaatgcctgttagtgatattttaaaccaattcgttgggagcaacagggaaaagaagaatacatacaaataaacacaaataccaaaataacaatgaaagagccactaagcaaaaatcttggaaatggagagaaaatatgttttaaagttttctatcttaattattgaaaagtattagatttccatataactattaataccactcaacaaacaaaatattgatccttaatcccaaatatagactatcaagccaaatgatattgccacagtcaggaaacttgcaaaaccaccacatcttattatgagaatcatggactgtgttctgttactatttcaaaagaaaattgaccctgttactatggatccagaaaaatcttgctgtaagccatcatggggagagtcattaaaggtaagtaaaatctatcattgtcaatcctatgagctgcatcaggcgtcctcagcccaggacactcaatatagaccagacaaactggcagacaataattgatcattgcgtattgaaaagtttatcttaaactccatcacctaaaatgtaaagagggatagattttaaagccaaataccttctttttatgacatctgtccagaaccggtggctagtattggcacagccttggtgtcaacccagcccagttttcaaaaaggggcttgtgtggttggtggcattcagatgcacttaccagaaagaaaacttacatagcttttcttctttactctttccacatggaatccagaagacaatttgtgatttacagatttaggttggctactgccaatagtctcaatttgtgtatttagagcaaatcatctattacttctttgagaaaattcaatttagaagtacatattaactcaggaagaaagtattttcttccagaacttacaggttataatactatttttcagttgatgagtgcaacaggattcctgtggagccttcagcagttccctaaggacactataaatgaagagactgttgagttactacagccatattttaatatggatgattatacttttgaaagtgccaaaaaagtctgtgggaatgtggctggtctcctgtcttggacacttgctatggcaatattttatggcatcaatagagaagtgttgcctctgaaggtaaaagtttccttccttctcccagtaaatcaatatttcataaaatcagtcatcagtattactgctattaaaagacaatgcgtagtttagaccaataaaggtagatgtccctgttaccaaatttgtcttttttctctatgtcctctcaaagtttctccttctttttatatctgttacatgtttcttgacaatgcaggcaagtgactgaaaccaacatgttaacttacacaggaaatgaatttcttgggaataataatcaagctgtcataagaagaaaaacttgccatttctttgaagtttggagattaggtttggaggttgaatttgattactgtatttcaaacaaaacttataaaattaggtttgacacctagaaaggttttaaatttcaaagacagaaggagaaccttaaatgcaatctaagaagcaatcagacaaaacctaaaaggttgtttacaaaagacaaatcaagatgttgcagatttcccacaaccctaaatactagaagataatgaaaaaacatatgcagagttttgaggaggaaaatgctggggtccaagcactccataatggccaaagctggtcttcatggatgagggaacagaatgagattcttaggagggcaaggattcatgaaatgtatcactcagatacacactgcctccagggccccatcccaatctcccaccccaacaaagctaaaagtattataagtggttgctctgtggaatggataatgaggagtcggtgggcagggggttactgtttttcataagccttagagaagtggctgcctcctttaaaacctgtgcatgaggaactttgagaaaaatagaaagtcaatttaaaataaaaagttttaacaaagagaaatgataggaaaaatacaaaaaacacaccccaacaaaaagatactaagggagaaatcttacaataaatgtagaattcaagaaaaaaaagaaaacacacacacacatcagaaaagaactattctttgttgataaaaattatgatccatagtgaagacaattaaaataatgtgttatgcaataaataaaatagcataaaattgtataaaccaaatccattagtattttcagtggaaattaacaaacataatactgtaatttgagattgtgatacatgctatgaaattaacaaaaataatattgtaatttgagattgtggctacccctggtaggcatagggccagcttcttgggtgtgcacacagggccttgtgttaatgctctgctgttgccctcttcagattcttaatatttttttttaacaaggggccccacatttttcattttgcactgggccctgtaaattagagaggcagtcccgagtaggcataaattagtaattatatagaaattttacatgatactatttttcaggttgaataactacattgaactttcttcagtataaacaaagaacatgaaattatttctagagtacaagaaacatttataagaattaattatattcaatggtaaaagaggaccttgattaaattcccgaaagcaaaaaatcctggggtctcattctctgagtataagcaataatactggaaactttacattaaaatgaactcagtcattcctaattaggaaatgatgaaaataagcgagttaccaaagcttctgtgatatggccaaaatggtacattcttagcccttacatacatcaaagaaactaaacattccactgaagagttaaagtatatactcactcataagcatacatacacatgaaatttaaggaaatcggaatagagccaataaaaataacattaaaaattagagaaaagcagcagaattaatgagcaaatctaagaacctatgctttgcaaaaacaaaactgtaagaaatattcctggaaaatctaatcaagaagaaaatgaaaacaaatgaaaatagaaagataaatcctcataattctagatgtgaagatttaaataattataaagtaattgttttttaagagacagggtttcattctggcccccaggctggagtgcagtggtgcaatcatagcttactgcagccttgaattcctgggcttaagcagttctcctacctcagcctcccaaactgctcccaggattataggtgtgagccactgtgccaggctgcaaatattacctagttatatgttaatatattagaaaatctaaatgaaataaaagttttatgggaaaaggagctaaattcaaataaacattgagaatgaaaataagaaagggatcaaagaacttctaccccagaaggctttgggcctagattattttactgattattttaaatttacaggaagcagatcattaccacattgtaggacttagaaaaatatgaaaaactactgttacagtaatttcacttgcagaatctttgaaattggattgttaccaaagtaacaatcctaaatgtgtacatatccaatagtatttatcacaacattatttgtaataactaaaaatgggtgggtggacaaatgtatatgagtaggaaaaaggttaattatgatacatccaacacgtagaatatcatgcagtcacataactaacgttcatgatggacttgggaccttcataaaatgaaatgaaatgaaaaaaaatcaaaatgccaattacctacttcctaacacaatactcacaggttatgtctgagaaatttcggggtaacttttgtcctcctttctatacattgctgcattttccatgttttcttattgaacattaataattaaaaaaatttttttgagacagggtctcactctgtcgcccaggctggagtacagtgttgcgatcacagctcactgcagcctcgacctccggggcccaagtgatcctcctgcttcagcctccagagtagcttggactacaggtgcatgccaccatacctagctaatttttctatttttctgtagaaacaagatctcactattttgcccaggctggtcttgaactgggctcaagtgatcctcagcctctcaaagttctgggattacaggcatgagccaccacacctggccagtaattaaaaatttaaaagtaatgaaataccctccaagacgctttgctttcccagctgaagacacggaaacagatgtgctcgaaagtcccgtctagtgcagaaattatgtgatttgtgttatctaccagttacaatcatgactgtttcatgcagctaatacactaaccacgtcttcttcttttcaggccaacctggccaagcaggaaggccggttagcagttgctaatgctgagttagggaaggcacaagccctgctggatgagaagcaagctgagctggataaagtacaggcaaaatttgatgcagcaatgaatgagaaaatggtgagattaaacataaaaaatccccaaaatggtgtactgaaactttacacaagagcatgctatatttggaaatcaggcaaatggttgtgatgaaaaaatattggccagcatgcctatctgctttggatctttggtgctcaaaattattttttgtgttttcactgatcaaactttaccgtcactgatttgagggttagaaaactgggtttgagatgcagctcagacacttgttaattgtgtggtttggggctttcacgcgcgtccatgtgaagagaccaccaaacaggctttgtgtgagcaacaaggctgtttatttcacctgggtgcaggcgagctgagtccgaaaagagtcagcgaagggagacaggggtggggccgttttataggatttaggtaggtaaaggaaaattacagtcaaagggagttgttctctggcgggcaggggtgggggtcacaaggtgctcagtgggggagcttttgagctaggatgagccaggaaaaggaatttcacaaggtaatgtcatcagttaaggcaggaacaggccattttcacttcttttgtggtggaatgtcatcagttaaggcaggaaccggccatctggatgtgtacatgcaggtcacaggggatatgatggcttagctttggctcagagacctgacaggggcaatctacctagctctgtttgtaaaatggggatcctaatataacctcttgggataggttgtaagcagtggtggtctggtaaatgttaacaatctagtgtgcagtgtggggagaggaaagtccggatttgtaatatttgctgatttctgtggtgtaaatactcccatcactggcaattttaaactccaatgtaacgtcactgagcacagatttgggaaaaggtgcatggcagtaccccatcgcatactatttccaccatccagatacaacggtcttaacctcaaaaccatagataatattaacatttaaataattaggaagtaagcttttgttatttattacttttgcttttaatataattttttaattgtaagcttacatagtttaatttttaataaaggctgtgtttagcaccagctcacaaatactctaaaaatttaacaattggctcttaagagttgatacaagccggctgctacatgctattgttgtctgggatttttccaggagaaaatactttgtaaatgacaaagaactcgggattattactgcatccaagacatcaaaatggcaaatcttattgatttgattctgttttgaaaatattcaatagaaatactattgtaatttgtctgattaaaagataaattatgtgatttggattctgtcttacaaaattgctttccttgaaattttataaggtaaaatcactatattatgaatgatcaaaatttaatatgtgaagtttcaatgcacactgtatttttaggttatattattttgcaaagtaagaaattcccccatgtatttttatgtgtgaatataatggatgtttgtgttaagcacttagaaaagttttttgagacattctcccattatggctgcaggatttgcttaatgacgctgatacgtgccggaaaaagatgcaggccgcctccactctcatcgatgggctgagtggagaaaaaatccggtggacccagcaaagtaaagaattcaaagctcagattaataggtgggaatctgggtcttcttcataatcactctttctttgtgacattagagaacataaagtccatttccatgtgttcatctctgaatcccatcatctatgacagtgcttgcaacttaaatcatgcactctcaggtgaaatactatagagggtgaagaagattttgtgaaatattttacatctcagctgtggttcagcactgtgggttttcagtatgagagtgcttttgatattgtttggatttgccagagccgtctccactccagttctctatgcttcacctcaatgattttgaaagtgtggatcaatggtttgttgtggatcaatggtttgttgtaaatgcaaggctgtcttctgctggtgtctgttggtgtccttagaaaacttaaaagagaggggaatgagagaggagcaagaaaatggcaaaaaaataaaaataaaaataaaaaaataaaaaaataaaaagggaggggaaagaaaaaatggtttaacacaagactgaaatctgaataagagcaagggacaggatgggggaagatactttcctcacagtatcaaggctcacgacctgtaggcttcaggaggaagccttctttcttgcttcctgaccaccccacatgtggccactcctacccacttttgggtttggggctccactttgcacggtctttttccatgcctggctaccaagcattaagcaggggcaaagaaggatttcacccagtaacagagcaaaactgtgacctctcaaacaacttaatgtcaggtgactcactttggggagggggctgtgtgttttcttcacagacttgtaggtgatattctgctgtgcacgggattcctttcctaccttggtcctttcaatcagatatttaggaactatttgcttaaagatcaatgggaaatggagttgagagcacggaaaattcctttcacagaaaacctgaatcttatttcaatgttggtggatcctccaactgtaagttttactttcccaatgttatttgaatttcagtctcattttatttcttacttactgagaaacccggctgggtgtggtggctcacatctgtaatcccagcactttgggaggctgaggagggcagatcatgaggtcaggagttcaagaccagcctaaccaacatggtgaaatccccatctctactaaaaatacaaaagttagccgggcatgatggtgcatgcctgtaatcctagctactcaggaggctgaggcaggagaatcgcttcaaccagggaggcaatggttccgagatcacgccactccactccagactgggcaacaagagagaaactccatcccccccccaaaaaaaagaaacccaggttcattgaattttttctttaactgggaagattgttttgaaagtgcttaagagtttttttaaaaataattttctttatggtataaatgtttctttgcgttttaagtaatcttgcttccaaattaagaccaattgcattgctatgaactgaaagatcatttgagagatatcagcttgctaatactgggcccttcttataactcttcattatttacaccactcctgtgaagtcatactctctttcaaacattttaggcaaatgtaggcatgatctgtgctggtattaaccttattttcattatttgctatcttttttagtgtctaaaaacgtaacagaatagcatgttctggtgaccctaagtaatagcaagtcctttcatactaaccttccttgctgggaattcgatgccactgtcaatttccggtatatcttgcagagcttctgttgtaataaatgctttccaggcaatttgtattcatgagttgcttttctggtttgcaaatctgctctccagttgctgtttccttaggggatgccaagctattaatttcatattatctgtatttaaaagttaaaaactaatcttttccaattcgaacattgttgaattcacccttacagggaatagattatgtcttggagatgcactgggcactggtgaagcaaagtgggccagaatattctttattaattatggcctttgggggtcctgggataatttaacaaaggtggaggctggttggctcattggatctctgattattttattttattttattttattttattttattttattttattttattttttttagagacaaagtcttgctctgtagctcagacggaagtgcagtgctgtgatcatggctcacagcagcctcaaattcctgggctcaagtgaccctcccagactcccaaaatgctgggattataggcatgaaccactgcgcctggcccggtgattttattgatcacatggtgggaggctggcaatcccctctaaatttggagaaggaaatattcacaaaagtgtcattgatgagctccggccaatataataactcatctaatttatctccagctatgcaatcacccatacaccatgtgggcagaaccaaagggccggaaggggaagctatcaggggctaattgcctgggacttaccttgttctctgacatttcattatattcactatctccattaaccccaaatcaggtttaatatgcaatcaacttgctatgattcccctaagtatgaaaatacaatgcaaaaggataaaccttgtcttgggtaattaaagaagggattcattagataataaatttgtttttttttaatgtgaatgttatttggttcacatttacaagtttgctttttttcgaagtacaagttgcatagtctcaaaggaaaataatgtccacattttaaattattttactttacagtacttttaattactaatgagggcattcctgttctcctttgaatggtgatatccatttcctgttgttcagattggtgagtgggggctacagggattaccaggagatgatctctcaattcagaatggcattattgtgacaaaggccaccagatacccactcctcatagacccacaaactcaaggcaaaacttggattaaatcaaaggaaaaagaaaatgatttacaggtatgtagcatttggtgcaggggaaagtaatcttgaaatcatgaaactctttcaaaattttgattgaatctgcagtcataaagttgtcatctccatgacaaatgtttgctaattcacactcttgagttttgtaacagcaatttggggcaacagctctgattcttttctctcttttgtactctctttggatcctccctccccctctctttgtacatttccctgactccattgcttttgctaatgtcgaatgtggcttttgttccgggccttgggtttgggcctataggaaagtggcaaatagaacattgtgatccctcagttcaagaccattcatgccaaccttgctcaggctcttggtactacgtagcttactgagtccagctttggtgcttgcatctaataaggtgttaattttaaggtgagagtagacaagggcaggattccaacattcctgactcccttagggattctgttactattgatattttaattcaactaccaatgtgggatattcagtgtttcctagacactgttcccagtgctctaaacccccgtccccatgtttttgcttatactgtttctactaaccaaaatgtctttctctacctccacttatatcctagataaaaatctcagatattcttcaaagtccacatccaccactacctccatcaagacttttctgtgtccccagctcaatataacctgtcctgaatcctcacaatgtcttgtttgcactcatgttgtggacttagaatctgacttaaattattgttctttgcacatttatcttttatttctattgtaccatgaactcctttttggccaagttttattcatctttacatgttctgcactgctctttttgagtaggaattctgatatttattgaatttaagtgaattaatcaaagtgtgtcatcattatagaaaaaaagaaccaggaaaataatgtggtcatcttgatgaatatgaaaagaagcacttggtaaaattcaatgctcattcatgatcaaatttccagcaaactgggagagatcttccttaattagatagtttctttttacaaaaagccataacaaacatcctatttagtggtgaaatgttgaaagatttcctcctgagatcagtgcttctcatccaagtggatatagcccagtgctcggaagcacacctaaataccccacctcatcaatactccagaacacgatacatcagtctatgtttactaagaaaacccagggaaatcctagaatggaccaggcaatgtaaatagaagagaagagttaaaagaaatagtgtccatttccacgaagcttcttaggagccacattttcaggggtgcacaaatgtggtataccagaacacttctgttcttagtttctgcagccaggtcaactataacttgtccctggccccattccccttggctcccctggctttcaatctccctgctcatcttattcttggaaccttgcctggacatccttagctcaatgcatgctcctgtatcacttggacatgaatgctgctattttttctgatcttagctttatctctccatttctggattaaatttactgatagtcttcactgaagtcctttctgatgcaacccagtcccaggaaccttcttgtggaaggaatagaaatatgcccgaaactcttccttattttaaaaaccatccactgctgggatggaaatagactgaattgtattctccttactcagacaacattattttcttatgtggataagcacatgtacaaacacatgcaaatgaaaaacaaagcatagtttttatgcccagggctgtggtcaaccttggcagctttgccaaggctaccttcaatgccatctccaggacctacagctctgacttgtggaaagaggatgtatttaccaagtctccctatcaggaattcactggtcaccttgtaaagacccaataccagtctttgcgcaggtgaaccaggctctgggggtggctaccaaatagtgtttcacaagaaaaatccagtgaaataaacctgaaattgggattccaaaatactatttcaagtttctaaaagacattgaagatgactgaagataattatctccttacttgggaaagatatcacaaaaatagaatttaccccttgagaaataaagcaagatataagcaaatttagtcttactggtgcttttcttcaccttgtttattaagttcattaaagttctttgtttagattctttttccttattaacttacaggaaggtctttacagcacattatttgtataaagaaagctattcatccagggaaacaacttccttcatgtgcagaatttttttttagttatttcctttttaatcaaaacaggacaaaagtaggctgatttaattgttatatttcatatcttctttttatcatagtaattgagagatacatatttaattccattctcctaatcgcctgttgtcccagtggattcttccttgcatcttatggtctgcacccacaatagcctaaggcattagttgaattcagaagataggatacaaaaagttgagaaatgagcctttgggaatcttcacagttaggcagggggagggatcctaggtgaagtaagggttcaaatccaattggctcatgcagagatgaaccactacagtgtgtctattttaactaataacaaacgcattaatctaaacacgaagacccaaccaggaattcagaattgcagttttaaaaaaatgtaagcatatataaagtgaatgtctagtcttttaggttgactttacggaaagtgttaaattcttcccagtgccaataggagacagaatacatggatagaccctcagtgcgactcaatatatcatttctgacattcttatgtttactttttatcacttactcatcttgtaggggtcctgagaaaataaatgaatatccagatatgcaagttgctttgctttctctgagcgattatagctatgtaagtttgaaaggattaatccttgactattctcttccatctgtcaggagcagaactctgacattgcatctgagcaatgccccttaaccctcctcttttgatcatagagaccccattacacatctagaccccattcaacaaaatcatgactcaccaagttttagaaattaatttttgtatgttactttaatttttttaagtaagtcttcttctattgcccttaaaattcttgattacctgtccaacaaatctctcggtttcccttagcaatgggcacattctttgtaacacagatagaccaatgagttctttctgtttaggtgacatctctgaaccataaatattttcgcacacacttggaggacagcctttccttgggccgaccccttctcattgaggacattcatgaagagctggatccagccttggataatgtattagaaaagaattttattaaatctggcaccactttcaaggtgagctttgtaaaaaaaaaaaaaaagaaagaaagaaagaaaagaaaaagaaaaaaagaaaaaaattaagaaagagaaagaaagaaaagaacaatggtgacatctacttatcttattgagcatagcagcaaatgcaatttcctttaggcagtagtatttggtacgtcggaaataaactatttccagactgatacttcagtgtttccttttattttttatagcgtataaaagtttctgaggtgggggcaatattttgataagagtagtcgtttagctaaaactaagtaacattaaggaaacacattgtctggtcttaatatgttagtgcaacacacagtatatatatgtttaagcaactctagatattggttttgcaagccttatatatatacatttttacaaaataacccggatttcttccctggagaaaatgacattttaataaagtcattgatttggtaaagtcattgatttaataaagtcattttaataaacacattgatttggtcatttatctctttattttcagtctaaactcattgactttgttggaagctatggaatattgttctcaattgttggtgatgaattattttcaatttgtataagtgtttcatgtttaatttgtgtcattctctacctttaggcttcttaagttttataacagcatttctgattgggtgtttattactttggacaacttaatttcatgagtatcagtgaataagtaaaaatgaatattttctcattaaataaagacagatttattcagaaaaattttcttcataatgtgaaaatcttttatatgccgcattttaaaaaattcattcagcaaaggtttatggagcatccaatatatacttaagcctttatgagtttatagggagaaaaataaataaaacgcagttagtgttctgaaggttagcatcattctataagattagagggtagaatttctctttttcataaaaagaagctaagaacaaaattttggtgactggcttggatattatggactcatccacaattttgaactgcatttaaaaaggtttaatccacaggtaaagatcgtatatatttaaactgtacaatgtgatgatttggtatacatatacgttgtataatgattaccacaatcaaattaattaacacatccatcaccacacatgctgtaccttagatacctgaaacttgttcatcttatcactgaaagtttgtaccctttgaccaacatctccccatttctcccatcccctatcttgctggcaaccactgttctattctctgcttctatgagtttgacttttttagatttcacatgtgagatcatacagtgtttatctgtgtctggcttatcttatatgacatatttaatatgccaaaggaggttatagaatctctattcccgaaggtcttttaaaagatcctagatttttatctgcaatgtgaaggcataatgccttagaatgtgatggtggccttagtgatgttttcggtcacgggcagaattaagattaaccagagatttaagtcatttaaaaattctatgattgccacctgatttttagatagcaaaaaccaattgttttttcaacatgctgcaaatagtagtgttgaagataaatgttacctttttgaaaaaagttggcgtttttcctttgaaaattacattaactttttctgttgtcaaatatgcttcagatatacctatgaaattcaaaaaacaaaatttcctataaacacatcaaatttccacagtaggaaacaattttcttaactggagaaaaaatagcggctcctgtactacaaacaattgatgggagtgataagtacttgctaaaatgttaaagtcaaatcttagatatgtctaagttttcctttattcaccgtttgttttggataactttttcatttgatttgcttggtatcattgctaaaaacatcaccaggcaggactacaattctaaattattctaaattgaataggctttattatttaagatcagtgattaaaattttgtaactttccttcccaatttattgaagcgtcacagcactgacaggtaaattcttttctaaattgaacccaagttcctttccctgccctttaagctgtttttaattttatatgtgaatttatgtaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggtaatctctctctcaaggtaaagaatttctgcttataatacatgcttaaaatgtattgagaaattgctaagtatgtgaaaaagaaaaaaaaatttaaaaaccatatttatccttgttaacataagtatttcttttgcagccttaattcctgtcaagaaatcatgtaactcatcttctcatccagcctgaaacacacacacacacacacacacacacacacacacacacacacacacccgtctctttctacttctgtctttaaacttctaggtgtactgactctcttatgtatagtccttgtcttggggacacctgaaaacatcaataaaacaatgattgagagaaaaagaaattcctctgaatggctcttctttccactgtagtagtttcaactactacagtccaataatctaatgatatagggagccatacctttatttttaattaaattttcctgcactaaagcagggaaattatgtctaactgagggttctaataaaacaaagaacaacttaggactggaagattttaagagactgatacaagattaaactaatttttaagttgaagctcagaaaacattgttttatgcataaaatataattgcataaaatattttatgtatctgcattataaagtacatttgcataaaatatgataaagtaattaattttagaattaaagattcaagacaaaggcaaggttagaaataataagagcagcaaggcatgaagtggatgggtgagaaaaagaatgacaagggaggaaaacagacagaggagggaaaagaggagatgtgaatccagggtcccaaacacaggagagacatccaagaagggagagggaaatgacacagacaccaaagaagtagactcagtgaaaggcaacatcctacctggctcatagacagttaccacaggcacaggcccttgaaaggtggctggtctggtggagtgaaaagggcacagtctcagctttgactctcttagttgtttgatcttggtttccaacaaacctggggcttatgcagtccaggaagggatcccgttcctcttccacagccaggcggagatggccctggcccggcaattcactgtttccatcgcctctcaggatcacatgctgttaactgttgacagttagtcccttgtggtctaattggtgctgtgggtttattttgagatgattcctcgctggtctagatcccccatgcaggctgcactaacctccagaagtcaagcaactccactgtctaaaggtccccagggctccccacacccactcttcttattccctagcttcctcttcaagagatgtgctaagatgctcatagcaaccttgctggagaaaaaaatgcacatttaatatgcaggagggtattctaaacattatatttaaccctcctaacaatcctactattatacccatatttttacagatgagcaaatggagaccaaagaaaataagggtctcggtctataacagcacatggactttgcagcctgccaagcctcctagataaggtttacaggtcctgctatgaagtttagcaagagtccactgtgctatgatatctgtttttccatatccagaaaaggaagctaatatgatttcattttgtccatgtattcctatactgccacccaggggtgaccattttaatgaaaatgactaactggttatttccctgcaaatacagcaatgctctttatcgccccatcaactcctgccaccctgtaagtacaatggcaataacactagtcttggagttggaggacaagggtattaggctgttttaacacacagctagttactggcagagaccggcctaatacccttgttattcagagttcatatttctgggtccttggcttttccaaatgtaaaataaagaaattggactaaattcagcacatttcagtttgacaaatatttattgggttgagtttcttctttacaaagccacaagataagtactgtcaataatacaaaaatgaataggaaagcttatgtatctgttttctagatgcataaaccgtagttggagggaaataatctactgatagattgtgatacaaactatattagaggccaggcgtggtggctcacccctgtattcctagcactttggaaggttgaggcaggtggattacctgaggtcaagagtttgagaccagcctggccaacacggtgaaaccccgtctctactaaaaatacaaaaattagccaggcgtggtggtgcacgcctgtagtcccagctactcgggagtctgaggcaggagaattgcttgaacctgggcggcagaggttgcagtgagccgagatcacaccactgtatcctagcctgggtgtcagagggagactccatctcaaaaaaacaaaacaaaacaaaacaaaaaacacgcacagaaaaaaatcacaaaaaaacaaaaaacaaaacaaactacattagatgtacagatgaaggctgtgccatggcttttgattgactggttcaggaagactttttgaaaatgatgaaatttctgaagcaattttcccagaaaccttcccaaataagttttaaaacaccttcttttaacgtaattctaagtgcagcatgtgattctgtataaaatcagaagaaaaatgttgtaaggaatattattgagattattgagatttcaatgtagactctgtgtttagtgagagtatcagtgatactgacacatcagtatcagtgttaaatttcctgaatttgaatattgggctacacttatgtaaaagaatgacctggttcttcagagatttgctaaagtgtttaggggtaaaaggacatgacatccacgagtgattcagcagtaataataatgataacaacaataacaataatgacaacattatgtattctatagagatatagtgataaagcaaaatgtgatttggtgaatctaagtgaaggctatatgaaagttccttgtattaggcttgcaactttttgaatgcttgaaattttttcaaaatataattttaaaaatatatcattttatgtaagaagaaaaaaactcctgtaaacattcaagtttgccctctgtagaaggagatacaaataaaatggaaaatgggtttgtattggcaatcggctgtgccaaaccaggtacctggtgctcccataggaaccaggccaagagctcacatttaatctgggtagccccttggtttcttggtattattgcctttttgtttctacttgttctgactgcaaataaagatagcatttcttacagaagcagtgtgggaacagggccaagagaatgggacatgctatttataaacttaaagctggcaagagagcttggggtaattgggcaaaattatttagcagaattgtctggtgcctgccagtataagtgctgtggaaccttaatgacagtaggcataattttaaaaaaatttccacagaaacaaaaatatggatagatagatttggctaatgatagtaatttcttctgccattcaaaaggtactttgctttaaacttttaaaattgttaataaacactagtgagttgggtttactgtaataactggtaattatagttccaatgttattttttgttttttaatgacaggagttagaggctgagagggttaaacttttggaggatgttacttttaataagcggaagatgaaagaacttgaagataacctcctctataaattaagtgctacaaaaggtattgtgttattaagaagtaatgaaataacggattctgaataaggatttcatttacactcttttcaatgccctcatgactatagatgttaggaaatactcatgttatcaatgcaaaaacaagcaaggcaatttccatctagacattaaagagggacggcagagaatctgatttttgaattagcaaatagagactgagcatctgagaataacacaattttcttgatataattgctttctcctgagaaaaattagggctcctgatagagctagataactcattataggttaatttgcttgccccaaagaaactaatgtgctcaatctattttttttttttttttgagacagagtcttgctctgtctcccaagccagacgcggtggctcatgcttctaatcccagcactttgggagaccaaggcgggtggatcacctgaggtcaggagtttgagaacagcctggccaacatggtgaaactcaatctattttttttcaaattgactctttcatttggcattgaaatgcagttactgcaacgggttatgacacatgtaatccatgtcagaagagcttgggtaccaaaggcccagcttaccctctacttggcttgacctcccactttagatgggaaagacaggttctcctctgggcagccaaatcatcatgccacacctcaatttgaggatgtactctctctgcaatatataaaaagaaaattttatccaaagaaaataaaatcaacaaacatattgttctgtagcagacaaatcacagaaacctgaattctactaccttattagaagtgaatgaatacttcacaactgcaccttaatcccgggatgttatttaaacaagtctgaccttccagaagtactgtacctttatggtgagcttagtgaaaagtccttttatctgcctactcgcactgctcccgctagtgaagttgtctgtttcttggtccagtgactcctcccagccatttgggatacccctgggcattaaaaatatagcaagcagagctgagggctgctcccctagtctagccaagagtgtgctggatcaagacctctctccttgaggttaatcccaatttggacttccacagtagacagcatacccgttggagtaacacagcccttcctgcagcacttgtctgccatcccgaactctagggtaggccagagtgctgctgttcgcagatatgggaactgttcgcagatatggggactgttagctcagtacatccaaggtgtctttccttagattttaattaaaaaccaaattcattgtcataaacatgcactatttccattaaaaacaataataaaaaaaaaggatgagttcatgtcctttgcagggacatggatgaaactggaaaccatcattctcagcaaagtaatatcagaatagaaaaccaaacaccgcatgttctcactcataagtgggagttgaacaataagaacacatggacacagggaggggaacatcacacactggggcctgtcggtgggtaggggtctggggggagggatagcgttaggagaaatacctaatgtaaatgacaagttgatgggtgcagcaaacaaacatggcccatgtatacctatgtaacaaacctgcacgttctgcatgtgtaccccagaacttaaagtataataaaaaaaaaaataatgaaaggcaaaactaaaaataaaattcaagtttctcttcctggtgagacattttcactatacccaatttgctcttgttagagacagagggattagagttttctatagcaacgactgttctactaaagcagtgtgaggagtgtaccattcaactatcagcatgacagtcagcccatgtgtgaagtgttcaggttagctacaccctgagacaagcagcgtggacaagctgtgacactttgaggagagccaccaagatgacagtgggtgtgaagcctatcacatggggaacagcaaagagcactggagacatgatcattgtcttgagacatgtgaagacccaatcaaatgggtcttttgctttttgcagatgtttaggcagagcaggggatagtctgtcagcaggaatgttcagaaggcttcaggtattgggtggtagttggactagaagctttttggtgtcttaagattctactgtaccagtagtcttcctgactttggagacatcaagttgaaagctaacagcgttttttttttttcagaagagatgtatcttgctttgcaagtttcccgtcttgtgtactacggttttcctgttttgaatttcaggctcattggtagatgacgaatctctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccaggtgagtcctcactaccttcatccaaaagtggtgacttaaaagtttgcttgtatttctactcttttagaaattgctttttcactattcacaatagcaaagacatggaatcaacctaaatgcccatcaacagtagagtggataaagaaaaggtggtacatatacaacggggaatactatgcagccataaaaaagaatgaactcatgtcctttgcagaaacatggatgaagctggaggccattatccttagcaaactaacacaggaacggaaaaccaaataccgcatagtctcatttataagtaggaactaaatgatgataccacatggacacatagaggagaacaacagacactgtgacctgtcagagagtggagggtgggaggagggagaggatcaagaaaaataactaatgggtactaggcttaatacctgggtgatgaattaatctgtgcaacaaaccaccatgacataggtttaccgacgtacaaaccttcatgtgtacccctgaacttgaaagttttttaaaaaaagaaattgccctttgcttctttgattcttaaaatgtgtttcagatctgaaaagtcaccactacctcaaaagagaattacaaatattatcgagtacctgacatatgaagtttttacatactctgtcagaggcctatacgaaaaccacaaattcctgtttgtactcctcatgaccttaaagattgaccttcagagagggacagttaagcacagagagtttcaagctctcattaaaggtaaagtgtgtgggatacagatgtggtgtgtggaggatgttgcttttgatatgctctttgatataccataaacccatttctgtgatacagtagggaaatgatgttctaacgaaagtttaattaagttttatttttaataccttttttctgtttttcattcgttttgccctagttacttaagattcaggcctgtgccaactcacctgaatattggtattattgtagttattgatataactacattcagtttattcactgctgcccatgccaggaaaagtgatactggtgatggctttctttagcaggacagccattccctcagcaagggagtataatgatttttcagactgcaagaaaaggctcacttatgtttcatatttgaagttaatcctattcattgcatatctccatgttaaaggtataattaaggagacaaaagaatggaattttcatttcagtttagttacacgagtatttactgagcacatgttatgtaaacccaccacgctagctttggggatgtaagaataaaccagatattgcttgaaaagaaataataacctcagaatggggataaagataatttaaaaataactccaaagtaaggcagaatcacctaagtgctataagagagctaagaaacaagtgttgagtctaaaaggagggaaagattacatgtggttggtgaaatcaaaaagtttcttagaaaatatacctttgtgggttaagccatgaattggggaactatttggtacgtggcaaaatgtttcaatctttttcttgtgtttttggctctttatgtatgatttaaccaattattttctggctccccacaccccataaagaaagtggcatttgaggtggaccctgaagaggtagaaatgaggaaaacattccatgctgaaatggaacagcatgagaaagggaacgagtggagaacatctaagttgtaagaatcagtctggttttgttgaaatgaaaggtggatatggaggcatactgagaaatagagctggacatgtaaactggtgacatactgtggagagcctgggttcctgtaggaaggattttcttgatctgggaagaaacagggagttgtgtaaggtggtgacgtgattgatcattatggtcatttagggaggtgaacttggcacacgtgtaaggatcaaagaaaagaggttcaagggagtctctttcaatcttcccaactgcaggaatacattcctaacctagcgtaaaggcaatgggaatatacagggagataagggtgtagagattaaggaagtaaaatggcaaaaccgatgcatacaagagccaagagagcatgcagaaatgagtctatgatttctggcctatgcagagatttctggtctggtggttggaagaggagttggtttgaggagggttggagtgggggattgctggatgtgattttaggacctgtttagtcagaatcagaataggccaggttttgctgccataaaaacaatctcaaaatttcagtgacttaacacaaccaaggtgtacttctcattcatgttacctctccaacgtgctgttatagtcactcagaaatccacattgcttccataactactatggcagaggggcaaggatgtggcagactgtgcactggctcttaaaagttaccccacaagtgacacatgtcacttacgctcctatttccttagccaaagccagacacacagccacatctcacttcaaaaagagcagggaaatgcagttccccgtgtgtttgaaaggcggggaaacagtttgtgaccagctcttatgactacagacgtgaaatttgagctatccagaaaacaattagaaaagataacctaggccgggcgcggtggctaatgcctgtaatcccagcactttgggaggctgaggcaggcggatcacaaggtcaggagatcgagaccatcctggtcaccggtttaggtgaaaccctgtctctactaaaaatacaaaaattagctgggcgtggtggcacgtgtctgtagtcccagctactcgggaagctgaagcaggagaatcacttgaaccagggagtcggaggttgcagtgagcagagatcatgccactgcactccagcctggtgacagagtgagactctgtctcagaaaaaaaaaaaaggaatctagacagtccaagagaagagtcaggcagttacaaagatggggtacagaaataacagccaaagccatgggaatgaaagctaatctagggaaaaaatgtggagtatttctaacccacaaggtgataggacctgctatacttttgtcctctgcagcctatttataataaacgggcagtcaccgataacttcttactctttctctacttcatttaattccttcctcagattcaggttagattaccactgtggaaacttcgcaaactattttgcatcatctctgaaatctcttctttgtgcctttttcatgaacacaggttttatttctggtagttccaaggaagttgaaatgtatcatgtggttcatatttttttcacaggtctaatgcacttatggaagttggttttttaaggcagtgtggtgtggtacaatgaacactatctagggtggggaggaggcactgcagagagtgtcaagatgtatgaggttttggtcttggggatgcttaagtaaagtaagtgaatttacccaatctggaaacctattttacctcatttcaaaaatctttaagccctcacttggacttgggctgcagccctggtattgtatgatgctgagcaggggggtagggggcattgaagcgtgctgaaatccaggcagcagtggcagcaaaatgacccccacaatctggggaagcctcatatctatgcaccatggtctgaatgtttgtgtcccctcaaacttcatctgttgaaatcttaccccaccccctccaaggtgatggtattagcatgtgaggcctttggaaggtgattaggtcatgagggtagagctctcgtgaatggggttagtgcctttatgaaagaggcctgagggagctcactccccctcccaccatgtcaggacaccatgaaaggagccatctatgcaccaggaaatgggccctcaccagacgttgaattcatcagggtcttgatcttggactccccagcctccagagctgtgagaaataaaaatttctgttgtttctaagccacccagcgtatggtatttggtgatagtggctgaatggacaaagataccgtgcaatacgagtggaggagaagtatacttttgaatctttccttactggtgagctggctttgcttcctcaatgccatctgctaatatgacccctgagaaggaggcacatatgacatagaaaggaagaagtgggaaacctggtgcctgggtccacagtggatggtgggaaggaaaaaggaggtcagaggtagaaagaggaggtcaggtgcaaagatcctcatctcttccttgcctcctgagggagctgagaaggggagagtgccggagaaactcccagataggagatgcccctgcattctgcccagtgtcacacccaccatggaagcaggggaatggctggatgggtgagcctgaggtttggctggcacacagcagagactagaggtcaaaccaaaaagctgtcaagaaagagaactttgtacctgcagacaaaggaccaatgccaggagctggggcagtggattgcagtccagggccccaacagatagcatttgtcgtagctcataggatacagtacagggacctagcctgcacctgaggtgtgggaagcctggagggcagcctgcatacctgaggcatgctcgatactaagacatagtcccaccccgtctcacctctcccacctaccaaccaggcagaccagagctactacctgaaagagactgggttatttgaaagagggtgggtaaaccagaggagactgagaaacacggcaacacagtggggagggaattcatcagggaggattagatttgttacagaaaaataaagaaggctgaacacatgggttgtggtgtgagcacatttgtgaccccatttcatgaaattggagtcagggagaactatactgtatagggccaggagagtcagtgagaggagtttggatttaatttagttggcaatagggagccatcgaatgttttatgagcagggatgtggcatgaacagaacagtgctttaagaagattaatttgggattttatgataggttgattgacagcagtacaattggcttagcaataaaggagtttttctttttaaacaaaacataacatttgttttagttttgaactggcttacattttgactgaattatctttaaaagatggtatgactttgtttttaatgtttctttacaaagttaacaaatatgatccttagatcacagatacttttaaaaaatcattttgaactcaatacttaagggggagagtggaagagttatttatcctagcagaaatgtttgatttcccaagagtgacaggttttttttgtttgtttcaattactacttgctttctgcaatatttgcaaggtgcctttgactttcttcttcaaccaaaaatgtcagaacactttgaaaaatgaaatggataccaggcgcaatcctgcattatagagcaatggacttatctttcttccctgtctggttattttagaaagatattatctttcttttgtcatagactctgtacaaaaagacaccttagggggtcttttcttgccttccaaactggactgaacctgggccttccaagcggggaaagaaaaagagagagagaaagaatgtcagaacaagagctaatgattacatagctcttattattattctatactgttctaggtacattaatgtatttaaccttcacagcagccaatctggtagattctatcagacatccacttggcagatgaggaaactgagagggattcatgtttttttgttcaagtttatgcagctaacaagcggcagagccaggatattttgggggaataggaagggctgtcattgttctgggttagtttaggaaacacaaaggtagcttagatttcttctcctggtgtctctaaagctcaggattacatgaaaacatttctttggaaacaaccaagaagaaaaggggtgagtttgtctctgtgccaggcctgcaggtggctctctctagtggctgcttctcgcaccagtgactcctacattagcaatactgttgctccagtgagacctgctctgtctccaggttgcagaggggccgacagtaagaagaaggtttacacattgttctaaaggtgttgttgcactcagagccacagattcccaagtcccctgtggtgaagcaaatgggtttacatgaaaaaagtactttcgttcatacagctactcaggacgatgctagatggggagagcaaagacctgtagttcccccaagcccctttttggtccatgagttgatttgtgaactggaaggaatgatgagttcttaaggaagatgataagatttaaaagttaaagaatcactgctttgcatgcatctgaattaaacaacagtggagctggaattattatgatacattactaaagacatgcaatagaggaatttttaaattgtaaatatcatcatgtatttcattggaaaatgctgggtatgcccatttggcctgagatatgcttcagaatatgatcaatgctgtaactcattctccactggactcaagctctgtaaaagcaagggcctggttgggttttctgtgctatatcccccagtgtctggaacatgtcaaacacctggagggcgctcaataaatatttgttcaatcaatgaatggataaatgatttaaatattactcatccactaaaaaacccatagatctattatatcatttcctccttcacttccttctttattccccccctctttttatccctggcctatgtttctcccaccctccttccttaaccctaaccccaaccttaaccctaaccctaaccctaaccctaaccctaaccctaaccttaaccccaaccctaacccatccatgtctttatctatctgtttgacctggtaacaagtagtttttaatggcaagcttctggaggagtaatgactaagaagtgatatttaaaatccacacatggaaagatcaacatattcattgatatcaaaattataagttttaggttgttaaaaaataaaaagcaaacaaatataatcacttgagaaaaattctttgcagggaaaaatgacagagttgttatttataccttataagatggtataaatcagtaaataaaacactaagacttgaaggaaatgtaccaaaaaaccctcacattttctgtaatattattattttccaattttcctatattttcagtaatgtggctattttgcttttattatttggaaagtacatttctagaagtgaagtacaggcttacccaattcaccctgtctgacgctcttccccagggggagcagctctggacctgaaagcctgtcctcccaaaccctatcgctggatccttgacatgacttggctgaatcttgtggagctgagtaaacttccacaatttgcagaaattatgaaccaggtaatacaataaagggctggttgaaagtgcagatctgcaaacccaaacatacctgggccgcttaaactggggcttcctggcagcaattccttcacccaaaaaagtcaacccaatagtttggatttgaggctctgtggctgtctgggagagatcttggacagatggacctcagggttaacctcttcatagttgcaggcaactatgttttcctcctgtgtggtgggcatgggtcatttttgtatgcctgttagagttgctgctggaatcagaaccagtagatggacccttttattgtagacgactcatgcttttacactttaacttctgcctatgattaagtgatttgtacagatttgaatgtgagtcaaattaagaggttgaggtccctctaaaaaattaattattttagtggtgaaatataatggtgaaaatggagaaataggtaccgatttgcttgttgtttttttcttatttgaaaatgtacattgattactgtggattaattgttgagtcaattgttactggaaaacaatcatgagactcagaataaagatagctgtttcttactgggttctgttggctgcaactgcctgtcactaatggagcctgcagtttcccagtgtcagatgccaataatcatctcttttctatggctgctagtgactgacagatggggccataggtagactgcaggttgtcagagcctcatgctgtaatcaccaatcccctgcccaacatactgtgttagctgcctctgtttgtttagtggcatttctgaaacattgtgtagactctacctattcagcctggttgggtctgagtcaattggataaactctctgggttccatctgtggatagacagtgagctttgttttgtagtacaaccacagatgagtcctccaagcccaaacaaatgcttggaaaaagaaagtgatcttgggctgggcccgatggttcacgcctgtaatcccagcactttaggaggctgagccaggtggatcacgaggtcaggagtttgagaccagcctgaccaacatagtgaaaccccgactctactaaaaatacaaaatattagctgggtgtggtggcgggtgcctgtaatcccagctactcgggaggctgaggcaggagaatcgcttaaaactgggaagcgggggttgcagtgagccgaaattgcaccgttgcactccagcctgggtgacagtgtgagactctgtcttgggggaaaaaaaaagaaaagaaagtgatctcggtctgatcagagattgggtaagggagatagtcaagaaccactggaaaaatcacttgaagcccacgccctctaatgatggtttatattgatacaaggatatttattattgtttgcctctgccaactaggttttaactactcatgaggtagaatatagtagctattactgcttactatgggataggtactttgcaacaataaccctgccacagaagggcagagttattgaccctaatttatagaagagataacagagattcaaagagttagttaagtacttgcccaagagcccattgccaataagtggcaaagctcatgctcttcccatgccatcatgagttatttctctcccactcctcttacaccaccgattgggccagaagtggggtgaggggcagttctcaggaaggttgcaaaagttcagcggagacctgcagtcaggtggccatcagtctggcctgcctgtgggaaggaagggaggaagcagaagatcaatctcccagctgagtggatgtcaggaactgaaatataatagagcagctgccctgaccttggcatcccaggccaagggtcaggaaaaggaatgagaaatggagatggacatccagaggctggaagtcatcttatcacctatcatggctgcagctcactttgaagctctactgtggtcaagtcaaaattagcaggtggaaagtcagtaggtgaagaatagtcatccgctttcttcctgtgcctcagctgcagatgtggaggaggcctgtgggggacactgtgggcaggggcaaggtagggctcgcaacacccaggccctggcatgcaggcatcttctttgagggcagccaaccagagagagctgctgcaatcttcaggagatagatggcagttgtgaaacatttcagaaatcctcttcttttttttttttcttgagatggagtctcactctgttgcccaggctggagtgcaatggcgcaatctcagctcactgcaacctccagctcctgggttgaaacaattcttctgtctcagtctcctgagtagctaggattacagatacacgctgccacgcccagctaattttttgtattttagtagggacggagttccaccgtgttgcccaagctggtcgcgaactcctgagctcaggcactctgcccgcctctgcctcccaaagtgctgggattacaggcatgagccaccatgccaggccagaaatccccttcatcttttagtgccccagggacaaagtgggagcaactgagttgcagaataactgttctgttattaatttatactctatctgtatcctgtatgatgaattgttcacaccacagatatgagactttggacagttatttaacctctctatgcctcaataaaaagtaggggtcatagaggaaaaagtgtaatcctcaggtctggcatagggcatctgctatgtgagcctttgctatttgctattactgcttactgtggcttttttattttaattttaatttttttatttttttgtttttgagggggagtttcgctcttgttgcccagagctggagtgcaatggcacaatcttggctcacagcaacatctgcctcctcggttcaagtgattctcctgcctcagcctcccgagtagctgggattacaggcatgtgccaccacgcccggctaatttttttatttttagtagagacagggtttctccatgttggtcaggctggtctcgaactcccgacctcaggtgatctgcccgcctcggcctcccaaagtgcttacaggcatgagccactgtgtactgtggcttttttaaaagcacacttacaaacaccgtctaaataacccagcctgattgttgctgaagagcagggataggctcaataatctatagttttcgtacttagtcttgatggaacttgggcgtcagtgagcaccttttaatgcctctgaaaacctgaagtccttttcatgcttctgaacaatatttaagaccagctgttggagagactcctttcgttattaggctttaggtctcaaggtgggggatcactaggaaaataaaagttttgattttgtcatctatcattatttttaagtagagatcaacatttagaggttgggttatcagaatggtctgtcagtggttctcaactgagggtaatctacccacccccaggggcatttggctgtgtctggagacatttttgattgttaggacccgggtggagggtgctactggcatctagtggatagggacgctgctaaacatcctacaatgcccaggacagcaccccccacaaaaaaaattcagatccaaatgacagtaataccaagcttgagaaaccttgatttgtgtttcttctggcccaatcatttggtgcagttgacacacgatcctaattgtagcgaataatgtagaaaaataatggaagaactggaagggaatagtaatatccaagttattcaagtcattgatcctgaagaaaggtttaaactgtgctgttatgcttgaaaaattatctgcctgtaaagaatgaccctctcaggtgattcagaatcctttgtaatatattccacttacatatagttctgtggcttgctaattggcttgcttcttttagatatctcgtaatgagaaggggtggaaaagctggtttgataaagatgctccagaggaggaaattatccctgatggatataatgattcactagatacctgccataaacttttacttatcaggtgagaacaggcattatcagacctagaagcatcactcataatattgctaaattacagattttatctcagtgagtttacttcactatatcactgtcattgaaagtaacggcaaaaaccgcaattacttttgtgccaacctaatattataagaaatgtatgtacttccaaattatggttttggatagcagttcttcagttccttgacaagcaaaataaaatggtgatggtgacagggaatgatgtattttgacaacgtattaatgatagtgcttttagcaaaaagcgtgaaaaatatgcttttaatattcactttgttcatgatttaccattgagtgtaaatcagttattgttgaatttatttctttaaaaaaacagacctcacaaagttacaagacaattagcttataagctaaagttaaattgcattcgagaaaaaaacccaataatattgcactgaatttgaaatatataaatgctacttttggctataaaatggaaacaaaagtttgaaattgatgttaaagaagaaaatcgccctctcttttcactgtttacattttctcagtatccagtaactcagagaccttccacattgaaaaaaatcagtgtgtgtgtctgcgtgtgtgtgtgtgtgtgtgtgtgtgtgtgtgtgtttgtatggtggatgggtaaggcagaggagtaaagcaggggagatgagacccccacatgaaaaatgagaggtagagttattttgaagcaattttttcttttctaatgttatacacctaagtttccacttcttagaaaaagctgtttcttagatattgtcacccttcaagagtgaccagaacaacgctaatgttgacctcatagtccgcagagtatgaaaaggcttttttttttttttgagacagagtctcactctgtcacccaggctggagtgcagtggcatgatcttggctcactgtaagctccgcctcccgggttcactccagtctcctgcctcagcctcctgagtagctgggactacaggcgcctgccaccacgcccggctaattttttgtatttttagtagagatggggtttcactgtgttagtcaggatggtctcgatctcctaacctcgtgatctgccagccttggccttccaaagtgctgggattacaagcatgagccaccgtgcctggccagggctacttagttttattggaacaaatgtgtcttattttttaatccgtcacttaaaaattagatctatgtcaaatagtgcaatctagtagcaccaaaaaaaaaaaagtctgtggggcttgtctgtgctttaccatatcaatattaaatgacacttatccaatgtgtctgtgtgtgtagaacttgctatggtgtgcactacacaaatggtatgccacaaatgcttgctgacccacttactttgggcatctttggcatattggttcctcctctgaaaaggctgtggagcttcagagtgtgtggcaggtcagcccctaccatgtgttggagctggtagaggacactgtgttgttatgggctctgccctacttcttgccaatgcctggctggtaccaaaaccacacgattaagtttgtgctcatctgtgataggaaaccttgccattcctcttacttagatgtggaaaagtaggaattaacttgttgcccttttgctaattaaatgtatgtttttacttactcagataggataaaaattgaacacgtttagtttatttcgcctaacttgtattcatttttaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactgggtaagactagcaatctacaaaatgtagcaacacttccatatttttttgccccaaattttgcctttcgtaattttataactgattcttagaaatagatgtaaaactgaattcgaaaaatattaaacttattcctctttcatcctttcatacctcctaaagtgagggtatgatataggtatctttgtttagagaagaacatgctcatctagcatatagtgttttttttttgattggttgtgttttaagttctaaggagatagctgtattgcatggatagctgactaacaagaatgaacacacaatagccaaagtttatgttattgccatgtctatataaaattacagcaaagtttattttgtcacaaattaaaaaactataaccattattgtaatgcatagtagttagggattaattatttcattgctttcacttaataaccattcagtacaggcagtgtgctagatctggggagcacagagatgaatacaacacagctgggaaagacagacacgtaaacatgtaattgaaggcaatgtgacaactgcagtaaatgtttcatagaagtggctgatcacaggattcagagctactcggattgcctggggtataggggaaaacatcacattgatgatatttgagtaggaaattaaaaaatagataaaatttaccaggtggggtggtgggagatagaaagttactccagggagaggagatgggaaagaagttataaacacagaagtgtttataagtgtgactgagtcagtaggattaaaggacagggatgcagagcacatcttgacaggactgagccatcctgtaagaaggactttcttgacaggactgagccatcctgtaagaaggactgtttatcccttgcttcattcatactctgaaaatcggaatgctgttgacattggcatttgcaatcttctagggtcaggtatctgtaactataccttgtagggttaatccaatcatgtcttttgagtattacagtgattgattatgaatcactaaatctatcctgtgaagtaaaattacattaaatttattacatagtcgacataagcatgatataaaatcaattcagtcatgtccacgtactagccacatgtccctctgcataaaaccaagctacggtagcatggtccatgttcatgttctcttttctcatcttgacttcactctatttgttgtcaccacactgttctatattctcagtggatcagtgttcaaatggccacggtcttctgtctgaacactgataccaatgcaaagagctcccaggttctattggcaactgctcatggttaagtctcattcgctatcttcaaagtaggcagttttgctctagtatttactgcagcacaccagccgtctgagtttatctcagagtgatgcctctcgagtagccttatagtttgcaaatctctctcaaatctgttgctctatgagtgtttatccagctgcctctaagcctcacttctctctgcacacaggtatattttttctctcttaacacttaccattcttctccacatggcagaacatgtggcttctagtggctcatgggcttcactgcttacgtgctcagaatgttcagcaccctcagggaaactcctcttattgtcatggttccaagttccaatatccagggaagtaactcattgtctttgctttggtcatgcactcctttctgggccaatcaatgaactgtcgctctggagataggttcctagtagaaaccttatgtacagagctggaatgggggacatttcttagaagatacaacgcctagaagaaggagtattcaactagagttaccatttcaaatgttgtaatttgagaacataattaaaaaattcaaggtctcctttgggagaaattataactgacattaaatgaatgcagaagggcagacttgtgttatatcctttagtgttatcatactgctttgcttggcaatttggtggtttccgtttcttggtcctaccttactttttccaacaacaatccaggcttctattgattactttattagggtactggaacaacatagatttggctttaacactgaaggatcaaatgaattttataaacaattctactgccaaatcatttgagcagtattaggaagtctcaggctgcttgctgctttgggttgaaagtcccaaagatagctgttaaaatggaactattacacataccgaacaacatgttaatgtagtctcagctattaatattttatttgaaaatctggataataaataatcatagaatgcttcaggtgaatgtgactggaaatcttgaaatccaattacttttttttttttttttaacagttgggggaaactatggtctggagataaggccccagacctagtccgtggcagatctggttcagaacttatctcaggaaccccacttcagtgatctcattggtctttctttttcattccttctcattgttttcattgaatgaattaaccagctacccgaaaataacatacggatgggacagaatcaataagtttttgtagaaaaagaggagaagggaaactttggttatagatattgtcttgtactggtcaagatctgtagtgagaaatttggagcagataaactctgcacagagtactgggtacatgggcaaagtggagaaagcagatgggtttagcacgagagcctttctaggagcctgactactggaggagggaggtctcagaggaaggatgggcttaaaaagaacacctaaaaacaaacgaaagagaacaaatacataaaaccccacaaccacacaaaagtagtagtgggaaaactgatataacaatatgtacagatgaaacattttaacattttaaataataagagaatggctcataattatagtaataaattacaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaataaattacagcatctcattaaaattggcaaatttatagaaacatatgaatttagaaaatttcctcagaaaaggtagaaaaccctgaataaaccaataatcaaggggagaaaaagtagaagttttaaaattattacatcagcaaaggctctaggcttggataattttctgataagtcctttaaaactttcaaggactctcatatgctatattctgttccaaaagatggaaaaagagaatacattttcctttttcttttgagacaggctcccactctgtcacccaggctggagtgcagtggtgcaatcatggctcactaaagccttgacctcccaggctcaagtgatcctcctacctcagccttccaagtagctgggactacaggcacacaccactaatcctagccacattttgttttctgtttttttgtagagatgaggtctcattatgtttcccaggctggtcttgaactcctgagctcaagtgatcctccctccttggcctcctaaagtgttgggattacaggcatgaaccacttcatctggcccattttcctctttatttgcattattctgaaacagtaaaccgacccagatagtaactgcataaaagaaagaaaactggctgggcatggtggctcatgcctgtaatcccagcactttgggaggccgaggtgggtggatcatctgaggtcaggagtttgaggtcagcctgaccaacatggcaaaaccccatgtctactaaaaatacaaaaattagctgggtgtggtggcgggcacttgtaatcccagttactcgggaggctgagacatgagaatagcttgaacctgggaggtggaggttgcagtgagccgagattgtgccattgcactccagcctgggtgacagagtgagactccatctcaaaaataaataaataaataaatgtaaggatcttaactaaatcacaagcaagatgaatttatagtgatgtcagcaagatgtctcatatccctccacatatccctccctcatatcccaccaccacatcaggaattctgtatccatctacagacaaagtctctctgcaggaacctcgggatataggtagaaggttgtgaaaccctattaaaatccaagacctaggagggttgttttgagagcacaaactgacacccaaatggcagatctgccaattgtgcttccaggttcaagcctagaaatggccctgctccccaaggagtttggctatagccctttttggccttgagcctgcaactaaaaccaactgccaagggttgtaggtggaatcaggcacactagtgtctcagtgcagaggctcgtctgcctgccaacatcgatcttggcagtgaacttgaaagttgccctgtggcttgtctccaaccaccctcagctgaggtcccaactcagagctaactgtgcaagagcccagaaggaggcttgctcatatctagcagactgggagtctgagcctccatgaagggctcatcaacctctgtaccccagcagataccaagggtgcccactgtcagctctggtccctcctgctgcagtcagggaactatcctacctgtgcagggatctactgggagatacatgcccttctgagccaatgagatgagctcttcagccatcatcctccagcagatcccaaaagggcccagtctcagctccagttcctcctgctgtagtcaggaaactaatttgtgcagagacctgctgggagacacactcccatctgaaccaatgaggtgggcttgccagctctgccccacgtcaagtcctgaagggctccggtctcagccttggctcctcctgctgcatttggaaactatcccatctgtgcagagacttgctggaagacaaacccatctgggccactgggacaggcttctgggcttgtgtccctgaccaactgtctcacacagttcaggcacattgtccctaaaaaacaaaacaaaacaaaacaacaacaacaaaaaacttgttataaatatcagattttttggtaagcctcatggtaaccacaaagcaaaaacctatattagatacactaaaactaaaaagtaaggaatcaaaacatactactagagaaaatcacttaaccccgaccaagggaagactgcaagagaggaagaatggaagaagaaaggatctacaaatcaactagaaaacaagtaacaaaatggcagtagttagtccttacctaccaacaattaccttgaatgtaaatggattaaaatctacgattaagagacacagagtggcttaatggattttttaaaaaagacccagctatatgctgcctacaagagactcattttacctggaaggatacacacagactgaaaatgaaggatggaaaagatattctatgcaaatgggcaccataaaaagaacaggagtaactatgcttatatcagataaaatagactataaaccaaatactgtaaaagaaggccattatacagtgattaagggtaaatacaacaagagtgcatgtgtgcatacacacaatgcacccaacatcagagcacctaagtgtataaagatatataaaaattaatatatatattaattataataaaagatataattaataaaaatgtaaatattaatagacctaaaaggatagactgcaatacaataatagtagggggcttcaacatcccattttcagcaatggacaaatcacccagatagaaaatcaataaagaaacattagagttaaaccatactctaaatcaaatggacctaacagacatttacagaacattccatccaatagttgtaaaatatacatgtttttaaacagcacatggaacattcttgaggatagatcatatatgaagccacaaaacaagtcttaacaaattaaaaaaaactggaaacctaccaagtatctttcttgaccacaatggaatgaaactagaaatcagtaacagtaggaactttggaaactgtacaaatacaaggaaagtaaacaatatgttcctgaataaccaatgagtcaaagaagaaatttaaaaggagatttaacaatttcttgaggcaagtgaaaatggaaatacaacacaccataatctatggaatacaacaaaagcacctctaagaagtttagagcaataaatgcctacaccaaaaaaaaaaaaaaaaaaaaacaagatcacaaataacctaatgttgcatctcaaggaactagaaagacaagaacaaattcaactcaaaatttgaaggaaagaaataataaagatcagagtagaaataaatacaatagtgttttgttttgtttttttttatgaagtcttgttgtctcccaggctggaatgcagtggtgagatctcggctcactgcaagctccgcctcctgggttcacgccattctcctgcctcagcctcccgagtagctgggactgcaggtgccagccaccacgcctgactaattttttttttgtatttttagtagagacggggtttcaccatgttagccaggatgatatagatctcctgaccttgtgatccacccacctcagcctcccaaagtgctgggattacaggcgtgagccaccgcgcccggccgatagaaatttttaaaagtacaaatgatcaacaaaatgaagtgatatatttttgaaatgataaaatcagtacacctttggccagactaagaaaaaaagagatatgactggaaaaaaaaaaaaacagagatgaaaaaggagacatcataactgataacacagaaatacaaaagatcattaaagattgttatgaaaaattacatgccaacaaattggaaaacttagaataaatggataaatttctggacaaatataacctaccaagactgaattatgaagaattagaaaacctgaatagccaataatgagtaatgagattgaatcagtgattaagtctcccatcaaaaaaaaaaaaaaaaaaaaaaagcccaggaactgatggcttcattatggaattctatcaaacatttaaggaagaaataatacctattcttctcaaattattccaaacaattgaagtggctaggaattttttcagactcattctatgagactagcattactctaatatcaaaacacaaggacacaacaaagaaagaaaactacatacaggctgatatccctgatgaacatagatgtaaaatcctcaacaaaatactagcaaaccaaatcaaacagtgctccgaaagatcattcacattgattaaatggaatgcagggatgtttcaaggtacataaatcagtaagtgtgatatatgacagtaatagaatgaaggacaaaaaccatatgatcatctcaatagacacagagaaagaactggataagattcaacattcctttgtgataaaaaccctaaactaattaggtatgaaggaatgtacctcaacacaataaaggtcatgtatgacaaacccatagctaacatcatactaaactgggaaaagttgaaagcttttcctctaaaattaggaacacaacaatgatgcctactttcaccacttctgttcaacatagtacaggaaggtctagctagagcagttaggcaagagaaagaaataaaaagcatccaagtttgaaaagaggaagtcaaattgtccctatttgtagatgacatgtatacagaaaaccctacagatgccaccaaagaattgttaggactgaaaaacaagttcagtaaagttgtaggatacaaagtcaatctacacgaattagggtttctatatgccgacattgaactatctgaaaaagaaatttaaaaagcaatcccatttaaaatagctacaaaaaataaaatacctaggagtaaatttaattaaggaggtgaaaaatctctacaatgaaaattattaaacattgatggaagaagttgaaaaggacacagataaatggaaagacatcttgtgttaatgacttgaaagaattaatattgttaaaatgtccatagctacccaaagcaatctgcagattcacatgcaatctttatcaaaataccaatgtcattgtttatggatagaaaaaaattctaaaatgtatatgaaaccacacaaaatcccaaatagctaaagcagtcttgagcattaaaaaaaaaagtttaaggcaccaaactacctgacttcaaaatgtactacaaagcaatagtaaccaaaacaggatggtagtggcataaaaccagacactaggccaatggagcagaatagagaaaccagagataaacccatgcatttacaaccaacttatcttcaacaaagttgcctagaacatgtaatgaggaaagatcaatcttttcaataaatggtgttgggaaaactgggtaattatatgcagaataatgaaactagaccctatctctcaccatacacaaaaatcaaatcaaagtggattaaagactgaaatgtaagacctgaaattgtgaaactactatgagaaaacactgaaggaaatgctccagaacattagtctgggcaaatatttttttgtgtaagacctcaaaaacaggcaaccaaagcaaaaatagacaattgggattacctcaagctacaaagcttttgcatggcaaaggaaacaatcaacatagtaaagacataacctacaggacaggagaaaatatttgcaaactatgcatctgacaaggtgttaatatgcagaatatataagtaacacaaacaactcaatagcaaaaaaaaaataataataatctgattattaaagtggacaagagatccaaacagacatttctcaaaataagacatataaattgcaaaaagatatatgaaaaaggctgaacataattggtcatcagagaaatacaaatcaaaactacaatgagatatcatctcaccccaatttacatgccttgtatgaaaaaaaccagtaacacatgctggcaatgatgtggagaaagaagaaccttcatacagtattggtagaaatgtaaattagtactttggagaatagtatgcaggttccccaaaaaactaaaaatagaactgctctatgattcagcagtgctgctactaaatacatatccaaaagaggtgcaatcattaagaaaactttgaaaggatttttttcattttaaatataaaatttaaaaaaacgaagtgaaatcagtatattgtagaggtatctatctgtactcccgtgtttactgcagcactattcataaaagccaagatatagaatcaccctaagtacccatcaccaaatgaatggattaaaacatgcggtacatatacacaatggaatactattcagccataaaaaaagaatggcattatgtcatttgtgacaacatggatgaatacggtgggcattatcctaaatgaaataagctaggcatagaatgacaaataccacatgatctcactcttgagaatctaacaaatttgatctcttagaattagagtagaatagtggctaccagaaactgagggagggtagaggggaggaagaatgatttctagtgttctagtgcacagtaaagtgaatagttaaccataatttattttttaaaaaaatatatagtccaaaatatctagaagagagaatattgaatgctctgaacacagggaaatgaaaattatgttgtgacggatatctaaattacctgatttgatcattacacaatgtatacatgtattgaaacatcacactgtacccataaatatttacaatcattatgtgtcaatgaaaaacaaaatatgactttgaaaaggaagaattcaatagaacatcaagaaataacttgcaaataataacgtgccttcaccaagttggaacacatgggcaaatataagaaagatgcaggattaagaaatctcatcacaacaataagagaaaaacttctccttaagctatcatactgttatcttgatgggtgctataaaagccattttataaaaattcaacacttatatttgacttttgaaaagtaggaacagaaggatattttatttatatgataatgattatgaaccccaaacatcgtgatacttattggcgaacaactagagacatatccattaaagtcagatacagatgtctgctattgccactgttatttagcattgtgttgtagaagatatggctaatgtattgaaagaatcataaataaaagatgtaactaccggaaaggagggacaaaatcaacattattcttagacaatataattgtctaacaaaaaatacaaatgaatcaacggaaaaactattagacttaatagtctaatagttcagtgaggtgactgtttacaagataaatatataaaaaatgatgctttcttgtaaaataagatgtaaaactccccttcattatagcaataaaaataaaactgagaaataatttttaaaatactcatttaaagaaaactataaaaccttcttagagacataaaagtagttagaataaatggagaggtaagccacattcccagtatagagattcaatgttgtaaagatgtcaatatttcctaaattaatctataaattgaagccaagtctaattgaaactcaagcatcattgtttttctagttggatagtagagggatattagagcttctagaattgcaaatggacaagaatagctaagaaagcttgaaatggaaaaaaataagaataatggggaaccagcaccaccagatttttaaaacattatcaaatgccaataattttatcatttacattacaaacattgataaatatggagcaaaatgaaagggccaaaattagactcttgtatgtacaatagcttaatatgtgataagatttgcatttccaatcagtggaggaaaagtgggttagacagtaaacaatgttgagatagcaggttaactttagtaaacataaaagttttacctcacattaaactctaaatgttaggtcgattaaggcattaagtgctttaaaataaactataaaacaagaaaaagaatatattcaattagttatatattgttgagtggccaagattttcttaatcataatacctgagtctaaaaccagagggacaagatagataatatgactggaagaattttaaaacatctgtatgttataaaaaggaataaaataatggcatttgcagcaacctgggtggaattggagaccattattctaagtgaagtaaatcaggaatggaaaaccaaacatatgttctcactcataagtgggaactaagctatgaggacacaaaggcctaagaatgatacaatggactttggggactggggagaaaaggtttgagggtgtgagggataaaatactacttattgggtagagggtacactgcttgggtgatgggtacaccaaaatctcagaaatcaccactaaaaatcttattcatgcaaccaaacacaacctgttccccccaaaacctgttgaaataaaaaaaatctgtatgtcaaaagcaccataaataaaataaaagcacaaacaaagaaacaaggataggtgtgtaggctggggactatagcattccacttcagtgggagacactgggagtcctttttctttttttttttttttttttttttttttgtaaaggacatatcatatttattcatacacatgctggaattattggtgcagacatttaaatacattttctttgagaaagtcctttttttttttttttttttttgatggagtttccctcttgttgcccaggctggagtgcaatggtgcaatctcagctcacaacaacctctgcctcctgggttcaagcaattctcctgcctcagcctcccaagtagctgggattacaggcatgcaccaccacgcccagctaattttttttatttttagtagagacggggtttctccgtgttggtcaggctggtcttgaactcctgaactcaggtgatctgcccgccttggcctgccacagtgctgggattacagtcgtgagccaccacagctggcctgggaaagtccattcttttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccgggcagaggggctcctcacttcccagtaggggcggccgggcagaggcgcccctcacctcccggacggggcggctggccgggcaggggggctgaccccccccacctccctcccgggggggctgacccccccacctccctcccggacggggcggctggccgggcagaggggctcctcacttcccagtaggggcggccgggcagaggcgcccctcactgggagtcctttttcatatgttgtgaattttaaaaaaatgtttgaatgctgtatccaaactattctccatgtatgaattcctcctaagaacatattgagagacatacatccagatttatatacaagggtgtttaatctagtgctatttataatactgaaaaatcaaaaatgtcttaaatatataaaaaggtattgattgaatgaacaagaatgcatatgacatgatggaacaccgtgctgccattaaaaactgttttctgataatatttgatgacagtaaaatattcacgacatactgttgaaacgtagagatataaaataatgtatagtccgggcatggtggctcacacctgtaatcccagcactttaggaggctgaggcagaaggatcatttgaggtcaggagtttgagatcagtctggccaaacatagcaaaaccctgtctctattaaaaatacaaaaaattagtcgggcgtggtggcacatgcctgtaatcctagctactcaggaggctgaggcatgagaatctcttgaaccctggaggtggaggttgcagtgagtcgagattgtgccactgcactccagcctgggcgacaaagcaagattctgtctcaaaaaataaaataaaataaaataaaataaaataaaataaaataaaataaaataatgtataatacatatatgcatatatacattttaatatagataggtctacaaacccttggagtcagatatgtttcagaaatcagaatgttctggtttttagaaggtgatattccatatattatataatacactgcagctaaggtataaatattcaggaagatagggataaataaagactataaatagcctcacatctgtttaggtcagcttttgcctccaaaatgatttacgattttcagagctttctgaattttgaaatgaaggtaagggattgtggattatgcatattaaaaggattagaataaagatctctagggaggaatattggtgatttttatttccttctttatatgctcctgtatttttcaaaccttttaatgtgaacatatattatttaattagaagtaagtccaaaaaaataagaaaaagtggaagagacacaagcctaattttggaaaggaatataaaggcagtcaaaattttactaaagtctttcaaatacaaacaattaaaacaaaacctaaaccaccaaagtgtaattatactgtatcacctgcagcaacacttcctccaatgtttcctgcatacacgcttctcttgagagtcccccttatgatatcttggcagtctttgccccccacctgtaaaaactcagcctatgctgtttcttgtctcattggcccctttccttccttgcgtgggaatgtttctcactttttcaatgccaatcaatctttttcttccccaggccactcagaaaagatataaaatatttatcaccttatattaaatgaagaaagattacaaattaataacaaccttccacattaagaaacttagaaaagaagagcaaactaaactcaaagcagtcaaaagaaaggaaataataaatatgcgagcaaaaaaagccagataatagaaaaacaacaaagaatcaagaagtcaaaggtatcttttttgaaagatcaataaaactgacaaatatttagctaaactaaccaagaataaagaagagaaagtgaagattactaaaatcagcaatgaaagaggggcgtaactacttacccaaatttaaaaactcctaagggaatactgtgaacaattatgccaacaaattagataacctagatgaaatggaaaaaatattagaaataactattgaaactgactcaagaagatgtagaaaatctgaatagagccataagaagtatggagatttattcattaatcaaaaaattcacacaaaaggaatcttagtcccagatggcttcattggtgaattctagcaaaattttaaagaatagcactagtttttctcagcttttctaaaaaataaaagaggagggaacacttttcaacccattctgagaccagtattaccatgataccaaatgcagacaaagacatcacacatagaaaaaactacagaccattatcccttaggcacatagaaacaaaattctcaacaaagtattatcaaaccaaatgcagcaccatataaaaacattatacactatgaccaagtgaattaatcccaggagtatgagattggttaaacatatgaatatcaatcaatgtaatataccatattaatagaataatagacaacaaccacatgatcatctcaacagatgctgtcttagtctgtttgagctgctgcaacaaactaccatagactgggtagcttataagcatagaaatttatttctgatagttctggaggctgagagtccaagatcaagaccttggccgattcagtagctgataaaggccggtttcctatttcatagatgacttctcattgtgtcttcacatggtggaaggagggcatcttttataaggtcactaatcccactcttaataccttgtcacttcctagtaccatcactttggggtttaggtttcaacatatgaattttaggggtacataaacatttagtccattgcagatgcagaaaagcattgaaaacattgataaatatggactagcaaactaggaataggaggaaattttctcaacctgataaaaggcacctacaaaaaactcacggttaatgtcacacttaatggtaaaagactgaatgccttctcccaaagatcaggagaaagacaaggatgtctactcttacgacttttattcagcattgtattggtggttctagatagggcaatcagaccaggcaaagaaaaaaaaaaaccatctacattggaaaggaagaagtaaaactgcctctatgattgtgacatgaatttgtgcataaaaaattataagttgtttaccaaaaaacaattagagctaatagatgagttcagcaagattgtaggatacaagatcaatatttaaaagctattgtatttctatgcactagcaagaacaattcaaaaatgaaatcataaacacattacaattcctttacaatattattaaaaataaaatacttaggaataaattcaataaaagaagtggaagatttgtacattgaaaactaaaaaacatcattaaaaaattaaatacctaaataaatggaaagacatccagtgttcatggatcaggagactttggtaaaatgccagtactcatctaatagatcaagagatttaactcaatccctataaaaatcccaacagccttttttaaaaatagaaattgacaagacgatcctaaaatttgtatggaaattcatgggacccaagataactaaaacaatcttgaaaagaaagaacaaagctataggacttatgcttcccaaaatcaagacttactacaaagctacagtaattaaaacagtgtgatatgggcataaagatatatatcattgcaaagaatatatatctcaatgcagaattgagagtccagaaataaacccagccctcacatattatggtgagttggttctcaacaagggttctaagaccatgcaatgttggaaaagacaatcttcttaacaaatggtgctggaagaactgatatgcatttgcaaaggaatgaagtgtggtttttacatcacaacatacacaaaaattaactcaaaatcaatcagagacttaactgtaaacactaaaaccataacatacttagtaaaaaaaataagagtaaatctttgaggccgtggattaggcaatggttttctagatatgaaaccaaaaacataagcaataaaaggaaatattgataaattggacttcatcaaaatgtaaaactttgtgcttcagagggcaccatcagaggacaacctataaaataggagaaaatatttgcaaatcatacatctgttaagggtctagtatccagaatatataaagacctcttacaactcaacaatagtcaaattacccaatttaaaaatgggcaaaggatttgaatggatatttctacaaggaagatgtacaaatggccaataaacacatgaaaagatactcagctttgttagttattagggaaatgcaaattaaaatcacaatgagatatttcttcattcccactaagatagctataatcaaagacagggacaacagcaagcattggtaaggatgtggaaaaattagaacattcatacattgccaacggaaatgtaaaatggtgcagctgctttggaaaacagtctagcagtttctcagaaagttaaagatagggttaccacatgactcagcaaacttgcctctaagtatatacccccaaaaaactgaaaatatacatccacccaaaaacttgtatgtgaatgctcatagcagcattactcatactagctaaaaagtgaaaacaacccaaatgtctggggctgatgaacagataaagaaatgtggtatatccatgctgtgaactcttagtcagccataaaaaggaatgaagtaatacatgctacaatatggatgaaccttgaaagcatgctaactgaaggaagacagacacaaaagaccatatattgcataattccatttaatgaaatgtctggaatagagacaaagtagattggtgattgctggggtgggaagggggaatgggaagtgactgctaatgggtatggggtttcttttggggttgatgaaaatgttctggaattagatgatttgatagtagtgatagttatgcaactctaaaaacatattttaaaatattaaagtatacactttataatgaagtatatatttcataatttatatggaaattatacctcaattataaaggttcagaaatatatatttattgagcatctactgagtgccaggcactatctaggtgctgggttggccaccatgtctaagtccctagctgatattctagactggggataaaacagacagttattgataaacaaggtagtacataatatcctaagaagaaaagtataaaatatgctaagaagcaggggaagggacagagtgatgggagaggtgtgccgttttagatagaacaaggtccgtcaggaaagtcttgctgacagggtgagaaaaacctgagatgtgaagggagtgagtctggaactctgaaggagggaacaccaatgaggctggggtgggcctggggaggaggctgttatggatggaggaaagtgaatggataggggggtggtgagataagaaaaggtgtgtgtgggggggagtggggggtggtgtgtggcagcagtagcagggactgattgtgtagggccttatagtctgtaaataagaactttggtttggattttggattttgccttggatgcaatgggaagccattggatggttctgagcagaggatgaacataatctgatttagggcttgagagacccctctggctgctgtaggaagaatagctagtagaggacaagggtggaagtgaggttgtcaccagttaggaggccattccaagaatctaggcaagaggtggcagtcacttacaccaggaaataaaagcagagttgggaaatggccagattctggatatgaagggatgcctctaaatcgcctcttgacccaatacctggatcaagcaacaactgtcccagggccacctgaacgaaaactagaccttccttgtagaaggtgtgtttcagaggagttggaagaagacagagaggctgtggctcacactcatgtgttaatactttttgagcctatcactttccctcattgatctattgaacatttgtgtgttcttccgaaataagtggggctcgatatctatccacgatccagaggctcctcccattcaagtcacgcctctcctttcttctgcttttataggctgggtgggattcttttcaggtgccagattccccttaggagctggaaagattcatgtgggctttggtgggaaaatccacctttgcttgttaatacttggcccatttcaattcctgattctccaagcagtgagtgctcttccatcctccttcaggctctcattgcaaagtgtctccctgtgaccctgagcccacgaataatccctaatcttgcaccctgcagaccctctcagaatatctggccattaaccacaggatgccatttaaatggtgtgtcctgacagtgtctctggtttctgacatacttccctccccaccccatgaagtctccagcttcttatagtctctaccagcagttaccataaacacacactggttcacaatgtctccattgattgcttttccttgtacagggattatgcctctagaactcaagaaaatttgggtccacaagggcttgcttaagagttaatttccaattgcagttgtgcaaacatgattctcagacttcttcattttagctaattcatgtgggaggtcacaagcatggttctctgcctgggacatctggtcctaaatggtgtattatctctggaattatgacatttctcatcgtggagtgttttcatgtttagttccaaggtggtgatttaatctgaggagcagctgagaactaggtcttagacggttgcccctgaatgtacccgtcacagggctgaactgtctcaaatttcatctcagaaaaatgatcaaacatacaaagaaaaccaaaacaagcagacagaaaacactgtgagcctgatatctaaaaggaataaacagaaaattaaatctttacagaagcgtctgctaaaacgccgaaaaggattctaaccaaaacttacagcaaaactaaaaaatcctttttccctacaaatacctgtgatagcattgtagttgcctctcccaccattgatcttgttcctcattgtctccaaagaatctcaaactctctaaaagcccaccatacgtgcctttttctctcccttcctgacccccaacccacgcttttccgggtggtgcctccaggtctctgctccatgcatttctctgatccacacaaccaaaggccaggcctgtttgaacagcaaagatttttttttttttttagaaacaatagaaggaggctataatcattcagaaattaatttttcattctaatcctgctgtaagagttgtgtttcatcatagtgaactttctcctatgttacagaatgtagaactatctcaatggggcaaggacaagaagtacatgctcgaaagctgattcagatgtcaatgcagcaggtatgtgacaagagactgctcctgctgcaacattattgctagaaaccccacaatcatggatgttaccacattcttctcgtgatgctcaatcctggtttttccatttttgtttatcattacctgtgaattttaaacctcagtctagtttcctcctgatattcgcatggaaagcttattccattttctatagtatatgctccattttaccttcaccaattttttgttcgttttatgatttgggagacacaccttctgatttctaagaatgcatctctagcagtcttggaatttcatgatcaatatgaataggtagtacttaaggagtgacagattgagacagttaaatttccattttcagttaaaggcagactttcatttttcattaacggatcatttcaggcaaagaaggaatatttaaggatgctatgtttaaatactgataatggttttcactaataattgcaagctgaatggagtgttgagagagatttcccatcacacctaataaatacacaggacattaattttctagaaatgctctgtagatagccatttcagctgtaataagaaattataccatttataaaaataaaataagatattggtttatttttaagcttttgatctcagaatgtctgtacaaactttggtgcagcttttccctgggaattaatgactagagagggttaatgggctaaaactctgttgggtcatcaacttttccagctagtcattaattctcaaatgccctaagcctcaatctttatcacttaattaaattcaataatttatttaatttatacatgtatatctcaaagcaattatacataattatttttactcggatcaaatgtttcactctattgagtgatttgacagtttaactttgggccttaaataatttctttagtttctgtgggtgcaaaactttaatttaaatacggtgttcatgttaactgtctttggaatactagcctttataacttccatggtctgtttgtcaaagtggggtaagtattgattatatggcataatcagaaaagaaaaccagacatgagcaggtgcagccatgttgccgccttgagggacaccatgtttagcataaagctggcattgtggaacacagagtggggaaccagaaagtaagtgggtccatgatgacacaaactaatcctgaatgctgttttcctctgaaaccccagttgtatagacggcacatcccctttactagttaagccggtgtgagttgtattttcgcttacagttgagacatggtatatatgccttgccatatatttatcatgctcactattttgtagttttatgtagttcaagatagctgattcctgtataagggtattaaaatgtctagtaaagaaactatgttctcacagggcagtgatggttttgtgacatattgtttaaggtagtttgtttaatcaagtatttatttagaaagtgcttaataagttatgtggtttcaggaaagtgtggagagtgatgataaagaataaagcttagcattatggtagtaaatgtcaccaaacgtattgtctccagctttcatgagatcatgtgtatctttctttgtaactatgaataactgtgaaccagtcttctgggttttgggggtgagtcagttctgatttaccttaggcaggacaacttgttactgattccaaaatacccgttcccaccattagatggtgcacacactgtacttacacaagtctgccttcaagttttaatttctgttcctttctgaaccaggggtggcagaatacaatcattttgaacccacttgattctaagtaattagcttgtaccaattacttgtaccatagcaggagaaatgattgtattgacatataatttttaaaaatgtgttcaaaacagagtattcacatggtttttaaaaaaagtgcacattttgttttattaaaatcatagcaaaaaggttacaagaaataaatatgaacttatttttggatacagggtggttgggtattactacaaaattgccaccttggcctggaattcatggaagaattactagagacgctaattaccactgaagccagtgatgattctttccgagtatggataactacggagccccatgatcgatttccaattacattgcttcaggtttgttactaaacgtcttttcatcgagagtcatagtaataaagatgacatcattgacattgttgaaagatgggaacacaacagggctttttggtcctgtagggtctggactgcaagatcttatactataatactataatcatcaaaatcttgacatcaaggttagactgtagtaaatatttccatagaagagctctaagacttagtactaatttattgagtttcagctctgatcaatgtacttagtttatacaatgctgaactttgcccccactttatgtaccataagcatattgttttctgatatacaggttgagcatcctaaatctgaaaatcgaaacccgaaatgctccaaaatctgaaacattctcaatgccaatagaatgctcaaaggcaatgctcatataacaatttaatgctaatattccaaaatctgaaattcaaaacacttccagtcccaagcatttcagataaaggatattcagcctaatattgtaatttctattttattctttatagtaatttatagaaacaaaagcactgttttcttttcatgacagacctctctcaaattcactaatgagccaccccaaggtgtacgcgcaggtttgaaaagaacatttgctggaattaatcaagaccttctggacatcagtaatttacccatgtggaagccgatgctttacacagtagcatttttacactccactgtgcaggtaactgcagaaagcagttttcacatttaggagatggccagtggtgtgctgaggccccattggagaggcttccaggagggtgctatccgttgccgctctgtctccttactctcttttccttcatagcactttccccacctggtatagtgtatatttgtttatgtattttgtgtgtgccccctgccccaacccccaaccctgactattggaatgtaagattctccagggtgaagactgtcttttcgtaactgctgactctcctactgtcacaacagcacgcaggggattgtcagagctcaataaatatttgtagaatgagctaatggattataaagataggagcttggttttgaaagtgcctgtgctggccaagaattttatgtgcaccatctcctgtaatactaacaaccacatttcaagataggattatcaccatcccaaagatgttaagtactcttcaaatgtggttgctaggattggctgaactaggattggctggctctgatttatgtattgttttgactctatttattacctgatagtaaaagtggtggtgatgttggaggaggaggaggaacagcagctccctgtctttctcaagtcatttgctgtttgcttttacagtcttagtactgacgcagtaatttaataattttatgattaccaagcaacttgtctgttacgattttttaaattattgttagtgttttgttctgcatctgaattttatattttgttctgtaattcaaaagctatacattttcaatgcactggatccattccttgatttcacagagaattgaagagattcctttaagccctacctggagttctttctttcctggggttggggtgaaggacaaaataaatcagttggtctatcccaggagtcaggcttttagctgtgtacagtgatgggcagaacttcacattacctctccctgccctgtccaaagatggaggggaacttaatgctcatcccagaaaatactgtgtgtatttacccctaattcattatccctaccactttactaggttcctggctgcccaggagagggatgtggtgtttgtctgcctcccaacactgagaaagttaaaatcagattaaatgctttgctggtggttatctttactaagttccattgtggcctttggattgtcaattacagctttcaagtcacagaagcctatttcatacattcttatctgggaattgttcgctttgctagaccttatcacatcctaatacaaatattgctttaactctgctatttcattcccaattcacaaataatattttatgattgtgttcccagtagtgatgattcaactcttccactgtgcttatcatggagagctggttgggggtatttgccatatggttaatgtggcaacctgtgtttttagtggccattatccaagtgctaaagggaagaagagcaacaggaccatggtccagccatggggctaaagtgcccttgcacttaacaccacatgtgtttgggttaaaacggaggaaaaatattttcactgctagggcggtgaagttaccagtggagtgtccaggaataaaaggctgaatatctcttaaaatcaaataatagagggctagaaataacacttcactaagagtcaggaggcctggactttcgtgcttgctgtgaaatcagttagctgaaagcagttagttgatcaagttatgtctctctcagggcttctgtttccccatctgtgcagttagaggcagaagtaggtgatctttcaaggtttttttcaatttctaaaattccatcgcccaattctgtgacaatacagtgagtgtaggtaattctttttcatcaatttcagaagtgtttactgtgatatttccaaaatctcctgggaattttagacatatgtttcagaaatatcacagaagtgtttgctgtgattttgtgtaaatattttttttacttggttaggatagggacagcttgatagaaaaatccaaaattcttcagagacttgttgtcttgggccagaagcatcaacatcacttgggagcttgttggaggtgcatgtcagatctcgcctcagactctcctaaatcagtctgcattgtaccaagatacctacatgatttgtatgcacctgaatgtctgagactcaactgctataggaaggaatgttgtggattagattgtttgtgacttacgtttcttttctctctctagtgttgagtataagagccaaacatctgatttgttaattgattaattgagtcctccaaattaaaacaggtatccgttgctttaaacaaacatgttatatgtacttttgttcttgcagagacagactgaaaaaagaattaggcacaggatctgaagctccagaggggttcatgctggagttcatcccacattacaatgcagaacccaggagtaaaatagccaactccctgcctgctctccagtaaaaaatgtaaattctcccttggaatcctggtttgggtggcattatgccatcagcttaccccagttcataggcatgatatgtggattctacttcagttgcagggaacaaaatgagcacctctccttttctgggagaaggggaagtaaatttggctggtcaaggataacttgggcagaagagtggtggagggcgtggtttgctttattcttgaggtgggagcaggctttcccaggaggagggtgccctgggtgctgccatgggaacatgcatagatgcacgaggcaacgccgcactaagctctgctccctgccactccccttctcctccagcaacttactatccacacagagcagtagcagctaccctgagaggggaagttactgctgaagcccccacccctgctgcagtccagtgatgtctctgcttttgccagtggcccttctgccttccttatgggagccttttattcccaggaccctggtgtgtgcctgggctcggtttggctgccactccctgagaatgtttcagcatcctcttgaagattacttaggagggaagcttctctctggcctcggtattctgtctctgtgctttcctgggtggtgtagcatccagtgtagcatcgttctgggcttgagagcaagcccacattcaccctttgggattttaattttaagcacattttcctccaaagtcttagtcttttgaaactcaatcattacatttttagccacttcctaacacctcctgcagaagatcagaataatgttctatgggttatttttttcctattgattgtcaatgtgccactctttgaggtgtgtattggaccgagtaaatgtcttaagtggtcttctcagccaattatctacaattgtcttctcagccaatgcctgggccccagaacaggacacttaagtcaaaatccccaggaggccaaaaggaaggagctcagtctttttaaaaacttccaagtgatcctgatatgtggcaagaattgaaaataatggccaaatggccacaacccttaagggaagagtcttgaaccacttttacatccatttcatagtctggagtttttctccccatcaccttggtttgtccacattgaactgcgtatttctttatgacttttcaaacagcttatatataactctgtgaggtgaggtgctcttttctttttcatttttcttttttagctaaagttattgattaggatctctaagggcctatagtggcagttgcaaacttggaaattctatcgtggcccttaaaaattacttagatagtaaataaaaggggccctatcaatagggcccagggaatctcactattaacagttcttcattcggaaaagtgtttgcttcccctacatttcgttttctttctcaagtttgagccttgataaacattcctttcaaatttaatagtgcatataaagttcttgctttggggagagatggttataaaattcttcatttaaatgtctttgaatgattatggtaatatgatactggtttatcttttacactctgccccatagtgtttcccagaggttctggctgcttctgtcaactatttttacctagtaaagtttcccttacattgtctagtgtggcttgtatttttctttgtatattagctccagttattggagttagacagttaactccagttgtctggttttgaagctgtgaaatgattctgcagctctgtgggaactgctgaggtagaacctaacgtaaaattggaaatggctctgacatcattaaaatgattgaacaacttttcatcagtgttctaaggagtttttcatgattccacattttccatatttctctagtagttcagagttttgtatattctgtgaaatgaaaagaagaaactgtattaatcaaattaagtagggagtggactggttttcctaaaatcatcagtcaccatcttaatgatggacagtcctctcccttctgtcgaatgaagttttaacattcaaatttgtctgcattccatgtcttgaagcacgtgaccactgagttgctgctactcaccagaactagcccgctactgcagtagaaccttctgtctgcagcctttttctccacaagtcacaggatttgtgttcctagttttgctcatggcctttgccaagcctggaagtctcttctctcctccttgtaaagaccagcttcagttttattcttcccagaagcctctgattgaacgtctccttcaggcttatcattgtgaaattttgacagttaattatattcactatcccattattctttttcttgtctccaagtcttatttttgcaacagattaaaacttcttgaaaatgcatcctttttgatattttttattgtattgcataggactcatcccatggtttcaaaaatgttaattaaactgaagaaattcaatattccaaataagtccagcaaaaccccttgctttgatcttccaaatgagttcttaggttctagttgtttgagtctatcctgatagtattccaaggtaatttaaaaaaatagcaagaagatgaaatgacttcatttgtgaaagaaaaggcacccactaagattttgggctttttttcccaagatgagctaatcagtttatgactttagtgaaccaacttaaaaagtaaatgctttagatgaaaattggtagtaagaaatataaacatgaagcaaatctcagcattagggcaattttcaaaactcacattttaaagaacaactaaattgcagttgctcagtgcatataaataggagtgtttccatagagtcaatttgagcagctttagtaattggagttatttttcatttggccacccatctaattgaacattaaaatttaaaaattaaatcaaacacataggtaaaactaatggtataaattctgatcctctttttcaaaaatgggaaaacattcacatttcactaataagtcattagcattcttctcttcaaagtcctcaagatggaagaaattccaagaactaaaacggttagctgtatgaattttcatgttaatatcccataaccctctccacccacccttgctcctgggataatctggaagaggctcacctcaatgtttctgagtccacttcagaaattccaaacactgggtgagcctcagcattgacctcttacagagaaagggttccttttgccctggtaataatcgaccagtgtttattaggcaaccatgattctttcccccaaggtgcaaaaggggagacaaaaatagaagacgtgtttttcactgtcaagactcaaaatctggttacaggaccacatatatcaatatgaaacatcttaaaaaacccacaaaacaaaaaccaaggcaacatgaatgctgggactaggaagcaggaagctgtcaagagaagcaatgttagggaccaaggctcccacccttgcacctaggaccacacagtctctcctcccttccaggctatggcctctgctcctcctcacctcttctaagtacagggtggaagatggttcttcacagctcctgagtttacaagttttcctagtctaagccccagataacaattacaaaccctaagtccaaattcctgggagaaggggtctggtcagttctttttgggttggctgtctaccttggatcaaattagctaagggataggtgtgggtgtcacatagcgcaaatctctaatgcctgacaaccttaactaaagaagtttaggtctagaggtaacagtagtactttacgtttttaagagctactcctattattattattattattgttgctcttagtctgatctcccagggtcagaacatctagacccaaattaatcttaatggtttactaaatactttaaaagcataccctgaaactcagtaattcaaacctttgaattttctgaattccttctctgacttgttcatgaacttgtcccaacaaaaatttatttagatttttttttaaatggtggaattattcaggatcggaatcatggaacagctgcagcaagaaggattggaatggcttgtgaaaacggcagtgtgtgtgtgtgtgtgtgtgtgtgtgtgtgtgtgtgttgagttggggaaggcagaaaagaaaaagaaaagttagtatatacttagaggtaaaagagtagaattaaacattcccatagatgtatagggattctactctccacatgagtcctcaccttaggcactagaattagggtctaggaactaatctaataaatccctggcccttccttagagactgattatgtgttgcgataggaaaagctgatgccatagaaacatctggactcatctatgtgggttgttggatcatcagttcttggagctatcaggtctaatacttgccatacctttaaaatgctctctggaatatcaaaacaattgaatcatttgctctgagtccagtttgattatttattggtgatttgacaattgtaaacagttagccactattgcacaggagtctcttaggccctctttgattaagtagagggaaacaaatgagggtcatgtgaaagtttcaagacagacacgtcatgtatacaacagaaatttttagttttcaaaatctgaaatggcaagattgcaaagggaagccatcacagaatctaagtgctcttgagagaggtttagataatccaactgaaaaaattcaaacccttgcatttgacatttcaaactttcaagagtccattgtagaataacagttcattcaacaggtatttgttgagcatctactgcattttttgagttgtcagtggagacctagactttttttaaaacccaagaactccaacttggcaaatctttggagatttctttatataaaccccttagctatagagccatgaagtaatatttctaatatggctatatgccacataacgtttcagtcaacatggattgcatatacggtggtggtcctgtaagagtataatgtatttttactgtaccttttctgtgtttagatgtgtctagatacacaaatacctaccattgtgttacagttgcctgcagtattcagtcccgtaacatgctgcacaggtttgtagcctgggagcaatagactacatcatgtagcctaggtgcgtataggctgtaccatctaggtttgtgtaagtgccctctaagatgtttgcgtgaggaaattgcttaatgatgcatttctcagaaggtaaccccatcattaagcgacatgaatgtatatccaaaattgtatatactattcttttaaactaatgtcaatttattttgataatatagccttaattttactgtattttgatagcaataaaaatggaatcaggtacatgcaatacttacttttctttggtgtttttaaggagcgacgaaaatttggccccttaggatggaatattccctacgaattcaattctgctgacttttcagccagtgttcagtttattcagaatcaccttgatgaatgcgatattaagaaagtgagtgaaattatgccttttttcctgtttttattgctcttcttaaatcagggttctacagtcatttgaagtctatgataaggtgtgaatttgctgagccccatggagccccctttgaagggacttgttgctgtaatcaggcacttgctggggcagcctgtccctgcccccaacactcacatacctctgaagctaactaactcagtgtgttgcaaaataccgcagccttcctcatgttacactcagggaccacagtgcacttcaagagaaggtgtgctttaggtcaagcttctcctcactggtcctactcctgcctcctcagaagtgaagatggtatctgcctgcccatgcgaaagttctttctcaccttaagtcacttcttaactgctcagcttatgcatatgaataacaatactttctagtaatggtcattcatcatcatatgacactttgcagttttcaaagttctcatgtgtgcaggatctcacttttatcttcacaaccctgtgagatcaataaaaaaggcattattatttatttatttattacccattttactgatgaggtaacagacaggagagactaagagacttcctcaaggtcacagagctgagaacgtaaaatctgttgtcctttcacacatataaagggttggaaatttgttttttctataatctttggcaagttaatgagccttaaagcctgtttcctcatctataaaatgaacattgtttctgtgaggaacgaatgagttagtatttgtgaaagcacagtacacagtacctaataagagctcattcaatatgactctctgcagtctggccccctcttcttccacagagtagggcttcaaggtaattagagattctgaagcttccgtaatggggtggtaagccatgatgagtgtttactctagtaccaaaccgtcatttttccttgaaatgacaaagggatatgaaattaaaagtaaggcagtctgatgaaaagttatattctatgtgttcatattctgtggtcatttatcattttggtacatacaaataatagttaccttaaaatagttgctttgaaaggcaaccaagctgaaaaataaaattttaaccaagaaaaagtaaacaaaaagcaaatatccttatttctcgtaactcaaatgtatcaagggtttaaagaaactgctaaactgcaatatattgctagtataaaattgctatagaaattaataaatattttgatgtagttttagcacatagaatgagatgcagaggatggcagaggattgcattgaggaaaaatcttgtggataaataattttcttgttgttctcgtaatgattccagaaaatacattactaagaaagcgtattaaagcaatgattacttgatttttctccttttttcactaaacaccactttcctcctctgtaacagcttggcattactacaatgagtattataggtaattatatccccagagtgaaaattagtctttttccctattttaaataatatacgtgcaatatacttaccagtgtttagtattgtagattttttcttggtgaacaaactgtagtggttccagccatgtaatagtgaaagagttattaatataagacgatgaataattttaaatgtgagtctagtgagtgcttccttttccagacctttcctctagggaaagacccgaaatgtttataatgatgtgtttgggttgacaattaataatccttttttacttttaataaagggtgtatcatggaatacggttcggtacatgatcggagaagtacaatatggaggcagagtgacagatgactttgacaaacgtctacttaattgctttgccagagtaagtcaatttagaaaaataaagtttggagacacatttcactgtattttccaatttttttgtttgtaataggtctgccaaactcaagcatacagcagagctgctgcaaagaattagccaagaaacaaatgcatgtgtgcgcttacacacacgcacacacatgcacacacacacacacacacacacacaacaaccagcaattgggccaggcatggtggctcacgcctgtaatcccagcactttgggagactgaggcgggcggatcacgaggtcaggagttctagaccagcctggccaatatggtgaaaccccgtatctactaaaaatacaaaaagtagccgggcgtggtggtgagttcctgtagtcccagctacttaggaggctgaggcagaagaatcacttgaacctgggaggcggaggttgcagtgaaccgggatcgcaccactgcactccagcctggtgacagagtgagactctgtctcaaaaaaacaaaaacaaaaacaaaaaccaaccaacaatctacttgtggtgcagagcagagcagtggtcagttctcattgctctataactcctttcccatgtagatgaaactgcttgtgcccagggcctctcccccactgcccctcctccatcttccgcattcctgtgcacctcacttgtgaggaaaacactggccatcatttctctgcctctttctctgagtgaaagtcttatggtgatttcaagccccaaaataagtgattgggggattaatcataatttgagttttctcatctcttctattaggatagacaattggaaattgaggaagtgttcactttttctctgtgccaaataaaatccacatataacatgctgataaatattttctagagaaaattgtttattagcaattgtggctttcacatcaaggatgaatgtaataaataacacctaccagactcaaactcttcttaaaatgttttacattttagggaagtaatatataacacctaagtgagaaaaaaccagatgtcttttatggttattaaattctttatattggaacctataccggtaattctctacttaaatgattcttttttcttgacaaaattaaagcctcaacaacaaagcacaagctttgggagtattttgataagctgggggttgactagaaaacggatttttaacctttacttgttttagcaagtttttcttgaagctacatatggagaactgtgaaaaataataagtgttggtgagaatgtgcggagggaggagccctgctgctgggaggtcaaatggacacagacctcctggaaagcagtccagtaatacttactgaaattaggtatctcaggtagacatatctcagaacatttctagaaagagtccacaaatggacatgtacaaaaatattcatggcaacattgtgtgtggagctgaaggcaagcatcatagatggttttcctggaagcagaggtggagatttgcattcaagtgcctcctccccagccttcctgcaagacatgaccttggctgaagcagctgcctcctgctagggcagttcctggggagggacaatgctgtgagtccacagtagccaacactccagacagcggtggggagtgagtacctgctcctgaaagaggatcgagtggcacatcatagcatccactacaaaaacctaagactcctaagagaatagataagatgtggtgggtgagcaccatggcatactattgctcacccttgtggggtgcaacctgttagtcatagtcatatcaagtgtgtgatacgactaccttctgaaccagaatcctgctcctgagtatatgtcccagagaaattctcagaatgtaccaaatagattattcatagcattgttggtggtagtgggaagttgaaggcaacttaggaatccatcatggggaaatagttaagttacctgttgtagaggcctatggtggcatataatgcagcacttagaagcaatgatctatacgacatcatgcataggtcttacaaacagtgttgagtgcagagctttaaaaaaaagtaaagtgagatctataaaggaatatatgcatagttcacaaggataaatacatgttctaggacatatatcaagtacacttaaatagatgccctcagagggaaaaggagacagtgaatggatatcagggcagaatggggaaaaattaaaataaaaggggcctagattcataaaaataataaactcgggagtgtgagaaactgacctctgtatttgagattcaaaggagaaaaaaaaagatgtcttaataagtatactttgttagaataattgtaaaagtatctaaaattggagttttagcagcagagactaagatgtggttagcttcagaatataattcaccaagagtaccagcagaatgctgatgggatcaagtgcgtgggtgaaagaagaggggagtcaaggtcatccctagttttgacttaagccactggacacagaatggggctatttacagacaagaggaagggctgcagcagggaagagttttattggctggggctggaaattaagagtttggttttgatcatataacatttgagatgtctattagacatccaaatcaagttgtctcagactgtaactgccatgagggcagggactttgtcttattacatcagtgccaaactctgagcaccagaaacagagcccaacacatctaagtgctcagtaaatatttgttgaatagaagaacgaatgcatgaatgcaggtgaacaaggcacctggatgtacagatccggaggtcatggtggagctcaggcatggagataaggatctggaattcttcagcatgtagacagtggcaacggaaagctgctgtgttggtccagagcctccagggagatgtctgagccgggagcacacggagggggaggaagaagtgtcgctgtctcagcctgctccaccttcaagagctcaagcagggggattcccctctctgacccctctcctgcctttcttcctcttctacttcttccctgtaccctgacatttggcattttgggccacagaggactagtgagctgacttcaaccctctcctagaaacccaagattctctgtcctctgggcctgggatgtgcagacttcctgatctaaaagcacagggttccatatccaggccccagttcattggctgttcccaagtaacagcagctccctcctcacctgagttattttactcccttctatcatctgattctggtttctctggactccattctcagcaattagtgccttaagtcaaaagttcatcttactattttcccattcatttgcccctgagtggcttctgtgggctcattccctccccctctctcaggacttccctaagagtggcacaaccttcagtggcttcaattctctgactgttggccaccccacttccttatcctactgaatcttctctttgccctacatcctctccaacctcctgtcttgttgctttccctcattcatttctctgtctagcttggacctgtttcagatggtcatcaataaccagaggtgagtttgggtctctggccctaagggcatgagcttaccacatgaacctggcagcagcaaccctcttgagaaaggctgcacaaaagcctcacagcccccacaccctgccttcacctgtttgatctcatcctcagccccaggcttgccttctgaccagccacctgcctgcactacctccactttaccctaaccatgtcatccagagttgcccatgggagaagcagctccactgtaaactcacgcctgcacatggcatcctctgtccctctgactttcaatctcgggcttgtctttgaaccttgttttctctgttctcagcatcttacagagtctctctgctaaaagcgattgcagaactgtattggatgttcatggggtatgaccgctcacaaagtagctccatgtagatttcatatttcatattttgactttgcccccaaatagcctccaaatttggtgaaactcagctatttgtatgtgtataaagtgctgggaaaatagtaagaaacttcattttggtcttatacatacatgtcatctgacaacacagaattcagtgtggttatttgttatctgtgtgctgaggacccagggcctttgcccccttagggtgtcttcctgcaatttaagtcatccacgtcgtgaaaaatctaatatttctaagtaatgaccatgctcataacactattctctttaataactttcaactactctccatttcttgaattaatcaccagtcctcaccctgacatcaatagtcatccatgatatgacctcacctcacttttcctgtcctatctcttatgactacattgtgtccaccctatattccattattcccttaacctgcttctcatttttgcatcagttctataactttgcttatgtggcctccccattccaagttctccggtcaaactcctctccttcaaggcttagctccaaaaatcacctccttgagaagacctcagctgacatccacctggatgttttttgttcctgctttaaacctctttagtactttgcttatttttatttccttctgactcttgccttagtgcactttgtattgtggttattaagtaattggctcatccctccgctgggtcacaagctccttgaaagaaaggactgtgtgtctcttatctttgcattctgttctggttctaaactcagcctgctcatgcataggagttgaataggataaaacagagagaatcagtacacagggtatttcagagcaatcactggatctaaaaagagctggaggaaggagatggagggaaggtactagagaacgtgtgaccaaccagaggaaggcaccgtccctctttcctgtcaagtgctccgagtaattcagacgtcgtgcctgcatttccactcttcctgtcttcccattatttccttccccactgggaaaattgctgtgagacgtaagtcattgcctcaaatctggctcataggcatttagcatcatttttttttcctttctgagaataagtctattcacaccaactatatatttgttctctcactggtttgttaaagataattcatatggaataagaaagggatgtcttaaggcaaacagcaaggcagctgaatacatttacttcatgtggacagggacataattagcaaaggaagctcttcaactcaaggtgggaggggagagtttgcatggagctctcctggccgtgtgctggggctcattgctgtgtgagtgaaactgcgcacaagcacatccttctggtatgagccccatgtcggggagaagtggggtgatgaaaatgcccagatattctcttgtgtgtgggagtatggcctcacagactttgcagtatgttcctattcctaaaatggaattgagggttgtcaaatgactcaatcagagaatgggcatgtagagttgctctcttccttactcttggtgaatatcttctttggtgttaaatggaggccaggtcaaattgtgttctggactctctcttttctccatatatgtggtaattattctatcagtagtattgttaaagcattctcaaaatcaatattaaaaactctgttaaaatggaaataaggtggcccctctcctttcttgtagcagttttcatttagatgctcatcaattttatttcttttgttttctctcacatacaggtctggttcagtgagaagatgtttgaaccgtcattctgcttttatactggatataaaatccccttatgcaaaaccttagaccagtattttgaatacatccagtcactgccatccctagataaccctgaagtctttgggcttcaccctaatgctgatatcacgtaagtccctggcattttttaatttgaaggggtcatttgtaactcagtctggcaaagatggtgcatttcattttctctcctaatctctctcctttccccctttttttattttactgtgaaaaatagtgtcgcttcctgtctcccaattacaactttgtcatatcttggcctgctctcctctcactaaatcctgatgctccagtgtttatgacaacgttaagctctaatttatgcattgattatttcttctctgtcatgtcataaaacgagttggtgttagtggtagcagtgctctccgccggcagaagagtggtctgccagctcctcatctctttcttcaaaaattcattaagaatataatgctcataaatagaatctaaaaagccaggtgagaacagatgggagggtgaagaatcgtatttctgcctggtcctctctttcatggcccctctccctcacttgctcatctgcatccttttgtcatgcactgcctgtggtgggtgcagtgcggtgagcacttgagtacccgacacagatgcacagccccgggaggaaagagtggaggggctcagctttgcgtgaggtccctgctccactcatcacctagagaagaaatgctccccggttccaagccccttggcatgaggtgtcaccccttctctctttaggatccctaccaaacccaagcacctgaactggaatcctttggaatggaccgcatgtcctctgcagccccctgatgaaaagtcacaaggtttacattcaggaaaatggtttcaggaagtggaagaaaccaagactcctctggcagattctaagttgagaatgccctaagagtggggcattcctctctcctagtccctggcctactgttgtaattttaataattctctgggtttggacatggacatttccctggccttgccagatgtcccaggagtcccagtttgctgccaatttccttgtcttcccgcctctgaccaccctcctagctccctgcatgaggatgcacttttggcctctttacacccaccttgattccaccttcttcatatcctctcatctcgcccaggctgcttttcatcttcaaagatgcggacatgattgaaaatacctacaaatgccaatgcttcattccacccccatgatggaaccacgaaggttcgttagtggcagctcttgctgttatctaaggaggctttcataagttatctggggatgggaaagaagtgaagaaataaaaaggattcctcagggattggattgacaatcaactcttaacgttttatgaaagaggagcataggaaagtagttttgctttagctgagactttaaaaatgtgagtcagaccacatcaacccctgctcagaatcctcccaaggttcccgtgacactctgagtcaaggtcaaagaccgacagtgacctacatacagatgacctacaaagtcaaatagtgccactgccctctacctccccaccctggctctttcagtcctctcccaccttcgtgcccactcagctcctgttactcaggccagacagcttcctgttactcagacaggccagacagcacctgccacaggatacttgcactccctggaacctccctcctcctagatatcacagtggctcacttttacctcttctagtctttgcttagatgtagccttttcaatgatgccttccctggctgtgctatttaaagattgcaacccactccccaaaccctgcccaagagcttgtcctcctgacctgctcttctctatagtttgtatcacccactgacatactctacactttttttttttgccacggaatttcgctcttgttgcccaggctggagtgcaatggcacgatcttggctcaccacaatctccgcctttcaggttcaagcgattctcctgcctcagcctcccgagtagctgagattacaggcatgcaccaccacgcctggctaatttttgtattttttagtagagacagggtttctccatattggtcaggctggtctcaaactccctagccttaggtgatccgcccacctcggcctcccaaagtgttgggattacaggtgtgagccaccacacccagcctcatactttacactttaattactgatttgttattgtccaacaaccaccactaaaccataagttccactacacctgaaacttttgtgtgtgttttcactgctgcatcccttgtgctatagcagtgcctggggctcaggaagtatttgttgactgatcagtgctgctaaattcttctagagtgtgaaggatgtgatcaatgaggagattccatagaaagatcccacaagttcacgtgagtggacagagaaagaactgataagtcttaatgcacttgcaaatttgtgactgaaaatgttctcatatgagggctctgaactttaattccatccttgacaagagactggggagtcacgagagctggttcctggataatccacaagatcccaacaagatgaaaccatttcaccctcacccagggtgatggtgcacctaggccttgttcactgcaggctgtttcactcaccagctctcaagaaagatgaaacagggctagaaaaggtccagagaagtacaacgcaaatgtaaaagcaattggagacaaagacaaagacaaaccattttttccttgactttttatttggaatgattacaaactctcagaaaagttgcacatacagtaaacattcatacgcttcatcgagatccaacaattgttcatgttttgatccatttgctttttctccttctatatttatatctctgtatgtttatgtatctacagctatatctatgtataatcacatatatttctctgtgtgtgtgtttgtgtgccctctcagtggatagagctaggaagcatgtacttttaaaaacatcatgagttaatacaaataactccaattccagttgtatacctcagggttgttctttgtcttcccccattccatattgatatctcctttctcccaccgtaaaaactctggttcccagcaacttcaatatgtgtattcatttacttgcaattactatgccaataccactaccagcaacaaacctattaagtagaggtcaagatttctttgcagttctttttgtccttaggatatattccactaggtataaagagtactgtgttcaaaggtcacttggattaatgatttttttttctgtgtggttatgctatcaactgatatatagttatgtttatttgtttctgtttgtattacatttaagggtttttttcccccacatatgctattgttttgaatatgtaaaatatgaacatggttcaaaagttacaactttaagttgttcttagagaagtctcagaccctttcaacccatttccctcttcttttatgggtaaacaaacacagtttctggtttatcttctctgtgtttctttttgcatgtacatacatatatacatattgttattaccctttcttatacaaagttgccaaactatatctattgtgtgtgtcttgcttttttctcttaacaatgtatcctgtaaatcacttcatatcaggtcattattatcttcctcatatttttttttacagctgcatgctgctccattgtttatatggatcatagttgttcaaccatttgcctatgtatgggcatttaggttgcttccaatattttcctatctcaaataattcttccattaataactttatgcttgtggactctcatattattagagatgtattttcagggtaaattgttatgggtgggattgctagatcaagatttagtgaatattgtcaaattcccttacatagggttatactgttttgtacttttacttgcagtctgtgagtgcccattttttcagaatctcatcaacagagcgctggtgaggcatttgaaccttcaccaatatgacagtgagaaatgttatctcagcatagttttagttcacttctcttattttgagtgaaattgagaaaattttcatatacttaagggctatttatatatagtctgtccattcctttccaatggagtttttattctttttatttaattttaggacttatttatatgttagggataacaaccctttgtttgtgatgtggattgcaaatatttttctcagcttatttagcgttgcttgtgattttcccccattgatcaggtagaagtgttattgtcgtttcgttttatttttatgcagtcaaatttatgactacataaattctgttcttgctgttgttacatctggatttttagtaatagtaagaaagcttcttccctcatcagggtataaaggaatcatctacatttttttttttttttagtgcttgtatggtttcacgtttttacatttagttcttttatccattaggaatttacctattaggtataagtatggatgaaattctttttcagaatagcaatccagttatcctatcaccagtgactttttttttctttttttttttttttgagccggagtcatgctctgttgcccaggctggagtgctgtggcatgatctcggctcactgcaaccacctcctgggttcaagtgattctcctgcctcagcctcctgagtagatgggattacaggtacatgccaccatgcctggcaaatttttgtattttagtagggaaggggtttcaccatgttgaccaggctggtcttgagctcttgaccacacgtgatccgccagccttggcctcctgcttcctttaacatagaatttccttccataggtactcgggtccatttctgggctttctattctgttttcctttctattttgtagcagtctgttttaagtttagctagtctccagtatgttttattatctgatagttatagtctcccctcattgctctttttttttttttctgagcttgtcctagctattgttgcatgtgtgtttctctattgttgtcagaaattggtgttgaattttgttgaatacctttcaacatttatggaaagaatcacatgattttcccctaaacacctaaaaagttagtgaattatattaatggatttcctaactcaaattttctacagataatctgaaattaataccactgggttcggaggtattattctcctaaggtagtgatatactctattaatggttcattggggaattttgcattgatattcataaataagaatggcctggagttttttgtggcatctttatcaggtttaattactaatcaatgttatatttgctttgtaaaaatgtggaagtttttctaagctctggaacaatttatgtagtattggatgctttaaagtttggtagaattctcctgtgaaaccatctgggctcagtgctagttctttgatatctttcgtatttctctgtcaccactgcagtcaatattttgtcagttgtgttctcctaggaaattatttgtttcatctaggttttcgtatttattttcacaaagacatgcaaactagtctttaatctggtctaataagctggactcagtacaatgtggtaaagaatgaaatcacttcttccttaccctatactgagtccaacccattcaataaaattgttacagaagtgtggacataacactagctctgtagaccttggtctgaaatctgatgacaacttgaagccactctcgtgcctctcctaaaggaatgtactagccttcttaatataatctatcgaggcagctctgttcaaccacttcactatggtgttgccaacacatcccagagaaaccactgagaaacagtggttatactgttatatggtggttatacttacttaatactaagaaggaacttagtattgacacagatgaacacctcaccagagccagaggctcctcttcacagggttctcctgctgtccggcttagcaggttctcagtcctcagtggcaaaatcacactgtgacagagtaacaaaatttgttgcaaaatgcaaaaggctgcaaagcatgactttaatagcatcacccttcagtgtatggtccaggtagcagtgtgatctagtatctctcatgctttaaagagccttcccttcccttcacatgcctataaatctatagcctatgttctactcacattttaacctcttttatagtcatgtccaccttccctcctgagtagagctcatctatgccaatggcctttaaaacatcaacatgccacatatatgttgtctagacctttcctctgtgctccacagtcatttatacaatttctatgtgacatccactggcatgtctttcagacagcttgacctttaaaagccccaaactgaatctcctccatctacttctcctccatctaaatggcttcctacagcagttagaataaaagacaagctctctgccatgtgacaaggctcatctagagcacccatgatgactaatcgacacctcgggtaccctgtgggtaagtccaggtgtgtgaggatgcaggcctagaatagggatgatcatggggtggagtgaagctgcaggacaggtctcaaggggggactgataggacttagcgaatgcagagcaatggctgagaaccttcttctgtagctgttaatctgtttcttgctgcaaactggtgtgttagagaggacacggtgagccttctgtgttttgtcaagtctctcttcacagctttgtccagaagcccacatggtgttgctggcatgcatgctgtaggatgccgtaagcgagcttctcccaaaatagtgtcaggatcttgcaacctttcaccacactagtgaggtcaggtagaaggccctggacccctgcctaaaatgggggattatatccactagagcaactggcaggcctgtaagaccttcgtcctcctctgttctctcttcatccttaacttcccatatggtctgccttggggtctctctcacccacccctgatcccctttccccagcatgtcttagcccatttctggttcctgctcaggtggttggctctgttctgcagctctgtgtttggtaatttttttggtctctgagtacctaggtttgattcttctttcctctggctctgaaatatctggtggatggaatcctggcaagtgagcttgccttcttcaaggacttctctacgccccttgctgttcccccaccggccaccaggaagcagtaagcaataacagatgaagcatcccagctgaaacccacctctggtcctcacccagctccagcaagatgtaactctccaagttctgagtgaaatgaaagaaggggtcaaagatgccctgacattgcttgtctgggagctgggttagtggaggagttgggaacaggagtatgttggaggagaagttacagagttctgttgggggcatgttgagctgggaaagaacatgggatataactgaatggggtgagaaatatggactggagcccaggtgaaagatttgaatgcatgtgtgcagagataacagcttcagccatgagagaagactctctaagatatgctggctaagtctgtgtgaatgtccccagccagaggaatcattaatttatctgaccatccatggtgttcaacagcattcttgcttctttttgtttgtttgttgttttttgttttgttttgagatagtcttaccctgttgcccaagctggagtgcagtggtgcgatctcagctcactgcaacctccgcctcccaggctcaagcggttctcatgtctcagcctcccgaatagctggaactacaggcatgtgccaccaggcccggctaatatttgtatttttagtagagacagggtttcaccatgttggccaggctggtctcgaactcctgacctcaagtgatccacccaccttggctttccaaaatgctgggattataggcatgagccacggtgcccagccatcagttgatgataggctataattgggccatcatggagaactcgatgccccctgtttattggaatcttcactctgaagttagcatccataaatttgagagaagagggagatttgggcagggcgaatcacaagtctctctcctcagtccttgcataagaatgcagaatctctgaagtggagggggaaatcaaggtgaataaatgctttaaaataagtaaaatctctctcaagagtttagatagcatagtgataagaaccatgaaaatacacagtttattcacattttattatgtagatttataaggtaccaaagactctgcaaattcaactctttcaatgtcaaaaatggttgcttattttcactctttttctcatcagtggttatgcatgtttctttactttctgaaatttatcaaatgccttattacaacctttatattcatttcaatgcaatacaaattgaaatgtattcccttgagtatttgaggacacttttgagatttagattttttgaaaaatttatgctcattgatatttcatgtgcaaagacgtatgtaaatctagactgatttggatattacggtgcactaatatctcattaggtagttgtttatttcatagacagctctgtttttcagttgttttgcatttctattatccatgaccctgacttcccagaaccaccaagctacaagggcaatctgagcttcttcccatatttactctaaagagaaattttcttcaagaaataacttagaaccaaccctcaaggaatattatagctcttgttcttcatctcagagcatttatgaggactgttctcctgaaagcccttgggcttttgtggcatatagagagatttgcaattctctgttatagctagctaactaggcttctgcctttcatatctttgcaaacataaaatcacattgtggaaaaagaaatgtgagttgttcagccctggaataccagggaatgacattctgtgcatagtaaaatgtgtgttggggagagcttggctagctcttattcacagtggatcagcttttcaaggcttcttcccaacatctatgttttgaggcccgtgttcagatcatctcataaaaaattaaatcactcatcatgaaagtgatttattaggtgggatctagcagcagcagcatctccatcagcctctccttggagcaccagtgaacttggccagagtcagcagagagcaaaatggtcatctctgcaatggtgtgcactgttgggacctagcccctggtgctgagcacacttccacggagggctcaagctgaaggtgactgagagagcacctgagaatttggatatgggggctgtttttttttttttgtagctagaacaggtaggaatcatgaactctgcttttcttagcatgaatggaaatttactgtggttttcttgtctttaatcattaaagatctgcattgataaaataataagaagaatagttttacttcactctcaaattatatctttctgattctcctgtgttttgaggactatttatatatggcacaaaaggcatttgcaacccattcctgaattttgaagtagggcatgatcacagtttttaaaagtcatataaagtataagaaaaatacaagtaactctgagagggggaatcctgtgaaaatatcctatgaaaacaaatgaacttatcaattgtcaaagactcaagaagagatagatagaaagatagatatttctaatatctatagatgtatttattattatattgtattgtcatattatataatagatatataataattagaaatgaatgttcctaattcattattagaaatgaatacaaaagttgtaataaggcatttatacacacacacacacaaacacacacacacacattcattgaaaggtgccaggaaataaaaaaacaataataacaatatactatgtttttaccataagaaggaataagtaaattttcatgtcctttaaatattgaagaattgctgtcctttgtatttgaggtttaataaaatgcaagccaattggcctcaattcaacaaacaaacatttgttgagaacttactgtctggctaacctggggatacaaagatgagtaagatgcagtccgtgctcttggagcgcatcatctgttggggaagatgatgaatggcaaatgctgatgaggtacaatatggtaaactctaaaatcagggtatgtatacattgctatgataacacaggtggaggagcaatcaattccaatttagggatcaaagaaagctagtgagacaggctccatttaagttgtgccttaaagcaggggtccactacccctgggccacaagccaataccagtccgtggcctgttaaaactgggccacacagcaggaggtgagcagcaggtgagggagcactaccgcctgagctctgcttcccgtcagatcagtggcggcattagattctcataggagcgagaaccctactgtgaactgcgcatgccagggacctaggttacacactccttatgagaatttaatgcctgatgatctgtcactgtcttccatcacccccagatgggaccgtctagtttcaggaaaacaagctcagggctcccacagattttacatgatggtgagttgtataattacttcattatatattacaatgtaataatagtggaaataaagtgcccaataaaagtaatgtgtttgaatcatcccgaaacttttccgccgcctcccctccagtctatggaaaaatgtcttccacaaaaccagtccctggtgccaaaaaggttgggaaccgctgtcttaaaggatgtgcaggagtttctcagattggagatgaggtgggaaggaagtgactgcaggactggggtcaaggacagagtacaaagaagaggaacataatgagcggtaaggaccaagaacttagactgggatgcacacaccaaggaacaatccaaggaagggaatgcaaacatgaatgtgtgtggggagttctgggaaccaggtccagtatgcctaaagcatgagggaggggggtgcttaaagagcggagtggccgatgcagagtgtggcttttgaaggttttgccaaaagagtttggggcaatattttaaattggaatacggttatttaatcatttatttaaatctacttaacctactctaccttctacatggccatttctgcttgcatgagttgatgggaattagcattttgcatacagagatttaagccttttcctgccatcacataattcaggctgaagttggaatgaagataaacaagcatgtcatcatgtacagaatgacaagtacaacaataaaagcaagcactgagagctatgcgcacacatagggagaaagtctagggaaggctgtctagaggtgaagacatctaagctgagcttaatattaatagctagttaggaatgagctataatcgatgaaaaaatgagggcagagcattccaggctgtggaggtaacttgggaacagtcaaagaaatatgaggggagtcatggaatgcttgatgagcttcaggtaactcacagcacagggtagagtgtgggaagaagaaagaaggaagcaagagcagaagctggagatagaaaaaggcttagtgatgaaaaaggtttgtatgccatgtgaaagacttcagattttatcctgaaggttatggggagtcttcgaatacatttaataatcacttttcaaatgtcaaaacttaccttggaacagtggttggaggcaggaggatgtgttaggaggtgatggcagtgccgcacacagaggatgatcaggaagttagggggcagaactgaaggcagtggggatgacggtgggtcacggggaggggatgctggaaatgatttggaactagagcttggaaactaagaaggtctggggagccacagcaaggaggaagccatctctgagggttctcagttgggcaactgggcagacattgatgtcactaaagtagatggggcaaggagcagtccaggagagggataagggagaactaaaataataaggttttggatttgtttggtacaggaaacaaagagctctggggctccagggaaatgtggatgcacagagttcatgataaagtcagaggttcaatgttacccaggcttacctggtgtttcgtggctctctgtaagatgtcagccatggtgacacccctgtgtcttccctaacatagcagttcatccacatattctatctgtagtgtacctaatgctagagagagctcatggagtaatatgaatcacatacaaatttaaatttctgaaaatgtatatagtaacatgtggatccttgacttttgttaacttcattttgttgtctcatcagctattttcattgaactttcttctcagacttatttgtatttttcttatacggtactttatatgactttttaaaactggggttgtgccatatttcaaaatgtcggaatgggtctcaaatgccttttgtgtcattttactagaatattgtgttctctgttcatgtattcaactgcatgcatgtttcaacttttaagataagtgtcttttgggatattccaaatccccaacatctgaatagaggttgctcacagaaatagtaaaagaattttaagttatatctaaaatatactatacagtcaatttttgttcattaaaaatcaggttttacttcattgatccttactgggaaagtcatgtatttaaaggtaatatgaagctaatattccaactctggatggagttacaaacacttgctagatctgatactaggaccctcgtatcactgtatctgactgaaagttctgtatgtgaagcatgacaccttatgcatttatcatggcatgacttttggaaaggatgcagatagttcgggtatgcatgtttgggtccagatgtggcattctagctgctaatcaaataaaaatgctgaagacagagcatctcctccattcttcagctttattcctaaatgaatccaaaggctgctatataggatttcctctactccccaccacacgcagctttttcataagcaaagaagcctggttaactttcccagcagcctcttaggattctgccaattcgtgtggcaaatttcacaaaaggctgtggaactgacaccagggaaggaggagagaaaaggatgcaattctctctttccatacactgcagagaaaaggcagaagggggcgctttctggtggggcataaagagtaagggtttgtaagatgcatctcagtgaacctgaaatatttgtccctgatttatctctgttaacttcttgacaactgtgatgggctttgccttatggggatttatttttctctgtttttcaaactgaaaatgatttttaatattctttattctaaaagtcctacattcttattgagaagcataaacaatagagaaaaataaacagcaaaaagaaactaataattacataaaaagctcatcatacaaaaatcctactgcaaaaatacccttctagtttttttctgtgtctataagcacaatattaacaacaaaattagatcataccataactgggtttgatgccatgttattttattctataatcccccaatgacacctcgcatgatcaatgaatatacagctacatcagcatttttattggctatatagatttttataaagctttactaggatttattattacaaatactgttataaagtcatatagattcatctttgtacacttgtctgattattgcttctaaaacagccttattaaacattgaataaatacaaaagaatatatatactgtatataaaatgtaaaggacaaatatacaatgttgcttttttacgccactctttctatgttttgcttcttttcttcttcttcctttttggcttttgctaaataagacttttcccatttcattttttttctcttctctagtttggaaattatgtactctgtttctgttcttttaccagttaccctagaaattttaacgtcagttcttattttggtctaaaattaatatatttatgctaggcatggtggtgtgtacctgtagtcccagctccttgggaagctgaagtaggagaattgcttgagcccaagagtgttaagtccagcctgggcaacagagcgagaacctgtctctttaaaataaataaataataaataaaatgaacatatttactttcctttctcttagataactttagctacagtcactctcctcctgacatttcagtattttaattttatcttttataatcccacaattagacatacaatgattgttttatactataatgcttatttagacttacctatgcattggcccattcttttctatacttcaaaccttccaacagaataacctccctcctttctaaagtatactccaccatgagggggacattcttttatggatgataaactcttctatttttgtatgaaaatgccttattttgccttccttttttgaaaaacagcttttatgagatgtaatctgcatatcttaaattatctcatttcaagtggacaataaatgatttctagtaagtttaccactacaatataacgttataagatttccatcactctaaaaagaaatgttgggcccatttgtgccaggctgtcatccccagcctcaggcaattgctaatctactttctgtttctgtaaatttaccttttctggacattttgcataagcagaattatacattatgtgatcttttatgtctggattctttcacttaacataatgtttttgaagttcatccatgttgtagcgtatattaatacttccttggtttttattgccaaatagtattccagtgccacattttgtttatgcatttaccagctgatgaatagttgggcatgttctactttggggctgttaagaacactgctatgaacattcatgtgcaagtctttgtgtggacatgtcttttcatttctcttgtgtagataactaggaatgttatgtagttattgggtcattgggtcataatctattcttaacatcttaagaaactgccaaactgctttccaaagtgactgcatcaggccgggagcagcagctcatgcctgtaatcccagcactttgggaggccaaggtgggtgaattgcctgagctcaggagttcaagaccagccttgccaaaatggtgaaaccccctctctactaaagtacaaaaaaattagctgggtgtggtagtgcacgcctatggtctctgctactcaggaggctgaggcacaagaattgcttgaacccaggagatggaggttgcagcgagcaccactgtactccagcctgggcgacagagtaagactctgtctcaaaaacaaaacaaaacaaaacaaagtgactgcaccattttacaatcccctctagcaattacgaaggttcaggtttctccacatccttgccaatatttgttattatgtgtcttgtgatcataaccattctttgtaaatgtgaagtggtagtattacattgtcgttttaatttgcttttcctaataaataatgaaactgaacatattttcatgtgcttattgacccatctgtatttcttctttgatgaaacgtttattcaaatattttttcttgccttcattcttgaaagagagttttgtttggcacacaattataggtatatagttattttatcctagcaattagaagacacttttccattttcttctggatttcattgctgctgttgaggaattgactgccagtgtaattgttatttctttctagataatctgctctttctctctggctccttttaagatgttcattttgtttttggttttctacggttttactgtgatgtatctacatgtagagtccaagggcgggagggatttggcttgccattactggctttgcaaatatagaaagtgggccacaagccaagaagtgcaggtggcctctagtagctgagaaggaccttcagctgacagccagcaagaaattgggtacctcagtcctgcaatctcgaggaagttaattctgccaacaacccaaataagcaaggaaatggatcctctcctacatcctatggaaaggaacccagccttgctgatgtgttgattttagcccagtgagacctgtgtcatatttagcacctacagaactgtaaaataataaatatgtcttgttttaagctgctgactttgtggcaatttgttatagcagcaataaatagtataggttttaagttttagttatgttttatttctagaacttctttttaactctttttcaaatatgctattcatgtttatagtttcctctttaatacttgtattttcagtctccttttaaaactcttcaatattgcaaatacagtattttgtagtgtgcatctgaaaagtcacttaagatctccacaggtctgattctgatttctgttgtttctactggctctttctcacagttccttgtttccttacaactttttaaacttttgactttgagcttatgtctattggaaattgactgttggattatttgagacctgagtcaaaggtatattgttccaggaaagagttgtgtttgcttccatcaggtgccacctaggacttcctaggaccaccttaaaataaattcttggcttgagcttttccaaattgcacaggtaatatgagtaaatgttaactaatgttacaaacatggtgaattcagaattttcaggaaagatttttcccccacttagtgctaagctaggtagaacaagttacctatcatcttcttctgacaggtggaggttactttctagtttacccttatactgaggttgtagctgtgtggggtcccagatttatgtaggaatttcctattatgctttccacctcaggtatgagggcttctctcctgtctcattgcactatccaaacagaaactcaaaaacaccagttagttgatgcccccagggtaaaatctggctttatctctctggattccagcattcactttatttccagcattcattttatttgaccctgaggattttttattgtattgccagttcagtgatgtttttaaaaggatgtttttcatatcttctccagaagttttagttgtttcagaagggtggttcacagtaacatttgcaccataccgtcagaaatgtaaatgtcaaatgtctctttctttttaaggattaattcttaggtgtagaattgctatattaaaaggtatgcaagtataatatttagatgtatatatttccatattacaatggcttgttttctgttcaagaaaataaaacagaaaaacaagccactaatctcaagcatttgctgaatcccttttagatttgcctctcacatctacaaaaggaaatatgaatgtggttaacatctggacaagagacaaaattagcaaacaaaacaataatcctccaaaataaaattatgtgaagtgtatagatggtaaattaggagttcagaaaaggctgaaaaatttaaatctgaccatgtcacacctggctagggaaatcttcagtggctgcccattgcctttagggtggtgttcagaatcctacaagttcccatataaccctgcatggtctggctcctgcctcttctctgtccttgtcgctcctcctagctcactggctccaagctcactggccttatctgtgttcctcaaatgcactgaaacccttttcaccccaacccttacttcttatctgaatgtccttttctgcctcccaccaccccaccccactgcgtggctgacctgttcatccttctggtctcagcttacatgtgactttttaacttttactaatcttctagtgtaaattacctctggcacacaaacacatacacacacacaggcacatacagcgccccaccccccacccacccacacacacacacacatttctactcaaatgtccaggtaactggtcaacccagcatctcagggacagagactaaattcatgcatctcagagtgtctggtcgacctgaaagaaagctagagagtgggaatgagagaatcaaacctctctgaaagcatcctgttctttccctccacagcacttgttagaatgggattatctaatatctatctcctccactagagaacagaactatgtcctattccctgccatattctagaacttagctcagtgcctggtacatggtaaatctttattgaataaatggatttaaagatgcatggctgcatttgaacaggtggagccgatgggcgtcaatagatttccctggaaatcataaaactagtggaaaaatgagaaaaccaagcagaaaagacgaaaatattttaataggttataactcagtgaggaaatatgaatgttcctctttgagccaacaagctgtcctataatgatagactcttatgaccagtctatagcaggggagagtgaaaggaggtgtgcccgctgttcagcatgaggtggtcaggttagctacaaccaagatggtgaagaagcgatttggatttccaagggtgtttttgggtctctttccttgaagatggagagtgtttcatttcagtgatgttcttgatgtcctattaggaggcagtagaatggatctctagtttctttcattcctctaggttgatggtagttaacttttcttcttttttttttttttttgtagcttgctttgatttaagtgattctatcagttcattttaacacttgacacttatctcttacatgtttccctgtaacattctgaacagctcactctttttactaggtatcagagtaacactgcttctgctgttcttgaaacaattaccaacattcaacccaaagagagtggaggtggtgtgggagagacccgggaggctattgtttatagattatctgaagatatgctgagtaaactccctcctgattacattcctcatgaggtaagtcttgctggtttcccactggcatacagggctatttgtatatttaaacagtaagtttgattaccttgaaaagcaagaaatctacctgttggtgactatgtggcagattacctgtgtgaaaaattttgactatattactaaactctgcatctctcattgttcacatagttctctcttcaaaacttaaaaatatcagaagaaaacattttccatgatgcttttctgttgcattcttttaaaaattccttcacaagttaattcctcctcaatcaaagtttccacggtgacccatttatatatcaatttctatgataccttaagctgtgctaaaaaaaaaaaactcaaaaatctttaaggccaaaaagcaatggtgttggtcatttggtattctataagacgttccaagtgttttaactgtaggtagatgatccacccatctattccattgatttttaatcacttctgaaactcattgaatagggtagaacaattagtggagatattatgaatataagcaccctgttaccaatctgaagtcttctaagaaccacacttattcattgattagaatggggtggcatgggacagtagctgtgtttttgagcactcattacaagccagacactgtcctaagtgcttcatacacattatgacactcagtgctcaggacagcaccagcagaaatcaagctaagtggcagagcaagaatttgaatacaaagtgatctgactctagaacctgcagtcttaactagttttagcatgcaatgagtgtcccaacaataaaaaatgttttattgcctcttaaaataattattgtttccattgtgtagataggtaccaagacctttggttaagatattgaaatcaatagcttcatgtagagatagttatagtaaggggagaaaatatttttaaatggataaatattgtaagtatacactttcaatagttttattggtgtgatcttcaaaaaacaaggcagcatacttgccttcaaagatttttaatactggcatgtgaaagtgagataaaacttactctaaaagattacaccacaggactgctattgccaggggaaaggttcaagaccttgtgataattcgagctgtccagtcttagctggggccacttcaccaacaagacctttgttctggtgattattccagcagaaactgagcatcaggggtgtaactaaatggattcctatatgggaaagagcttgtactaagagacatctaaaacttgtccctgttccaagatcacttactttttagtgtcttattttatagaagagatctttcttgaacaggtggctgtaaagtgaattttgtaaatcaaaatataattataccattgagttctgtagtaaaaatgaagctacattattgtagagaatactacctggtcccagaaacataatgaaaatgctatataaggctacagcaagtcttaaattttattaataaaaagacaattttaggctggaacaataattatactcaaaatcaggactagaattacattttctagggtttaaggtttttctaagcatgtctctatctcaagtaaagtttcccttttaaaaccctaagcaggacaaggtgatttgtttgaaactgttaatatactagagatacctgggctattgatttgatactgtagtcaatacctgagctttattttccactcatggggttgcaaaagtatttctataatttcccttttccttaagagtgaatttccactcttgagatggattgatttaaagggaattatatatagatataatttatatatatatatatacacacacacgcacgtgtacgcacacacacacacacacacgtatgtatgtatgtatgtatgtatgtatgtatgtatgtatgtatagcatatacatatgctgttcagccactggaggttgaaggacttgggatggagatgagaatgaggcactggaggctgcaaaaatgtaggctctagaaccaagaattctgaagagtagctgaaggttgctacgtcggactgcgttagggacctccactggcatgcttgactgattttaatatagtttgctccacccgcataggtagtcctattcaggctgcctattttatatctgtgctcagtgttatatctccttccctttttgtgctttccgtcttcctctttcactcactagaaacaacccaattgcagtaaacagaggtgtcccttgctgaaaggaaacttctgcaccatactagaggcctgtcctataaaaggaggagaatggttcagatgactctgaagcccacccatctctaacattccaggctttatgagggggcagtgggcatctctggcagagaatcctgcagttcctggcctcctgtgatcctttggattgatacctcactttgagttctctcccactccatgtgtcccttccttgttcctttgattctggcatctctttgattgtggccagcagaaagttcaaatccctttatgagttcctgccagtatttgtagtcaatcttttgttgggcatatgtcaccaaattgaaatgtgtatattgcattggcttgttttccaataattgtcatattttattgttcccacaaccagaggcttttgtattgatctcttcaaaatagtcaataagtgatacatcaaaaggaacaaatgacagatatttaactggctgtcccacaaaatcaaatattttcattgattggattaggaaaggctctctttagctgtcatagctaaggcaacaatgatctttggaaactatagctaatcatatttgttggtaactgctctgtaaagatttttgctgtattaactttctatgacatttctaataactctgcaaacataatgaagaaaaaaattccactgtacccctatgaaggttagattgcaaaaagaatatctaactgacacccagtacttaatcatgtgaaaggagaaaaaggtacaattttatttcagctctttaaggtacatttccaattattagctaagtacaatcagtaagaaataaaaatcattttagttgaacagtagttttggaaacgcaggaaatggaaagtttaatggcaagtttggttctgcaagacatattttagaattcatttgggctggtagagatacatctagaggaagaaaaagaattgagaaagaagaggttattggaagagaaatgacagatgagaaaatctcctttattgcattgtttactttgttttaggtgaaatctcgtttgataaagatgggccatcttaattcaatgaacatatttcttagacaagaaattgacagaatgcaaagagtcatttcaatactccgcagtagcctgagtgatctaaaattggccattgaaggaacaatcattatgagtgaggtgagctgttattacatcagtaggcatttccttctttgttgatgtttcttattcatgtgttttaactttttcttctccagaatctgagagatgctctggacaacatgtatgatgctcgtatacctcagctctggaaaagagtgtcttgggattcgtccacactgggcttctggttcactgaacttttggaaagaaatgctcagttttctacgtggatatttgaagggaggcctaatgtgttttggatgactggtttctttaatccccaaggtatgtgctcataggagatttggcaagcttggaatttgtgtattgttggatagtagcatcgtgtgataaatatataccatataaaacaatatggaggcgtagcttgctgggtgctgcacatagccattcaaaggcgaaagaacacaaataattcttctgtatttgttttacaaattcaatctgaagctcttcctatcaattctttacaatgtggtagcaaaatccttcctttttcttttcaccaacttcagcaaaccatcagtctggggttaggacacatgaaagagtaaaaagaagtttctctctaacttatagtttttaaatgtttgtgaaatatcaaaaatgaagcaccaaaagatgcaaaaattgtttccagggtttagaaaattatattggtttcaaaaatgactgtgacaaaagtattcagagaacttcaggggggtcttcccccactcagttttctagttttctttttcttttttcctgaaagagtgctttataattctgcttcatttattccttccttctagaaatgtttactgagaaagttaatggcttgatgtcatagagtttgtaaggttcagaaacatgacacattttgtcttactaaaatatggatagttttacttcaagtaattcttggtgaaaatgaagaaatgttgaattccttatggttcagcagcttatggctccatttgtaataaaattttagaaacattcacacttacagatttaggatgaattattgtttcttgtagcaatataggtgcatctcataaaataatgttgagtaagggaaaccaaacagaaaacattacatgcggtatggttccatttatacaaagaagaagaacaggcacaatggctctatagtgttcaaagtcaggataatgactgtagaaggagggcagtgattagaaaaaggcacaaagggccaggagcgatggctcacgcttgtaatcccagcactttgggaggtcaaggtgggcaagttgcttgagcccaagagtttaagaccagtggggcaacatggtaaaaccctgtctctacaaaaaatataaaaattagctgggtgtggtggcatgtgcctgtagtcccagctacttgggaggctgaggtgggaggatcacctgagcctggaagatcaagattgcagtgagccataattgcaccactgcacttcaacctaggcaacagagtgagaccctatctaaaaaagagagagagagagagaaagagagagagagagagagaaggcacaagggacttctggggcccaggaatgtttcacttctagatctggatactggttatgtggctgaattcccttggtgaaaattccttgatattgctgtatactgatgatttgtgcagggttttttttgtgtaaagcatactttgatcaatattatacatgaaaaatatgtatttaattgtcctttgtatacatacattcattcactgtatgcattttccaataccttaaaaatgtttaaatttgaaacactaaccatggtgatttctatgaacatatcaaattatacatagtattttataaagtccgtagcctttagagttgtaaagggcagcccccagatttcacttatctatttttctcccagaatttccattgagttaggggaggaacattttttattatgggtctcagattttgtgtgtctacttatgagtctctttcctccgtatgagcctcaatttgagtaagtcgtcaccaggtaatttctggctggggagcatgaagtaatagcatttaacttaataaggattgtttgaccacctcccatttgccagcccctctgctaggtacttccaatgaagagagatttgagacttggttcctgccctaaaggagcctataatctggttggtaagacagacacatcagcaaccttaatgtaatgtgataagtgccccactgtgtgagaactaagtgccatggtagcccagaggacagagagattaattctgccaagagcttcacacaggaagcagtgagtagggtttgcagaagcagggatgccaaaaaaagagcgggtgctttccaggtagaggcctgagcaaaaacaagtcttgttcaggggaacagggagaccagtgtggccagggctcaggagcaaggctgggggtagtggggaatgaggctggagtatgaaaaatcttccggggcctcaggggttggggctgtatatcagaaggtaatcccaagagaaggcaagtgagggactggaatatggaggcccagtgcaatgagactcttgccaggtccaaggaagagggcctgggaccttaaccaggtgccaaggagggaacagatttgatggagtgattaaatgggggtctctgagagagcaaggagggacaatgtaggctggaggcaaggtacaagacagggaacattgggagagggacaggtagggcagagagacagggagcactggagaggtatgttggcagacttggagttgggagaggcgtaaggaccaatgattttcaaaagtgtgaggttattgaatgtatctttgatatttagaaaccaagggagtggagttggttcatccctggctttccatagtcacgaatgcacataatttttttcagtgatttttttcattcaaaatataactttaaaaagcaaagtgttaatatgaactgatctttaattgttaatatttgttaagaaatgttacaaagccaaacaatacttaaagaaatacaaatgtagattcacatgatatggtttggctctgcgtccccacccaaaactcatctcaaatagtaatcccagtgactggatcatggaggtggttttccccatgctgctttcgtgatagtgagtgagttctcacgagatctgatggtttaataagtgtttggcagttcctccttcactctctctctcctgcctccatgtaagacgtgcctgcttccccttctgccatgattgtaagtttcttgaggcatccccagccatgcagaactgagtccatttaaacctcattccttcataaattacccagtttcgggtatgtctttatagcagtgtgaaaatggactaatacatcacatttcagttaatgccttactttccttcatttgttaataatacttatcttttcccttttcttcagttctgctttcaagttagactttgattctttctctcaggtctctccatgtcttggaaagccctaacttattcaaacatcctaccctttacacacaagcacacacacacccttatccatgactgctttctgttagtcgcacagaagactggaagtcaactcttcctgcacactaatcacttctctgctctcttttcattctcttgacatgagggacaaattactttctgttccacctcacttggccaaatctggcaaataaagattacagctactccatacatgttcccagggagtgtgcaaacagatagagtcctttcccactggaagcctcgctggacactatttgacatcaacagttgatctcccaacatgaatgtatctcctgggttttatgtcctctaattcagtcctcttcaatgaagtaatttctttctttggttcaaaacatttaagtaaatggctttaaaaaaaaaaccctacataggcagggcgtggtggctcacgcgtgtaatcccagcactttgggaggccgaggcgggcggatcacgaggtcaggagatcgagaccatcctggctaacacggtgaaaccccgtctctactaaaaatacaaaaaattagctgggcttggtggtgggtgcctgtagtcccagctactcgggaggctgaggcaggagaatggcgtgaacctaggaggcggagcttgcagtgggccgagatcgcgccactgcattccagcctgggcaacagagcgagactctgtctcaaaaaaaaaaaaaaagaaaaaagccctacatatttaagtaaaacacaatgcagtttgtataaaggctgtagtttcatcacaaatatatatgcagtaatcaaaatcacctggaccataaggaagactatagaacacctgcaaaggctttattcacgtgtgattgctaatgtttataattgtataatgcaatgtggcatctgatgctgtttagtgtgtttccctcattgaccctctggtgactgctccacaggcctaagtgactttgaggtccgtgctacctcaaggacaagtgacatgccttgcttgcccctggtcagcacctgagcttctgctgtttgtagcactgctgtttgccttatgggtggcctgatattttgtctgtcatatttgaagaggctgagtcagccaccgtggagctcatctggcattttcagcacccctcacaatcatttctgtagcaattgatgagctcaaccatgtggcaattagactggatgattaaaatagtcaagctctctatatctgtgaccctgtgatagttttttcaatgtgcagcttttttctgtgtgtggatttgtctcccagcagattactcaggccaggggaacctttgtgctccactgggttttcccagcagttgttggtgcacatcttcccacattatttaagattgtttttctcgggtgtcgcaaaggatggccctggtctgtttttcccgaaggtgcgccttttcagtgcatcgtgtaacatgatttagattctggtgcatgagcttgcaagtgtgtgtacatgtctgtgctgtgtgtggggatgtgtttaaacccaaagaatatagtcgtaatgagcctgacttcaggccagggtattgactgcctttcagaacatcttaattgatagccatgctttgccatttgatgttagctatgactcacaggggctgctaatgaaatggaggcagaggctgagtgtgttccccaggtctcacacctctatagtagattgaaccatgcagtcccgttattttccgaatgtttagctcaatctggagcttgatgccatttagatgccaaattgtgcccacttttttctgttatttttttctcagtgtcttgacaagccatgccagtcagttgtgtcagatatcagtgacaacttcttccgtaatgcaaatcaagatttttcagttagaggcaatcctgctggatcaaagagatggatcatttttgttctgttatcttgcattctgtaaaaataatctacaactttttgcctgtgtgtgtgttttcagggaaacatcatcaactagctacaatctctgaatgcttgtcttgaagagttataaaagtctgccgtttgtggaggtgggaaagtgtgccaaggactaatggacctttaagattggaagggacttggggatagcttctaatctaatagcaattctaagcatgccccagtgccactgtttgatgaatgagagctacccttaaacatcttgggaaatctaggtgagtggacctcaagtcctaaacttcaacgtgagtgatagcactaacctgccctgtccccaaatcacagaactatagaaatgcctctgagtgaataacaacccatcctccttgactttctgtgtgagcagcttttacgcactggccttagacacaaccacatctcttgtaattccagtttctgcatgtgtttaccttccttagcaaccacctagtcctttgtaatctggctgggctccatcactgtgctgaagctgctctctccacggccctcatatctaacgacctccctgatgacatcattgcccttgactagagctagaatgctgactctgaaaactctcatgccttggtttccatccatgcccctcctctgatctcttcctacctcagagctcactttgtgtgctcttctcggcaacttctgtccttggcctcggccccctcgttgatgacctcagcctatgagtggctcatctaatgtcccactgtagcatgctcattcctcacttccacctgccaagtaggaatttcatcctcctgcaaaggtcaccagagccatgatctgcccatcttcctcctgagtcatctgtgccaggattctgctgaatatgcttgtgcaccatcctccaggtcacctggactcttgtgaatgggctcctcatgtcaaacagtgtggaagagggaaaccaggacagcatggtgtcatggaaggcaaggagaaggagagtagtaagtaagtagtggcaggtgctccaagagggcaagtaagatgggccaaaaatggccagatggatttttcaacaagaagactgttggcagaagtctcagtggaataggtggggaggtacaggagtctgatttgggggtgtgtgagtgaaacgaggaaatggagactaggtgagtatgcataacatggataattctctcaagacatttggctgggaagaggagaatcaagttggaggagtaggtataagaataaaaagttttctttctttctcttttagtgataggagaggcttaaacctgttcaaatactggtgggaaggagagagaaagatagaaaaggggttgtgggaggaatgaaggagggagagagagctcaacaatcccagggaggaggtaaaagaggcaggaggaggtggacacagcactcacagatggagaaatgtgctccaggcaggcggcacctcgcacactgtaacaagagtaataaggaaggaaagggcatagatgcttatggtgatggagcataggtaggcttgctggcaagaagttaagggcattcccatttgatgctttctactctctgtctgaagcaggaggtgaggtcctcttgaaagcaagaagatgttggtggagagatttttaaaagagtggtggaagtttgagaaagagggcagatgagggggacagggaaggactgataagtggccttgagaattctgttgaggctcttcatggtgaactgtggtgatggtggctgtgtgatggtttctagtttcattcagcagcctcgtatagacgtgagagaggggggcatttggattcatctgggattgcggttttgccaggcaagagatgaaaaggatggatctgaactaaacagggaagtaaatgaagaaaagggatggagttgaggagaaggtcataaaaattgatgaggccaaaggtctgagaggtcagatgctgaatggggtactggagagacccaggtgttgtcagagtgcttaatgggtcgcagcagatgggtatatggcaaggacaatgagaggagggacatgtggccagaggctgtggttgtcaatgcagcagaaattcccttaaagggtggaggaacagctgggaaggacaaggtctttagggttgagccggggcaacctggcggaaggtggaaagaacattctgtgaaaaggtggaaaatatgagagtttgtcaacagagggaacattggaaaggtttgcgagagaggggagaagtgggaggttggttaaagggaaaggaagcataaactagctcaaggaaaagatagttcagggcagaaattacatttttaaatgggtttagctgatcccagccttgctaagacaggtagtcccaactctcctgtttataccgaagttttactggagccaattatgtcctggattagtcatttcagagaaggtgtgtgtctcaaggggccctggaaggagtcagcttgtactagtgacagtcttcttaatattgtgcctgtactcttcccacttgtcaaacttgttcttaaaacaactgtgcatcagtgactgtcaatgacttgtctgcagagctttttacggggcagtggttctcacacctgcctccacagtaaaatcacccagggagcttttaacacatactactgcctggggccccagaacaagtatatcagaatctctagggatgagccctctagaatccatacaatcaattttcttttcttttcttttttattttactttaagttccgggatacatgtgcagaacgtgcaggtttgttacataagtatacatgtgtcatggtggtttgctgcacctatcatctaggttttaagccccgcatgcatcagctatttgtcttaatgctctccttccccttcccccaccaataggcctcagtgtgtgtgttcccttccctgtgtccatgtgttctcattgttcaactcttacttgtgagtgagaacacgcggtgtttggttttctattcctgtgttagtttgccgaggatgatggcttccagcttcattcatgtccctgcaaaggacatgatctcattcctttctatggctgcatggtattccatggtgtatatgtaccacatttactttatccagtctatcattgatggacatttgggttggttccatgtctttgctattataagtagtgctgcaataaacatatgtgtgcatgtgtctttatagcagaatgatttgtatttttttgggtatatacctagtaatgggattgctgggtcaaatggtatttctggttctagatccttgaggaattgccacactgtctttcacaatggctgcggagaaataggaatgctgtcacactgttggtggcaataaattttctgaaaagcttccttggtcattctaatgagtgaagaaccttgaccttggacctttgctacccagtatgtggtccaccagccagcagcgtctgtatcacctgggagcttgattgaaatgcagaatttcaggccccactcttgatctacctactgaatcagaacatgcacttttagtacatccccctcctcaggtgattcccatgaacattaaagtctgagaatccctgccttaaaacaaatctggtgcctgggttccacctccagagattctgattgtatttatctgagctgtgacttgggaattgggagttttagaagattcctgggtgtctctaattttcagcagtttaatgtccctgccttacagcaaagaaccggggaaggtgcttggtgcatttttattcaacagggttgaccaaccctatctttgtttaatgatttctgaccttttgtttaatttaccaatgaactacatttgcttctcatttgggggaaaaactgcctgtcttaaactcgtggcaggaacatcatttctcctcatcttcaaagatgctgctgggaagcttagtaactgattagacaggaaatactgcacagcctaaggcctattgcataaggaccagttcatttattaaagaaaagaaaatgttgcttatttttagtgtaaatcattacaaaatgccaaccaactccttataaatttgagaagagcaatcttcctgattagttatttctttcaccttttctaagaccttgtatgaaatgatatttaaagcactcttcagctttctttaagccagctgattgcacaagtcaaacaacagccgtgagtgtgttgaactgttggattactactattataggaatggacacataacaagtgttactttagacctgagtttccaaagtataatcctagcttaaaagggaattttttaaaagaaagaaaacaggaaactgtattgtattgggaggaggctggaggggagatgaaaaaaatcatttggattttgtgtgtgtgggtaagtggggggtagctgtctataactttcattaagtgtttttttttcttctctttataaagtaagctgcaggctttgggttggcaaaccccagggggatgcagaaatctgaggctgctacctttttatctgccttcacggtactgtcctcttcccccagctcctccctgaccctatggaccaggcctcagactttccagctaactgcttcctgtgagccactactctgatatcagcctataaccaaaggagctggggggtccaggcttggtgaccaacccttctcagcccactcaatcagggtgcttcccacctgcaggcaggaggcaacaccctgtctgctaccatcctccccttccagagcccacctgcctgcccagccctgccctgccctgcccagtcgagccataccttgctttgtcccacctgggggtgccctgctcagggatgggctggcagggctgcactcagcttctctggtaagcagagattcaagaaacctctggggtcttgttttctggtcgtgtgatcccaggggtgcacatgttccccttgggtgtctgaacagaagggcctgggagggagggccacacccctgcagtcttgctgtgctggtgtagtgggcagctgcctacccccatcccaccctgcactgtgggctccagaatcggcagattaagcattttataaattgtattttagatacatatttcaaacttgtgagttttttaaaaagaacaagcttgacaagtgttttaagaagtcattatgctttatgggtttgagggggaagaattttttttaaagcatctgatttagaccacatgtaactcagatgtttaaataatcaaatcacctgttttcatgtgggtggtttactctcatgaagaatagaaggttactattgttgaagattttccccaactttttgtttctccctttggagttaaacatatgaacataggaatcatttttgcaccactgatgattgaaatttggtttaggaattattaaaactaaattgtgccagccaggggtgcagtggctcacgactgtaatcccagcactttgggaggccgaggcaggcggatcacgaggtcaggagatcgagaccatcctggctaacacagtgaaaccccgtctctactaaaaaatacaaaaaattagctgggcatggtggcaggtgcctgtagtcccagctacttgggaggctgaggcaggagagtggtgtgaacccgggaggtggagcttgcagtgagcggagatcacgccattgcactccagcctgggcgacagagcgagacaccgtctaaaaaacaatcaaaacaaaacaaacaaacaaaaaactaaattgtgccaaaacaaaagtactgctttcaagctcttatagagaaaaatatatcaatagtctttaaaaattatacaggcttcaaaaaatcagcttttcattccattagacttgctatcagtctacaagaaagatggccattcattttttaaattcaataatgaacagttcattggatttgctaccctttgagtgctgcaaggatcatgctctctttaggaagcagagacaaaatgatcaagacttgaaaggacatgtatcttctctacgttctctgaacatgggaatggcccattaacgtttcctatctccactctcagactgcaaatatatttaacattttcctttcttaatagtacaaggtaatgtaagtgtgttctagagtccacctcctggcattgctaagcattaggagacttatggctgaagtcagctgcccaacatcattcccattagggagtgcctctccccattagggagaagataagacatgatgtctccttattttcactagagtttttcagagctctgatgatggcttaagtctttgtagcagatgtgctaaataagcgagaatccagctctatcctcctctggcacctatgacattgtcttggtcattgtctagccacaaggaatgaggtcaaatttgcagtttagctggaactttaaatgttataggaaaatttaattattcaacttgtacaaatggatggttaagaccaggattcatgccttgtacattatgaccttgtagattcatagatcagtaatgaatcttaaaacatcataaaatagggttgatttaattccaagtccacaaaaccctactaggatatacagtgtctaatacatggatgcacgctgaatgttgaatggtgaaaatgacattttcatggagtgccttagaatggagaattgggttttattatttttgtcatatataccattgactggaaaacacaccacatgttttactgctaaagtatgggagcctggatgtttaaaatggaagttgcctggcacagtggctcgcatctgtaaacccagctactccagaggctgaggtgggaagatcacttgagcccaagagtttgagaccagcctgagtaacatagcaagaccctgtctctaaaataataaaaaaggaagtcaacatactcacatgctgatcaaatcccctgaagtgactccacacagagcacaggcattgaccagccattgctaccaggcaaacttccactacatttcctgcctcctatacttaacattttgtatcataaaaccagtctctcctactaggcactcggtttcatgaaactatagctttataagaatcttctataaaagtccttcactcagctgctttggttgattggtcaactcttcttttgggttaatgcaaaggcccttctttaccacacctaatcctattttagtgggcactccgagtaaatgtgtcaagatgcaaataaagccaaaccatttgaatttttatttaaattttcagtggcttctctccatccacagacttaagtccaaactctgaccttgaaaaatcactgctgtatcttcgttctaaccttatctgctgtcactgactccacactctctcagccatccatgtgtgtgtgtgtgctgttcctttacctggaattgccccatctggcaaactcctatgtagctctcaagagtcatcttccacttcatcttctcaattacgctttccctgagttgtcttcccgagtagttaactttgttcacgccttttttcataatgacaacgttgtgtcaatgtccagcctcccccacactccctctggactgagctccttgaatgtggggcccatggatggcctcttcatctttgtggtcatcccacatagtgcagggcttggtacatggtggccacttcagcaaggtttgacagagcaatgaaagcatgaccatatgagtgcctctccaagtgtctcatttaataatggggagaacttgactcagtaaagccaggctaggacctattctttctttccaactccaagggatctcgactcagtgcttataattatgccttgcaactctcccctcccccaactcccattcaaacctgataaaatgttcacttttgtgttgttttgtgcatacattggtatgtgctggtttggttctcagagctcactaatctaggagtagcgggaacacacacattataaaattttactcattggagagctttatgatttttaatatttacatggaggccaaaataaaatatgtagatcataaatatgttttcttaaggttttgaagtccagtttgaagtttaggatattttttctaacattgattgttactctccaagaaaggcttatcttattgaattgaatgcatggtttgcaaatattaactttaaagaaaagccacagtgtacgtaactgcatattgtcttaaaatcactgtattatgcacattaaaatatgtagctttcctttccagggtgattgctttgtttggtcaaattgaaagtcaggttttctattttggcattatgccttatttccctagactaaatgaaattgttccattatagcaaatagaagcttgataatggtttgattcaaggctaattggaatgctattctcagaatatttcaccattccgatcttattcctcaatattatattttcaaatagagactgtgagctagaattgggttacaagcctttaagacttgagcagctgaaatctcaggagagtttcaaaccaaggcccagtttgaagtataaacagtactgctttcctgctgtcagcaggcgagaaagatttagctcattgcaggtccccacagaaacgaaacactgagacaaatgtctcccctggggtttggcctcaactccttttgagatggatgtgtagtttggagattgataagcaagtaacacttaacattgcttccttcttgtttttaaagcagattgcaacaaggcttcaacatctcttctttttttctttaaggcttcctcacagcaatgaggcaagaagtgacccgtgcccacaaaggctgggcactggacactgtgaccatccacaatgaagttctgagacagaccaaggaggagatcacgtcaccccctggggtaggcgttgctgggcaatagcagggaccattctggagccagagctgaaatttcaagttctgcttaaaactgagctatgagtgccttggttaggtccatttgctttgcagtgagggttccctccgtcatagccagaagacatcagtgccaaagcctcccccatctgccagagtggaagattaatgacaaggtctaatgagctcttagaactccgtagactacatttctacaaaattacaagttacacttgtgtttgctaaaaaggctttttggccaagtgcggtggctcatgcctataatcctagcactttgggaggctgaggcaggaggattgcttgagcccaggagttcaagaccagcctaggcaacactgggagaccctgtctccaccataaacaaacaaacaaacaaacaaaaactagccagtcgtgatggcacacatctgtagtcccagctatttgggaggatgaggtgggaggattgcttgagccccggaggttgaggctgcaataagcagtgatcacaccaccagactccagcctgggtgacagagtgagaccctgtcttaataaataaataaataaataaggcttttctacacatctccagctactgctgtgggctactcacagattctactgtaggcagcagagcagtgctgagggcagcagagatgaaggggactagcaggttggagccaggggccagttccaggggtgtcccctttgagtggaaaggaacatggctggggggaagagcccccacttcctggacactgatctgctcaatgaatgtgggaaaattctttaacttttttgagtcttcacatcttcatctgcaaaatgagcatgataattcaaccttattaaaggagttgtggccaggcacggtggctcacgcctgtaatcccagcactttgggaggccaaggcgggaggatcacttgaggtcaggagtgtgagaccagcctggccaatatggtgaaacccgtctctactaaaaatacaaaacttagcctggggtggtggcaggctgtaatgtcccagctacttgggaggctgaggtgggaagattgcttgaatacaggaggcggaggttgcagtgaactgagatcccgccactgcactccagcctgggtgacagagcgagactctgtctcaaataaataaataaataaaattttaaaaaaggtagttgtgaagatttaaatgtgatcatttaggtgtggtgctggaccccatgtagactctcagtaaatcagtctccctttccctttctctgattttcattccctcatttgtcaagtaagggggctggaccagatgatttccaagttctagccaagttccctgccaccttataacgagggccacgtttccttcagtttccagtattatcttccacattcctgtctgaggcctcaccagaagcaccttaacctccaggttcccaccaacaatctcttttaggcagtttcaaaattcctccagcctctccccattatgcaattccagaataccttccacatctgtaggcatttgttaccacagcatcctgcttcctggaatcaaaatctgtgttcctttccaaaggctgtcataacaaagtatcattaccttgggtggctaaaaacaacagagatctattctctcattgcttaggaggccagaagtcaaatcagggtagggttggtttctactggaggccccaagggaaaatcttgttctaagcttctctcttcgcctctggtggttactgacaatctttggctttccttcatcattacaatctctgcctccattctcacattcatctgtataagtatatatatctctgtgtcctctcctcttcttataaagttaccagtcacattggatttaggacctaccttaattcagtatgtccttatctaaacaatgtgtgcaaagtccctatttccaaataattacattctaaggttctgggtggacatgaagttttgggtgacactattctatctaccacaccttctcactgactttttaaagttctgaggctgaaagcaccctggagagggatacaatttaccatatgatggcttttaagtggtcccattattcatgtagttgattgtcacccactgagttaatgatggtaaccatatgtcctgattttctgggactgcccatggttttactgtcaaatcatgtgcctccgtttttggttcaaaaaacacagtcctcacacggtgagcccccacagggggattccagaaacactttgcaatgaatcttactgtctttcgttctaatcagcatttacttccctgatccgatcctcactggagatggaaaaacggtcaccatcctctacatttacctatttggtgagctggcatgattgttggagcctcccctgtgattctccttcagcctttctttttttagtgaatatactgcctacaggatccagtttaaactcttcagcttagcacccagatccttccacagtcaacccctgacttcttttacaaccatcgagccctctgataaaggaaatactggggcttttccggctcgccctgcctttctttgtagtgttacttctgcctgtgatgcctacgctctctcctctgtctttccaaacacagccccctgctgcaagcccatcaaggcccatcaaggccatcccctctacagaggctcctgagcactccagccacagggaccttgcctcagaattcaccgccctcacccccagaacagttcaccgggcaccaccagtaacaagtgtgtgctgctattcaattcttatctttaaaaaatttttctgcacctatgcatcttatctccctgatttaatgatgaggaaccccagggtagggcctattgtatgagagagacactggggagggtggccagatgctgccctggccatgattcccctggctctaccatgcctggcctctgggggcgctctgactctcccgctagctgggcctggctgtggaaacctcacttcatcctgtgactgagatgaagttgagacacaggttggttggccgggggcaggctgagatcccacctgacagcagctctagatcctgttccatgctcccaccttccaccaactcaaaccagacctctcagagactttcacctccctatagaggtgatctggtgctaccggctaagcctgttgctcagggaggccaccccacacttaaataactaataacaaacacgaacatctctacagcactcatagcctcaacacaggctgcaggagaaaactgggctcagtatttcacgaatgcaatgtacccggtggtgctttctccctttggtagtgttttaagactggtgtgtgttttatttccaaactgacagcctttatgactaattttgcagcacctagtttaaaaaataaatcctattaccttatgcttgactcttccaggaaggtgtgtatatttatgggctctacatggatggagcagcctgggacagacggaatgggaagctcatggaatccacccccaaggtactcttcacgcagttacccgtgctccacatctttgccattaactccacggcacccaaggaccccaagctgtatgtgtgtcctatttacaagaaacccaggcgaactgatttgaccttcatcactgtggtatatttacgaacagtgttgtccccggatcactggatcctgagaggagtggcccttttgtgtgacatcaagtaagttcatttccatctgctcagggcaccagaacccacatagacagcctgtgctattgagggactcagtgatgtgtgtgtcttttctccccagtaattccttaattactctttctacattaaaaagttgatgttctaaaattgctagtgcgtgtgtgttttcctcacatatcaatattcaaaaagataactctaaatgaatgttttttattctgggaaatcatatttcactataattactttttaaagataaaaccctgtttggatgttagaacactttggaagctctgaattttaaaaatttgaaagtgttgatatgtgacatcctaaaaagagcctagtagttgtaaacttttccctcaagtaggtaccaatttcccttgaataaaatctagccatgtctatgtctgtgctaacgtgttatcttttgttcttttgagtttggtgttctgaactctgtgcttctgaaatggaaactgaagagacccagccagtactcctcagtagtacagctgttcagtatgaagtgtttaagacagaaaatcctctgggatggccgttcctgtgatttattttaattttattttatgttgttttattttaatttttactgcttttgaggcccagagaacttagactctccagctttccctcccaactccaattctgcaggagataatgaaacacatttctaggcagcaaatggagaagggaaaaacaaaccctatcaaatgaaattaggttacatgctgaatgtcttaaaaagcaaagtctttaaaaagtgaagctatttcttattctgtagctagtctaaaactcagtttgaaccttgatttcctgctaaaggaaactgtcaatttaacaaaacagatggggtcctatactgaatgctcatgcggcttcaggacagtgaagaagtgtctctaccagtcttctcatctagaatccttgtgcctgcccacagctaaatgcatgagcttcattccttcatctattctgaaggagggaatgtttcaagttgccttgtttccctctcatccttctgccaccttgatcagagatgctgatgacaaacaaaaccaggcaaccaagcaatagcccaggtaaggtttacagaaaagaccccagagaaaactctgccacagtctagtgtactttcaaacagtagaaaacacattatgaaatgcaaattgtagcagtggcctctggtattttcctgatattgattcaatgtcaaaaccatagaactttaaaaaaataaaggcagttttaaaaataaagtagccaacccctggctcaagtgttttagcactttccttggccgatacatacactaaagtaaggatggcattcttgagaaagaatatcctcctgaactgaggctagaatttggaagcacctgtcagtctgggtggacacagagaaagttaaacaccatgacattatagcaaaccaagctgcatgttccaaaatcaaacacacatgttttattgatagccctgtccagctgctaaaacaattgaaggcaaatggaaagtcgaaacccctggatatcacgataggttttccaagaataataattatgttcagtttcctctaatgacttgaatgtctcgtggaaaactgggaatagaggtgaagaaggtgtaaatctggcaaagatcattgatcagaccagttaaagtcacacatgtgccatttcctgggcactctctgctgttgctggttactttggactatgtcaacacagaagagagagagagatgggcattaaggtccggcaaggatgggcaccaggcacctgggcagggcctcaaaatggtcttctttctggtcagtgcttctcagctgtccctagttctgccagggtccagttctgctttctttctctaggcccagtaaatggtttccttggacattttaattgacattaattgaacttccataagcacataaccattttctctgcaaaattgttgctctttcactaattacataatttgccccacttgagtgagggagacctggtgtgcacaaaggagcaaaggatagaggacgaaatgattaagccaatgaagctgagagagaaggaaagtaattgttcttcttccttggaatcaatccacatcttcttattttgctcttggcaaaatgagcaatgagatttataccttccttgattcaaaatgttcctttagtttggactttgcataaaaataagaccaaaagaaacgtgcagagagatacatcatcctaaagggattggtcttgtgggtgatgttgcatgaatgagccaccatctctgccaccagagacctcagatgaataggggactcaccgtaactggaggcgcaaggtgactcagggccatgggtgaagttcaaaggaatggtgaaggaaactcaggatt

SEQ ID NO: 15842 - DNA, 222697 bp, Human
tgagtgcccctcaggcatgtatttccctacccaggacttgcttttgatttatccatgtcacactatgcacacatcaaaaacacatcgacctctctgctgtaaaacagaacgaaatcatgtcctttgcagcaacatggatggagctggaggacattatcctaagtgaacaaactcagaaacagaaaatcaaatattgcatgttctcataagcgggagctaaacaataggtatacatgtacataagaatgggaataacaagacactggggactccaaaaagggagagggtgggaagggggtgagggctgaaaaattagctattgggtacaatgttcaatgtttgggggacaggtacaccagaagcccaatccccaccattacacaatatacctatgtaacaagcaagcacatgtacccccgaatctaaaattaaaaaacaatcaaaaagcaccgacttccttaactggcagggaatagtttcgagaatggatgtaaacaccgaattccttaatgtagttgcagattctgccagttttgtctcaacctctggatcggttcctttttttaactacctttaattcttaaacagattgttgctattgctatgctatatacttattgtatcacttataaatgtataacctctgcaaattagtctctgaattgaaagtattcattggtaaaacgggtatttcttcaccataggaatagttggacatgtttaaatacttgagagctatttttattacaagcacacacagctttgtggtgttttttgttgagacagagtctcgctctgttgcccaggctggagtgcagtagtgcgatcttggcttactgcaaccttcgcctcctgggttcaagcaattctcctgcctcagcctcctaagtagccgggagtacacactaatttttgtatttttagtagagacgggtttttgccatgttggccaggctggtctcaaactcttgacctcaggtgatccacccgcctcagcttcccaaagtgctgggattagaggtgtgagccaccgcgcccggcctgtagtgtgtttttgaacgtatatgtgaagttgtagcttttttttttttttttttgagacggagtctccctctgtcgccaggctggagtgcagtggcgcgatctcggctcactgcaacctctgactccctggttcaagctattctgcctcagcctccagagtagctgagattacaggcgcccgccaccgcgcccggttaaacgttttgtatttttagtagagacggcgtttcaccatgttggccagaatggtctcgatcttctgacctcgtgatccgcccgccttggccttccaaagtgctgggattacaggcctgagacacagcgcccgacctaagctgtagttttatgattatgatttatggttgtgaggcattgatttaagacattttaaagcttaagtcgtcagatcctagaagaaaaaaaaattcaccaagacaagctaatgccattgtcataaatgggagtttggagaaaattttattaatatttgtttgggtggtttatgtacagcgttgaactgatttgaaccccgaccaaacactgtatggaactaatgtacggtaggggaaatcattaactgaagatgccttttttgttgctattgtttagaacgcagttagaaaatcttattttagaggttttaccccgttgacaaagcctcaacttttcttcaaaagaactaatttccattttacctcccctacattttgaacagaatatggaagaagccagcgccccttctccgcgggcgctgctgcaaccctgctcccgccggggcttccgcgcgaaaccgggaacactggagcagtaccgactccgctcgcctagaacccgccccagccgggcccacttccgccagagccctggccgcgcccgccccgccccacggacccgagattcgtcggaattttcccgcgacgccgcgggagcgcgcggggccgctagccaggccccagaatgcactgctgacacgtgtgcgcgcgcgcggctccactgccgggcgaccgcgggaaaattccaaaaaaactcaaaaagccaatacgaggcaaagccaaattttcaagccacagatcccgggcggtggcttcctttccgccactgcccaaactgctgaagcagctcccgcgaggaccacccggtaagcggcaggccgcagaacgcagcgagggcggaggcttccctcgggggtctggccgacacgtcagcggcgagagcgggaggaggaggcgaggggcaagagggaaggctcgcgagagcgggtgggccaggcgcgccttgcggtgggcgagaggggttcccgccggcgcagggctgtggctaaggctgaggcgggaggcgggaggcgggaggcgggaggtggcgggcggtgccagcccgcggggcggggccagggcggggaaagcgggggcgggagccggcgctggggtcgcgcggaagggagcccccggagaggcgggagccgggtgttggcgttttggttctttttgttcattgagcgcaggcagctatgtcttcttcaaaggagaggagcaaaggtgaatttctctgcctcggactcgtgggagccgtgaaaagctcgcccctttgagccggtcgccctctacagctggcctcgtcctccccgtccctcacacccctgcccccaaaccccattcgccggggcgccaggaggggcgaggtccaattagaggagcccggggcgcggctgttacccctcccgccctccgccttttattcccggagggaggcgggttcgcagaggccagtgtcttccctccattctttttgtggacgccaggccatatcttcaaagcccgtgagagatttttcaggtgctgtttgttggtttgctctttttaattttttaggtgggtgcgtttacaactacgaaccctctatgatcttatgtgtccagcgcaccgaatgggggaaaagacttggagttttataacatgggaaattgggtaccagaatcttaagggaagagaccaaggagttttctagcaaagtcctgtatgtgcctggacttttgttctaatctgaaacttggaaaactcccgggcatctgattttattctaacttgtgccccatttaatgcatctaaactgtgatgtgatttgacttagcatttatcaaatgagcagagcacttttgggccacccaacttcagctctttgtggctgtcactcactgtcagtgatatgccctcagacagatcgttttctccttactcccctgaaaggttgttacaaacagtagaattcataccatgtgttgagatcattcattacctaagcttagatggaaaacatgttcattgcgactttatacattaaacttgaattgatgtttcaatgttatgtgctgtaccagagtcacctggaaataagcactcatatacattattcatatacaagaaaggctgcatcgaaaaagaatttgttttcctagatatatcagagatctttttcaccaacccactactcccagtaatagagcctgcttcttgagaactggactaattatactttgtatattatacattcgaatttatttttgctttattcggtcatattttctcttgatttctccaaaaacgtttaccaaggcatcagaaaagaaaagcaggctctatattggtattttttgttttgtcctctaataaaaagcattaacttgattgattggctggttgtggaagatgtgttgctgcatgtatgtgcaactgtgcatgtacattttaaaacaaatggtacttttaaccagttccatatttcagcaggtagttccaataacaattatacaaatttcgtgtttatgagaaccagctacagggaggccagcctggccagtagaaagttggattgattatctgggccatggagagagccagaggaaactcacatgagtggtagttccaagttggtagtgttagggcctcaaatcgggctggaaatgagcaccaaatgatttttaaaagttttattttaggctgggatatgtgcattctctgtcttgtttgtggatcttgagtgattgacttaatgtgaaagaatacatacaggagaagcaccttggaagttttgcaatgttttaataaaaatgcagaagtggagaaggaaaggcaattcagataacaggcagagcatggtggcttatgcctgtaatcccagcactttgggaagcggaggcggaaggatcacttgatcccaggagttcgagtccagcgtgggcaacagagagagccctgtctctacaaaaagttaagaaattagccggccatagtgatgcggggctgtggtcccagttactcgggaggctgaggtggaggatcacctgagttcaggaggtcgaggccacagtgaactgtgattgcgccactgcactccacactgggcagcagactgagaccgtgtctggaaaaataaaattggtaacaattcagattggccaccagagttggactgggggctagcaggcaatggttttacctccattttgagattggcatcttctaactcaagtttaatacgggactgagggtaagagacctgcatgccttttatgtcagcattacattatcttgattatggcagctttatagtaagttttgaaattaagtagtgtaagttatccaatgtttttcttcattttcaaaattgttttggcggttcagggttccttacatttccatataaattttagtatcagtttgttattttttttcagaaaaccgtgctgtgatagactttgtaggaattgcatttaattttgcatatctatttgggggagaattgccatctcatcatgaacatggaatctctttccatttgttgagcgctttaatttctcttagcagtatttagtaattttcagtgtacaaattttgcccttttgtaaattaattttgaagttttatttttgatggtattgtgaattgaattatttttaaaatttcattaaaattttttttatcgataaagtgaaagcaagttttttgttttttttttgagacagagtctcgctctgttagcccagactggagtgcagtggcacgatctcggctcactgcaatctccgcctcccgggttcaagcgattcttctgcctcagcctcccgagtagctgggactacaggcacccttcaccacgcccggctaatttttgtatttttagtagagacggggtttcaccatattggtcaggctggtctcaaactcctgacctcgtgacccgcctgcctcggcctcccaaagtgctgggattacaggcgtgagtcactgcgcccggccgaaagcaagtttattaagaaagcaaaggaataaagaatggctactccacaggtagagcagccgaattatttttaaaatttcattatggattgttgtcagtatataaacatacacttgatttcacttattaatcttatatcttgcaaccttccttgttgaacttgatgattacttccagttttttgtgaattacacaggattttctacatacggcatcatgccaatatagttttacttttctttccatgtggatgcctttagtttcttttttgcctgattaatttttttcttacctggttcgaccctccagcactttgctgaatagacatggagtgtatattattgacttatttctcatcttagggggaaaacatttaatcttttaccattagatacgacgttagctgtaagtttttcataaatgcactttatcaggttgagagattttccttctgttactagattgttgagaattcttatgaacaaatgttagaaatgttgcttttctgcatctattgagatgactgtggttttgttcctttatcaatatgatttattaactgatttgtgtatttatactaaccttgcattctaaatcccatttagtcatgttatataatcctttttacatattgctggatttggcttagtaatattttgtttaggatttttgtattatgttcatggtaatattagtaatattttgtcttgtgatgtctgtctggctttggtattaccgtaatagtggcatcttagaatgagttgggaagtgttccctcctattttttcagagtttgtgaaggattggtatttttttttcttcaaatatttgatagaattcactcacaaagtcatcagttcgtggatatttctttatagggaaatttgaaattacaaattcaggttctccagcgcacgcatgcgtgtgacttctccggtgaaggttgtcgtgcgcgcacctggccgtgactcctccagagcgaggttgtgcacacatgcgcgcgccttctccatcgccagcttccacatactttctccagcactggttcccaggcacacacgtgacgcttctccagggcggagctcccatagtgtgtgcggctttctagcgctcactcttggtgggtgtgctttgccagcgctagctccctggggtgtgccgcttccccaacgctggctcccgtgcttgggtgccgccccagcacctgttcccaggcgtgtgcacgtctccagcgctaggtccttggcatatgtgcttctgcagcgccggcttctgtggtgtgtatcttccccagtgcaggctcttgtagtgcgctgtgatcagctgcacccaatggtcaactgtgtacctcagcatccccctcaggcgattttgtaactgagcctgtggtgggacacctccctgtgaacacttttcctggcgccctagaggatgggtttctggcaagttaccaaaggtggttttccagcaagttgtactggtacagcacccacagagacatctctcgtattcagtgagccatggctgtgctccctccaaaaagttcttgatcccatttctgggaagaagtgggtatttttccttagggcacccacctcagccctaggggcagtggctcctccttatatctcctattcctgtgttttgtagaattctctgtacttcttactagccagcaccttgttactccagtcctgttacagtgaatagttcttgactgggcatggtgacttatgcctgtaatcccagcactttgcgaggccgcagggcttgggagaattacttgagactaggagtttgagacaagcctgggcaacatagcaaaacccctgttctacagaaaacacgaaattatctgggagtggtgtgtgtcccacctactacggaggctgatgtgggaggatcgttgagcccaggaggttgaggctgcttggagccatgattataccattgcattccagcctgggcaacagagtgagaccctctctctaaaaaagaaaatgacaacaacaacagtaattatttatagttgactttccttattcaaattattatgtggtttctttttactgactggacccagactgatttatcacctttgctctgaacttcctcaagaaatcatgagtggtgagagtatttagtctgttcattttcttgaattgtgaaagttaatcctaaggtttctcccacttccacatgacgaaagacacgtttgtgtgagagtatgtaggcttttatgaagtgatgaaactgcctttccatgcctttgcaaattagaaacagtatagattatcatggaaagtggggtcagagattaggaggggaggagaagaggacaggattagaactgtggtcgaccttatggcatccagtgggcagggttcccagatgacctgactttagatgtgactgtacttctcattatctttcacccctgtttttcatttttcagatttctgggacttgtgttttcattttcctctagagccccaatgatgcttttgtaattcagaaacatttatgtgtgatataaacattttatatacatttagctattttagtggaatctgagatctgttactctggtgactacccataagacagtttgaggctgcggtttttcacacacacacacacacacacacacacacacacacacacacacagattcagaggagactatttaaacaatatgaatttggctgggtgcagtgctgtgcacctgtagtcccaactatttgagaggctgaggctggaagattgtgagttcaagtctcctgggcaaaattgtgagaccctatctccagggaaaaaaataaataaataaaaggctatgactttatgtctgtgattccttctttacctggttcagttcaaaggtatggaattgccagacacttttgcttcttttataagattttggaggtgccatttaccttagtgacttccaacaccctcctatggctggttcctttttgttgtcattttgtttttgttggttgttactgtttacttaaagctataacattataaggcattgtacttagcctaatcctatttttgtaattatgcttgtacattcaagtgctgtactcaatagatttccttattaactcctgattttttttttttttttttttttgagacggaatctcactctgtctcccgggctggagtgcagtggcgcgatctcggctcattgcaagctctgcctcccgggttcacaccattctcctcctgagtagctgggactacaggagcccaccaccacgcccagctaattttttgtatttttgttagaggcggagtttcaccgtgttagccaggatggtcttgatctcctgacctcgtgatccgcctgccttggcctcccaaagtgctgggattacaggcgtgagccaccgctcctggccaacgcctgatttattgatgaccatttgtggttatgcataatgacttttcctctgtctttgtgcactgcagttcatattattgccttatgtgtatatgcttgtttccacaactcttagccaacttcttcagggtatattcttttttattatataactgcattgatgtttgttgagtgccaacatcctttcctcccttctctgtcataacagaccctagattttcttttagtagtcactattctatgggctctggggaacactgatactacctctagctcctgggggtggacttttattggtttaaggagtgtgttttattgattcgtcacagtcattggttaaggatgggcataagctcaagcaagtccagtctgaatacatctgaggtctgtctcttacttgggatgctggaacagaagtatgtactctatttttgggtggtatggatgtgatgtgacttctgtaatggctaaagctgttttgctatcatgagggaagcaggatggagagacagatcaactgtgaagtctgccctgtttctggacttgccagtttcttgaaccaacgaattccccccctccttttttttttttctcttttgaaacagggtcttgccctgtcaaccaggagtgcagtggcacgaacatagctcactgcagcctcaaactcctgggctccaggaatcatgccacctcagccacctgagtaactaggactacaggtatgcaccacaatgtctggctaattaattatcattatttttgtagagacagagtcatgctatgttacctaggctggtcttgaactcccagcctcaagctgtcctcctgcctgggtctcccaaagtgctgtgatgagaggtgtgagccaccatgcctggcctcccattattgttttagctggttttgcttggtgcagcaggggcatttaatgcttactaaatatttagatcttccctcacatttcccagttcacttgcagctaggtaggacattgtgattgttctagccaatagattttaagcaggttatttccaggtagaagcatttagtagcagattcctgacctagctatctcttctttttgcaatggtgattctggaggctaggtgttgagatgtctgagcacctgtcatgctggatccatgagtgactgtggagcagaacaacacccccaccccacaaacatgtgtgtcccacataacatgttggacatatagtatcagaaaaaagttactacatcataacttagcctatcttgatgaatagagttgggttttcaattactggaaaccaaaggcatcctaggtgatatagtataattttgtaattcttagtgtgtatttggtgatttacaatgtatgcagattatacattgtaattgattagtaagacacttgtctgaaggaatcagttatatttagccctagctttctgaatttggtgtacccaaacatgaccttgtccaacatggattgtaacgattacttagcctatctacccctacatattaaaggttataataaaacactatataaaatatacatttatacaaataatatcgaattgctgcttttgcttgaagccgttagctaggaatttccaatcataggccgtaagagtgagtaaccgtttattattggtataacagcatgcattttatttatgaagtagtattttctgcagtatttggcacccagaagagtatcttgtgtttctgatactgactagtaccattagaatttttagtcattacactaaaaaagttggcaaagctagtgaaacttttgcttgatgataagtattttgataagtggtgactttttgaaactatgcagccagttttaggagtaacagaaatatttttatatgaaatggtataatatgactgattttttcttaaaattgagtagttgtaagcaagaaaagtgcaatacaaatatctttttcttttttcgagatgcatctcactcggtcccccaggctggagtgcagtagtgcaatcataactcgttgcagtcttgccctcctggactcaagtgatcctcccacctgagcctcctgagtagctgggactacaggcatgaggcagacactgtgcctgcccttaaaaatatcttgaattttggtagtgacattcctttgaaggtattaaaagctagaaatttgtttcattctatcaaagtttcaggtatcttcatttagttctacacgtgtgtgctgtacccatctaatgtttgcctaaaattgtactgtctttttggttttaaaataatttaagtctaggccgggcgtggtggctcatgcctgtaatcgcagcactttgggaggccgaggcgggtggatcacttgagtcctggtggtcaaggatgcaggtcggctgggcaaggtagctcctgcctgtaatcccagcactttgggaggccaaggcgggtggatcacttgaggtcaggagttcgactccagcctggccaacagggtgaaacctgtctctaataaaaatacaaaaaaaaactagccgggtgtggtgacatgtgcctgtaatcccagctacttgggaggtggaagtacaagaatcgcttgaactcgggaggttgcagtgagctgagattgggccattgcacaaacaaacaaacaaaaagcggtgatctgtgattgcaccactgcactccagcctgggtgacagagcaagaccctatctcaaaaaaaaaagaaaaaaaaattaagcctaagatgtttaatttaaaaataagtttttaaaaaagtatgtttttgaggcaaaatggtgagaataggacaagtatttgaaaatattgtggtacttgatcagaaccacctttggttacattgttttgtggccaaagtggctatgactaaatgactacatgttattttaaaaacattgtttctaaggtattactgatgtacatgaatggattgatattatcatggagtggtttgttataaaagcgagtttggccctcttgtgctctgtcgctgtgtgatgccttccattgcgatgtgacccctcaatcttagacttcccagcctccagaactgggagctgataaatttctgttatttgtaaactactgagtctcacatattctggtatagcagcacaaaacagactaagacaggcagttgggcaacagcaagtctgagttcccttccagcagcaactggcaggagtgaaatcctggctgtcttctttgcagtcaaatgctctaccactgagctatacctactggctatcttctttggacagttgctgtttttcaccacaagcctgtctaattgctttactcatttaacttatctgttgtggactttgaatttatgacctttgtctaaagtaatttaagttttgaataattctgaaatgcattcagttgttaaactaacacttagaaaaaaatggacagatcagaacaaatttgtcatacttattggagaaattactgcactaatcagggttctctggtgacttctaagtttcatatctgtagaaaaggttattattattcttgagcagtaagatactgtataccctttataaatcagagctttttgttctgttgattttatacaaatacgttggttttataagcatggtttttttttgttaactacttcttttgatttcttaatttatttctaacattactttgggcaatagccctattaaaagtgctttgtactttccaaattatttccatatagattatatgggattctcacaataaccatatgtgctaaggtaagataggcattttaaaaaaagaaaaacagggctgagcacctgtaatcccagcactttgggaggcagaggtgggcagatcacttgagcccgtaagttcaggacgagcctgggcaacatggcgaaaccttgtctctacaaaaaatacaaaaattatccaggcgtggtgacatgcaactgtagacccatacagtgtgacatgcaactgtaggctgaagtgggaggatcgcttgagcctgggaggttgagggtgcagtgagctatgatcataccactgcactccagcctgggtgacagagcgaaaccctgtgtctaaaaactaaataaataaataaaaattagaaaagaaaaatagaatggagacttttcaaaaaaattactttggctcataattaaggaattcccaagagattgcccaaaggaggatagctactgatgaacttcttgggttgattgtgtgtgtacagcttttaaatgtgtcttaattgttatgagatgataaccttttcaataatcaaaagagccgggtatttctggttacccaaacccaactgattttagcagaaaacatttgccttaaataataacttctctttgaaatgtttagagagaaggaaactgagtttaatggcagggttgttggctgttacccagggaaactaactcctgtctggtgctctttttgttgcaccagtagttcgatgtccaagggtggctgaagcttcctatggaagcattgttaagcaagtctttcgcaggctttcggttgcatctttctactgtgtaaataggggcattaggagaaatgtaatctttgaatactgcccaaccagtttctgcttggtaatgtgccctgaaaccctcaatgaatgccagcaaacaaattagatccacagtgtatttgatacgcatgtcttttccccaaacaaaattcaaatttcacaaacacaaactgagtcattttccaaatgtttgtatatgaatggaagtttttgtcctgttcttctgtaaccaataccataaaacttctgaaggtccttgatgcatttattgtacaatgttaatccaaaacaaaactttattctgactaaacttgtaggtatagagagataccaaactcatttttgttgatcagtacaacatgtttgtaccaaccagatctaaaaaatgtgtaaaggagtgccatgctgtaaagaccttattacagttgtaaacatcagtgcagctgttacaaatctagcaaaacctcaggttaaacaatttcaaatttactgaagatgacattccagacccagttttcataacataaacactctaggaaatgcctttgagatgagtgggattgtcattaatattaatgccaccaaattcaaggctgagaagtcatttcttttcaagctttattttcactcctaattttggaataaaatatacttttaacctgaagtatggcgtgtcttttcacagcctgaaaacatttgatcctgttgcctttgaattgtaggaatgcaaaaatacagtataagtcttttattcttgatggtcatttaacttaaatgagtttgttagaattaaagttgggaagaattaactgttaatggaactcagttgcattgttcaattaaaaaataaaaggatgctaaaaatagttgctgtttaaggattgtattagtgtgagattttagaatgctgcatttagggaaggaattttattctaaagtgatttgaagcacatttttttgtggtcctgtctttcatctagacaaggtaggacaagcattcaaaacctgtaccagtcttaatctgtttttttcttcttagtttccacttagtgggacatctggtgaggtatcattttggccatatagtcatttctaaagtttctttctgtgctctgatttccaattaagtcttctatgatgtttgccaaatttaagagcatgcaggggtccactggaagtgctgaataactgggctttggcctaattctttgtgcatggctgtatgtgtggggtgattttgttttctttgcttgtttattggtaattgcattaaattccatttgcctttactgaatttttttttgttggacttttggggaaacctctaaattggataatagagcaattaagtgactgtttgtaagcgatcctcagtgctctattagagaggcagcatttatcaaaagaaaacagttgaatttctcttgtttaaacttgcttttgaaattctgttaattttctaataaggagaattgaagccaagcattgtcaagtaccatattgtaatctgaagttggtaactgtggaagcacatagttgatatggtgatacctttttcagaggaactttggctatttccatcagcataaaggacacaacagactgcatctattgccttcacctctgccttatttcttctgttttcccttttttttttttttttttttttttttgagatagagtcttgctctgttgcccaggctgcagtacagtggcacgatcttggctcactgcaacctccgcctcccaggttcaagggattcttgtgtctcagcctccaaagtagctgggattacaggcgctcgccaccacgcccacctatttttttttttcgtttttagtagagacagggtttccccatgttgcccaagctggtcttgaactcctgggctcaaatgatctcctccctcagcctcccaaagtgctgggatcacaggtgtgagccaacactcctggcccccttttttttaaaaaaaattaaagaggttgtggaggtttctttgaattcttttggtgtttttaaaaatgttatattttgagaagaaaatctgggcaggtacaaagaacccctccctttcctgtttgaaaacttttttgcagtcgccctggaattttccttcactgtcattcatccttctctcctttcttgatattgggtcttctgtttactttattttctttctttgttttctccctcctcttgatgtgaagcagatgttctagtatcttcctaaagcagaatgtgtgggagatgaattatttctagtcactgcctgttgaatgtgaagttattctagtcacatttgattgatagtttgtctagataagaattccaggttggaaattattttcctttagaattgtgaggcattgtttaatttccttctaccttcctgtgtttttacaatttcatgatgatgtgcctggtgtggatctcttctcatccattttcttgggcacttggtcagccctttcaatctggaaactcctgtcttttcgttctgagaatatttttggtgattatctcttcccttccatattggaactcattacaagaaagctaattaaggaagagtagagggttgtgttatgggctgaattgtgtccacccctcccccattcataagttgaagctgaagctgtaacccccaatgggactgtatttggagatggagcctttaggaagtcataccggtggggtcctaatctggtaggattggtggccttagaagaagaggtagagagagagatctctccccacatgagcacaaagaagaggtcatgtgaggacacaggtggctgcctacatacaagccaggaagagggctctcaacaggacctaataggccttgattgtggactttacagcctccagaattgtgagaaaatacatttctgttatttaagccaccatgtatgtgatattttgttatggcagcctaaactgacgaagacaggttgaggtcaagctaggacctcagcttcataaaggtgaactgcatgcgttgcaagagaatattaacatgatgctggtgcgcgtgtgttctcctttttgactggtccctttttgaacttagctcactcatctgcatatcaccctttgtgagttagcacaagtcattaacccaaggttctagatctgtgctgaccaatgccatagtcaataggtacgtttaattatataaatttacattaattaaaattaaataaaattcaaaattcacttcctcagattcattagccatattgcatgcgttcagaagccacatgcagctggcgcctgcagtattggatggacagatagagccagaacctttccatccttgcagaaagtctggctgtacaaccgtattctagatacttgccttacacctctccctctctcttttttttcttgtccagtgggtctgaacttttttaggttcaagacatacttaggaatactagaatttgtagtggacatcttcaaggttttaaaacaacactaagaagtaaacagccattatagtgcaaactctgccaaagtgtcatatgcatactgagtctataactgcgtctgcagtgatcatgctattcatttggccatgcttctgcagtatggcccttagaagagctgttttttacccctactgggctttctgatatgtttgtaggacagagaattgcaggaagcaggccttcatatctgagccgtgctgctctggtttgctgtgctgaatgttgctgtgctctcccggaagaggtaggcacaagtgctttagaaggaactgtcagaaccccactgctctactgagcactggtgagtctgaggattcacaggctaaaggcaggtcactgaaagcggcctacattctggaatttctcggaacagattatttcctgagatgacaaaaagtataattttggtcagaaggatcactgaatttcctggaatctaccccaccaggctgtgtcttcataggtgggaactgttctcaagaatcctcaaaacagccctttgaggtaggttctgtttcactcccaaagagaagcgaggttggcactcagaaatttcacatcatttgccctggctcactgaatgaactagtgaatagtgacgccgggttcagacctttccgtttttctttaaaacttgtgtttctttctaccagaatgcaactagggttggccagtggccccttctgtccaccacgtgggagcagctctcctaaagctgggctctgcattaaagggattgtttacaaattcattaaattaaacatgtttaattcagggtaaaaactgaatgatttagaagatcttttttcttttgtttttttctttgttttttttttttttttgagatggagtctcactctgtctcccaggctggagtgcagtggcgccatctctgctcactgcaaactccgcctcccgggttcctgccattctcctgcctcagcctcccgagtagctgggagtacaggcgcccgccaccgcgcctggctaatttttttttttttttttttagtggagatggggtttcaccgtgttagccaggatggtctggatctcctgacctcgtgattcacctgcctcggcctcccaaaatgctgggattacaggcgtgagccaccgcgccaggccttttttcttttattttaaagaactgttgttatttttatttcaattaaattgaaaaacacagggaaaaaatgcaacaacaacaaatcccaggcagggcatggcaactcacgcctgtaatcccagcactttggatcacttgagtccaggagtttgagaccagcctgggcaacatagtgagacctcagctctagaaaaaaagaattagctgggcatggtggtgcatgcctgtggtcccagctactagggaggctgaggtgggaggatcgcttggaggaggttgaggctgcagtgagcctaaatcagtcatgccactgcactccagcctgggcgacagaacaagaccttgtctaaaaaaaacccagaaccaaaaaaaacaaaaaaccccaacaaatccctcatagcaccagcacttatttttgaagacttcctgtacttacacatataaatattttgtacaaaaatgttatgatattataaatatttttctgcagcttccttatttgacttaagaatttatgatgaacatctttctgagtcagtcaggaatattcttcatgcactgttaactcctctgttactttaacaattttgtgtgtgtgtgtgtgtgtgtgtgtgtgtgtgtgttttgatggttattgttatactgactttagccacttttcatcattttagcctttaggtctctttttttctttgtgtggtcttaaccgagaaataattgcaagcgaggaacaaagtcttaaatttggtggcactcaccaccaaataattgcagatgtttgccttccttctacatagaaagagcccactctcatgctgtatttgttcttctcatcctcccctgtcttatttctctttcatttcgtttaattttaacctcaataccagacttattttgtgcagcccttggcctgctgcggagttatctttgccactggctctctttccagcccccagtcgctgatgtgtctcttggcagctagtgtaaatgatggtggtcctctcattctgacgtgggagcaccccaagtcagcagtaatatttggtgtaacaagtaccagggtgggataaccacatatccctggactgggattttaaaattgtcagttgtcctgtcatttgtggtttagggatcaacttgagcaagagaaactccgtctctactaaaaatacaaaaaaaaattagccaggcgtggtggcagttgcctgtaatcccagctactcaggaggctgaggcaagagaattgcttgaacccaggagtcggaggctgcattgagccgagatcgtgccactgcactccagcctgggcgacagagcgagactgtctgaaaaaaaaaaaaaagaaattgtatttatttcctacagacttctttttcttggttatcacctgacattgccttatcaggtattttattatgtattttattcctttttattatttttggcttaaattttccttttagtcttttacttggatcattctttcttattttctcctccatattttggattcttcagacttcttcccttttcttaatcttaccattaccagatttcccttctgcttaaatttcatgatccagtttttcagtggatggagatagaaggctgaggtgaggaaggtgggggtaaatacgatacttgctgaatttcaaatataaaacaagatattaaggaacttatttccttttttattccctatatttgggagaccatagaattggctggccgctaatatcaagtggcttttgtgtgtagacccttacaaagaaatgactgataaagtccctacttctgggagttctgatagtaaaaagtgtgacatccatgacacatacattgccagtcaatgatggatagaaatggacagactttgaggagatgagttttgagtatacagagataccattttgtgtgtgtgtgtgtgcgcatgcatttgagacagggtctcactctgtctccctgcctggagtgcagtgatgcggacatggctcactatggcctcgacctcccaggcttaaacaattctcccacctcagcctcccgtgtagctggaaccacaggcatgcgccaccatgtctggctaattttttgatgttttgtagagctgaggtctcactatattgcccaggctggtctcgaactcctggactcaagcgatcctccttcctcagcctcccaaagtgctggaattacaggtgtgagccactgcagggccgcagagatacagtatatttgtgataccattagtaacttttatttgacagagggttaagtattgactaagggataaaacctattctggggcttagaaaacaaggttttgctccaagaaggcggttagatgtggataacggtttcagtactgaatttggaacctttttactaaaatgtagtctacatgtgggtatctagcaatagagtcactgttagtaaagaactatatatgtgacatacagaggaaccacatacagtttcttaaaataatatgttcttcatctttgaggaaatcctagacaaagctggaaaaatttcaagttttcttattgctcattacaaattatagggattttgatattgtgcagttaaaagttcagtagattttcaaaactagttattaattgacctcggttctgcacatttttgttgctttgcaagagtacccttaaggctcaaataaagttaaaagtaaggtaaatggtgtgttagactaaaactgtattttttgtctgtcaacacttaaatagaaaaacaaactagcttaagaacatgactgcaatttaggatcttaaaaccatatataccgtagtatttttaaagcctgcaaccaaaaagtagaatcattgtgttttatagcactttgaaattctgtctgatgttactgtatgtctgtgctgtcctgatatggcttttggattgcgtttgtggtacaagattgatttcttgtatttgtatattacttggctgcacagatggtatccgcttcaaatctactaaataaaactagaacaatgattttgccagttggttttgactgcttttatttattttggatggctgtagtctttgtgaagatggcagactaaacctggaagtgacagctaagaacagaatgggtgggctacaggtctgctaattgatctcagcagaactcatgctacttctccctgggtacaagacgttttcttcaattgaatgttcacaggccagctgagccatcctttgctcccatatctctattgtccttggcccagaccttttctcatcctccctgggttatctcatccatttccatagctttagttactgtctctctgttgatgtttctacatctatgtcttcagctcaggcctgtttcctaacctcttcctcacatacccactgcctattggacctcttcatttagatgccccaggtctcttgtactcaccatgccctaagctgagcctgtctttttatccaagtatgttcctactcctttgttgcccctttcagtgtatggtggcataacacatctagttctctaatcagaaacctaagcaacatctttacctcctctctattccttttttttactatgtctgatctaaatactaaatactatgtgttctccctgataagcatctcttatctgggtgcttttctctattccttcatgtgactagactaggcctcagttactgtaagatggtcttccatcttacagtatgatcttgtctcccctggtggtccattttctatattgcttgtgtgatttttctgaaacagaaatctgagtatatcactttaatgctaaaaatcctccagtgacttacctttgctcttagaataaagtccagagtccttactctgttttgtaaagtccttttaaatccatctactacttgcttgagcagggtgacagtcttggtaaaatgtacttttatagccagaagtccccctcacacttaacatatcatgatgctttcctttcttgtgagaagcgagaaattttattgtgacattttgtccattagtaaaccacactcagatctgtgtgcccctcttccaaaaaatacattatacatatttctacaaagagagaaaacatgtaatagttgtcaggttcttttgagaaatccttttgtagaagttatgcttggtgttgttttaatgtttttattacaaagtagagagcctgtctgatgaatcttacacaaataaagtaatggaggtaattagataacaccacagcctttcctttctctccagaagaggtaacaagagtcagcattcatttggaagcagttgcccagacatgccaacagaagttgtgggcatctgtatctccttctaagaaagcgggtttcctgaaaaccttgggaaaggaaggaagagagggacggagagagggagggaagatgctatgtaggtgggccagtcaccagcagagggataaaaaatggtgagatcaaaatataaaagcacgagtagtgtattcctttggctggcctctatctctagatgccctaaaatgtttatctccattattataagtcagtgtagatgcctagagaaaggaggcatccctgatttgggcaggattctaaacaattgccttttgtattgttagtctacactttgctgaaagtccctcttgcctcagtctgctgttcccctggtgagcccccacatatggttcagttctcagtgtcaggtctctttttctggaaactttcctcaacaccccaaatctgggttaagtgctccacttagtctgctgtactatgtaacacttctcactctgcagttttagtttgtattttaagttcagtgactatgactaatgttattgtttgaaatgaaagagattttaagagtttcttcaagaggattgaccagagtcctgagacatttctccattcctaaatatataaaagccatgagttgcctttgaacttcattacaattttgaaaatttttagacatatcaaaggtattctgtagatgagagctagcccgcttcaatccagttgtgactatcttgagtgtgaatgtcagtgttcatgtttgatgttctttattttggtgtatactctaggtgtaaagccagcccaatattgtcccaacacatgactgtgtttgtttggctaactgaatacaccttacctgccttttctccactttctgtcttcatatcgaaatccatacacttgaaatattctaatccattagatatatgtaatttcctcatttatgctttactgaaaccctgttggaaaattcaaattaattacccttagattaaaaaaaaaagcctaacaaagctctgtggatttggtatgggaacatatcaataaattttttaaaataaaaaccacataattatttttaaagacaacatttattttcagatctgttgagtttttccacctatttcttcaaagttttccttgtcatccaaagacatgacatttgaggatctgtctctttactacttttctatttttcaggcaatgaaacctcttgttacatttaattagtgtgtctaggtcatgatccttagtcattttaaattggagtgtgatagagaggttttaatatattgtgcagtagatccttgatattttcagatgtaaaaggtttgttttgatttttaaaatcactttattgagatatgattgatatataaaaagttgtacatatttaatctatagaactcaatgagtttgtggataagtatatacccatgaagttatcaccaccatcaaaactgtaaacatacccatcacctcccaaagttccccctgcctgttttgttattatttttttgtgtatggtaagaacacttaatataagctctactcttttagtacatttttactatacagcataatattgttagccatgggcactatgcaatatagtagatctccaaaatttacttctcttttaggactgaaactttgtacctttaactatcacctctcaatttcccctcctgccagcccctggcaacagccattgtactctttttttttttttttttaattgatacagggtctcactgtgttgcccaggctggaatgagtggcgtgatcatagctcactgtagcctcaacctccggggctcaagagatcctcctgctgtagcctcctaagtagccaggactacaggcatgcgccatcctgcctggctaattttttattttgtacagatggggttttgctctgttgcctaggctggtctcaaactctggcctcagatgatcctctcttattgtggttttgatgtgtatttccctgatgattactgatgttgagcattgtttcaaataactgctagccatttgtttgtcttctttgaagaaaagttggttcaggtccctttgaccatttaaaagatcaggtttttttgttttgctttgttttgttttgctttgttttgttttgttttgttttttgttttgttttggtattgagctgtttgagttccttatataatatattctggatattaacaccttctcagatgcatagtttgcaaatattttctcccattctgtaggttgtctcttcacgctgttattttctttgctgtgaagacatttttagtttgatggatttttagtttgatgtaattccatttgtctgtttttgcttttattgcttttgtggtcttatccaaaaaatctttgcccagaagaccagtattatgaagcattttctctatgttttcttctagtagtttcataatttcaggtattacatttagcccattttgtgttgatttttctttttttttagatcaacatctcaaactttataatacactcacatttatacacaaatttctgtttacaagtacaaaaggcaaagaactgcaaagaagctaagcaactgcatcatcagccacattcaatcgaattaatactgttgtcccccgtccgtagttttaatccagaggaaatggtagatgccgtctcacacatggactccactgttagttttagaagttggagactgtgtgtggttccgcagaagtctgggtttctacagagctgaactgagactccatcatgttccaggccatatcagccagaagaaagtcgtccattgttgtttgagtttcgttgttggtgaagaacaagctccccagggtttcaaacccagaactcatggtctgtgtttctatactgttcaactgaactttgctttctagagcaggtatatctttaacagtggagattccttcagtttgtgtctctgtgtcagatgaatcagtactcatggaaaagctggagtgtttcagaatacttcccagaggcagatgagggctactgtctaagaaaaagtttaagtctgtctgtgtttgtctgtcaaacatctcaaggcctaagaagttagaatttcccctacacccataggactgagcagaggtatctgcgagtaagaagtccgtttgagtctctgtgtccagtgactccaagactggctcagtgttcatggtgctaagttcactctcttcagtttgagtctggatatgtgaggccgaaaagaactcttcaatatcaaaattgattccagggttctgggctgggccagatgggagctgggtgtcaggtccaggatttgtgttagacaaaagactatgatgatccaatgtctgagcaggcagattacttgacaagatgttttccaaatcacttaataaatctatggtttgggtctgattatctgtcatgttctgtgaaggaagcatactgttctgtgcactgaagtttataattggtgcacatttctcaatctcttgatttaaagtcttaggctcattctgaggtaacaaactatgagttactatctctgctactaaactgttgcttataatgttacttgtagcaacattatatgatgaatgaacactcaaaaatgtctctgcacattccagcttggtccatctgtacatggtcatccgttggactttgtatcccactggtttgagtttctcaggagaccccacccgactggaaacaggtgtccataaatgcatcagtctgagcagctatagatgaagttaccttagagctgggcaaaaatgtctgagtgtgaacactaatgggaagagacacttgagaatcaaacaacaaatcagtttgagaacaagacgacacagaggaatcagcggtggcccactgtgcagaaggtataaagttttgtgaggcataagacagatctgtctgcacgttgattgaagaaatgccgttcttctgacatgtgttccctagttcttgtaaagtattagatggacttttacccaagttcacttgaacaccagtacttattggctcaacagcaacaggatcagcaatttagaaaagaagtaggctctctttaagagagcaagcctctgaatctaggccgaggatcagggttcctactgacaagggcaggcagtaagtgcacagcccctgtggcagagccctgatcaacacctaacaccacaggctgggctgaggagtcggctgtaggcacaaagacaggcatgagagaaaactgcatcacgggtagtttaagcaaagccactttgggctttggtaaaagcaacttttgaggctatctcggtgatgttgtaagaaagagtctgcttgtcagtgttagagccacaagagtcttcaaaagatggttctagctttatttctgaagcttctagttcttgggtgtctggtctagggattggttggttgttaaatgattcagtggtcttgttggataacttctggttttgcacagttttccattttccttttcttactaggtgggtccctgtgttctgcagggatctcgtggccagttcggtagatgtgagactgcaatgcttttctactggcgtagggacagccgcatgtgcaccggaaggtcttgccacagtcctctgcaagtcttttcaggtcccattctgtaccgtacgaattgctgcacttgctacatttgtgcttcttctcagcatggattttcataaagtgctgttttacgagagaaaactgagaaaatggtctgtcagggcctctggggcagccttcgattggacaacagtagaatttcggtacagttttcaaatcttttcttattattggattgactgtgctatactgcatgcggtggctcttgaccaggtgcatgttgagcgcggggctgttgggcaggatcttgcggcagccgcgcacggtgcacaggatgttgggccatgtggtctgggacagctcgctcacctactgctggatcagctcccccgccagcacggaggccgcgggctgctgcgtcacccccgcgggccgcggccggctgcccctcagtcggggtcccgggggcacccacgggcccgaggcggcggcggaggctcctctcgtggccgccgggacggcgcgggcacccgccgccagagccgtggaccccgccgccgccaccgcctccgaggccgccatggctcccgcagggcggccaggcccagctcgcagttgtgttgatttttctaagtggtgagagatagggtctacctccgtttttctgcatgtggatatccagttttcctgaacaccattcattgaagagactgtcctttccccagtgtgtgttcttggcgcctttgtcaaaaatcagttgactgtaagtgtgttctcttttctgttccatttgtctgtgtgtttttatgtcagtactctactgttttgcttactatagctttgtagtatattttgaagtcaggtaagattgatgcctctagctttgtttttttgacgcaagattgctttggctctttggggtcttaatatatatatatatatatatatatatttttttttttttttttttttgagacagagtctcactctctcacctaggctggagtggagtggcgcgatcttggctcactgcatcctccacctcctgggttcaagagatcctcctgcctcagcctcccgagtaaccgggactacaggtgcctgccactatcctcagctaatttttgtatttttagtagagatggggtttcgccatgttggccagggtggtctcgcactcctgacctcaggtgatccacctgcctcggcctcccaaagtgctgggattacaggcatgagtcactgtgcccagcctccatacaaattttaacggacttttaaaagatacgaattcttccaatctgtgaacatggggtatcttcccattttttgtgtgtcttcaatttttttcaatattttatagttttcattgtagagatctttcacatccttggttaaatttatacctaagtattttatttctttttttttggcaggtattgtaaatgggattgctttcttgatttatttttcagatagtttgctattaatatttggtgtatagaaacactaatgatttttgtttgttgattttatatcctgcaacttgactgaattcatttattagttctaatagtttttttttagtggaatttgtagggttttctatgtactgtgtcatctgtaaacatagacagtttaacttcctcctttccagtttggatgccctttctttctttctcttacctaattgctctgggtaggatttccagtgctgtgttggatagaagtggtaagagtggacctcgttgtattgttcctgattttagagaaaatgcttttaacttttccccagtcggtatggttagttgtgggtctgtcacagatggccttgtgttgatgtacattccttctatacctaatttgttgacagttttttttatcatgaaagatgtcgaattttgtcaaatgctctttctgcatctattgagatgatcatatgatttttattcttggttctgttaatgtggtatatcatcttcatagattggcgtatgttgaatcatccttacaacccaggggtaaatttcatttgatcatgatatgtgatctttttttatgtgttgttgaattctgtttgctagtgttgtgttgagtgaggacttctgcatctaagtttatcagggatattggcttatgattttctttttgtgtctttgcctcctattcttagcagtgttcccttgaaagcaatttgtctttttataatctctgtctgcttttaggacttcctctttgcctttagtttctgcagttttactgtgtattttacttcagaggagtgtgttttgtcccattttccagaggtcttgttggactgagctctggttacctacccactctggtagttggcttaataaccctcctttcattggctgtgattccctgtgtcacttctctactttcttaatggtgttccctttattgtccaaataaactactctactcaaatccctttttcaagatctccttcttgggagtaatagggcttcttagatctgaggattaatgttcgtgttgatcacaatggaatagtgatattgctgacagaaagatatcattggttatacttggaagatcctcagtttccctaatggcaaaagacttgggaatctgtggatcaagatggagcatatatgatcccagacagaagtattgtttctcaggtcccccagagttccccaaaggatggatttgcatggcaagagaagctcccttatcacttctaatggggttttatatggttttggtcaattacccttccactgcttgaacattactcttctggaacccagtgacatgtgtgcctactcaggaggtagaattaactgattcacaacaattgccaaacgttttttagagtttactgcaaggttggatgacatgaagaccaattttctggaatcagtctttcagaagatgtaagcctcaggcatgtctgatttctattctaaaacgtgtggctgggcacaatggatcatgtctgtaatcccagcactttgggaggctgaggcaggaggatcacttgagcccaggagtttgagaccagcctgggcaacatagcaagaccctgtctccacaaaaaataaaaataatatcagattagtcaggcatggtggcatgtgcctatagtctcagccatttgggaggctgaggtaggaggatcctttgagccttggaggtcaaggctgtagtgagccatgatagcaccactgtactccagcctgggtgacagagcaagaccctgtctcagtcagtcaataaaatatcatacagttatggttaaaaactaaaacaaatttttaaaaatttgaatgaacaatagagaatgtattaatatgctttgaatttatattaattttgtggagaagaatcatttagaattttagctcaatcataagcctgtagatgatgacacatgaaattattatccccccgtgaaatacaagtgtgaaagatgactacctttttgtggtatgatttctatatactatactcacgcgcacttcaaggttcagttgtgtggtttttcagttcttactccagccactggttgtgcaaatactccgtgattgtgtaaaaatcatacctgttaatttatatatactgttactggcaggagacagacagatagtgctatttattagaattatatgtgcttctgagcattagttacctaatcaggtattttaaaagttcagaaaaaaatttttaagtctgaaccttatgtagtaactctgaaaaactatagaaaacagagtaataaaatataaaagtagtagattgaaatgatactcttcttattatcattatttctagagacagggtcttgctcttttgtctaggctggagtgcagtggcatgatccgtagctcattgcagcctcaaactcatgggctcaagcagccctccctcctcagcctcccaagcagctaggactactggtgtgtgtcaccacacctggctaatttttgtttgtctgtttttttgtgaagatggggtctcactgttaactgagctggtctcagaactcctgggctaaagtgatcctcccatctcagcctccctaagtactagggttacacgcttgcactaccaagcctggtctgaaatgagactcttaaaggaaacaggaaacagtgaacaaagagaagagtcattggaaattaaaaaaaaaaaaaagtgaaatgccctatgtgtgatcaaatagaagcactggattcagattatcaacaaactaatcaagatggaagagcataggaaatttcccctggcaagagcttggtaaccaagacgtcaggggccagagtgaaacatgctgaatgcatgagccaagtgctgggactcagttgacctataagaacaaataaaaagaaatccatgtaaatccatataaaacacaaaaccatggacacttgtattaaagtatggcttgtcaatagaatttgcatcagtgcatgctaaggttaagtcacagtcaaagcctattcaaagaatagcctagcggttttcaagtagctgggcaggtaaagaaaataccttgacatatataactcttaagatctgctgtaacaaatagttattatactagccaaaccaagtttaattttctcctatatatggtcttggtaaaggcatcatgttatatagaacaaacatgatcgacttggataatgaaattgtaaataaaatcctgctttacaaattattattgctgaaacagcctgtgttttagagaaagcaagaatgtttttagataaaagaaataattattccacttattaatattaaaattaaattatagcattttattttaatgtcagaagtacttgttctgtacagagattatgaagaactgggatcatgaatctgttgctgataaataaaatttcagaggtcttgggataaattatgaattcagtttgggagaacaggggttccttatcagctagaaaaactgattttactaccatatggcagtggtaaaaaaaagtccataccaaattccttatcttggatatgtatcttgaatttttatgcaacagaacagaaatacagttttgttcaggaaaaaaaattgcagaaatactactctgtgcagctcctgtctagaacatgcctgcctttttgttgtacacaagaaagagaattttctagtttaattccttgaagagcaatttgaatggtttccacttgggaaattatgtaatttcatattaaatagcaggtggtaaggtagtcagatggaaatgttcagttcatccagcatcatcagattgatttgacaaatggaattcttttaactctatggaaagcatttttctccctttatcctttggcagaggcagacattgtctgtggtttccccacaaaagtttgagtgggtaaactttggatgtgtaaatataaacagcagacagagacattgcctctgacagctggaaggatccactgaggatcttagaaggagactgctgatatggatgatgttggatagagagacttgagggaggaattaaccaatgtgaacataaatgaggaatgcacatgcttagaaaaaatgatagttcctccttaagtttaggttgaggttgttgaaaatttttgcttttgatatggataaaaacaacaaaaaactgacttttatggataaaaacaacaaaaaacaataaaaaactgacataccatgtggatgagcacatggtatgtttcttggtgagtggctccatctcgtacatgatatgtaaccttgggcaagatatttgggcaagatatttacttctcttttccttagtttccacacctgtatagtgggattgtagggactgagataagtttacggtgcttataattgtccttggcatagaataagcaccatgtaagtgatagctgctataaaataataataattattattttggtggattgagaaattcccttaaggaggaagctatttgcttcctctaataaccttagtatagttgatgtatttatatataaatgagatacagaattcaggagcaaattatttagtgtttaagatgatttataaagatatgttcatattaccttttaaaaattaaattgtgaagaatactgcaggtgcccgccaccatgcctcactaaactctgagcctttgcacgtgccaggaaagtgctgtggctggacactgggtctgatgatgctccccttttctttgcttgaacagtaatcagccctcgagactcttctggtttgtgaaatctttgtgcccccacgttatgtgtgtgtgctgccattagatcaatttcacattattattggaatttttgtttgcatatctgctaccccactcagttgtgtgttttccagtctactataaaatgtttcaaagattaaaaattacatcttttcattagccacagtgcctgctgcatagtaggtgtttttaggtaaatgattgaatgataaataaatcataccggtcatgacagtattcaaaagaaaacagttcttctcttgtttttcctgtaaggagcaaggaaatctttcctggaagcccctacaccagacatctccacgtattggcctaggatacagtcactgacaagggaatggaatttccctagttggcttggaaaaggcagtttgtgtttaaccacaaagatcactgcactggttacaaaaataatacatgattattataggaaatttataaattaatgaaaagtacaataaaataatctggcattacacaaagaaaactgttgttaacattgtggtgtttgctttccagtttttggttgtatatgtatatgtttgtgtgtatagaagaaaattgcaatcatattgtatatagctttttatagtcttacatttaagtctaacataagcagttttccgtaccattaagtcatatttttctgaaattagactaatggcttaagttccttcatatggctgtattacaaattatataattcattgcttattgttggagatatagattgttagcagttttttactattgtaaataaatatgcagtgaacatccttttatatcaatcatgtacatctctggttatttccttacactaaattcctagaagtggattaatgagtgaaagggtataaacacattcaaagttttttgatatacttctctgattatctttcagaaaacttggaccaattacattaccagaaacctgcatatgagtggctgtttaactgtattcttgccagtactgggaatttttttttttcaagacaggatcttgccctgttgcccaggctggagtgcagtggtataatcatagctcactgcagcctcagcttcctgggctcaagcaatctgtgaagtattttttaatcactgattttatagtcaaaagtggtttcactctgcttttttgacttgtagtgttacttttcatttagtcagcatttagtagatgtttgttgaaagaagaaatccgtgtttcttgatatgtatattgtttattcacatctattattggcattattatttttgcttttttattgtgatatacaaaaagtacataagctgtactaatgttaagtgtaaaactccatataatttatggcattctattttcagtttgctgttttggatattagtttgtttagtttatagtattataataatttataatattatctcagccaagtctgttgggtgagatttattccatcatagttatattctccctagggctcctaattacatagagacttcatttttggttctgactgagaaataaattatttctttctcaattcctttatattatttattacatgtctatggtttttttgcacaatccttctctttggcaacataccgttttatttatcttcatgttcttctagatatcaaaatctttttttttcagtatttagaagaaccattaaattatttcctttttatgctttctcccttattccttggctcagatttattttttctgtgtgtgtgcgtgtctctctctgtgcgtgtgcgcatgcgtatgtttgtgtgtgtgtgtgtgtgtgtgtgtgtatgtgtgtgtgtgtgtgagagagaggagtcttagagttcaagtaaatgatactttcctgtgttatttattaacagttacaactgctgttgttaatatttatctcatttaatctttttttgtctggtaagactggtacatatcattgtgtttttcatttagagggaagtgaaatattttgggccatactgttaatagtgctgtgtggatcagagctgagattagaacccagtatgctagtgatatgtttggatttcaagttataaactgtactgggtttagtcttgcacataaaaagaggctgaactgaagtttccaagatgttgagaaatttacagtttatttaaatttgagtcttgctctcaagtacactcttttcccagttatttgcagctagaaaagcaaaagtcttcaagtataatttaatatgaccaataggaaccacatgacttttacagtcattttgttgcgtactagtgtttatacaactcatgacttgacagccgaccaaactgtcttatccatctcatattaacatattgtgaatgtagtaggaactggcttagcaaaatcttgaaacctctgactctaatatttgtgggatagtaaagtaaacaactttggggctttcaggctgtgtgatgcacagcccgttcaggacattaatgcttattctctctgttgactccattgcttttgtgaacagttttgccgacaggtgtttaggcttgccaagagagattatttctagctagtagaggactcttggagaaagacattggtttctacttagaaatacaataactaatgataataactgacattgaatgggtgttaaaatgtgccaggcacaattctaagtgctttctgtgtaattaatgtattttattattcacagcaaccctactaggtttttcccattttacagatacagaaacggaggcatagactggcaaaataacttcccaaggtcacatagctagtatgttatagagtagggattcaaacttcggcagtctgcctccaagtcagccttcttaatcactctgttatgctgacatttattagatgaaaagaaagaggcacaggtgagtcataagtggctgtttgtgtttttggaaaatatttgactttatgcctactggcagcttgaaataattaagctgctaccattcattaaatttttatttttttgtaaagtgagttatttgcttgcatgtaatattataattggaacatagtgagtaaagtatacccttttatgtttgtacaaatttagggtaagcctgtattttcattaaaaaagtggtctttgagaaagaaagtgtttgaaacaaaactttgaagagtgggttcagaatcagggtgacagccacagagtagtaagttatttggtcaatgctctgtaataaatagcagagactgccttattggtcctgtgcgccatcttgaagagctgaatgttgcagaaatggcaggctaaatgttttggagtaacccaagctgactctaggcagaatttgtctttggcatcttctcattttgcctgtcactggcacctgtctcattcaccttttgtcattgccagatatggtatggtgcctaacaacctttactaactatcaacaagtccagctgggtgtggtgacatgcacctgtagtcccagcccctggggaggctgaggaggaggatcccttgagcccacgagtttgaggctgtagtgagctatgattgtgccactgcacaccagtctgggcaacagaggaagagccatctgttcaaaacaaaacaacaacaaaacaagtttctcataaaatattaattaatgtttaataaaagggatatcctttctcagggtatttgcatttaatagatcattctcaaagtttgggctttgggttatttttgagagttggcatttattgctataaacttccctcttagaattgtttttgctctatcccataggatttggtatgttatgtttccgttttcatttgtctcaggatatttttaaatttctctttaaatttattcattaactcattgtttaggagcatgttgtttaatttctatgtatttgtaaagttttcaaggtttccccttttattgatgtctagttttataccattgtggtcagaaaagatacttgacaagattttgatactcttaaatttaaaagacttattttgtggcctaacatatgatttatactggaaaatgattgatgtgcagttgagaagaatgtgtattctgtacctgttggatagaatgttctgtaaatgtttgttaggtccatttggtctagggtacagttcatatctgatgtttctttgttgactttctgtctaaatgatctgtccattgctgaaaatagggtgttaaactcttctactagtattgtgttacaatctatctgtttcttgagatctattaatattggctttatgtatttaggtgctctgacattgggtgcatatacatttacccaacatcagagcacctaaatatgtaacatatccttttgctgaattgaccaaccccattatcatatattaatataatgaccttctttgtctctatttacagatgacttaaagtctattttatctgatataagtatagccactcctgttttggtttccatttgtgtgaagtatctttttccatttatttactttcagtctatgtgtatccttataggtgaggcaagtcttttgtaggcagtatatagttgggtcttgttttctttttttttaaatccatttagctactctgtgtcttttaattggataatttaatccatttacattcaaagtaattattggtaggtaaggatttactactgtcattttattaatttttttctagttttgtagattctttttttctttctttcttcctttgaggttaagtgattttctctagtagtatattttgattctttgctttttatttttagtgtatctattataggcttttgctttgtggttaccatgggacttataaaagtatgccttatagttataaaaggttattttacactgatagcaactttgatcgaaaagaaaatactctttaactccactcccccattttgagcttttggtgtcaaaatttatatctttttatattgcatgtcccctaacaaattatcgtagctattatttttaattgtgttgtcttaaccttcttaaaaaaatatatgatgtacataccaccattacagtattagagacttcagaatttgactgtgtacttgcttttatcagtgagttatatactttcagatgtttttgtgttgctcattgctatccttttctttcatcttgaagaactccctttagcatttcttgtaagacaggtctggtgctgatgaattccatcagcttttgtcgtccagaagtctttattcttttcttcatttctgaagtacagctttggtaggtgtaatattcctggttgatagttttaatttttttttctttaggactttgaatttcttcaggacaatgtttctgcttagaggtctcttgttaggcatattagtactcccttataaattatttgcttcttttctcttgctgctttcaggatcctctctttgtgcttgatctttgacattttgattataatatgttgtggggtagtgttatttggattaaatctgactggttgcccttgatcttcctgtacgtggatagctatagctttctccaggtttgaaatactttctgttattatttctttaataagctttctactactttctctttttcaaggttcccccttgaacaccagtgacccacatatttgctctttagatgttactcataaatcctgtaacttcattcctttttcctttttcacctttagttacgtattttcaattaacctgtctttgaattcactgatactcctctaattgaacaattctgctattgatgctttctgttggattttttattttgttcattgtagtttttagctcctggatttctgtttgattttaaaaaattatttcaatctctctgttaaatttctctgatgaatttctgaattgtttttctctactttattgaagttagccaaatttccttaaaacaagtattttgaatttctgtcaggcagcttttctataatcctctctttaggatcagttactggcagcttatctttgtcccaaagcatgtttttcctcctttgggccagctggttatttagtagtgccttgttcagtttccacatttgtgaatttcctttgaaacttcctgcatttatttttaattgctttttttgtcatcagagcacatttgttatattactaatgttcttttaaatatatgaagactcattttatgacctagcatatgatctgtttagaatattccatgtgatcttaagaaaaatgtatatactattgggtggagaattctatagatgtaagttagatctagttggtttatagtgttattcaagtgttctgttttcttgttgatcttctttctagttgttttatctatcactgaaaatgacagtttgaagtctccagcgattaatattcaattgtctgtttctccctttctgtcaatttttgcttcatgaattttggtccttagttgtgtatgtttataatggttatatcttcctgatggattgacccttttatgattaacaaaatgtccctctccatctctaatagctttttgttttaaaatttgttttttttaatatcagtatagccacaattaagtttcttgtttttgtatgtttgcatgacatatcttttctatccttttacttccaatctgtttgtatttttcactctaaagtgtgtcttctatagacagcatatagttagatcatgttttcttaaagtctgacaatctttgtcttttgatgggaatttttttttttttttttttttttttgagacagagtcttgatctgccactcaggctggagtgcaatggcacgatctctgctcactgcagcctccgcctctcaggttcaagcgattctcctgcctcacccacccgagtagctgggattacaggcacctgccaccacagccagctaatttttgtatttttagtaaagacagcgtttcattatgttagccaggctggtcttgaactcttgacctcaagtgatccacccaccttggcctcccaaagtgctgggattacaggtgtgagccaccgtgtccagcctgatgggattgtttattccactcacatccatgatattattgacatagttggctttatgtctgaacttttactttttctgtatatctcgtcttttttttgtaactctgtttctccttttattacgctcttttaagtaagtattatctgttttttttttttttagacagggtctcactctcttgcccaggctggagtgcagtggcatggacatggctcactgccactgttgacctcctgggctcaagtgattctccttcctttgctgcccatgaaactgggaccacaggcatgcaccaccacacctggctaatttttctatttttgattttttttttctttttttttcttgagacagagtattggtctgtcacccaggctggagtgcagtggtgtgagctcggctcactgcaacctctgtctcccgggctcaaactattctcatggttcagcctcctgagtgattaggactgcaagcatgcaccaccatgcccagctaatttttgtatttttagtagagacggggggtttcaccatgttggccaggctagtctcttaagtcttggcctcaagtgatctgcctgccttcacctcccagagttctgggattacaggtgtaagccagcatacccagccaattttttttatttttttgtagagattttttgttgcccaggccagtctcaaactcctgggctcaagtgatccttctgtcttggcctctcaaagtgctgggattacaggcatgagtagtaactgatgcctgtaagtgaatatttcataatgtagcattttaatttctttaatgatgttttcactattctttttgaattttttttttttagtggctactctagagtttgccgtagaataagtttcagacttatgctcgcttaattaccgtgatatatagaaatgttactcctatacatatgatttttgacttatgtcctatacatatgattctcgacttatgatggagttatatcatcataagttgaaaatattgtaagtcagaaattcacttaatacacctaatgtagtgcacatcattgcttagtgacaccgtgcactgtagagtgttacttgtttacccctgtgattgctgggctgactgggagctgtggcttgctgtcactgcccagcattgtgagaaaagcatacttgagaagaatgtatgttctgttgttgggtggagagttctatagatgtctgttaggtctgcttggttatagtgttattcaagtgttctattttctcgatcttttttctagttgttttatcagtagttatggtatcacatatcagtagcctgggaaaagagcaaaattcaaaatttggagtatggcttctactgactgtgtatcactttcatatcattgtaaagtcaaaaaattgtaagtctaaccttcataagttatggatcatctgcatagctttattcccttctcttcctttttttgtgacattattgttatacatattacctctcaatgttatgaattcaacaatgttttaattattactttaacatgtgtagttacttccttagcccaatacagcttggctgtttaactcatttgcactgtgtttggcaaatatatttacatatcttattcctttctatatgttataggcccaacagtacagtgtgtacatatcattttatgcaattcatttttatgtcagttatgagaataagagagaaaaaatgtgcatttataattacataattatcagtgttcttttattgtgtggattcaaattaccttctggtattaattcacttttttttgcaaagtgggttttctagcaacaaattcagtttttgttcttctgggaaagtctttatttcaccttcatttttgaaaggtagttttgggggatatgggattcttggttgacaacttttgagcactttgaatatgttttcccatgtttttctgggatcttttgtttctgctgagaagtcacctgttaatcttattggggttcccttgtaagtaatgggctatttttctatttctgcttttaagactttctccttgtccttgactttcagcattttcactacagtgtttttgtttgtggatctcattgcatttatcttatttggggtttgttgatgttcccaagtgccaataaatttggggagtttatatgtttctttttaaaaattattttatttttaattggcacgtaatgtgcatatttatagggtgcaatgtgatgtttcaacacatgtatatattatgtactgatcaaattaggatgattagcatatccgtcatctgaaacattgtttctttgtggtgagaactttcaaaatcctcacttctagttattttgaaatatgcatacattatgtttaacccttttcccatttaggaaaaaaggtgcagctcactacccagcgctcatttaattttacattaatgtgctctttgaggctgaagcaaatctgacagattttcaatgtgaaaataaaatataaaaactgtttttggagttatttctaaacagaactaacatcagaattgtctgaatcatcagaatcatctatttcagaaaaattgaattgaaatggatctttggctaataactgttcaagaacaatgttaccatcatgcataggaatgctgcattttctaggatttgatattttcagcgattgagaattactatattttgtaaatggaaataccagtgctaaaaacagaatgttataaatagaatgatgttttttgtttccaaattcaatgtactagagcttgcgaaaatagtagtaaaagcgagcaaagttatctcagagtagacgctgcagcctcatgtactgtgggcgagtattctctgggcaaacgggaaaagggttaactgtagtcaacctactgtacaatagaatacaagaactctttcctcctgtctaactgtaactttgtactggttgatgaaccgataattatgctttttaagctcgtggaaaatgtttcagatctttaaccacagttagtaggcaaaagtactcatactctttctttgatttttgttgttgtcgttcttgagatcctactcaaatcaatgtggtgaagccttctgagtattgccagaccagatataattcttggggtatgacaaggaatgagtagtagcaccttatgaagccttaggttaggtatacatagaaataatcatgctgttacttgagattgccctgcccctaaataagtggtcttgaagatgtggtaggcaagggacagagaaagaccaagctccctgtgaccagaaaaggattatctgttatttagaggaaggggttagagaaaagctggcccattgaattaatgcaagaaaccagaggtactgttaggatattctgcagactaagtcagggtgaaaacatatttaagaacaaattcagcaactgagaaacttcatgtcttgaatgtgagaggcaatctcccatatgaaactgttagttgacgttgaaaattcattcatcctggtggttgggttaggaggagacccaagaagagcttttgtatttagtttcctggtggttggagagttcaaacactagacttggaagcagataatacctcatagtacaaggaacaggaacttttctcactgtctggaaaaaccaagcatctggctgtctgattttagtgaaattgtaattcagggggaactgattaattttattagacagggtgtgagtcctgtggctcctgccaggtgtaactgagatccactcttgccttctctctctgctcctgctatttatgatccttatgctcagagtgtgtagagtaggtttgcattcttttttttctttttagagactgaggtcttgtgaagttgcccaggctggatttgaactcctgggctcaggccatccttctgccttagcctcctgagcagctgggattacaggcatgcaccacctagctaggtttgggttctgtttggctacacttcctcctattcctgccaccaaggtttgtagttgtcgttgattttaatagactattttttagagcagttttaggttcacagcaaaattgagcagaaagtacagagatttcctctataccccatgcccccacatgcataacatccccctactgtcaacatcccccaccagagtggtacatttgttaaaattgatgaacatgcattgatacatcattatcacctgaagtccatagttaacattagagtttactcttggtgttgtacattctatgggtttggacagatatacatgtgtccgctattatagtatcatacagaatagttttatggccctacaaatcctccgtgttctacctattcactcttccctctcccctgcccgagtggaatttctgtttttattttattttattttttgtttatttatttttttgagataggttcttgctctgttatccaggcaggagtgtggtggcacaatcatagctcactgcaacatctacctcctaggctcaggtgatcctcctgccacagcctcctgagtatctgggagtacaggtacacacaaccatgcctggctaatttatttttcttttttttttttttttgtagagacagggtcttggtatgttgcctaggctggtctcaaactcctgggttcaagcaatcctcctgcctcagcctttgcaatcccaaagtgctgggattacaagcatgagccaccacgcctggcctgtttttatttttaaaaattacttgaggaactggttctaattccagtcctgtgctgaacttgtatcatacatagttcagagaattcctacctatgtagggactgcagatatcctccccttatccctttcctcctttcccttccccaaataatggcaagtcagtgcccatactgtgtatcagtccatttcattttttgagatttccttgatggtctgctaatttggagacacttctggacaaatgataaatttctggcagtacaagcccaaagtagtaaggttttgttctagacactggagctagaatgaaatttaaaaatggttccttgcttttacactgttggtgggagtgtaaattagttcaaccattgtggaagacagtgtggaaattcctgaaggatctagaaccagaaataccatttgacccagcaatcccattactgggtatatacccaaaggattataaatcattctactataaagacacatgcaaatgtatgtttattgcagcactgttcacaatagcaaagacttggaaccaacccaaatgcccatccaatgatagactggataaagaaaatgtggcacatatacaccatggaatactatatagccataaaaaagggtgagttcatgtcctttgcagggacatggataaagctggaaacgatcattctcagcaaactaatacaggaacagaaaaccaaacaccacatgttctcactcgtaaatgggagttgaacagtgagaacacatggacacagggaggggaacatcacacaccagggtctgtcagggggtgagggatttggggagggacatcattagaagaaatacctaacgtagatgacgggttgatcggtgcagcaaaccaccatggcgtgtgtatacctgtgtaacaaatctgcacgttctgcacatgtatctcagaacttaaagtataataaaaaaattaaaaaatggttcctactctctatttacaaattatgaccacttcatccaaagatcacaaattctaaagtgatacaatctttctgggtagccttaactaaaagagctgtatcactcttgagttcctctatgcatatgccaatcatttcctctttgctacaccctgttttgaagtgtctgcccagacagtagtactcatcaaccaccaatctttgtgggatgagcaactgaccccgtagaaaactatctaaagggtctgttggctggattgagccaatcacatcctcttccctgagaatggggaccttgagatactgagctgattagataatggttagttcttgggctgaaatttcgtatagaattgtgaccaccttctgaactacagcataaaagacgtgcaagctgggggaacaaaaaaagccacagacagcagagacagcagaggcagctagtgtacagagagatgtgcttgaacggagcagaaatgtggacaccctgagatgtggcaggagcttctagttccacttcctatttggaccagctaaaccttttctttccttgggtgttgttcatgagatctttggtcatagccttttcataacacctcttcccccatttgacttgtgctagttgagtggatttctgttctagagctgaaatgcagtgccagcagaatctagtgcaatagagtcttatgtaattaaagtcctaaagactctttgggttgtgagacacacaaaaagatagaaaaccaaggttgataatcagtacaaaataactacatgttggggtacccttcagtcagtcaatgtcttcctcaccggtaggcatttagtgactcgttcaccacccttccctcgtcgaggctaaagaatgcctacgtcatttcatcttttctcaaaaaagaaaaacattctgctgttttctgcttctttattgatcacatttgtccttaattccttcatataacctcaggtagaatattagtctaggtgccaggggatgtgggttctgttcttgttggggttctaacgggatggatggtctctgtaaggttcttcatctctctgtacccctacccccacacctttgccggacagtgaagagttatgctgatcaccgatttctagctgataactcccacaaaacaaggtgtgaataaagagtgtgaagaaatcaagctacttcacaggcatttgctatagatgaaataaatatgcctatccctcacttaatgatgttaattctaagaatcctgccagtaagtgaaaagctagaaaatgaaaaattacttctgttaatttttttgttgttgttttggttttgttttttgagacagagtcttactctgttacccaggttggagggcagtggcgtgatctcccagctcactgcaacctccacgtctcgggttcaagcaattctcgccacagcctcccgagtagctgggattacagacatatgacaccacgcccaactaattttttctatttttagtagtgacagggtttcactgtgttggccaggctgggctcgagttcctggcctcaagtgatccacccgcttggcctctcaactgcagccggctaacttatgttcattttagtggtaaaagttatgatgtgttccatcccaacctaagatgtccaaatactttctacaaatagaaaaatatatcattgagcaatgaaaactttttattagtaaataatccaaaattaaataaatgtaattggtacataaaatgtgttaaaatgatgctttgttgcctcaataaaaaagaggaggcggggccgggcgcggtggcttgtggctgtaatcccagaactttgggaggccaaggcaggcgaatcacgaggtcaggagatcgagaccatcctggctaacatggtgaaaccctgtctctactaaaaatacaaaaaaatttagccaggcgtggtggcgggtgcctgtagtcccagctacttgggaagctgaagcaggagaatggcgtgaacccgggaggttgagcttgcagtgagccaggatcgcgccactgcactccagcctgggcgacagagcgagactccatctcaaaaaaaaaaaaaaaaaaaaaaaaaaagaagaggcttgatgggattgatggaagagggaaggagccatactttggaaggtggttggtgagtcaggtgataaacttttaaggcgtgcattcagcagcaaaagtgcttaataatatttttcattggggattttgacagtagaagaaactcctaatgtggaaacctttggtatattggtagaagggaatcttcagatcaaaaaaaaaagcaagatgtaactttgcttccctttttgtaatttgcaattcatacacctccttgcaggatgcgatattagtttcccgaagctgttatagcaaattactacaaacttgttggatcaagagaacagaatcatatcttgttgcagttctggaggccaaaagtgtgaaaactgacatggccacattccctctggggacaccttcctctcacttctggcggccagcatggcattcctgggcttgtggccgcatccctccaatctttgcttctgtcttcactttgctgcctcctctgtgtctgtctccaacttgctctgcctctgtcataaggttgcatgtggcctaccctaccctgatattccaggacaagctccttctctcaggatcctgaatgttaccactttgtagtagttgttgttgtacaaggtaatagtcattcctttgccatgtaaagtaatattcacaggtcccatgtgctagtgtgggaatgaggtgccgacatttgggctgctaattctttgttgtgggagactgtcctgtgcttggtagatgttcagcggtgtacctggcctctgcccactgggtgccagtgacatccttctcccagctgtgacaaccaaaaatgtcttcaaacattgtcaagggtcccctctggggcacgactgtccttggttgatgagcactgctttaacctaatcagagcccattcttatcccactcaaatatgctgactgggaagtttccagtctcgttaagaagggggagggtggagaatggatgctggagaggtgactgctcctctccactacacctaacattctagtgaagtccacaaatgggccaaatcgagcaggattatgaaatttttgctagacccctgttagtgtattctaacattgtggcattttatattagtcaactaaatctcaatattatgttttaaaaaaatccaatggacctctgaatccccaggttgggttttttctactttacctatgttaaatatgttaaatacctaggttgccctttatcttagaatttgtccatgtatcacctcattctttttcagcaggtccctttctggaggttttcatactcagttggatttatcctccctgcgactgctgcctgctccttgccttgccatgcggcattagtagagtatgaactgcacatttagcacagcagtttatgcactagagaatcaggattggaatttttctgaagtatcttatttttctgtgaaataattgaaacagagtatagacacatttgctgttttgaagtttttatgatttccaaagtaataaatgtgcactctcacagttctcgggtggctgatctctggagtgcttgccgtttctccgggtggttgctttgtacaggctcccctctcgtgttggcctgcaagtgctctcgctgcgacgggtccctgaccggtactggatgagaggactagtactggtgcagatgttggcataaacaaaagctgcagctttttaatcatgactaaggcatgggagaggctgacatataattgtggggaaaagcgagagagatcagattgttactgtgtctgtgtagaaagaagtagacataggagactccattttgttatgtactaagaaaaattcttctgccttgagattctgttaatctataaccttacccccaaccccgtgctctctgaaacatgtgctgtgtcaactcagagtggaatggattaagggcggtgcaggatgtgctttgttaaacagatgcttgaaggcagatgatcaataaatactaagggaactcagaggctggcgggatcctccatatgctgaacgctggttccccgggtccccttatttctttctctatactttgtctctgtgtctttttcttttccaaatctctcgtcccaccttacgagaaacacccacaggtgtgtaggggcaacccacccctacaataatggttcccagagtgtccctctcagaccaataaaacatagcaaaactacgtgataaccaggctggaatgtatgtgaattgttcgagtgagtctgtgtcacttgaactgtactgggcagtacctaggggcttcatgtaaggcatgaagggctccagaaagaacccgctctttgccttcagttgtattctatatgtttaatacacagcacagcagaagcaatcagctctccccaatgttacttatcccataaatcatctttccttacacctacgtattttcttctgtattcaattttattaatggatcatctgatctccagctttgctggtttagaacctctgtgctcatcttaagctcctcaaggagaaaaggactattgtaatcatctttcaacgagtttgtaaaaacaattcccccatcacagcactgtgcctcatagggtttaaaatttgaccgaatgactgactttacatacatccttcccagaccctttaggactactgctcccctagaggttttctctgccctttggaaaacaggtaggggaagagggatctagaaatggcagtattcattaagatagccaaagcttgataggaagagacattcattttactgtggtaattaaagtgaaaatgggagaataagaaggcatgctgcttctttttcaggagtcttggcaagggttctagttttaaaagaaagagacacagccaactagattgaaatgatgtggagttcatccctccacagtcatattttactgagccatttttcaataaatggactaaattgtcccttggaactcagtaggtggtgctcttgtgctatagcatagcatcggctttggagaggttctgagagcacagcggctggttccagggcctgtgtcctgtcagtcccctttcatagctgccaggcacacacctggagggcatcacatggctggtctggtgagaggctttctgtctttggaaatgagggggtgaattaaggtctttaccttctctagcctgtctgagctctgctttccaggggaacctaaatgagaggttttctaaccttttaaagaaaaaaaaaatgtgactgtttatccaaacaattacgatgtgtattgttaccagttttccaagattttttatattgttattcatctgtgattcctcaaatcaaagttcctttccacataactcagggtatcattcttgtttatgttttcctttatgttaatgtttgtttcctgtttaagcttcagagaagatgcagcagaaagaaataaatatgtagtagagaaatttggaagtgatgaaggaatacaggtgaaagccatcgagttcatgcagcagctagtagtaacttagctgacaacagacccttttggcaggagcccattgctttactccttttgctatataatgagttccttggtccgaagttggttgtgataccatgatggtgaataaggaatccagtcaagtccacatttggtgatgctggagaagtgtggtgggcaaagaagataaatttaaatccagagtgagttatctattacaaggaggacaaatctgttgcctgaagcatttcagggtctgctttttcatcaagtttctgtaggggttgtataaaacgaaagttacttcacctatatccaccaactggtaggggagaggcaaaatgctagtgggactcacagcctggatgtgctgatctgacccattcagtcacctgtgatgtcgaaaggctaccagccaggtccgagtgaggccaggctgtggggccagcagctgggctcctgagctgtgctgctgcagatccagtgatgtgcagtgtgttttgtcaagacagagtgcttcctctccagtctactgtctagtatcttgtgcactgagtttttaggttttaatgaccgtagtcctgatttacatactttgcagttgatttttttttagccatcttttaattctgccttttcaatttatactttcttattttttaattagcttttttaaaaagcaccctaaatatactgatttttgttggttttaaaaatcaccttaaatatattttgttgggattattttagtgtcttaagtatgctttgttaggattttttagcatctaaatatacctatttgttggactgattaacttcatctgaagtgaatttgtgatctaatgtctgatattgttagttgcatttatttcttcatgtactttagaactttggttaaatgacatgttttgaatgaggttttaaaaacttttcactcattcagtcatttttcgcctctttctccctctctgcacactctcccctgtgtagcctcattctgcttgtctctgtctggcttccatggagcctgggtgcagaactagctttcacagtgggggcttagttacctgggcattcatggctgcttcacgcagtgcctggtcctgcctgacaggtgtcctccatcctccctagaccgccactccataggaggcaaggatgctgcgagccttccttcaggcatggaggggtagggctctagtcagcaccttccatcccaccttccagcaagggtgctagtttctcactctgtcgtttgtgcctctgtttagcccccaacccttctaagacccaaacctacagtttcattgcctgtttttggaccctagcataggaggggctggctgctcatggttttgtcctcggggtcttgcctctttgtgtttctgtctcgtatcgatttcatagaaatgtttattttgtgtgtgtgcttgcctgtatccttttccttttttctttttatgtttcccctctcattgctgtatgtttggagtaaagagaatccatccaaaagtgaatttaccgtgccatcttaactggaagtcacatgggcagagagtttaaaggaaagaaagatacttggttttacatagtactgaaagctaaccacaagaacgcttcctatgtgagctcagtgacccatagcatatagttacttaaactccgtctgaggcttgcaggccccaaaagatgagtgggattaggcaggtgggatttattagggtgctatggttctctacaaaggtttcaccttctatttttcattttggtggtaattttttaaaaattcataattccacacacctaaatgcctgcaattctaactaagtaatgtcttaaaatttcagtgcctggagttgtgtttgtattggtgccaaggagcactgctttaaatatagggagatattataaaagaacagaggtgaaaatgtaaataacgtgtttgagctaagagattgccgttgcacagtggttctgaagaggaaagtgatgcgtgaattaagctgtctccctgcatgtgttagtattggccagtcaacagaacctgcctgtcggtaccaagccctacatggttagtccaaagtgagtttcaatgactgcatcattgatcacgctgaattaattttgtcaatttaaattttactcattttgtagatttgttggtatttaatttgtatattttttatattgtggttgtgtaagagttacaagcataaaggttttactggtttatgtttgttaatatttaactaataagaagaatgactttagataatactgggagctctcaacagtttttaagtttgagaaccatgggtcaaatggtaatttaactcttgctgttggttgcagcaagcaccttgcatttgattttgatgtctttagctcactcctgctcatgcttcctgacctgcttagctcaggatcgtttctctctggggactctgacacctccatgccgggctggtgccccttcctcatgctgcctgcagccccctgtgtttccttctctcccagcccttcccacagtgtaatctgtgtatgggtcccaatttcctcattagccataagttgcttgagagtggggaacactgtcatctttttatttgcagtgattttcagagctcttgtcataaaataggctcctaataaatgtatgggtttccttgtttttgtttaggtagtaataaattacctgtagaatcaaggagagaaagaggcagaaataacttggagccaagtcacaaggcaagaagaagcttcctaatattttaataactaatgtgttcctcagctcactttctaactggtctaaccaaaacccaagtcttactgtcaggtaagtgaagtgaggacaagaaacgcaaggaaaggaagtaatgattgtaatagaatgcatgagggaaggctggtatttttcaagtccgaatgatggctccttggtgctctgatggagaacaaggtcagagatttctgtcttagcagcctcgatggcaagcgctgtggtgaagggatgcttttattttgaagccaagtccagagaatagctcctctccccccattgctgaggtcttgggtgggagaattgagcctagtaaatccccagagttatctgctagattcagtttccttaattctttgcaaagtcatctgaagagtatatatacatactctgcacctggattgaagttgcctcctccaattccttaggcccagattttgtttacaattgaggtttgtttgaaattatctgcaaatttcaggtctgtgtttttgattagactatctcagaggtggaacgccactgactcaacagagaaatagccagctcctcctagtggaacttttcttaaaacctcattggttttaggaggaaaaataccatttgtttctttcataagcacttaatgggaacaagaatcttttattgtgactttcaaaaaaaaaaaaaaagccacaaacacaggggtaaattgaccagtcttaccctgtgaagtgaagcaaagaaacattacatttcagcaaattaaaaatagttatcaggctttcatcaaggaagaggaagaatcttgtcaacttaagtggaattgaacataaatttcttaattttatatttgattatattttagggggttttaaatattttctgacaaggtcatggtgcccctagttgatgacattgattgattggaagctaagtatttgatttgtcttttttttctttttccataattagtgtgttttgtagcattctctccatacatctcctgtttggtgcttatttcatgagagaaaggacctcatgctgagggtaaatgggaaaaaagtgcactttatcaggtcgcctccactttgagaagcttatatggtccatatttggcatgagtagacttagctctctgggcttagagatgttttagaccaaaggaaagcattcttagactttcttgtccccctgacaggtaccatgtatagctacttttgtgtggtttaaaatgagctttgttttaaatgttaacaatcttggagctacaggggtttctatcaacataaaatcagtcagaattttatctgttttatttttcttctacaacagccttgttgctttttttatgtatttattttccatacatttgttcagtacatatttatcatgctcctacaatgtgccaagtattgtgtgagtttgtgggtttcaaaatatgctcagcaaactaggtcctgagatgtgtcagctaggatgtgtttgattgcaagtaacaggaaagccaaagaatggtgttaagggattaagcaaaaagagcagttccacatttggctccttcattgcctcaactatgctgtgaggacacggggctgtgattcttctttgctgtttgcagtatgttggccagtcccctcaggtttccttatccctgggtctcaaggtgactgttaccgttctgagtatcacacaaagactactatgtcagatatggaaaaaagtgaactcatttaaaactgaggaaaactgagaaaccttttgttgaagttcagttctcatgccctatatttccataatatacctgttcctacagtttgataggcgagcaaaagtaaataccatgactggtctgtactagccattcccaaaatgtggctgagggcccagggtccccgagacccttttaggaggttcacaagggtaaaactatttttataataatgctaagctgctatttgccttttcgactcgcattcgctcactagtgtgcggtggcgttgtcaagaggttacatgatagatgatgatgacctctctctgacagctaatggaatgtgtgtttgtatattttgtctttttaattgttctcagttttagtttctggtggtaaatatctatctatctatctatctatctatctatatctatatatatatagatatatatatatatacacatacatacacacacacacacatatatatataaataaaactctttggggtcttcagtaacattgaaggatgtaaatgggccctgagaacaaaacatttgaaattacctgctctgtgtgaatcaagattcacccctggcactggcggatatcccagtctccctaagacatatggccttgagattcctggacaaaactcttaacaaagaggaaatggagagcttagggctgctgggtgggcaactagcagtgtgtgcagccctgttctgagggggccctgaggagacagcagggcagggatgcagcatgttctccaggccccacctctgctgggccagccaggactggagccactgtaggtttgtcatttgtgtgttgttggttttttaattgtggtaaatataaataagattgtaaccatcttaaccacttttacatgtaattcagtggcattgattacattaacattgtttaaccattgccgccatccatccccagaactttcccgttatcccaaacagaaactctacccattaagcagtaacattccattactgtctcccctcatgaattaatttgcctctgtgaatttgactattgtaggtacctcatctgtgtggaatcaaagaatatctgtccttccgcattttgtctgatttcacttagcatggtgttttcaagatttattcctgtatgtatcagaattacattcctttttaaggctgaatgatattccagtgtgtgcatatgccacacttcgtgtatccttttctccactgatggatatttgagttgttctcacttttggctgttacgctgctatgaaattgggtgtacaaatatctctttgaaaccctgcttttaattcttttgggtatatacctagaagtgggattgctggatcaatggtaattctatgtttagttttttcaggaaccaccatactgtttttcgtagcagctgcgccattttacattcctaccagcagtgcacgagagttctggtttctctgtgtcctcatcaacacttgtcgttgttttcttgatagtagccgttctaagtgaagggagatggttttctgtttgtttttaatgaattaggatgcattgccccagcctgtcacccagcgtctcctccctctttgttatctttcttcagacactgctcaagtgttttaatgcttttacttccttctgctctcatgaattgtgcttggtgagctccatattcttgtaaggtacattttccatgaagtttttgaatatatccttctcctaaaggatagaattcaccaaaatgaggaacctttagtcctgaggtaatactctttgttgcctgctgtactttgaatctgagccatgttatctcggtgactcagaccatgagcccctgtggacagtggtgtatctttgtatcatggctatttgagttcataaaatagtacttaacaagcaaccaaactcttgagcaatttatatgtgtgagaagaagggcaatggcagtggtcctaagctgatgccattgtgaactggttccttttcagtatcttggatgtttgcatggccccatggctggtttcccttggtactttatcccagcccctcacctcttcctgcttctgaaggatccgctcccacctggcaggaaacagggacaggatcaagcatgtgtgggtccttcactggacactgccttctgttccagcgtctgcatctctctgctcatacgactttgctttagtcccctctgcataggaatttctgaaggtctttatttaatttctttattttctcctggaaatacttactgagggatctaacagcttctgttgtttttagtctgcatacgtggagaaggtgaaatcatggtttgttttgattccttagggactgggtaaatgcactaaaagatacattatgcaagaaatggaaaaagtggatttccttctgatttttcatgccaattgcttttgctgcattagtatatgctgtgcgtgtatgcacaaaatacttgttaacatcctgagttttcaggaaatatgttataaaacatttaccttttttatttcttaaaaatgctaaacagtatttctctaagagctagtaatgaaatgaatttaggtacatacactaggcagaatcataagaaagtcaaggacttacatttggagcaagataaaggattttggtattgagcaaaaaatatagtcagctgtcaattgtctaataggtttgtagattacctgcgataaaaaagtagtacatctgtgaaaaaagttgaaattaccataaatctgaagaatcagccccatttttcaaggcatgcattttttggagctgcacggaagccaccttatatgtctgcttcgggtgacactgtcttattcctccgtgaataatgaattgaacgtctctccctctttgtgacaaagccctctggggcaaagcagtagccgtacaggtaagatagggggtccagacagcaggttttggattttcccctccttagagccaggactggaaaaatggagtcattatttgaggactggaaggaaaaggagggagcaagtgctaggactgttatctctgcccatcctggtgggtggttttaatatttccagacagagaactcagttaaaaaaacaaacaaacagaaaatacatactatttcaacaatttgcaaaattttgttgtattcatcaagtactgtccatctttattcacatttataaactataatactttttccttttttctttgcctgtggggtgatgtctttatggtaaatgtgtatctggaagttttttttttttttttatattttaagttctgagatacatgtgcagaatgtgcaggtttgttagccaggtatacacgtgccatggtggtttcctgcacccatcaacctgtcatctacattaggtatttctgctaatggtatccctttcctagtcccccaaccccctgacaggccccggtgtgtgatgttcccctccctgggtccatgtgttcgcattgttcgactcccacttatgagtgagaacatgtggtgtttggttttctgttcctgtgttggttgctgagaatgacggcttccggcttcatccacgtccctgcaaaggacatgaacttagccttttttatggctgcatagcattccatggtgtatatgtgccacattttctttatccagtctatcatttatgggcatttgggttggttccaagtctttgctattgtgaatagtgctgcaataaacatacatgtgtgcatgtgtctttatatagcaggatgatttataatccttatatacccagtaatgggattgctgggtcaaatggtatttctggttctagatccttgaggaatctccacactgtcttccacaatgattgaagtaatttacactcccaccaacagggtaaaagcgttcctgtttctccacatcctcttcggcatctgttgtttcctgactttttaatgatcgccaattctaactggcgtgagatggtgtctcattgtggttttgatttgcatttctctagtgaccagtgatgatgaacttgttttcatatgtttgttggctgcataaatgtcttcttttgagaagtgtctgttcttatcctttgcccactttttgatggggttgtttttttctcgtaaatttgttttaagttccttgtagattctggatgttagccctttgtcagatggatagattgcaaaaattttctcccattctgtaggttgcccgttcactctaatgatagtttcttttgctgtgcagaagttctttagtttaattagatcccatttgtcaattttagcttttgttgccattgcttttggtattttagtcatgaagtctttgtccatgcctatgtcctaaatggtactgcctaggttttcttccagggtttttatggttttaggtcttacatttaagtctttaatgcatcttgagttaatttttgtataaggtgtaaggaaggggtcctaattcagttttctgcatatggctagcagttttcccaacacaatttattaaataggggatccttttcccattgcttgtttttgtcaggtttgtcaaagatcagatggttgtagatgggtggcgttatttctgaggcctctgttctgttccattggcctatatctctgttttggtaccagtaccatgctgttttggttcctgtagccttgtagtatataatttgaagtcaggtagtgcgatgtctccacctttgttctttttgcttaggattgtcttggctatatggacttttttttggttccatatgaaattcaaagtagttttttctaattctgtgaagaaagtcaatggtagcttaatggggatagcactgaatctataaattactttgggcagtatgaccattttcatgatatctattcttcctatccgtgagcatggaatgtttttccatttgtttgtgtcctctcttatttccctgagcaatggtttgtagttctccttgaagaggtccttcacatcctttgtaagttgtattcctaggtattttattctctttgtagcaattgtgaatgggagttcactcatgatttggctctctgtttgtctgttattggtgtataggaatgcttgtgatttttgcacattgattttgtatcctgagactttgctgaagctgcttatcagcttaaggaaattttgggctgagacagtggggttttctaaatatacaatcatgtcatctgtaaacagagacaatttgacttcctgtcttcctatttgaatatgctttatttctttatcttgcctgattgccctggccagaatttccgatactatgttgaacaggagtggtgagagagggcatctttgacttgtgccagttttcaaaggaaatgcttccagtttttgcccatttagtatgatatttgctgtgggtttgtcataaatagctcttattattttgagatacgttccatcaatacctagtttattgagagtttttagcatgaagggatgttgcattttatcgaaggccttttctgcatctattgagataatcatgtggtttttgtcattggttctgtttatgtgacggattgcatttattgactggcatatgttgaaccagccttgcatcccagggatgaagccgacttgattgtggtggataagctttttgatgtgttgctggatttggcttgccagtactttattgaggattttcgcattgatgttcatcagggaattggcctgaaattttctttttttgttgtgtctctgccaggttttggtatcaagatgatgctgacctcataaaatgagttagggaagagtccctctttttctattgtttggaatagtttcagaaggaatggtaccagcttctctttgtacctctggtagaattcggctgtgaatctgtctggtcctgggctttttttggttggtaggctattaattactgcctcaatttcagaacttgttattggtctattcagggattcaacttcttcctggtttagtcttgagagggtgtaagagggtgtatgtgtccaggaatttatccatttcttctagattttctagtttatttgtgtagaggtgtttatagtattctctgatggtagcttgtatttctgtgggatcagtggtgatattctttatcattttttattgtgtctatttgattcttctctcttttcttctttattagtctgactagcggtctatctattttgttaatcttttccaaaaaccagctcctggattcattgatttttttgaagggttttttgtgtctctgtctccttcagttctgctctgatcttagttatttcttgttttctgctagcttttgaatgtgtttgctcttgcttctctagttcttttaattgtgatgttaggatgtcaatttagatctttcctgctttctcttgtgggcatttagtgctataaatttccctctaaatactgttttcgctgtgtcccagagattctggtacgttgtgtctttgttctcattggtttcaaataacttctttatttctgccttcatttcattatttacccagtagtcattcaggagcaggttgttcagtttccatgtagttgtgcagttttgagtgagtttcttaatcctgagttctaatttgattgcactgtgatctgagagactgttatgatttccgttcttttgcatttgctgaggagtgttttacttccaattatgtggtcagttttaacagaagtgtgatgtggttctgagaagaatgtatattctgttgatttggggtggagagttctgtagatgtctattaggtccacttggtccagagctgagttcaaatcctgaatatccttgttaattttctgtctcgttgatctgtctcatatgacagtggagtgttaaagtgtcccactgttattgtgcgggagtctgagtctctttgtaggcctctaagaacttgctttatgaatctgggtgctcctgtattgggtgcatatatatttaggatagtaagctcttcttgttgtattcatccctttaccattatgtaatgcccttctttgtcttttttgatctttgttggtttaaagtctgtttcatcagagactagcattgcaacccctgcttttttttttctttccatttgcttggtaaatattcctccatccatttattttgagcctatgtctgtctttgcacgtgagatgggtctccttacagcacactgatgggtcttgactttttattgaatttgcaagtttgtgtcctttaattggggcatttagcccgtttacatttacggttaatatttttatgtgtgaatttgatcctatcattgtgatgctagctggttattttgcccattagttgatggagtttcttcacagagtcgatagtctttacaatttggtatttttttgcggtggctggtactgggttttcctttccatatttaatacttccttcaagagctcttgtaaggcaggcctggtggtgacagaatctctcagcatttgcctgtctgcaaaggattttatttctccttcgcttatgaaacttagtttggctggatatgaaattctgggttgaaaattctttaagaatattgaatattggcctccactttcttctggcttgtagagtttctgcagagagatccgctgttagtctgatggacttccctttgtgggtaacccgacctttctctctgactgcccttaacattttttccttcatttcaactttggtgaatctgacaattacatgtcttggggttgctcttctcgaggagtatctttgtggcattctctgtatttcctgaatttgaatgttggcctgtcttggtaggttagggaagttctcctggatgataccctgaagagtgttttccaacttggttccattctccttgtcactttcaggtacaccacacaccaattaaacgtaggttttgtcttttcacatagtcccgaatttcttggaggcttagtttgttccttttcattttttttttctctaaccttctcttcatgctttatgtcattaagctgatctttagtctctgatatcctttcttctgcttgatcgattcaactattgatacttgtgtatgcttcacgaagttctcatgacgtgtttttcagctcaatcaggtcatttatattattctagttagcagttcctctaaccttttttcaagattcttagcttccttgcattgggttaaaaaatgctcctttagcttggaggagtttgttattacccaccttctgaagcctacttctgtcagtttgtcaaactaattgtccgtccagttttgttcccttgctggagaggagttgtgatcctttgcaggagaagaggcattctggtttttggaattttcagcctttttgtgctggtttttactcatcttcatggatttatctacctttggtctttgatgttagtgaccttcggatggggtttttatgtagacgtcctttttgttgatgttgatgctattcctttctgtttgttagttttccttctaacagtcaggcccctctgctggagtttgctggaggtccactccagacgctgtttgcctgggtatcaccagtggaggtttcagaacagcagatattgctgcctgatccttcctctggaagcttcgtctcagaggggcacccgccagttgccagccggagctctcctgtatgaggtgtctgtcgacccctgcttggaagtgtctccttgtcaggaggcatgcgggtcagggacccacttgaggaggcagtctttcccttagcagagttcaaatgctgtgctgggagatctgctgctctcttcagagccagcaggcgggaacgtttaattctgctatagctgcgcccacagccaccccttcccccaggtgctctgtctcagggagatgggagtttgatctataagctactgactggggctgctgcctttctttcagagatgcccagcccagaaaggaggaatctagagaggcagtctggctacagcggctttgctgagcgaacatccctgcggctttgtttacgctgtcaggggagaaccgccttctcaagcctcagtaatgggggacgcccctccccccaccaagctcaagcatcccaggttgacttcagactgctgtgctggcagccagaatttcaagccaatggatcttagcttgctgggctccttgggagtgggatccactgagctagaccacttggctccctggcttcagcccccttttgaagggagtgaacggttctgtctcgctggtgttccaggtgccactggtgtatgaaaaaactcctgcagctagctcggtgtctgcccaaatggccgcccagttttgtgcttaaaacccagggccctggtggtgtaggcacccaagggaatcttctggtctgtaggttgcgaagaccatgggaaaagcgtagtgtctgtgctggaatgcaccattcctcacggcacagtccctcacggcttcccttggttaggggagggagttccccaatccattgtgcttcttgggtgaggtgacaccccacctggcttctgctcaccctccgtgggctgctcccactgtctaaccagtcccagtgagatgagccgggtacctcagttggaaatgcagaaatcacctgccttctgcattgatcctgttgggagctgcagaccagagctgttcctattcggccatcttgccagcctgtggaggttttaaaaactattttttaattgtagaaagtaacatattgaaaagcatataaatacgatttatactttggtgagttattaaaatgtggatagatagtcattgccacacaggtcaggaaatagaatattgccagcatcttggtgccattcttgcacaccttcccaatagcacatcttcctttcctctaaagcagggttccccaagccccgggccacagaccggtaccagtccgtggcctgttaggaaccagaccatacagcaggaggtaagtagtaggccagtgagcatcactggttgagctccgctccctgtcagatcagtggcggcattagattctcataggggcatgaatcctcttgtgaactgcacatgcaggggatctaggttgcacgctccatatgagaatgtgactaatgcctgatgatctgaagtggaacagtttctcatcccacaaacacatcccccccatccctgcccccgccctggtccatgaaaaaattgtcttctgcaatgggagatgggtgcaccagaatctcacaagtcaccactaaaggacttaccgtgtaaccaaataccacctgttcccccaaaacctatgggaataaaaaattttttaaaagagaaatatctgaaacagtaattactgagaattttccaagttaatgtcagacaccataccactaatacaggaagctttcttattttgaatggaagccggaagaaaaatgcactttacctgtagaggagcagaacattcaacttctcctcagaaaccatgtaaggaagaagagagtggagtgaaatatttaaaaatattgatttaaaatgttgagagaaacaccttacattattaagaacatgagctcagatacctctagggatctagattaagagagcctttgaatgactgagttctacctgtcaagactcagattcccagcagggtcagatatgcccaacaggtgtgatcatcccacatgtggccgatggcacagggtactttaattaaccagatgctggcagcagccatcacccacactccctggtcatcacaactacagcaccatgttttcacccctcccagccccagaggttgtggagcagcatattgaggatcagtgcactgcatgattcctaaagctgtttgcatttaaaacaatcagatacatttctattgctgagcgaaggttgtttgcctttttttcttttttagacagtctggctgtctcacacaggctggagtgtggagtgcagtggtgctatcctagctcacagaggccttgaactcctgggtccaagcgatcctcctgcttcagcctctagagtagctgggactataggcatctgctattatgcatggctaattaaaaaaaaaaattttttttttttagagatggggtcttggtatgttgcccaggctggtctcaaactcctggcctcaagcgatgctcctgtgaccgcctgccaaatgctgggattacaggcatgagccactgttccaggcctgcatttttttttttttttttttgagacagagtctcgctctgttgcccaggctggagtgcagtggagtgatctcggctcacttacaagctgtctcccaggttcatgccattctcctgcctcagcctcctgagtagctgggactataggcgcccaccaccacgcctggctaattttttgtatttttagtagagatggggtttcgctgtgttagccaggatggtctcaatctcctgacctcgtgatccgcccgtctctgcctcccaaagtgctgggattacaggcgtgagccacggcgcccagccccgggcctgcaattttatttgaataaaatgtttgtctcttttatcaaaaagttcttcattttactgggttcccaaatatctaaactgatctgcatctagtgccatatgaaatatataagaaattcatcagtttgttagtttcttcagtttctttgtttcttttttttttcttttttttttttttttttttgaatcagtctcactttgtctcccaggctgcagtgcaatggtgcggtctcggctcactgcaacctctgcctcctgggcaagtgattctcctgcctctgcctcccaagtagctgggattacaggctcctgccactacgcccagctaatttttgttattttcagtagagatggggtttcaccatgttggccaggctggtctcaaactcctgacctcaggtgatctatccacctcggcctcccaaagttctgggattacaggtgtgagccactgtgccccgcctcttcagtttgtttctttaaggacacagactttagagccagaccctggattcatattccacaatcatagctctgctgttaactagcagttacttcctttcagtttttacataatcttactttgggcaattatgtaatctcttggtgcctctgtaaaatggagatgataatagtacccatttcatagtgttgctgtaatgattaaattagtatgaataaagtatttaatatattgccaagagcatagtgtaaatgtatgcaagtataaactattattatatttataaaatgagatattactaattaaatttcacacaggcaacataaaaataccttaaaattttttttggtggggaattaccttttaaaaattaaattactggctgggcacggtggctcatgcctgtaatcccagcactttgggaggcagaggagggcggatcacttgaggtcaggaggtcgagacccgcctagccaacatggtgagaccccgtctctactaaaaatacaaaaattagccgggcgtggttgtgtgtgcctgtaatcccagctatttgggaggctgaggcaggagagtcgcttgaacccaggaggtggaggttgcagtgaaccaacatcgcaccacttaactccagcctgggagatagagtgagacttcgtctaaaaaaaaatacataacataaaaataaaattaaattacttcatctggagaagcgttttgctgtggcatttagcttagaactgtactatgaggaataccggtgaattattcattccttaattcagtattttttgagtgtttgccaggcatatgctgcattctaggaagacagggaatttacacaccagtagaggaagcggtaactaagtgaacgaataaagcccaggataattaactggaatcagcagaaaggatttgttgtgtgcatgaagcagatgagaggcatgggctggaccgtggtgagctggggagagaggaaataagggctgtcagagacggtgctggagccatgttttgcagggtcttcaagactccagcaagcagctgggagtatctacggggagtttaagtttcttttcaaggaagcgtgaagagaggttttacccaggggaatgtgctggtctcatttacatttgctaaagttttttctgtctactgcatagagaatgaattggagacgggcaggcccagcctggcagtagacaagtgcaacactccagggctaggctgaggggtggcaatgaggtggaaggaagtgcatgcagtcaagtcggatcacacacatttattttggtggtagacttgacaggtggtgatgatagcttggatgaggaagacaatgaggaggcatggacattatctagatttttggctaagtgccattttgacagttgcatatattccctctattattaaactttcttttcatttagacatgatccttctcaaaactgtaaatgttctagtgtgtgtgctgcccaagtgaacatgaagactgcacattttttaggtattttaaaactttcccgatctagatttttttgcactgcagccaaattgtacagtcgtttcaaatttcttctttagtaatgggaacctcctttgttgatatcttgggtatttaattgggagcattttacctgttaattatggttgttgaggattttaaactcactttatttaccactagtcttttgaaattacattgctgaatatcctgcctgccctggggagtgtcagagcctgtgaaggcctgcacctgttgagaggcagccttccctcctctgcgattcctgcttctggcttccatgggtgatgaagggttgtgggatgggaggggcagctggagccgctgagccagctccacctgagtctcactgtgtaactccattgttctttttagcatggccttcaggggtaggaagtcaggcttatgagattttatctactgtcactgggactagtatacctcctcagtaagtggaatttattattattttactaaaatatggtttcttcgtgtgaatgaagtgagatcaagcatataaagcaatctttagttaaaagattgcttaaattgttacatgtggaataaattattttacttttttctaagaaatgaagagaaactgggaaaaaaattcgttagacagtaatgcatagagatttttttacacctaaatgagaagccagaaattcatataaaacataagaacttcaaaaacatttcttaggcacagactattattaaacactcatggatgttttttattttctattacattaaaatactcaagtcaacttcatattcagaacatttaaaaatagctcaatcttaaaaagaagatataaagtattatcagctgtgctttttgtgcataattagcgtgtgcctgtggaggtataaagacttctagcctaatgatagtatcatgataaaaagttcagatggtaaaaattggagctccagctggatgacatattttataacaattcaaagatggctccagcatagaagccatgctattttagttctttgtaatccctccttcacccatcaatgggtcgtgaaggcactgataaaagagccttttagaaatgcttctatttgttccctttcttacagatttaatgtgtgccgaccatttccttcagtgctggacaggctgctgtgaagggacatcaccttttcgctttttccaagatggctcaagattcagtagatctttcttgtgattatcagttttggatgcagaagctttctgtatgggatcaggcttccactttggaaacccagcaagacacctgtcttcacgtggctcagttccaggagttcctaaggaagatgtatgaagccttgaaagagatggtaagtagtggaccagaataatgaaattattttctgacttcagggactctaccagatttcaccaagacagaatgccacccagaatcgggacttgtggtattgactgaagtgccgatggattaggaagacaaattactcaagagctggtttcctagtctccgatttattatattattataatttcttcttgagtagctgtattgttacatgacacttcctgaccaagcaagttgttcttaaataatcaagatttcatgcttgttgtcaagtagtaaatgggattcttttgaaggcctttgtgtcccttgaatcttggagaatttgctacatgcttaacccttcttcaaccctcttgtcaagtgggctgtcctaagagatgatagatattaagatctcttcttataatactttttataaatattaagattttgagtatctttactattatataatttattattttcaaaatttaatatattttcattttgatgtcatgtttcttttattatgatagatatttttatgatttagcacatgttgttatattatgagctagtattttgtatttaatttcaaaatgaaaagcaaaattgtcacttaacaaagtgttcttgtgttaagcttttcttcccttaatcaaagagtaaataggaaatttgaagaataatttgtattgataatatgagttcatatgtctttagaaactataaggaaagatacagtctgtgtgaacaaccgatgctaatttttagaattgtttttttaatgagacatacgtaacttgacctttatatggtcccaaaaagtgtaggaccaggcttgatgctgggacacatgtgagagatgttttgctgcagtagcagaaagtgcccattgtgttggcttacctgcatgttatcctagtttgcttttatttttgaaattttatgaaaggtaacaagtggaaaaaggtccggttgtacaatagcatgcatgtgtgtttttaaatcttaagctgttttctatttggttgatcctttttctatttcagggtttagattgttacagactatgatgtcatttgccatacagtactcaaaatagtaataaacagatatatacatttatgctttggctgcttttatttctttttacaagttccagagttctcatccctttaaaccttcttctttgaaatagtcttactggagctgagttcgtaacctctcttatgttagaataaaaaaaccaggataaagatacgggattatatagttattaatcaccaataatgtgttttcaactcttaagcagtctttattatttttaaataaagtagcctttactgactattaagtatgagtagaattaattttgcaacacaattgattttacctatgtcatacatcttagtttggtgaccccatttaaggatgaagtaagttggttggttgctttttaaactttatttgaattacttacctaaagatcttctctaatccttttgtgcttacttttaaaaatggtatactaaacaagaagcattcacgttccctcaatctataatgtcagttcagtatttctaagttgcataatgcctttactgaccaaaatttatttttctttcacaggattctaatacagtcattgaaagattccccacaattggtcaactgttggcaaaagcttgttggaatccttttattttagcatatggtaagaatcaaaaacgtgtcctctcaaaatggctattttaatctttgcattgtttcacagaggcttacattatgaacctttctcctagttttttttttttaatggaacaacttatcaaatgtattcattgttctattacaaagatggcttcctatactgttgtccatgtatgtgtgtgtaggtttgtatagataaacacacacacacacacacacacacacgtgcacgcacccatgcagatcttcaggaaaatagagctcttcgtattagaggacagaaactcccagatgatttaaatatctacttttgcctgtaatcactttcataacttcattttaaattcaatataaaatggctatactaatgataccgagttaattttgtttcacggtttcataactcacacactctttcccatgttgtaaagtcattcttcagagtgtgaatcctgccgtgactttgcctttgacattggctgctttgaccttatttaagggtgccattttggttttatccaaggtggagatgaatgtgggggcactttggggaggtattccttcactgagctcctgtctgctgtccagtctcatttcctgtttcatctttcacagctatacctcatggtggtagccaggtcctattactaacagtgcctgaaggcactttgtgtcaggattcctttcacactcattctcctttgaaatagccttactggcctgaggtaggagctgctgggagtgtctccatggcctccagcatctccctttaatacacttacttcactgtctgatgccctgggaagacagcatgcctctcgagaacaggaaccatggttttagttctctttgttgtcctagggcctcccaaggaacatggctgaggtttgctttggattgactgtattattagctaatgtaatatttacttttaagattttttaaagtcaaagactaattgcataatataatgacattagaacccaaaataaaatgaatattcccctttgatgttttaaagaatcatgcagtttcccatttataggttgtcataatcattattggaagagacgtgaactaggcaggaaagggacaatatgtgtgtttagccctgtgagcaggcgtgcgtggacgcccacacactcagcctccctcactctaccccaccctcgtatgtccctcctccttcccacttatacctcttcccccaacccctaaacttcttcaagttcttgattcaaaatggcaaaaccagtgaggcagcaatgtgtttgcccaccaggaccacgcttacctgtcctaggtttatctattgcagttaggtcagtgtttctcaaacatctttgaccagaaatacattatgtatatgcatatgcacgtggatatgcacacacacagtgaaacacatctcatgaaaaaatgcatacaatggcaccccccttagactttctgcacttgcagttactcacagtatagtacaataagattttgagagagatggagagatcacatttatgtaacttttttttttttttttgagacagagttttgctcttgtcaacccaggctggagtgcaatggcactatctcggctcaccgcaacctctgcctcccgggttcaagtgattctcctgcctcagcctcccaggtagctgggattacaggtgcctgccaccacacccagctgatttttgcatttttaatagagatggggtttcaccatgttggccaggctggtctcaaactcctgacctcaggcgattcacccgcctcgacctcccaaagtgttgggattacaggtgtgagccaccgtgcctggcctaagggtttaacaatgacaacaatacaataaatcaactgtaacaatatagtgtagtacataacttctattacactatattgttacagttgatttattgtattgttgtcattgttaatcccttgctatgcctagtttataagttaaactttatcataggtatgtgtataggagaaaacactgtatttaaggtttggtactattctcagtttcagacatcccctgagggtcttggaatatttccgccattgataaagagggactattgtattattattctgtgcagtccatgttcactatgctgttcatagtgaatggtgttcatgacccgagactggatttcataacccttgatgcttcttgaccagaagtttgaagaacattgatctaggccaatatcgatggcaggaaaaaggaaaagaaattgttgaatgaccttcatttgaaagcagtacccattgttaggggcttcatggatttattaattgctttttagaaagaaagaaatattacgtcctttaaatgtacatcgtggatgtaatacatcctcaagtcagaaatgtgagaaacgtggggaggtttatgatgtcgtgtgagaggcattgctcactttgagctgggcactgttctctgtgggctacataatggacctaattaattcttgatgacagtgttgcagggtagataattatggattagagtcaataagtcgctttccctagaatacaacactaagaagagccagaaccccactcctcatgtgactttaaagtccaccttctgtaatgttctgtccctattggatcacatcttgtgatcgaagtgttccagtcttggcattcccactagccagcttcacttgcacatacatattaattcagcaggtatttaccaagtgttgggttttttttttttttttttttttttttttttttttgagacaaagtcttgctctgttgcctaggctggagtgcagtggcgtgatctcggctcactgcaacctttgcctcccaggttcaagggattctcctgcctcagcctcctgagtagctgggactataggcacccaccaccacatccagctaattttttgtattcttactagagatggggtttcaccgtgttagccaggatggtctcaatctcctgaccttgtgatctgcctgcctcggcctcccaaagtgctgggattacaggcgtgggccactgcacccagcctacaaagtgtttttttgtgtgtgccagcccttaggaaaacgcggctcactgtctctgcccattaggagcttccagtcagggaaaaagagatacttaagcaggtcagcctgactcaatgtgatggttctctgaatgggagtagcagttgctgagaggaaggagggtttctcaggagagcccctgctggggcaaacttgaagatgtgattctctaagacagggcatctgaactcgtggggtctcatatttcttctttgtaaaagtaggagttcagactgatttattctggtgtccttgaacttgtatctgtctatgatctttccttagcaccttatctgcattaccttggcccctctgacaaccagaaacaaattctccatccctttctgtctcaacgcttgtattaccttttgaactgctcataaatttcagtttcctgttgaggtatgccctggctgtgagctcacagaggtggctgaatggcatgaaactccattagcagtcagatgttgcctgtgtcgcccctgttgtttgactagttgggcactttcttcctggaagggatcttttcttatggttttataatatcagaattgcttttttttgagacggagtctcgctctttcacccaggctggagtgcagtggtgcgatctcggctcactgcaagctctgcttcctaggttcacgccattctcctgcctcagcctaccaagtagctgggactacaggcgcccgctaccacgcccagctaatctgttttttttttttgtatttttagtagagatggggtttcaccgtgttagctaggatggtcttgatctcctgaccttgtgatccgcccacctcggcctcccaaagtgctgggattacaggtgtgaaccaccacgcctggcccaaaattgctttttaattacagtaaaagcaaacaattttcatcatggaaaaaagtaagtcatatgtagtgttcatggagaataggatcagaaaagggtaataaggaaggagggatgatttggaaatgaaaagatactgaaaagagaagagacaaaatagataataatggaaagttagagaatacctttttattcgatgatgtcctcagcataaaaatactgccttcaccttctgaaattctgatccattgcttctaactctgccctcacgattaagcatgacagctgttacctctcttcttcactattcactattcctgtataacaaatttctgccaaacttagcagcttaaaacagtgaatattgtcttaaaaatttgctgccttcatacttttaaactatagaattaaagtttaaagaattgctttagcttttatgtagaatttcaattccagatatcaaaaaataaaatacaagatggcaagtgtatgttgttatcttcctttcctttccactcagttttagaatccaaatttacactaagatgggctgtcagtgactgtccctgcagtgaatcccaggcagtttcccatctcacttaacatgccctgtgggatgctccagcctgagctcagggcctccagggaggagcctgacagatgccagcccctggagtgagtgctggtggcacttgtgaataacagtccatggctcatgtttgtaaattgcctaagcaaagcaaactgtaagctcattagcagtgcatttcagtgcattgactctgggcacagaaagtcacctcctacaggttgggtggaagtttctctggctccttctctttttttatttttctcccaaaaaataaaattttgggagaaaaataaaaaataatataccttttgaactaagtttgcataatcactcaacacctggggaaactcccagttttgggtattcttttagatttaagcttcataaactcataaactgacatttcctttctttttttttttttttttttttggtggtgaatgtctggtttttggaaatgctctccatcagattacattctttttaacaccctgctgcatgcgtaaggatgccattggatgcatctgtcacacttactacatgaagctaggtagaatttcttctaatattgaaactatgggaagcataacagtcacatttttaattagtggcattggttaaacctgaagaatcctagaatctttagtggttaaattatacgactcttgaaatgaactgatctcaggcaagccagtgctttataatgctttatttgagctcataaaagctaggggaaaaaaatgaatggcctcagaataacccctgataaagttttttcagagatgttagttattggaaaagcataagctatgtatgttcacagggaaaaaaatgggtttaaaaattactgttagcattatttagtttgtggataaaaatacagaagtcgcttactagagttggtattgttcttatttctttgttaatgaagtccttagaaatgctgggttttggccaggcacggtggctcatgcctgtgatcccagcactttgggaggccatggcaggaggatcacttgagctcaggagtcggagaccagcctgggcgacatggtgagatccagtctctacaaaaaatacaaaaattatccgggtgtggtggcacacacctgtggtcccagctactcaggaggctgaggtgggagaatcgctggagcccgagaggtggatgtttcactgagctgagatcatgccactgcactccagcctgggtgacagagcgagaccctgtctcaaaaaaaagagaaagattgggtttattagattgcagaagatgaggtggcagagagtactgattccaggcaccggctgtcttagcctcacctccatggccttgtaaagtctgaagttgctttgccctagctcgggtactgacatcttcagtttctaggccccatttttgtttcttaattgtgttataaaatcatccgctggaatagactcagtcaccacaaaaggagaaagaaagtagctcatcaagtagatgttcctgcaaaatgtaagatttcaaagttcagattttcattgcatgtttggtaaagttttataaagatttacattttagagtaaaagagcatgtaagagacttctattttatccaaagcacttggtactagaaatatattttaaaacaatcctttttattaaatttctttttaacaagtggagctattttggcaaattaaaaaattaaaagattaaatcacaaatactggctaccaactgcctataaccattaagttgccttagaaaggtcgaaattactaaccatttgaaatgtgaaaaaactgatcatgaaaaaagcccagttctcttagttctttccatcattctcgtttggctttaaaaattgatactgttacagaaaggaaattgaccacacaagagttaagtgatcccaaggccacaagaaggacaaaaccccacaaagttaagtttagggaattctgaaggacagctaggagagcaaagatagagtgagggaaaatattcccatcagcagaaagagaatgtgcaaagtatgatggcgagaaagcaaatgttatattcagggatacttgttctgtgaacttagtagtttgagattttcctaaatataatgtttacagtgtttttatattaatgattttttctgcttgataaaacttattaagttttcctttttgtagatgaaagccaaaaaattctaatatggtgcttatgttgtctaattaacaaagaaccacagaattctggacaatcaaaacttaactcctggatacaggtaagagagtaaatcttgctctgcacttctttgaattaaattgattatttaaaagtgctgcttaaaaaaattttggggtggggtggaatccagttctatgatgttttagaaactttttcaaacatacccttcactgttacattatcttgctgagtaaaaagtttttcaagagatttcaattttgcttgactgtgaattccaaaagataccagtctttaggatgaagacctaatgttgagtggttttgaaaagtttctttcaggtgattaaaataatgtattccatttcactctagcaattgctatccttcaaaaaattgtttttccctatcaacctggtttaaattcctttccacatgcttccatgcctctctcaaaatctattttgtagtgaaatgaaaattcagcagtgcggcgggagcagcactctttattttgtgtcccgaagttggtgcctgagccagcatatgcacagactggatcttggtgctgcgcggcctctgctgctcactcacactttccagttggctacctactgtgctagtccagatagctgacagctttctagatttccctgtctgcttctactttctcctgaagggtaggcataaggtagagatgtggtgaggctgggctgcagctgccctcaccagcagcgcattggctgttcttttctgttccccgcactgccttgctgcagcaaccccaggactggctgatgcctgtcagactccacttagtatgcttgtggttcagatcagctgcttagtattatgaaatcatccaaccagattagtgcatatggttttgtctatcagtctgactggtgatatcgttacattcactgctttttacgatttctttgttttagacaaaattgctaacagatgatgaagacagtatttatatttttctgtttgaaagatagaagggagtgagagggattgggcaatggaaggaaagaatacaaactttaattggaaggaaaattaatgtaaggaactgaagaaaggaacagataagtagaattagggaagaaagaatgtgtaacaaggctgaagaaacaaaatgacatatttagtccttaatttttttaattgttgcttttattatttgatattttaatgaatatttagcatataattttgtattagatagctcattgagtcctgaagtaggccatctaatgaagtgtttttagagtgactggattaactttcttcatttaactcatgactttattagcctgtttaaaaatttctagcctcacattttattgtttttcttgtttaatactatatctacttactagtaggtacttattaagtatagttcagggagttaaaacacttaatctgtgccttcggggaattcccagactggtaaccaggtcactccagggcagcgtggttgagttattgctaaagctgtgtttaggtgtgacgctgacgtagagggggacacttgctctgacaagggggtttggagacatttcctggggcaggtgacgtgttaattgaattctgaagaacagctaggagagcaaggatagagttagggagaatattcctgtcagcagaaacagactatgcaaagtatggtggtgagaaagcaaacgtattcagggaactgtgggtacttaagtgtgcctggaacttggggttttgtggagttggtgatgaagcatgaagccagagagaccagcaagcacagtccttgcatatgactatagaaggtttttatcttgatgacagtggggcagccaccagagtatttaaaacagagaaatcatgcctgggcgcggtggctcatgccccagcactttgggaggccagggtgggcagatcatgacgtcaggagatcaaaaccatcctggctaacatggtgaaaccttgtctctactaaaaatacaaaaaattagccaggaatggtggcacgtgcctgtactctcagctactagggaggctgaggcaggagaatcgcttgaacctgggaggcagaggttgcagtgagctgatatcatgccactgcactccagcctgggtgacagagcgagactctgtctcaaaaaacaaaaaaaaagaaaaaaggaaaaaaaaagccagagatatcatgtagccagtgtgagttttagagactaacagcaaaaggaagttggttgggaagagggcaaggatagacgttggaagctattgtagtgataagttgagaaattgcgagggcctcaaagaaatggagaagggggcccgatttataagatattaataaggcaaatacccagaaggtataatggcagattaaatgtcgatacacttaggcatagctggaaatgtacagagagcaggtgaatatcccattgccaggagagcaagctgatttgctggcagaggattgaaagtcagccacctgtgggaatagtggaagccttaggtgaggtaaggtccgctcccagagagtgctggggtaggggcccaggggaactagagagagccttggggagacactgaccttaaggggaagtggaagaatgattgatgctacagaatgtaaggaggggtccaagaagtagaaggagagaagcaacggagaatgagtgctcattcatatctaatgccatacagcagtgctgtccagtaggaataaaatacatgctgcatagataatggtaaactttccaggtgctgctttaaaaaacataaaaagaaatagttaaaattaattttaagaagatatttcacctaattcagtatattccaaataccatcatttcaacatttaatcattattaaagttattgagattatttataatctttttcatgatgtatctttgaaatccactgtgtatgttacgctaacacttatatctacgtgttgtatcttcattcagatgttaaattttctttggaaattcttgatctgtatttagattttataaaatgtagggttgaaaaagtagattcacatacccaagttgttccgaggaattttataactgaatcaagtatcggtatttaaattaaaattgaattaaaattaaatacaaagttcagttattccctggtgcttactgcacggcagtgctctgcagccacatgtggcaggcggccgccgtgttggacagggcagctgtggagcatacagcagaaggatcaagaaacactacttggatttagccactgtgagcaaagactcggtgaggagaggtttagtgagaggtggagggaaacagccagattgctccagattgagaaatgttgaagaggtgaggaagcagagataataaacttcactctttcaagaaacttggcagtaaaggagggagaactttggcaatgaagggggtgatagccagactagggtggggttggctgaattgagcaagtcccaaacatgctttacattgagatgaatatgtgggtagggaacaggtgaggatatgcgaggttgggaaaacagtttccttcctcagttaccaagcaagcctgaactaaataacatgaaccgataaaaagatgtctaggaacatattaatgatttaactcttaacaatttattaacatattaattatttaactcttaacaactctaaagctaattacattgcccatcatcagtcagtacatacataatctcatgttggctgtaaatgcagcaagatagaagatagtctgtaggttggtttataaatcagttcacatctccggtatacttgattttatcttggaggtgatattttcttcatggaggttttagagtgacatagtatctgttaaagatgtgtaccttgacatccaatatccttgtgaaaattataaaacagccatattttaatgtttgctaattcattcagcaagcatttattagggcctaccatgtgctaggatgttctaattgtggtaataaaatcttgggtcattctgtgttactggagcattacaagtatgattgaaatactctaaatcaaaaactaagaatttctacagtaaattacaaaattcagtaaacattcaaattaattaataaatttgaaaatgatagactgagttgtatttttagcacagagaagaaataattctgtttgacacttgacatgttagcatgtgttatactggaaacacattgataaaatgttttggagttttactgacaaccttgaatgtgccatcatagagcaccacctcaacagctcttcttacagttcagagacgaagttccgggactctttcatgtattttgggaatatgtggtcttgaaaaatgtagttttactggtaaatccactgaacagatactttttgagcacctactgtttgccaggcacaactatagaggctgaggatacagcactggacctagaaagacagtctgttctcagatgctacaatagatggggaaggtttccagggcctgccaaatgtaagaggatgcctgtcttctctggcaaaaccataccactattattttttgattctgatagaaagaaaaaaagacaaaaaaacacaacagggtaccaggaacagagatcaaaaggtgttgtattctatctgtattttctttcgaaatgcaatactaagcaatatccagatagcgtctgtcctctactttcttcttttttcaaaaagaaaaaacttataaattaaaaaatctaacagacttacacaaaacataaatgccaagcttaataaattgtgacagatccttgtaatcaccacccaaggaaatagaacagaacattgactgctcctggatgtccctgccccccatgtgccccttgttgctttttttttttttttttttttttttttgaggtggagtttcactcttgttgcccaggttggagtgcaatggcgcaatcttggcccactgcaacctccgcctcctgggttcaagcagctctcctgtctcagcctcccaagtagctcagattacaggcatgcgccaccacacccagccaattttgtatttttagtagagatggggtttctccatgttggtcgggctggtctcaaactcccgacctcacgtgatctgcccacctcagcctcccaaagtgctgggattacaggcgtgagccactgtgcctggccactttgtgccttatttaagaaatttttctgcagtccaaggtcatgaagatcttccatattatcttctaaaagcctgttggtttccttttcctatgtaagtctgtgatccacctgtaacttatggtgtggtgtaaggtggtaagtagtccattttcatcttatttccacgttgatgtcccattgcctgacaccgttattgaaaatcatgatctgtggtgctaccttcgtcatgcatcaggttcctttgggtgcatttcccactgatctgtggtgccaccttcatcatgcatcaggtgcatttcccactgatctgtggtgccaccttcatcatgcatcaggtgcctttgggtgcatttcccactgatctgtggtgccaccttcatcatgcatcaggtgcctttgggtgcacaggtgtgatcctgcatctctccattggttttgttgtttatttatggtattaatcttagtatcaacttgactggacacaaggtcctggtaacattattctgtgtgtttctgtgagggtgtcttggggtgagattaacatttaaattagttgactgagtaaagcagattgcccatcctaatacgggtgggccctatccagtcagtgagagacctgactagaaaagaaggctgatgctcccgagtaagagagaagtcctcctgcctgaaagcttttaaactgagacattgtcctttttcctgctttcacactcagactgaaacgtcacctcttcccgggtctaaagcctgctggccttctgactgaaactataccggtgactctcctggttatctgggcatttgctctcttgtgtctctgacttgctggctactgtaatggtgttagctgattccttataataaatccctgtgtgtgtgtgtgtctatcttattggttcagtttctctggataactgacaaatatactatatttatgccagttccacactgtcatcattaatgtggccttgtaagtatcttgctatccaggaggaagttcttccatcttgttcttcatcaagacagccttggctaatattggaacttagcattaactgttacataaattttaggatgtgtgtgtcaggtttcactaaaacacaaaataacttgttggcattttgattggcattgtgattagtcagtttggtgagaatctcaatggccactatcctctaaggcaaaattggtttttctcagttttgtttactattagcaaattgaacagtacctggcacggcataaatttttgaataaattaatgaatatatgatatgcataaatgaattaaaagttgtacaaatttattttttcagataatcttcctgataactttgaaacatttttgccaacttttaattagcataaccttttaatgaggctgatgattcgcttgcagaagtgtctgtgctaccatttcccagttctcttaggttgcattcatagtagtatttttaatctctgacttctttgcagggatcttttgaagccaggtgtccatctgatggttcctttagttagatagcataatcagcagaccttccttactggtcacatggagaccataatgcatatcctgagaggaagtgggaaccggagggctcctgccagccctctgtgaggtggaatccccacccttccctcagggtcccacttggactacttgtgacacatgaccatctataacatctagactggctaaggtcgtagtgtgagtacatttgtgaaatattaataaagcttgatttcttcttacatataaatattctaatgttgttttcacatctcagtggactatcttgtgcactacttggagtacacaccccaactttattaaccagtaataaattttgataaaatccacattctaccttggtatatgcagcttctcttcatcttttctcaaccctaatatctccattttccatttttgcatccacatatcatgaaggccactccctgatcttcccagatcctagcatcttgctgcactagctccagacatgccaaacctatgcacagatttgtacttggcagaaattttctttcctctccttggaatggttttatacccttactagcctggcctggctgagatatggaaacctagggaaataattattgttcaagtttgaatggcaatttaaaagggaaaataagatgattagtgaaaaatagcagaggcaaggtgaaattcagagatgaggccagggatgttagcgattcctcttccacagctccatctactatttttattacttttaagtaacaaacacattactgatattttttttctacctgcgttctatttgcttgactttctacaacctcagggtttttttttttaaagattaattgataattgaatttttgtatttgcctgtataggggatatttattcattgcttttccagtatccatctcccctcctttcccgccttcttaatagtaccctgaatttcccagctgtgcatgattcattctgggtgagaggtatcttatgtggctcctggagtgggtcctacctggcttaaccaacacagcttctctgttcctctggccacactggttggtcaagatgagccccgtcaaggctgatgagattcagggctgtaacatttgtttgcaagattgggaagtggattgtatctttcctgatgaacatgaattaagtagcacataatccctgaagttgctgttggtcatgtggaaccatgagatcagagcgtctctggaaatggagttagtcctgacaaaacatagctgagaaaaacagcaagagaaaacaggtcatattcacattgtgtggaccctggatcaagtcttttccaggcataaatgctcgaatttctttccttttctatttgagctgtttggttcaggattttgttactaaaagccaggagtgttttgagataacattgtttggggcataaaaaaacatttctttgaaggtttttgaaactcagggacacatggacacaattgcaagaaaaaaatcttatttattcaaggatgttatgaataaatagtgaatttaataaagtactttcagtttcttaaaaattgctctaatttgtatttgttttttcactgccattcattgtagaagatatatgcattcaataaggcatccttcttcccagcctcagttaattttactcctttgcacaatcctgaagtgagttcataatatatgtttgtcactgatatggtttggatctgtgtcccacccaaaactcatgttgaattgtaatctccaatgttgagggtgagtggggcttggtgggaggtgattgtatcatgaggatggtttctcacaaatggtttagcaccatccccctggtactactagttcttgcgaggtctagttgttgaaaagtgtgtggcacctcccttgtttctcttgctgctgctctggctgcgtgacatgcctgctcccccttcaccttccaccatgattgtaagtttcctgaggcctccccggaagccaagcagatgctgcagtgcttcctgtacagcttgcagaaccacaagccagttgaagctcttttctttataattacttcataaattattcattgcctccattactcagtctcaggtatttctttatagcaatgcgagaatggactaacacagtcagtcagcttatgctcatttccatggttgctgaaatggcatagacccaataattggaggtcaccacaagatcttggcaaaagagagagtggccttcaagtaatacctttattccatgttataacttaccaaataataaataagtttctttttaaaatatccctctctttgatttgcaccctcataagaattcctctttaggttaatcacgaactctgttctccacacttggaactttcaaatataggattgttgcaggacttttccctagttcagctaaggacggggttctttatcccatggccatgaaaattcaggcttgtagacaatttgaatggtgagtgagactgggttttattgggtgaaaaggaagaaaatggggagacaggggctctcgctagaccagagtccctgctggagtgcttcccgcctgccattcgaatcccagggtcctcacaggaagaggaggggccaggcgcctccctgctgcaaatgttgtgaacttcctgaggctccacctcagtcagtgggcaggctggttggagtttctccagggacccctgtcacctggctgtctcagtatgaccttgatgtatcatttttaggaaacgtgtttgcaaccaccattgaaaaagtaacatagtttggatattttatggacttggtttttactttctgcaaatattgcatatagatctcagaaaagtaaaacagaaggagataaactcatggtctaaaatagtatttggtatgacagtggaattcaaaggttcatacttgaaattgaacctaatgcaagatcagactggtaaaatggagtgaagttacaaaaagaaatctgataatgagaggtgaagccagctggacttcctaggtcaagtggggacatggagaacttttctgtctagctagaggattgtaaacgcaccagtcggtgctctgtatgtagctaaaggattgtaaacacaccaatcagcactctgtaaaaacagaccaatgagcactctatgtctagctaaaggattgtaaatgcaccaatcagcactctgtaaaaatggaccaatcagcactctgtaaaatggactaatcagcaggatgtgggcgggaccaaacaagggaataaaagctggccaccccagccagcagcggccaccagctcacttgggtcgccttccacactgtggaagctttgttctttcgctcttcacaataagtcttgctgctgctcactctttgggtccgcactacctttatgagctgtaacactcactgcgaaggtctgcggcttcactcctgaagtcagagagaccacgaacccaccataaggaagaaactccagacacatctgaacatctgaaggaacaaactctggacacaccatctttaagaactgtaacactcactgcgagagtccgcggcttcattcttgaagtcagcgagaccgagaacccacaagaaggaataaattccggacacaataaggttaaataattttgcattggaaactggttctttattcatccatgggccagatgcagcatagaaagcaaggtatgtgcttccaaagatatctcacccctgaaaggaaccttgagctctcgaaaccactcactggtatgaggaacagttagattgcactccaggtggtggtgtgactgcactgcagccgcactacaccgcacggaaccctggctcctcagacagacctctttcactaggctggaactgctggggacggcacagggctaagtcttcattgtggctttaaagaaatacctgcattgatttctgaatggcaaacttaaaaaaatttttttttttactgaaataattaaggaagcaaccatttaaagaggatttgtcagcttttcagacattatattccgcagagttgggccatgtctttttgttcatgttcttttttgttttgtgttgtaactcatagcaggcacaaaataaaaaactactgaatggataaaattatttaaaatttaataattcagaattttttcccttctctttttctaaaaggtaagactacccagaattttgttttattttgaactgatctgttacaagatcactggaaagagccatgaaagaattacaatgtgtgtgtgtgtgtgtgtgtgtgtgtgtgtacatgtgtgcacacaagcactgacaggtcctaagtccacatctccaggtcgaacctttcccctgagccccacattttcagctgcctgtgtgacatctccacttgggtgaccatgagtgtctcaaactaaacatgttccagattaattcctgatcttttccccaaaactttattctccctccaggcttccttaactcagttaaaaagcagcttcattcttcctgtttcctcaggtcaaaagccctggcatcatccttggctgctcttactctcccatctcacctcaagtctatcaatccatccagtctgttgattttatctgtgacacgtgtccagaatctgaccacttcctaccagcctcactgcttctacccccatccacgccactgttgccctctccaggaacattgcagtatctttgtgtgtgctctcctagagtctcaaccagaaggatttttttttttttttttttttgagaaggaatctcaccctgtcgctcaggctgaagtgcagtggtgtgatctcagctcactgcaacttccacctcccgtattcaagtgattctcctgcctcagcctcccaagtagctgggattacaggcgcctgccaccacacccagctaatttttgcatttttagtagaaatggggttttgccatgttggccaggctggtcttgaactcctgacctcaggtgatccacctgccttggccttccaaagtgttgggattacaggtgtgagccatcgtgcccagccaagaaggatctttttaagtgtctctgttcaggagcctcgggtaggttcctgtcttattcaaagtgaaatgcaaagtccatgcttggctcatgaggccctctgtgacctggctgtggggtgttactgattttctctcatattctcacttctctcagccacagtggcctcctcactattccccatgtgtgcccagcaactccttcctggggtttgggggtttaagcatctgccttcactgctcctctccgagaacaacactgctcctctgggtaccatttgggtcactgctggatgtcacctcctcatggaggcctgcctcatcatcctgggctagaccctcactctcttcgcttgcacgcggtcttagtgctcatcagctcctgacatgctgggtttttttctgtctccccattacctcccaactaagttacatgttccatgagtgcagagaccttcttgtacaggctaggatagtgcctggcacacagtaagcgttcagtgattatttgctgaatcagtaaagaaatgaataggaatttttgtggcaaaatgtggtgggatgaggagagggacttccacatggagaggagagaatggacaaagttgaccatggccaagaaatagtgatcactccagttaggctggagaatgaggtacctagagggagaagttaaggttagaaaaatagtttgggacgcattttggaggactgtgagtttgtttataaattaatggtgtgaggcaatagtgctgcgagagtgttgtaatgtggcacctgtcatgctccgcatgcccctgcttccgccctggctcccctcccatcttttcttcatcctccatccctcatttattccacaattgtatcctgagtgcctactgtgtacaagcaggtgttggggatggaaaggtcttgcctttgaggatctggtgattttattgcattttaccaagtgaaggggtggaacagcatgcagaaggcgctgaggtagccagagggaagggagagacactttgttggaggagtgcagagaggttgcaggggtggttaagaggcttccagaggggaacagttgagtttgcaacatgaagaacaaggccccaagtgagcagaggctgagggcctgtatggtactaggagacctgaaagtgatttgaggtgtaggcagagagatagctagaaacgttcttcttgctaatgataagaagaatggccatctcattaatcaaatgttaggtactcaagaaggtttagctgggcctgatcccaatgggccacttggcccgtagtaaagaattcacttaacttggaaggcaaaacttttaattgaaagggtttaaatgggggctgggggacacatatgtaaatataaatcagatggtggcttctttgttgaaaatacgttcagcacagtgcaggagggcaggaattggcaggttgagatgttggagaagtgggagtggagcagtggaggatagcgttaggttttaggagactaataacacttctgtcagtcgtctcctgtcttaggaactagttgagaataagataccagaggcaggcaattggacagttcctttacacctaaacagattcaagaatgtagcttgtgtctgtggtttggttggctcctctggatttagtagataaatccaccaggcactggtgagctgagcccccagaggcctacctggctgggactgagcctgcctggcccagtatggtgcagcagtaggccaggacgcatcctttctgcaggcaaggcaagttggaaagacaaaggaaaaaggacctatggcgggcagggcattttaaattttctctcccgaactgaccaagtagatcatttctcttagagaggagagagagtgggttgagagatgatgtcataggtcgggctctcaggaactctgactttgagatggagattagtgttcagggagtgctttggggaggaacagctatggagtagaaaggaaggagacaggactgtgcagaggaaaaagtttagctgcactgcagtctccacagaaccgtcagctgtgcctgtgggggtagaagcgagagacccctcagagctttcctgtgctgggacgggagggctggacctttgtagctctacatccatcagtccttgagatgtggccactatgggatgggggtgtgaccttgggcaaagcagagacagctgaatatgatatggttgtcaaatcacaacatccttcacagatattgcacttgttcctcccctgctttgccctcctggggagtgggtggacattctgtctttgggaacctgggcagtttattctgtcttctctgggaacccgggcagtttgtcttcctctaagaaggaatgccgaggttttgtggttgaagatagacctttccctgagaagtataaggggaagatgtggtgggatccatgacagaagtcactagaatgtgcgaaagggaggagcaggagacagcgcatcccagcagctgccctcactcctgtctgccgtgttcctgggcagctaccctcactcctgtctgccgtgttcctgggcagctgcccggggagacgctgtcttctcctctgccttcctcactgccttttggtgtccttttccatccctagagcatagatcagggactacaataaagttgaatccttttccttttcaccccctgtctattattgaataaaagtggctagtaacaggcatctgaaaaagagaaattgtggaaaatttttttatacttttgtaagtgtatttttcctggaggtttggaaaccacaaaagttttctgtcatactttattagggtagcagaattggtggtaggttctaaattcagcaagtacatttagtaaatccacaaaatgccattgctttcttaaatatcatggttttatttagtctgaaaattttttctcagcatttcatagttttgcagtgtaaatatggcatttagcatcattttacagggctctggaaaatgtggaaattactgttattcccattttcagtatttcaagtccatttgttgtgatcagtacttcattccacacataaggtctaattgtgaatttttaaaatgtctctatatgtgcatgttttgtgggagtggtagctgtctcctgagtcattaatgtgagtgcactgaacttcttaaacttcccattatgaaaatttgcctcccctaaaggggtaaaatgagataccatttgtattcctaggtaggttttaattttgtttggaagttttgttttattttgtttttttcattttatttacatggagttctgcttattataattctaattgtatcagattgtttcttagtgatttgccagtgctcagatgggccagatcaagacatctattgccaattaggaacaggatgtttatggtatttactgatgttctccggatgacctgttttatgttttcagtttgttttgttttatgatcatgttggcttttccattaaactataactttaactgagttggcttagttagtaaaacattgaccagctccccttctctatcctccaggccccttctgatgcctcttcccctattgtgccccagcctcagtctgaagggaagcgaatttttaggtctctatgttccagatgtaatctatatttccaagacataagctcactgtatttcaacctaaattgcctgagtaatgctccttggaacatttagggataaatccctgtgaaaagtaaatttaaacagtgacgtctgtagtgggaggtatttcttaatgaatagccactagtgaggatgtgtggatgtctgcactacacgtggctgcctgatcgctacatctgttttgaagttcagtgatttcccagaccacatgttcatttctttagggggctgacatccctcccaggatccagtcattgtgagctggtaactgtaactggcttactctttttgacctagagattattatactttgtcttagtttgactattgttcctatcagatctgacaatattggagtttctataaattagcagcatggcagaggaaccaagtgtatttaaacccataaatcatgatttccaggtcttttaaaagctgtgtggtttgaatagtactttactctatggtagacataaagagtggttataaaaattctggctaatcaggaggcttttgtagttcagctgaaactacaaaataacctcagatgcgtcactcctttgggaatcagaccatccagatttgtcctggctctgccagtgagatcttttacaaattacttaccctcattcctatatattaaaaaaaaataacaaatactatatgattccacttaaataaggcacctaaagtagtcaagtttatagaaacagaaagtagaacaagctggggagcgggggtgataggggagttgtttaatggatgcagagtctaggttttgcaagatgaaaaatttcaggagatctgttgcacaacagtgtgaatgattaagatgataaattttctgttttttttttttaaccaatcttcaaaaggatggtattactgttaactgaatgcttggtatgtgttatgcatgcattatcttgttaactattcacaactccatgagggtagatattgtcaccgtgtttataggtgagagaacttaaatggagtttactagctaggaagtggcagaccatgttgggcctagatgtgtccgtaaagccacttgaaaaatgtgttgccaccagcacacttaaaggcaggctcactctcgggctttttagctctagaatctgtgattctatgattctgagacacgccagggactttgcaaagacccatcaagtaggaacaaagtttaaatgtttatgtgttcagagaccacttctctactatttttagtgaatacaaactgccatattatatgtaatctgtggtacatcagcagcaccaaatgctggtttgtgagagggtgagatgttactgaaatgtgagaaaagttaaggtgtaaatagtaattacttcttttttttgttcgtttgtctgtttgttttccttgagacggagtttcactcttgttgcccaggctggagtgcaacggcacgatcttggctcaccaccacttctgcctcccgggttcaagcaattctcatgcctcagcctcccgagtagctgggattacaggcatgtgccaccacacctgggtaatttttgtattgtcagtagagacggggtttctccatgttggtcaggctggtctcgaactcccgacctcaggtgatccacccgccttggcctcccaaagtgctgggattacaggtgtgagccactgtaccctgctaatagtaattacttctatggaatggtttggtgaagactgagaagaacctcacctattcattatatttttcgactttttgagtttgtaataattagcttgtattacttatgttataggttgaatttgtgcccccaaattcatatgttgaagtactaacccccaatacctcagaatgtggccttacttggaaacagggaattgcagaagcgattagttaagatgaagtcatactggattaaggtggaccctaatcaacatgactcttgtctttataaagaggggaaatttagacgtagacatgcacacagggagaatgctatgtggagatgaagaaagagctcagctgatgcttctgcaaaccaaggaataccaaagactgccaggaagccccagaagtgtagggagaggcatttcctcacagccctcacaaggtatcagcccttaggacaccttgctgtcagaattctagtatcaagactgtgagacaaatttctgtggtttaagccactcaacttgtggtactttgtcacagcagctctagcaaactagtacaatttctaaaataaaaaggtttttattacatacaaaaaaatgttaaccatggttactgatagtttatccaaagcagtgttgaaattaagaaatgatctttatatgtgaagatgtttattgtaatattttttataatcagaaaaaatgagaatccaaatatctaggcattggtgaataaccaggtataacaaattatagcataactacttgatgaaatattgtatggtcattttgtatagcctttgaaatgtgaaaaatgcatataacataaataagctggatgaaaattttttatacaaaatgataacagttgtatgaaatatatatgcatcagactgaaattggaaggaaacacagaaaatgaaaaagctttgttaggattatggaatcataagtgggcttttttcttttaatcttttaatttgttgcttttattacatagaattgtggcaatgtattattgtgttatattattttttaaaaatcaactttattgaggaacattttacgtgcgatcaaatgcactcttaaagtgtataatttgatagttttgacacatgtatacctctttataaccaccgccacaatcaagaaacaaaacatgttcatcaccccagaaagttctctcttgcccttttatagtcagtccttctcccaactctggtctcagttagccactgatctgctttctgtcaccatagatgaactttttcttttctataatttcatataaacataataatatagtatatactctgtgtctggcatccttcattcggcataatgtttctgagatttatccatgttctagcttatatgtagctgattactttttattgttcagaatgttccaatggtatgttgtatccatataccagtttgtttatctgttcatttgttgatagcaatttggattgtttctagtttttggctatgagtaagttgctatgaacaatttttttttttttttttttttttttgagatggggccttgctctgctgctcaggctggacttaaacatctgggctcaagtaatgctctcacctcagcctcccaggtagctgggactatagacatgtgctcctaggcccagtttgaacattttttgtaaaagttttatatagtcatacattttcatttcccttggataaatgcctaggattggaattgctggattgtgtgatagtatgtgtttaatattataagaaactgccaaatggtttacattctcaccaccaacctatgagagttccagtagctgtacatgttcaccaacacctcacattatcagtctgtttttatcttagtcgtcctcatggatgtatagcagtctctcaaagtggttttggtatgaatttccctgatgatttgacactgatcatcttttcatgtgattctatcttcttttgtgaagtgtctattaaaatattttgcccattaaaaaatatttatcttcttcttaaggtgtgtaagactaccctttatattccagatactgttcctttgtcaaagatatgtattcagagaacatatccactcagttgtggcttgccttttcattttcttaattgtatactcaaaagtgcatatgttttaaatttttactttaaatttaaaaattttcctgatttgtcattttgttctgttataattcatgcatttttttctattataattcatgctttttatacctaaaaaatttttgcctatgtcaagtttatgaagattttctcctgtgttttcttccaaaagttttatgtgttactttttacatttagatatgtgatctattttaagttaacttttctagacagttatgaggtgggagtagagggtctagatttccatttgttctctgttttcttgttttagctcgttgaacataatttcagacagattttgtgtgtggctttttgtttttgtttttgtttttttcagatgctctgtcgccaggctggagtgcagtggcgcaatctcagctcccgggttcaagcgattcccctgcctcagccttccggagtagctgggactacaggtgcatgccaccatgcctggctaattttttgtattttttagtagaaacgggatttcaccatgttggccagggtggtctcgatctcttgacctcgtgatctgcccgcctcagcctcccaaagtgctgggattacaggaatgagccaccacgcccggcccagacagttttttaaaagtctttgtctagtaagttcaaacctgtatttcttttatttatttatttatttattattattttttattatgccttaagttctagggtacatgtgcacagcgtgcaggtttgttacatatgtatacatgtgccatgttggtgtgctgcacccattaactcgtcatttacattaggtatttctcctaatgctatccctcccctctccccctaccccatgacaggccccggtgtgtgatgttccccaccctgtgtccaagtgttctcattgttcaattcccacctatgagtgagaacatgcgatgtttggttttctgtccttgtggtagcttgctcagaatgatggtttccagcttcatccatgtccctacaaaggacatgaacacatccttttgtatggctgcatagtattccatgctgtatatgtgccacattttcttaatccagtctatcattgttggacatttgggttggttccaagtctttgctattgtgaatagtgctgcggtaaacatacgtgtgcatgtgtctttataacagcatgatttataatcctttgggtgtatacccagtaatgggatggctaggtcaaatggtatttctagttctagatccttgaggaattgccatactatcttccacaatggttgaacttgtttatactcccaccaacagtgtaaaagtgttcctatttctccacatcctctccagcacctgttgtttcctgactttttaatgattgccattctaactggtgtgagatggtatctcattgtggttttgatttgcatttctctgatgaccagtgatgacgagcattttttcctgtgtctgttggctgcataaatgtgttcttttgagaagtgtctattcatatcctttgcccactttttgatggggttgtttgatttttttcttgtaaatttgtttaagttctttgtagattctggatattagccctttgtcagatggctagattgcaaaaattttctcccattctgtaggttgcctgttcactctgatggtagtttcttttgcttgtgcacaagctctttagtttaattagatcccatttgtctattttggcttttgttgccattgcttttggtgttttagtcatgaagtccttgtccatgcctagatcctgaatggtacgcctaggttttcttctagggtttttatggttttaggtctaacatttaagcttttaatacatcttgaattaatttttgtataaggtgtaagggaggaatccagtttcagctttctacatatggctagccagttttcccagcaccatttattgaatagggaatcctttccccatttcttgtttttgtcaggtcaaacctgtatttctttagggttgtttctagaaatttatatcgttcctttgaaggggccatgtttccctgtgtctttgtgtgtcttgtgatattttgttgacaactggtgatttgaaaaaaaacagccaattctctcaatttttgcagactggctccatgtggggaaagaccttcagtagttagcccagtgtaaaggcctaaggtcttacacttttttggcatatacatcttccttggatttgtctgtctggttttttgtttttttccaattccgctgtatacatggctgctgttacatgtattaatttctctaagagccttactcctgctgcttcacagagactcagctgttctgctgtttttctctgcccataatctcttgcccacaggtgactgcagtttcctgcagttttcatgcactacagaacttgccactaccttctgcagccttcaacctgagatccaaagtgtcccagcattcccatccgaactctgagtcaggcaatgaagaaccagtcccttgggcagcccgcagacatacttttctctgtaatgagggagaaaactaggaattgggtctctttgtctctcccatgctatgccagggaaaggctagggcaagtgcaagcaagcacagcatgacatttcctatcgttttcagtgtggctttttcttgattgggtgtttgcttggttgctgcatatccttgacctgtttccacagcttccacaaaaccattttaatcagcatgtagttgtttgtttgatgtttccatggatgaacggagagggccatcctagtctgccatctagctaacatcaccctatcaaatgctgactatttttaaatgttttttctgcatctattgagatgatcatatagtttttcttctttatactattctagtatggagaatgcagtcactgatttttaatgttaaacctacttttcattactgggatggtccccatttagtcatgtaatgttatctttttaatatattgctgctatatgctaaaatgttaagggtttttatgtctatgttcatgagaaatattgatctgttgttttcttacagtgtctttgtttcgacatcagggtaattcactcttattattatttttttgagacagggtctccttctgttgcgcaggctggagtgcagtggccaatcatagctcactgcagccttgacctcctgggctcaagcagtcctcccacctcagcctactgtgtagctaggactacaggcatgtacctctgcagctggctaattttgaaattttttatggcaacgaggttttcctgtgttgcccaggctagtctcgaactcctagtctcaagcgattctcccaccttagcctcccaaagtgctaggataacaggcatgggccaccacactcggcctgcccttatttttcttccttaaatgtttaattgaagtcactagtgaaactttatggtcctcagattttctttgggggaagtttttaaattgcaggttccttatttttaaaataggtagtttctattcaggttctctgtttcttcttgagtcggttttaataatttttgtcatttaaagaattacctattccatctttgttgtcaagtttattgatataacatcctttaataatgcttttagtatctgtaggatatgtaatgatgtcttctcttttatttctgacattggaatttgtgtcttctcccttttttctcccccatgaactgagcaacggtttaacaaattaaatttttttaaatagccaggttttgggtttattgattttatctattgtttgtgatgtctttgatttttgctctttatgattttctttcttctacttactttatatttaatttgatctttcttaccctagctcttaagctggtgacaaatacttgctcagagaccttctttatttacaccatgagacttaaagctataaatttccctcagtcgctgctttatgtgcatccactgaattttgatacattgtgtttttatttaaatttagttaaaaaaaatttactaattttccttgtgatttctttttttgaccattggttatttagaaatgtgttttttgtttgttttttttttgagatggagtctcaccgtcacccaggctggagtgcagtggcacaatctggctcactgcaacctctgcctcctgggttcatgccattctcctgcctcagcctcccgagtagctgggaccacaggcgcccaccaccacacccggctaatgttttgtatttttggtagagatggtgtttcaccatgttacgcaggatggtctcgatctcctgacctcatgatccacccacctcggcctcccaaagtgctgggattacaggtgtgagcccccaggcccggcctagaaatgtgtttttaaattaacaaatatttgaggcttttccacatatctttctgttactgatgtataatttaattttgttgtgtctgattatatatttgtattatttcagtcttctcaaattcactgagaattgttttatggttctgaatttggtttgtttcagtaattgttccatgtaaacttcaaaataatgttgggtggaatattttctaaatgtcagttgggttaagatggttgataattatcgaagactgtggccggtctgagatttttttttccttcctttttggaaggtaacaagttagactgccactgtttcatgcatgctggctgaagacataggacttctgggtcagagacaaaggattttataatcacagcacagcaagccacaagagtttggtgtttgtatctgctcctctggtcccagaagacctatgggagagatgcagagagtcctagataaatactgtgcacatgtgggtttgtgtcacagctgaggaacctacagcttgtattgctcaaatcttttataataggctgcaaacaaacttcctttttcgtggaggaagacattattcttattgttggacagttagcaaacctgtcccatttcttctgaatgagaccctgtctcttttccaaaggggttggctgtacaaatatcattgaaaatatagtctggagcaaaagcagaaatgcagcagacccatggagaattgtctaccaataatagtgttgttcaggtccctatagtcttctgattttctgtctatttttatcaatctcctaagagatgatgttgaagcctccaattatgagttattaattgctattttcaattctgtcattttttgtttcatttatttctaagctctgtaactgtgtataaacacatttagaattgttacatcttcttgatgaattgacccttttatcattgtgaaatctttcttttttcctggtaatactttttgtttttaagtctgctttgtctgacattaaaacaacagtaacaacaataacagttttcttttgattactgtttgcatggtacatccttttacttttaacttacttgtgtctttaaagtgggtttttcataggtagcgtatagtttttggttttatctaatgtgacacctgctgctttttcatctaatatttaaaacatttctatgtaatataattattgatatggctggtttaaatctttaataatagttgctgttgttaagtaacaagccattccaaagttagtgaataaaataataatccttttaatgcctttttagattctgggttaggaactccactacacaatgtaattggcctccactgggaagacttgaatgctggcaggattcagcatctggggctggagtcacctccgtgcttactccctagttttcctgacgttagttgataccgactgtcagctggttcctcaaatgaggctgtcatctggaacccatggcctctacgtggggcttcttggcttcctaacagcataatggctgggtttcatgagagtgtccccaagagaaccaggcagaagctacatagccttttgtaacctatcctcagaaatcacagagttatactgtactctcttagcaggagcagtcatactaccccactcagattcaagggaagggatctgaaaccccacctttcggggggaggagtatcaaagatctttaacaccagacttcaaaactgccacatcaagcaccttgctatttgttttctatttttgtcatctgttctttgttctttcctcctctttcccatcctcctcactctctctccctatctccctctctccatctccctctcctcctctcctaccaccttcttccctcactttcttgtttctccttacctcttcagagaccgtataaactgctctctgctcccctaagagaggctcttgtttttaggaatttaattcttttacatttctttgcatcctcagatgcaaagtggtttacccattttatctagttattactgcagaagcagtgatctgtatccgaactgtaagagatatctttgtctttgaactggtaagtttacaccatttaattttttaaaattactgctagtttggaactcttttttataactaaatttattacttcaatttgacctatttttaatgtttcttttaaactttttatcatatatttttgtggtaaaatgcatataaaatttattatcttaaccatttttaagtatatagttcagtggtattaagtacattcatattgttatgcagctattactaccatccatcctcagaactcttttcatattgtgaaacagtacccattcaacagtaattctccatttcctctgccccggcaccaccattctacattctctctctgtgatttttgactactctaagtacctcatataagcggagtcatacgtttgtctttctgtgtctgacttactccactaagcataatgccatcaaggttcatccatgttctaacgtaagtcagaatttccttcctttttaggactgagtaaaattccattgcatgaagagactgcattttgcttatccattcgtctgtcagtggacacttgggttgcctctacagtttagttgtttgtggataatgctggtgggaacatgggtgtacaaatatctcttcaggatcctgctttcagttcttttaagtataaacccagaagtggaattgctggatcatctggtaattctatttttaattttttatatattattattatttttagagacaaggtcttgctgtgtttcccaggctagagtgcagtaatgtgatcatggctcactgtagtctcaaactcctgggctcaaccgatcttccaaccccagcctcttcagtagctgggactacaggcatgcaccatcatgctcagctaattttccaaatatgttttttgtagaaatagagtcttgctttgttccccaggctgttctcaactcatggctttaagcagtcctcctgcctcggcctcccacagtgctggggttaccagtgtgagccaccacacctggcccattttctgtttttttcatagtagctatcttaatgggtgtaacatagtatcacattgtaatagttttgagttgcatttttctaatgattaatggtgttgaacatcttttcatgtgcttgttagctatttgtatgtcatgtttggagaaatgcctgttcagtccatctgtttttcagttgtgttgtttggtttttattgttgagttttagttctttatacattccaggtattaatcccttatcctggtatatgatttgcaaatattttctcccattctgtgggttgcctatttactgtatctgtagtgtcttttgaaagttttaaatttcgactatttgatttgcctgtttttttcttttgttgtccgtgcctttggtgtcacatccaagaaatcattgccaaatctgttgtcataaagctttgccctatcttttcttctaagaattttatagttttaggtcttaaatgtaagccatggatgcattttgagttaatatttgtatatggggctaggtaagggtacacagttgcattattttccatatggatagtcagaatttcccaccatcatttgttgcaaaggctgtcttttccccattgaatgatcttggcacccttgttgaaaatcattcaaccagatatgcagggatttattattggactctgtattctattctactgatctgtatgtctgtctttctgcctggaccacactgttttttattactgtagctttttagtaagttttgaaatcaggaagtgtgagccttctagcttagttcttcttagggactgttttggctattctaactcttttgattgatggtttttactgtttcctttcatctctactttttgcttattaggcatatctttttatctcttactggctgctctagggcagcagtgtcctatagaaatataatgtgagccacaattgtgacccccatatttcccattagcaacattgaaaaactcaaaagaaagaaatgaaattaattataaaaatattttatttaacccagtataatgaaaatatcattgcaacatgtagtcgaaataaacagaatgagatactttgttctccttctcatactaaatctttgaaattcagtgtgtaacttgtagcttatctcagttcagacaagccacatttgaagctttcatttgcccatgtggtcagtggctactgtgttgggaagcacagctctaggatttataatattcatattttgcataatacatgactacaaatattacttgaaaatagagtgcataacatatgtgtatactattagaacctcatcacagtctacagccacatctcctctcccttctgtttatcgtggtggtacatttacttctaaacattttataaacccacagtatattattagttttaaacaaaattactgttttaagaacattgacaagtaaggaaaaaatcttttctgtttacccacagattctcccttttcagcactctccctttcttcctgcagatacacatttccatgtgatgtcactttccttcctcttgagtttctcttaccattgcttggagtgcatgtctgctgctgacaaattttctcagctttggtttctcggaaagaggccttatttcaccttcatttttgcatgatagatttctaattcgacaggtttttttctttgctatttggtactttaaagaggtaattccattcacctctgtcttgcatagtttctgagaaggctgttgtcatttttatctttgttcatctgtatctttttctacttaggctgcttttaagaattttttctttatcatagattttcagaagattgattatgatgtatcatggtatggttttctttgtgttcatcctagctggagtctttcgagattcctctatttgtgcatttatagttttcatcagatttggaaaaaatttagttatcattcctttaagtgcttattctgtcctgtaccccctttcctaggacttgaattctatcagtgttaacctacgtgagattttcccaaagatcattgaggttcttgtcataattttccccatctgttttctctctctgcttccttttggatagttttattgctatgtctttaagtttctaaagatttttcttttaaaaaaaggtttaaagaaagaatgactttaaatctttaagtctttctcctgaagtatttagtctgcttaattttgctttgtgtattttttatttcatatattgtattctatatctgtagaagttgtgactggttctggttttttttttttttcttaccattcatttctctcctgattatgtttttctttaaatacctataatacgtgtaattgtttaaggtctttactacttccatcatctctgccatttccagcctgcttccttaagctgcttttctttttggttatgggtcatattttactgcttctgagcatacctagtaactttttattagatgccaggtattatgaacattgcattgatgaatgtgttgattatgttgtcttcttttagagagagtgttgttttatcccggcagacatttatgttttgtagattaggtctatcctttccaagcttgtttgtaaacgttgttggggcaggtctatagtggcctttctccagggctaattttatctgccctttcatatgcacagataattaattttaccaaggccaagtagcatgttaaggtcaagtagcataacaaggtcaagtagtaccctacatatgcacagattattattcagccaaaaactcagagcccccatgttgatttctggagccttttctctatctagtttcctcttggctctcaaattgtagctatctttgccttatcagactccagtgttggtctccttaactcagtgaaacttctgtgctctgctcacgatggctctccagccctgattcagaaagtgcacccaggcagaaagccaggccaatcatagggattccctcattggtttttctgctttcaggatcacagtctggtgctgcctgttgtcaagtgtctgaagatattttgttcagttttctagttttctgtagcaggaggatacatataatagcttgctagggttagaagtcctgaagacaactggagtgctttaaaatcctttgaaaaaattggtaagccttcaagaaatttttaagtagtgttagaggttagtatatatattaatatgctacttgaccttggtaaaattaacatttttcaggttacaaagatctattgtaacctgtcctattagtatatagatagagtttatggaatatatatgacatgttttcagagtctccattctgtaataattgccatttgttaagattgttaagttgaaacaaattgttgggcatctagatcagatttaaaaggagttaaaccaaattgagactgaattttggaatggctatgccaagtactctgcaacacagctaattgcctgggttcaaatcctggtgtgtcacttactacttattaccctgggcaagtcatataacttttcgaaattacagttttctatctgtagtgacaaaataactttaccacctcgtaggattgttggattaagtgattatatatagtgtgtatgtgtatgtgtgtgtgtaaagcttttagaacaatgcctgatgttatgtgctcaaaaaatgttaattattgtcattgtgattgtcattgttagggaactgagtttctgattaaggtttattaagcctgaattttttttttaccattttaattgagacttctcttgcttttttaaccaagtatatcattttataatttaaaaaataataaataacacatatctatcatccagtgttaggaatagaatgttactgatatgttcaatatcatccacataactgtccctgctcacatatcctattctctcttcctatcttgaattttctatttattgtcaccttgctttcttaaaaatagttttgctatgtattgatttagtcataaataatatatattaatttttcctgtttctaaaattttatatagatataatgacatgtattcttctgccacctgcttgtttgcttgatggtgtatttttttgagatttgttcatgttggtgcatgtagtcgtgtgcattcatttgtaccagggtagagtgtgtttatttccaggttttgctgttacaaacagtagagctctgaatatttctgtgcatatttcctggtatacatgtgcaagagtttctctgggtatatgtctggatgcagacatttcaggttacaatctttagcaggctgctcgctggagcaggccagagtggaagtaggttattgcagtaggccaggcaaggggttatgagggcttgaaccagagtgattaccttggaatggagggaagcagatgaattggagattttgtctggaaatataatcaatagatattgatggtgtattttataaagggggccggatgagaaagaacatcaaggagactcccaggattttacatcaagttgccatttactgaaatgagaactgctcccaacagatagacatattttattttgttttaattcatacatgggcttttaaaaagaataaactttattttttaaagcagttttaggtttgcagcaaaattgagtggaaggtacaggtatttcccatatctacccattcctacacatgcacagcctcccctgttatcaacagtcccctccagagggatgcattggtcacaactgatgaacctgtcctgacacatcgttatcattcagagtctgtagttgacattagggctcactctgggtagtgtacattctatgggtttgggcaaatgtgcaatgacacatatccaccattacagtatcatacagcgtagtttcactgccctagaaattattcgtgctctccctgttcattcccctcttctccctaatccctagcagccagtgatctttttactgtatccacattttttccttccccagaatgtcctgtagttggaatcatagattatctagccatttcagattggcttctttcatttagtaatatcatttagtagctcatttttaaagtgcaaaataacattccattgtctggatatattacagcttatccattcacctaccgaaggtcatcttggttgctttcaagttttggaattatgagtaaaacatctgtgtttactaaaacacagatgctaaaaacatctgtgtgcaggtgtttgtggggacacaagttttcaactcttttgggtaaatatcaaggagtatgataggtggagaatatggtaagggtatgcttagttttataagaaactgccaaaatgtcttccaaagtggctgcaccatttttcatccccatcagcagcggatgagagttcctgttgttatacatccttatcagcatttggtgttagcagggttctggatttgggccattttaataggtgtatagtggtatctcgttgttttaatttgcatttccctgaggacatataatgtgcagcatctttttgtatgctatttttcatttgtatatcttctttgacgaggtgtccattacagtctttggtgcattttttaatcaagtagttttcttctagttaagttttaacagttctttatatgaatatgtctttttaaaatattttctcctactctgtggcttttcttttaattctcttgatagtatcctttgcaatggcatagtaggagataatatgggtgacttttctgttaaaaggtttatggaggccgggcgcagtggctcatgcctgtaatcccagcactttgggagaccgaggtaggcggatcacctgaggtcaggagttcaagaccagcctgaccaacatggagaaaccccatctctactaaaaatacaaaattagccaggtgtggtggtgcatgcctgtgatcccagctactcaggagactgaggcaggagaatcgcttgaactcgggaggcagtggttgccgtgagccgagattgcaccattgcactccagcctgggcaactagagaaaaactccatcacaaaaaaaaaaaaaaaaaaaaaaaaaaaaaaaaaggcttctggattagcagaaggcatttacagagtttaatactttcctgtcccttacctcttacctgcaaagtttattagaagatggatttttaacatctaggctgaaatactacagttagagccatttgtgtcacactcctgaatgtagtctagtctgtattattaaaattttaaaataaacaccgaaaagacagacacacacgtacacacacactcacccttcattcctcttccttaggatgaagtaaaatttgttaagttatattaagcctctaaacaaactgctttatggctccagcagctttgtgttgtttcttatctttgtaacattttgccacaggtacagtatataatgaaataggtgggggtggctagtggagaggttgtaacactgtcaatgagaaggcacccgggatttgtccgtctgacctgctcagtcagagtagtggagccacccggagttctagggagcatcagtctaggagggagatgggcaatgttgcatctcctggaggccagcacagttcaaagttggttttctgagtctcggtcttgtggttttaggattttatggcttttggtgggtatgtttgggaaggaagagccttcattccttgcttaacctgtgcaaataatcttcaaggactttgatcactgggcagagggataggagactgccatctgtcctccagatgaaagggttcttcttggcaggagcactacagagatggaagttgtgattttttggttgttttgactttatgcttctagaaaggatcttttaaaaaattcttatagctcttttgttttcttttcttctttatggtttctttcctttttagtgatagaagctgtggccagctcttcatgtgagttcacccacttgcccctcccaaggcaggcaccctgatatagaccagtttaggtggaggtttagggtcttccttgctcacctttgagccaggctgggctgccaatttctggctgagctgacttgacctttaaaaaaaacaaacttgatattatcttggctcctacagagaagacatgcagtgtggggctgggggctgggggtggagcagggtttggttgtactcccattcattagttcacctctttttctgagttcctatgctgggtatcctgactgacccttatacactgtacctgggataatgctcctggaaaagcatgtctttgcaaccccattactgtcatcatgaacaaaattagaatggaaagcaaatttttgttacaaaaaaaagtttaggggtaaacagacctgcagatttttacaactgctatgtttcttggtattcttctgtgtgtttaatcactggacagatgtaagggtgaattttattgttcccttggtgcatgtttaacctgtatcttagctatctgttaaggggtttaacttgggctgtatatcttctttaagagcttgaaagggaatttagagtggcatatctattttcattgcagcgttagatgtacggtaagttaagccatttttgtgaaaattgaaagcgtaatgttaaaagtgtccagttttttagccatttgtgcacattaaaaataacttgctatttatgttcagtggtttccttgttagacgatgtaggggacttgccacaacacatgcaacagattataaaaagactgcaaatttaataattacaacatggcacagaccgcgctggcagataccgagatccagcacactctttaatcatcatgcttcccatagtgtgggtggtcatggtccgcagacatttcaggcaggccagtcccgttgcaagagcacaagtaaacagcattccacaggcttttcaggatttttaatttgaaaaagtatagcatttcttttaggttgcttttcctttctccttcctccttctcccgcctcctcctctaaattttcgttgtttagaatgtttgctttttcagcaaaacctttttacatatgatgcttttgtgtatttctttttccagcttttatttggggcaacaaaataaaacatttcttaatactcctgaagcctgtttcagcacaaaagctgaaaatgaccggtaggatattttgctctttggagaagttagcaacttttcattataagtcctggtaaattgaatttaatcaatttatttccttactatttttttaaaatttaacttttaccgcttgtttcctttgatgtttgtttgattaaatgaaaatttgagtcatctgcaaagtttttcttcctcattcaaaaatgttgttcttgctagcctgttttgttcttctactttccatttttttgaagcttttatgatcttagtctttaatgttaatgaatattgataaaagaagcaagtcactagtttttgttgattaatgagaattatggagtttagtaaagctcttggttagtttctctcgggaggagttattttaagtaataaatgtgtacaaatggaaatgtatcattccgaagctttaacattttctctgaaagtgttttttttttttaaagaaaaacttggaaaaacacagatattttaataaagaacagttaatattacagatgcgcacctttctcttctttccttccctagggatttccttaagggatgctgtcttgttgctttaaattatagacactgttcctagtcttcatatatataattaaagacagttgtcaagttttttaaaatataaaatatgacatcttagctgctattttatataggcacacataattgagtaaaagaactatgtaaaaaaatactttaaatgtatatatcataagatacagtccttactaaagtcatagtatactatacctttttttacataagctgattaaaaatgaattgctaacaattagaatttataatgacattgtcaaaaccagcttaaagagaaagtggtgtgattatacattttagaaggaataacttccttttacaatcatacctgtatagaatgcagtgctatacataatttttggagttttgttattgttcatgaaagcattttaaaaatgctttagtcattttcatttgtgataaagctaatctaattctctattctgatgcttcttgccaagctttagatcataacagcttaatttaagacaaaaattgctggctaatcccctttggtattttgaagctattttgggctccctttgttctatggtacgttccattctgtttatggggagccatcgggtgtttgatgtgggaccctgtggcagaggagattggaactccagagtctgggtgcaactgggacaagttaaggatgctgaatttaacttgctcttggatttgtgtttcttctatataaattgaaggattacatttaattttagatggagtaggggtaaggcagattgggtttgattttcgaagtcaacatttggagtttggtaaccatatcaaaagcgaggattttgacagatttaattttcatattactggttaacatatacttatgactaagtgtttagtctcccctttcctgagcttcctgatgggtgtcagatttgcattaagacaccaaggccaacccgcctacacacaaaaattgtgttttgaaagttcttaatccctcatttcagactcatgttgtggttcccaccaagtgggctgcctgagacccagtggaagtttagcagatttctattcacaggcatgctctcagaacatctcccagttaccaatgcctaattaatgtccttgtgatggatatccatgggtctatatagatgaagcttcttgaactccattcataaaacagatatatagccatataatagacatgagtaatggacgcctagaagactaaatgttctatgtattgttttttgtggttccttcagtgaaattaaaggatcaatgttttacgtaagtttaaactactattgttgaaattattttactttcctggccttttgtctataaagaacacattagcatatactaaccgtgtcttattattggacacagtgcttctttgctcctggggatatttacagttatcccctccactctgtcctaagtgtaagtatacattgttgtgtttttgtgttatagattaacagctctgaaaatgtggtccaaggactctggggtcttcaagactatttcaggaggcctacaaggtcctcccttttccagctatgtaattttattatgctggattttctttataaattgaactaaagcaacatatcacaacagattgaatgccgcaacagataggagaacacagctgtcttctattgagacaaacattaaagagatttgcaaaaaaatgtaaaacagtgccactcaaaattttttgttttgttttggaaaacatattttttcataaataatatttttgttaacatgtaaagggttattatctcatattaattactagataaatattttaaatttttctgaggcttgattacaagtacagtaaatagtgataggtaaaaccaaaataaaaagtgctttgggatcccaagaccagaaaacttaagaactgctaatatatacaattgggattattgctgtggttctaaaatcaaacttccattggcttctctgagagttttagccaagtgagcatataaaatgtagtgaaattagcctgcggttacgaggttttaatgaactgtctccttcacattttcaggtgtttttttttttttttttttttgagacagggtcttgttctgtcacccagccacgaggctgaagtgccctccagctctgggctcaagcgatccttccacctcagccttccaagtagctggaaccacaggcacatgccaccatgcccagctatatttttgtatttttttgtaaagatggggtcttgctatgttgcccaggctggtcttgaactcctgagctcaagtgatctgcccacttcagcctcccaaagttctgggattacaaagtggcatgagccactgtgcctggcctcatgtgtctttttataaataaattatcaagcaaagctgccactgtcctcttgtaaatttaataaggagtcataggttttagagttatgatcccttttacttatttagctgatatttctttgcagtttgacataatctggacccatctgaattgtaatatgtgacttttaacaaacattgtagattaccatctttcatatgtgatctcatgccattcatggaatctatggcaatttcagtaaggatagaactcatcattcttgtgtatacttgggatgtttctaaccacatttgcctcagttacctaatattttttgcttttcaattgatttctagtttggggatgaagaagaaaaagaatgtaactggcaaaatagccattattttttgcctttattcttatttcacactttctatttttagtttatcttgctttgtaaccaatcctttagaatgtaattacttcttaattggaaggggctaactgccccacagaagaaacttctgtaattagaaaaagagtcccataacatctgatctggttctttcgccctgagcatatttgttggcaatttatggcaaggttgactcactggtgggaagctgcctcactcctaacctgtgctagaaaagctgcctcgttctagaggcagccctgcccctgttaagcccagttctgctgcctcactcctaacctgtgctagaaaagctggctctttctagaggcagtcctgccccctgttaagcccagttctgctgcctcactcctaacctgtgctagaaaagctggctctttctagaggcagccctgccccgttaagcccagttccctctgccctggcatctccacctctactggggcagtttccccagttctcttcccagccagcagcacccctggagccttccttttagtctccggtcacatgagtgaagaggaaattttcctccttctccgagcttaatacagcagttttatatatttaacattgtaggtgatttgcatggcaatgagcttattaggctgttttttgagtgctgccaaacacctaattgattttttcagttttcttccaagattatagttgtcaagaaccatctgccttatatattacattaaatgggttaaagctgcaaatgcttctttaagcaaaatataagtgtgtatcttatagaaagtaatgcaatatcaccagtctgaggtttggagtgtattaaggtacttggtttctggaaatctttttaagcttggaaacctttaaacctgcgacttaaaaaaggatctacagctatctaagtaggtggccttctgtgtcttggctagttttagagtgtggtgtttgtttcttacgcaaaaaggaacaaatttaaatcactaggtactcaaccaacagatttcagtgtggattagttaagaaataattgtagttcttgtgtggtggcacaaatttttttccctacattttgtttatgcagactgtctttttttccttcatccttttctttttttcactgaaaaaggaaatcgcaattttgttagtggattgctttgaagaaaatacggagggaaagagagaaccagacttgacttgtgattacttttcatgagtgtggataagtgtgggcttcaagacttgccaggccttcaattctttggcttgctttttttcttaacatttccaaaggttttgttagtgactttcaaatggaacttcacgccttggaacagttccattaaaaagttgtgtggtgttagccacagtagcagcatggtttatttttcctgtactagtttcacagaggttaactgagctggaaatgatgagagactagcagtgcaagcgggtgggtgtgtgctatgtgtatgctttttccctcttgatttgtgcaaaaaaaaaaattttttttattggcattaacgtgtacttcaaatgttgtttaaaaaggaagcaagtcaaattatcctaaaatgctttatactacattgttgaaaactttcaaaaatgttctcttttgttaattgtatttttacattgcatagtaccagcccacatttataaaaggcaattcattatagagatttgctttcttgatgggaaatgtactacagtttacagctcagcataatcttagttgacgtgttctggagagtgctttttatctgtctgaatttaaaagaacacttgactatgttcatgattgagacggttttattcctggttcaaataaatatcttgaagttaaaatatgcgccttttattccttaggtgagtatattttttaagaaaacatggtctgttatttatatgtcatccgcttgttatatgcataagttacttgaagaatagtgaatttctaatgaaaataacaattacattaatactttagattttaatgctgttttgtaaattttgaagcaaattcatatatctcatttaattctcacaacaacctcatgataccccagggcagatataattatctccatgttatagatgagatgagaaatgtaaggcatttgcctgaaattccccatttggtaaatgaaggagctggatcaagtcctcacatccctgactctgctcttcgtcttgccactctcccgtaaacagctgcttagacctccttgatagtttacaccatggcttgtggatggacaactgccataaaattgtttataacacacacttattgactgcttacaaagtttcgcacattttgaaatgagacttaccccaattaattccctcaccaactctctgagttaggaactattattatatccctattttgtggttgagaaaactcaggttcattagataggtgagttgagcttcctagggtaatgtagccagtaagtggtgggtactaatgtgaaccccagcagctttgctctgagatccagggtccctgactgctaccgtgcatgaactcccagtggttcatgtgccggattttcaaacgccaggtattcactggtatttgtaatagcatctgtttgcattcatctgtaatcttgaagatctgaccatgaaaacttagaaatgagaggtttatcctctgaatttacaccgaaataaaagaaaaattttaaatataaaatacatattattatcagtagctatactgcatggagcagatagctactaacttgtataaatcatcctaaaaataagataagtgtttattaagaaacaaagaaggttcatataagctggggaaattttttttatctaataaatgtcctctctgttgtatagagggttcttaaaatgtaaaacttttggggagaaatgaagtatgaaaggtttcacctaaacagcagagccattgtaccaaggcgaatgtatatacctttcagaactctggaagtcactactgtaaacactcatccttggactggaaaccaggagcctctggtggtagttttttctctgttcccccacccctccattcaacaaatggaatgcctgtgtgcgctgggcactgtctgtgctgtgctgggcacacagtggtgctcagatggttcaggaggcaaacagccatcagtcagtacttccttagaccgagagaccacgccctgggagaagggtggctagttaggtcatggcaaacggacatgaggtggtcttgctggagctgacaccggaagagcaattcgggctttagtaggtgaggagagggaaggggatgtaggaggtgagcagaacgcactgggaggaggcatggtgagtaggaggggcccaaggaggcagagagggctgtgggtgcagggtggggctgcagggtggggctgcagagtcaatcctgggaaggcttctctatatctaagcagcagcaggaggaaaggattttaagtactaggggtgaggtggggggcttcgaaaactggccagagtgcagtctgtggaacagattgttttaaggatttgatacatggcaaggtctaaacccattcagatccaacaccggtttttaataacagatgttttataatacctggttggagatcctgaaatgaaattcaaaatactctttcaaaaaaaattcatatattgcctttactacaatataaagaaaactaggtcaggcacagtagctcacacctgtaatctcagtactgcaagaggatcacttgagcccaggagttcctggccagcctgggcaacatagcgacaccctggctctacaaaaaaagtttaaaagttagccaggtatgctggcgcacacctgttgtcctagctacttgggaggctgaggcgggaggatcacctgagcccaggaggtggaggctgtaataagctgtaatggcgccactgcactccagtctggacctgtttctagtaagactctgtctcccctcccccacacacacaaaaaaaattttaataagataatgtacatttccagtgtaaatacttgggtcttatgagactgggagacatcatgaacggatgcatgcatctacacatgggctctctgagaatgtgaccactgcaaattcaggctgttagaggagggcctcatgtggccttgccttccaggaggtgattttccaaaacgatagacaactcttgataatgctatgatgaaactgctgtaaaatcttccctgaccaacagggtaattacattttcagagaagtcagaggatgccagaacatgcaaaacatattttgtatttctatgtaaaacagctttaggctctaaaagaaggttccacatacatgatgatacagtggaacgtctgaaaattgtgtgtgacagtttgctattatatggtatatttctagttttccttaaccactaaatgccagtaaagccacaaaaatgttttaatagcagattagtggattttgaattggccccatcaagagtcactgttgtgttctatagccctttcccacctaagtcccaagctaaagacagtgaattgtggtagcatttcagaaattccatctccactagctgctgggtcatgacgtgtgtctcactcctgcgagtgctggcttaggggcctttaacacctctgagccaagactctggcatggagccctttgcccatcctaggagtcttgagtctcaacccgtgattatattcttgattgtagaccttctcccctgatgagatcaaccctttctctagggactcctggaatttggccactgatgcctacttgactactatttttgggtcctgtggggacctctgctgtgttgttccacccactcagaagggctttttggatggcttcatcagttcagaacatgtccaggcttgagactttgtttcttggccttctgcctggtaactcctttatgtcaactcagggcttggcatcttggctgcagcagcagtagaaggtcctcttgggcccagcaccactggccttcctcaggagtcagctctgcaatttaactaacaagccacgattcctgcagactgtgagggccatgtgcaagataagcatgatgacagggctagatgcacagtacctggcagagaaagctttcagtacgtctcaactataactaccatacagttcctttattatattggggtttgtttgtttgtgacggggtctgattctttcacccaggctggagtgcagtggcacaatcatggctcattgtagccttgacctcccagacccaagcagtcctccaacctcagcttctcaagtagttgggactacagatgcgtgccaccatacccggctaatttaaaaagtttttttgtaaagacagggtctccctttgttacccaggctggtctggaacttctgggctcaaacagtcctcctacctcggcctctcaaggtgctgggattacaggtgtgagccactgcacttggctatagttggcttttttaacttgaggaccttgggccctggtgttcatggatgggcttcaaagggtcagaaaactccatgaaattgtgtggaaatattgtaggcatatatagttttcctggaagagggttcacaactttcatcaggtactcaggataggtcatgagggacttctgtttttagcaattgcaaactcagaaatcaagtgacacctcctcctaaggatgagaaaactcagactaaatatgaaaaatatgcttcaaagcttgaaaaagctcatgatatagtaaatatgttctcagtcagagtccagggaaaggtagaggccacaggaggtgagcctatggtttaggactaggggtgtctgccagttacaaaggagacgattaagcagcaaggtgcttttggagcatcacaggactaggagggcagaaattagagtccgtggtctgccaactgagcacatcctggtgaaccttttacttgaggttgggatcttgaagggaagcacctgaagagtaaatgtgaaccgaagcagacaggccctcagagagtgtgcagtttaccctcagatcatctcagtcactgaccctggattagggtaatcctggattgctagtgattcaggtgtgacagaagcctctttggaggacgacaatattatcttggtatctcaaattatttctgccagcagttttgcaagtgtagtgtcgtgtctggtgtagataaaaataactaggtatacaaagagccaggataacaaaattgaatcagtagaaatagcagacaataaaacagacacataggggctccagatattagcgttaagactcagactttaaaatattataaatcaatcagtgtaatccaccatattaaagaagaaaaagcatgtgattatatcaattgatgcaggaaaaatgcatttaataagatccaatacctattcatgatttaaaaaaaaaatctcccaataaattaatagtggggaattacctcaacttcataaagggcacctcccaaacacgtagagtgaatatcatatttaatagtgaaagattgaatacttccccccaagaccagaaacaaggcaaggagattcgttcttataacactggaagttcaagacactgttatcagtcaagaaaaagaaataaaaggcctgcatattgtaaaggaagaaaaaccattgctatttgcaaatgatataatcgtttacatagaatatcttaaagaatctaccaaaaaccaaaataaatcaattgttagaattgataaatcaggtcagcagagctgcaggatacaagatcaacacacaacagtcaactccatctccgtatactatcaatgaacatttgaaaaccaaaactaaaaacacaatatattttagagtcactccaaagaaaataaaatacttaggtatatacataacaaaatgggatctgtttaatgaaagttacaaagtgctgatgaaataaatgcttaaagactgaaataaatggagagatatttagtgatgatgcattgaagactcaacttagtaaagatgtcagttcttctcaaattgatctataactttaaagcatttcctatcaaaattctagcaaggctttttatattcataggcagacttattctagaatttatagggaaaagcacaagccctagaatagctataacaattttgacaagaaaacggggagaaatcactgtatttaatactaagtctttactgtgatagctgcaataattagatcctgtgatattgacagaggcgtggacacatagatgaatggaacagaacagagaacctggaaatagacccacacaaataagttcaactggtttttgacaaaggtacagaagcaattcaatggagaaatttcaacaaatggtgcttttgcagttggacatcaacctaaacctcacaacttatacaaaaattaactcaaatggatcagggatttaaatgtaaaatgtaaaactataaaacttttcaaaaaaaaaaaaaaggctctggaactaggcatagttggtttttttttttttttttttttttttgagacggagtctcactctgttgccaggctggagtgcagtggcgccatcttggctcactgcaacctctgcctcccgggttcaagtgattctcttgcctcagcctcccaagtagctgggactgcaggcacgtgccaccacgccaagctaatttttgtatttttagtagagacggggtttcaccatgttggccaggctggtctccatctcctgacctcgtgatctgtctgcctcagcctcccaaagtgctgggattacaggcgtgagccaccaagcctggccaaactaggcatagtttctatacttgctaccccaagcataatatgtaaaaagaaaaatcaactgtgttaggacctcatcaaaactaaaaccttgtgttctgtgaaagcccacgtgaaggacaatggcagactgggaggagatatttgcaagccacaaataacaaaggactagtatctagataatcaagaaatctcaaaactcaatggtaaaaaacaacccagttagaaaatgggcaaacactatttcacgaaaaggtgaaataagttcatgagcaaaaaaaaaatggcaaataaacacatgacaagatatttcacatcattagccattggggaagtgaaaaaataaaaccacagtgggctatcactacgcacctatcaaatggctaaaataaaagccagcgagaacttaaaatgctggtgaagatgtggaggaactgcgttactcatgcatttttggtaggaacatggctgtggatagttttgtacccaaggcaaatgctctcctgcatcttcttagtgccagccttgacaggctgcttgttgacttcttacagaagtaatggaagccaggagacagtgtaatgatatcttcaaattcatgggggtggaggaatccattaaaaatgagacattttaggtaaacgaaaagtaggagaatttgtcaccagcagagctccacaaagggagtactaagactgttcttcaagcagaaggaaaatgaccaaagtaatcctccatctccaaaaatatacgaaatttaattaatctagtttccatgctctgcctggcccagtgagttttggccctggctgcacatcagaattaccaatggaatttaaaaaaaaacacaaccctctatatccttcttcagttggtttggtgtatggctcagggtcactaatggtactggtgtgcagccttggaagtaacagggtggactcagaaggagagaagaaagtggtgtcatggcttaaatggaacacactgtcctcctggttcctgggcctcacctttatgcctggtatgtcttcctgtggcagcattcgttctggctaggctgaaatgaccctccgtagctctgagttctccctcttttgctccagtgagcaccaaatcccgtctatcacacctgtgtggtatttcacacttttatccttttctcttcattgccattgccgcccttgcaatttgggcaccctttacattttgactgtgatagctggtcagtggcaaaaaccgcagttacttttgcaccaacctgtagtatctcagtttccaatgtcatcttcctctttcagtttgtcttgcacagtcttaccaacccaatttttgtaaagcataactcatgctactgccccatttagagacatttttagtgctcccctccccaatgttcacaaaataatctcaaatttaatacttttgaaaacaaaatcaagttgtttacctattgaataccctttgatcacacccacggctcctgttaccacagcatacaggatgcgacatgattggaggtctgtttcgtctccaccctcatctcatagcactccttcttctgctcgccatggcctagctagagtctgggtttttccttgcctttgggctgaacttgccgattactccacaagctgtttgcatgctcttttcttacctttcaggtcttgatcccatgcttagtctttggagtagcgcccccttgcttatctaaagtgaatcgtatccatttctaatctaatcagcatgctcttcatttcttttattgttggtcatcttcatcttgttgacttctatatgtgttcgttgcctcttcccttttccctcactggaatgtaaaccccttgaaggcagccacctcaactcttgttggctgctacatctccaaagccaggtacataggaggtgctcaataaatatcccctaatctattttgaatatagatacactatagtaaagattttataacaaaggaactttctgacaagagaatcttgtttgttcagtgatttggacaatgtagtactatgtagttggttattgaaattctgcctgttcccattcttacatgtaacctttggatgaatgaagggcaggaaatgtggtaggaaatgaaaccgtataggaaaaagctgatgtctaggttggacaaagaagctggaaatagaattctgtcatttctgcaagatccaagagtctctactttgactatacctttatgtctctgaaatttctgtaatctttttctgttgcttcaataatagtaattttaaaaatttgatagtcaaattccaggtactgtttttaaagggacatttctagagacgttatatttaataacatatttgaatggtgttctatagtttgttcattcgtaattgcgttgaacagctccctgtgaaaaatgttatatcctcactttgaaaatgagaaaagtgaggccctaaatgttaagaaacatttaaaaagctagttaagttgggaaactgggactgaggtctttgaatgtctaatccagtttctgtgtcactactgggtttcccatccctggggcgtcaagtttcaactgaaagtacctgtggcaggaactggagatgtaacagacttgcttgtctctcaaatctgggaacaagtgaaggtgactaccaccaggtcaccttcacatagcaacacgatgtctacctggtgatgtccttggtcgttgtccctgctcctcctgtcgttggtcccagcagatgtagttgtccagcttgacatggctgaagcaccgtgggaatcgattttagatatcacatccaaggtgttcctcccattgttccctgcatcttcattcttaaaaaggaaataagtctcatcaaaagtattactgcattcagaacaactcacatttcttactcataaaaattgttttggccttaagagagatatgtcctaacattccctcctcttgctgccttatggaaaatggatctcgggggaggaagcaagaataaaatgagaaaaacgagactggaggctgtgacagcatgcaggtgagagatcatggtggctgggatcacggtgaaagcagtgccctggagagaagcagacctatccagagtgtagttgagctgtaattggcaggacttgcagatgggctgcgtatggaggatgagggagaggatttgaaggatgagtcgaaggtaacatctaaaatgttgactggagcaaccatgtggttggtagaatcatgttcttgggtggcaaagatgaaaaaggggcttggggatggctgggctaagaatcttagttgtgttaaatttgagataccaattgcacagttgcagatgtcaggcaagctagttgcatatatgatctggagcataggagagatggcagggctggaactagaattttggaaggtgtggtcaccctatagaagtaggatgctggccaggtgtggtagcccatgcctgtaattccagcactttgggaggcaagaggattgcttgagctgaggaagtcttggctgcagtgaaccaagatcacaccactgcactccatcctgggaaacagtgagaccctgtctcaaaaaaaaaaaaaaaaaaaaaaaaggaagtaggatggtgactggggctgggctgggctgggctgggctgggccttgtgaggtttgaaccccaccctgggccataggagggagcactcaggctttcttagtcttctgttgacctgcccagatgcaaggccgaaggggaagttggcctggagttcagtcttttatgacagaagaccccagcatagaaatggcatccacaatcatgggactgtacaaaatctcatggacttgaaagccactgtcctgacacctcaagactggagtccagcccttcatgacagaagacctcagcatagaaatggcatccaaaatcccgggactatacaaaatctcttggggtgcaacctttgtgacagaagaccccagcacagaaatggcatccaaaaccacgggactatacaaaatttcctggagtccagcccttcatgacagaagacctcagcatagaaatggcatctaaaatcatgggactgtacaaaatctcctggggatcacttgagctcccaggtctccagtgtctaaaaatggggttgaagagaaagtaccagctaagttagactagatgaaaagaaaaatgtgtagcatgcggtgtaccagcagcagaaaccagggccaccctgctgacctgctctggtctcacccacacagtgccagggcgggcagtgtgtgtgcatcctggagatgtacaggtgcagccctgggggagaggcagcccagggcaccgctgagtgggcaagcaagagggtgcaggggtggatcccacggtttgtagcatggagttctgactggtgaactggtagggatagaagccagattagagaagcctgaagaatgaatgtgagttgcagaagcaaagaaggcaagtttagacagctttctcaggaaattgtgctaaatgcagaacacagagatgaggagtaattagaaggagggagaggtaggatcaaggataacttttttctttttaatctaggtagctcttctagcatgtttgtaattgacatgagaaatccagcaatgacgcgggtcactgctgcggagggtcctggcgaggtaggagtggaggtgatcagggcccaagtggacagctgcactttataggagcagagacactccttccatctgaacaggagggaagacaggacatggggggtgtgcgtgtgcaggtgagcttgtaaattggttaaattggttggtggtgagatgagtgagtttcttgctaattgctattttctcaactacatatgagatgagctcctcaccaggacttttggggaaggggtggtggtgtgatgagagaggaagcaggaaataattactcaggaagtggccaagcaaaatgaccaaggatgcataagaagattgtgaggcactgctgagccccttcccttcaagggttgtggtcagaaatccaagccaacgctgtcagctcagttgtctgatattctccagcagtgttcagctgtgtgggcaccaggaagaaaagctgcagcatggattcacaagggccaaggttttacacagcaagtaccactggactttagaaaagggggcaagccagggagatgagggtgttttcaaagggatgattatttaagcctggcagaatatttatcaaatgcatgatctgctcctagtgaatgtatttagtaaagcacacatttccaggtctgtgtatctacatatttctgtatacattcttatagatacggtttaatgccatggtttcattcaggcttattttctaaagccttttggttttggtttttgggaagcctactctatttccccccccggaactaatgagcgagcaagcaagaggttctgtaagcaaaagtaaaagctgcagactttgttatggttggacctgtgtgtggaaattctgtgaattgtgttctgtcagcatcctgctcacggaataggctatgtaaacaacgggcgctgggagggtctgtgaatgagcagccttccttcccactcacagacttaaccactgcaattctccaggtttctgagtgtttatttcatagtaaaaagggctctaaaaataccagggcagttaggtttttattgtagatcatttcacttaaactgcaatgggacatataaattttaaaaagggaaaaaaaaaacattgaaggcaggattttgaagcaaaagctacagaaatgtgtctgcagtaatttgttttggctgtggatgtaaaactgcaaaagggatgggaataaatttgttccatttttttaagttagagcaattggcgtatttaattgatattcacagtatttgaatagcatcccagaatgcacaaataatatgctatcatgagaaaattacatatactgagatgtaaatgaaaggaaattctttttttgaacttaaaatatcatttgtaacttatgtgtaattttttaattaaaaatcatagggcacatcatactgtaagtttgagtatgcagagtgaaatgagaaaaggattcaggcagattaggcttgaggacaggaggcaaagccccaagagtcagtccaggtagggattataaatggcagggttcgggaggagtggacataaaaatgcgagagaacaggaaactgcaggaagtaacagttagtgggaaacaaagagagaagttactgagaaaacagacacaaacactgacgtgtttcggactgccatgtgaccaccactgaaggatgataaggtttactgagtaggaagatttgaaattatggacaggagcaatatgtaccaaggaaagcaaatattttgcttttcactggatggaaatttctcccttctaggaactcctgaccttctttatgggaccaagcagtgtaagttgtaggcttgtggttccttctgacttcttgtgtcttctccctaggggcaatgatggtgctggggtgtgatgttttcagtatgaagttgtgcttggaggcagtggcaagagccagtgggagcttttcatggagcaggctgcattaacccacgcgctgtgtgcctcctgaagctgtggcagtagtggcgtgacacctgccttcctgggagcctgggaagaaccccaggaagagacagtgaagattgcatctcttgtgggagatagaaaagagttcagtttagtattggcagtgataaatgcttgctgtgtaggcaaacagaatgatgaaacagaagacattaaagacctctttctccccctaattaggataggttctagacatttggcctgtgtcagagaaacagccctggcactgaaccatggaaactaacatttatttcgcacctactatgagccagatctctagccgggcgatttacatgaagacactgatgcgtagtgacagtaagtgagtttcttcactgagtggcagaactactcattgaacctaaatgggtctgactccaagtcttgagacgtttccatcctgaaagcgttctacctcaggtcctcaagtaatctcaccacacacggtggtctaggtcatgtctgcaccctgttgttggagattttgaaccagaggaaggggtcactccggcagaggtggggaggtcacaggatgacctgggcttccccctatgctgtcctctcctggttctttccctagtgcacaggagataaagacacacagcatttgagctatagtcaggtctgtggctggtgagccccagactttacagtgcagtggaaagggggtgtttgtcctgttggaagagcagattctagggcccacccccagaggtttggattcagtgggctgggtgggaccaaggtggtctgcaggataattcagattgaggtctctgtacatgacatcctgagaaacgctgacttaggccctccggttttcagtcttggctcctcctgggcctctgcatacatttgtggcagacctagaaatgatatcgtcaggtgagtgtatgtatgcaggacaggcattggagatgagccagagggcaggaggtgggccttggccgtgaccatgaagagggagaagggagaaggttagaggtatccagaacccaggaactggggttacgcagctctcagattatactccatgctcatccgaactgcgacttcagatacagcagcatcagatgggagacgtgctgggagtgcgtaacgctcgctgcttcccgtgcatgtgcctcactcacttctgtgaacttcctcaaagtcagttttatcatctacttttatggaattgaaaactgaggagacctaacaccgtttttaaaaattatcctaaggccaggcacggtggctcgcacctgtaatcccagcactttgggaggtcaaggcacctgaggtaaggagtttgagaccatgtggtgaaactccgtttctactgaaagtacaaaaattagccaggcgtggtggcgcatgcctgtaatcccagctactcaggaggctgaggcaggagaatctcttgaacccgggaggcagaggttgctatgagctgagatcacgccactgcactccagcctgggccacagagtgagactctttctcaaaaaaaaaaaaaaaaaaaatccaacagtccgagcgcagcagtctccccctaacctcaaaagcctcctcagaagtaacctggtatcagtgggctgtgcagattcttatagtcttctttgcctttatatatgaaaataactttgttttatgtttgttttcacataggtggaattatactgactcttactctgtgacttgctttcttcacatgacagtaactcctggactgtttctgtagcagccacacaagtctcctttatattgccaatatctatctttatcccaaagacaagatgaatgttcaaaaacggtaatccaaactcacttctaaaaatgggtgtgtgtttaaagaagagctgctcagctgaggcagttttgctgccgaggggatttgagcaatgtctggggacgtgtggttgtcacaacttgtgagggggctcctggcattgaggaggtagaaggcgggaatgcacaggtcaggcccctgcaacaaggaattgtcaggcccaaaatgccaatggtggcaacactgagaaaatgtgatcggtttaaacctgcttatcttaatggtgtttcaacagccttattaaggggcttgaccaatatgtagtttatcaacaccagcctttggtgtagtggggtgagttgtgctcctgttggagaagcagattctagggccccacccacagagtgcatacttgagaggcagaggtgtgaacattgcccttgagctcaggagctccacagcagcctgagcaacatactgagagcccatctcctaaaaaacaaaaacaaaaaagtgctgaataataagtccattttaaacatatgataagatttcagattttctgaggaaaaaattaattagacttggcttcttctctgacttgaaattagcaatacttttatacatctcaaagtgtggtttatgaaagaggcaaaattgtcaatgactacttgttgaattttgcttcctaaccatgtaatggggacaagtgtttccgaaaacatgttttatatggttagttttcctgcagatgggaattgttcgctgaattatactttgtccacttaggcttaggtagatatggattctgtgaaagtggaaatcattgaacagtttaaatactggattaaaagaaaaggaactatggtaattgcagatctgttagatggaatctgtcgtgccctaataagagtgataaggaagaccattaactgttggaagcaagttgttgggttcgaggttgggaattgggcatgatttgtttcctgtgtcactgcttaggttaatttactcagactgccatttttgtgttggaaggaaataaggtctaggccctaagcttagactgtcttcatgcctaaagaagtccaaccattcattattacttcgctaaaggatgcattaacatgaatatatataataaagataatgactccttttttctcaacaaattttaaattaacttaaacatgcctgattttcagaaagaattaaaagtaaaaccatacctttaatttaggactgacttctgcatttcgattgtagattattctaatatgaagagtgctatttgcatgttggaatatcttttaattcttaatttgtaagttacaaagaaataggagactgaaatactttttatcttacaaaattccaaataccttttcaagcaatttatatcttatttctataatagttttatcaccagccaatgggtatgcactgtatgtcataatatggaaagaaattctttatcatttcagatattaaggatttcagattttaagagttatcagtgaaactgtgttacaagaatattttgttcctgagacatctcagtattataggtggcttcagactaacaggcacagaataggatagtgtgaagtatctgattagctttactgtacttggtacctttaggacgttcagccagaggtgattggagggatttgcacgtctaccactcgtgtgtgtatctgtgaaccatatctcctttagtgcctgcttttgaactttatataaacagaatgatgctgcctgtttatttctataattttcttctttcccttagcatgtgctgttcttggccccttgcttctccatgtgaattttggaaaagcttctgaagttccaccaaaaaccctatttggaattgttactggtactgcattgagtttctatgccagagaactgacatctttgtgacattgaatttttcttgctaagatccaaggtcttcctttatgcagacctttcacatgtatttttaacagttttgtaacacgaatcttctttgctgtcttgtcatgtaatgctttgccggggagtggtggtccatcttactctatagaggacatttctttctttttttagtgaagtaaatgtaggtggtgcttatgagttgttttaatttctagtttgtctttgtttgcagggggaagtgataatttaaaattgtgttgtaagaaaattggccaattttcaccatggtatttaatttagaaaaatataagtcacttgcaggtaatttagtcagtttgggcattttgatattaagtaaacaattccagtataataacataaatgctttcctagatgtttacatataatgccataattatgtaaataaataaaattcatttaattacattaaatttttttaatgtttacattaaaaaaagggggggagaagcaactaattcagcattcgggcacaagtattttatatggtcatggtcagagagccctccaggtattcgacatggtagcatggccacaggcccaggactgaatagactggtttgaggaaagagaaggttaaacacactgatttatacctgagaaatacattttggtgggccaaaaataattgagtgtatcggatggaactaacaaaagctttcttttactaaccagttttgcaggaaaaacatgttttaaaatatgtagatatgcattataacttctatttaaatacagctgaggttgaatttctcaggacccctttcagcaaagatggccctttgcttctgcttttcctgtccgtcctggatgttctaatcccagcacccgaaggttactgcaagctgagtggcaccaaagcaacaccgtagccaatgaaagtacatcatcattggtgtgcaggttctggtcagtgttaccaacatgagttaatatctttgaagtaaaagcacatagcgatgtcatgttttcccagtattctgtgggtattttatgacctgcaacttaggaaagcaaattgtgaaaaagaaaacttgttgtgttcgcctataacaaggtcacaagggaatcctgcagcgattatgttcttcactagctgtaagagagcaatctgtgctcttggttttgactcagctggtctttattgaatgactattgtgtggctcccagctgtggtaggaatgtgaaggacagcgaggcagtgcctgccgtggagcgcctgcatgctaacggtggacagaggagagcaggctcaccgttacactgcaaggtgaccttggaaggtgcagggagagaaacacaagggaggaaccacagagactccagaacaacatcttgcccagtcaagaactagaacaggaatcctagagaaaggtgaattttgaaagatgggtatgattttggcagctagagatgggggcggggaggttgttgggtttctcagaagaaggaaaaggtctggaggtgggaaggggctgggtgaatttggtgaccagccaggagtctgatgtcaccaagtcacagggatgaaagagaaaggcaggggaagtgagtttgcgcaggcgggctgaggccatgtaggggcaggctggagtaggggccgggagccttagggggtgacaggagaggttttcccaccttttttctctactccttccccagtcaccttcccctgtcccagcgacatcacacatgcattctttctgtcttccccttgcctctccctcctccactttgtcttcttccccagccctcagaatcagttcagatgccattgtctctggaagtaccccagaacccagcagttggaactcatctctccttgctctgttcccacagcggctgcctcaccaagagtcattccagcactcagcaagctggctcacgtgatggctattcccacctgcagcacccttcaccaggctgcagggcttctcaccccagtggtcccaggagagtggcttgaaagcagatcatcctcaacctgtgtttgttgaatgaataaataagggatccctatttataagcacgtttttcttggagatggagtctttctctatctcccaggctggagtgcagtagcgcgatcttggctaactgcaagctccgcctcctgggttcacgccattctcctgccttggcctcccgagtagctgggactaaaggcacccgccaccatgcccagctaattttttgtatttttagtagagacggggtttcaccatgttagccaggatggtctcgatctcctgaccttgtgatccgcctgcctcggcctcccaaagtactgggattacaggcgtgagccaccacgcctggccaacacctttttttttttttgtatattttgtataaagagatatgccatggagagcaaagtggtggaaattctaaaagactttaatgatcagatgaagaaattgtttagagaagcataatatacgtgctctgtcttagtttgagaatactgaccacagtttggctctcctagccctttgcctgagcaaaacccacaacccttcctccacacccagaccatgttccaagccacaacccattgctccagctttcctaacctgcctgcgaatgtgctgcctgttacacgagggagcagatacagtgaggcaaggacaactaacagcacccaaaagcaagggcagtggatttccctctgctttatttaaaactccccttcttaggaaagttcactcgcatgatctaagcacattcaatggcttttcacacatgagcagagtttcattcttttacatgaatcgaaattgggcttaaaatcattttagatacagccatcttggttcccatactttctactcatgaaagattttatatcagtggtcaggatgataaaatctgtacatctttatgtctgaacctgttcatttatatccacatccttttcttaaatactgatttgtatatttagaaactcagtgcttcattagtaaactgagggagttagagtaaaggatctccaagatcactctgccagcatttgagaaagaacctattattatatgactataggaatttatttttgtccaagagccaatgcctaatctttaatggttttgtgtttagactatttaccactaggtggcggtaaaaaaaattattcttagcaatgagaaatgctcatcaatatttaagtttactataaaataaaaatttagaggaccaaagtttgaggtgtctgtttgaaaactacgtaaccatatactggcctctgtatgttgtttctaggacttaacacttattttattcagggaaaaaactcttgtggcacttcatagccacttatattacagaattatggaaaaacgtaaattaaaatatgtaattttgtttcatacacacacacacacacacacacacacacacacacatgtgtacgtgtgtgtgtgtgtatgtgtatatatagagaggagagagaaaggttaggtacattcaaggtttccggcatccactgagggtcttggagtgtatcccttgcagataagtgagatactacattttcatttttccaggacattatatgttaaagtcagctcgtgcaatgcagacattggaagtttagtcatgtgccttataatgacatgttgatcaacaacagcctgcatgtacaatagtggtctcataagattataatggagctgaaaagtgtctatgacctagggacatcataggtgttataatgtagtataacacattgttcacatgtttgtggtgattctaggtaaacaaacatcctgtgctgctagtcatagaaaaggataacacatataattatatatagtacataattacttgataataataaatggctgtgttattggtttatgtacttaacatactatactttttgttattttagagtgtactacttatttaaaaaaaaaaaaagttggccagatgtggtggctcatgcctataatcccagtgctttgggagaccaaggcagaaggatcactttaggccaggagtttgagaccagcctgagtgacatactgagacctacctctacaaaaaataaaattaaatttaaaaaataagcctcagcttattcagtctcagctacttgagaggctgaggcgggaagattgcttgaacccacgagttgaaagttgcagcgaactgtgattgctagcctgggtgacagagcagagcaataccctgtctcaaaaaaaaaaaaaaaaaaaaaaaaagagttaactgtaagacagctttaggcaggtccttcaggagggattcattccagaagaagacattgttattacaggagatgacagctccacatatgttattgttattgcccctgaagaccttccagtgggacaagatgtggaggtagaagacagtgatattaattacctgaccctgtgtaggcctcagctaatgtgtgtgcttcagtttttctctttaatatttaaatttttattgatacataatatgcatacagaagtacatgcacaaagcattaagataaagctcagtgaattattacaaggcaaatacatttttgtaaccacaagatagaatcagccttgttcatgcttctgacatccactttcttccttcttcctctccaaaggtagccaaaatcttaagagctaatgttatggataaactttgtctttttagacaagtgttttattacagaacattttaaacatatacaaaataaacaaaatggtgtaatagacctgacactcagcctcaacaactactcatcatgtgctatttctgcttcatctatacttcagctcattccccatccctttatttttttatttttataagataagatgtatgtgcattgacatgtataatctttattgtacctttttgacaaatcagtacacccatataactttttatcctcttaagaatagaataccggctgggcatggtggctcacacctgtaatcctagcactttgggaggctgaggtgggcagatcacttgaggccaggagttcgagaccagcctggccaacatggtgaatccttatctccactaaatacacaaaaattagctgggcgtggtggcacacacctgtaatcccagctactctggaggctgaggcaggagaatcacttgaacctgggaggcagaggttgcagtgagctaagattgtgccattgcacgccagcctgggtgacagagctagtaacaatcattaatgtgcatatgaatcacctggaaatattattttaaatccagattttaatgaaataggtcagattttgataaaataggtcagggttttgtctgagagtttgtatttctaacaaagtacagattcatagagcacatgctaactacaaggtctcttttatctaaagtaaataaaatttgatgaataaactaagggaaattgaccttagatgaaagaacacatcaaaacacatgtgcaatatgctatctgtaggagcatttggttaacgagcataaaccaaccaagcaattttataattattttaatccaaagttagcgaaatctctattatggtttccatggaaatgctccttcaggctaagaaatgttagtatcaccagagggcactggttaaaaacaccacagatttggaagtcgatgtcttataaagtaagtgacagacccctctttacacccataagtggcttttacagagttacccaaaattcagtcatttgtacaccaagtgtagataattttcatagcttcctattaaaattatattttaacgcccttacaaaatttaactcaattttcttataaaatgaaataacatttttatatgacattgttattcagcttaaacatacatacttgtattgggtgctgtgtccgtgtgttgaccacccagtgttctttggggttccactctttgcacaggcaccacagctggagaaacacagacgcacagacacaagctggatcctgcgtctcttcctgcctccgggcacagggcgccagtcagcctggttgtgcgaatggaggtcgtgttccttagcacagagggactcattccagggcgctcccctcagaggaggaagagaccggaaggtcgttttagggggcacttcctgggacatgggccaagcctcctaaggagtgagggctccaaccagcaggtacagacctctcagaagtcagggataaggcggccattctgaacctggatctccaccaccccttgtcccatctcatcaagacagttctgaggggctattctggcacatgtctggacgttagaggctggaggacaatgtgggctttgatgggattcagataaggtctgttccagggaggcaggaggttgatgctcagcatctgggatggtgtccttgtggacagtgagttgcctctttgggtacaagtccattttcactacagaagagactagagcaggggtgtccaatcttttgactttcctgggctacattggaagaattgtcttggtccacacattaaatacactaacactagtgatagttgatgagcttaaaaaaaaaaagcaaaaaataatcttataatgttttaagaaagtttacaaatttgtgttgagctgtgcactgacaagcttgggctggagagtctgaacggctccccgatcccctctctgattctctttggcagcaaggccttgaaggggctgagtctcagtgtcttgggggaattctggaaagcctgtttgggaacctgagaagacctcttgcctggagcttgaatgcttgatttgctgtcctggccacatgcatgcttggcagccagagagcggggtttgcattcacaccagcacaacagtgagccaggggttgaagtgaccaggacaagtgtctgggtggcagtgtgcctcagtttttaacaaaaaagtttaaaaagtaaaaaaaaattaaaaaattaaaatagaaaagcttatgatataaggatatagtgaaagaagatatttttgtaccgctgtacaatgtgttttaggcaaagcattgattgtaatagtccaaaagttcaacaaaaataaaaggtttatcaaatttgaaagttgcggtaagctaagaatagtttattgctgaagaaagaaacaagtttttaagaatttagtgtagcctaagtgtacagtgtctgtgaagtctacagtggtgcagagtcatgtcttcggccttcatattcactccccatttactcacccagagcaacttccagttcttcaggctccattcatgggaagtgtcctatacaggtgtaccattttttcagtgttataccatagttttactgtaccttttctatgtttagataggtttagatcacaatgttacagtattctgtacagtcccatgctgcacaggtttgtagcccaggagcaataggctctcccatgtagcctaggtgtgcagcaggctgagccatctgggttcatgtaagtacactctgtgatgtttgcacgcaaagaaactgcctaacgaagcatttctcagaatgtatcccagttgctaagtgatacatgactgtaatatctagggaactatttgtggctattttaaacattacttaagaattatttacaatctctcatctcaccctctgaatctatcaaatgtcaagacggagctcatacagtattgggaagtcaccctccgtgagctggtcccaggcccagggtgtgagtgcttctgggaggctgtgggttaggggaaagcctgggcatggttttgtttaacatctacaatcttaactgacccttagctgttactgctcaaaactggtttccttcaattacatactacattactttccatctcaaccaggtttgtagcgccttgcgctctaattttttaagggtggattgtgatatacaataacagtagccacctgtttatgggtggcttaattgaaactttgctgaattgaatttgattaaaaactgagcctgggattttcagtgagatgccacacttagagaacatagtgcctcacacattgtaagcacttggtaaattgtggttgtcacaattgctagaattccttcaagaagtcaattctcacaagtgaggggcataggagagctccccaggcagaggggattggacatactgaagtcctgatggcccaaaaagcctgtggccctccagggtcgcaaacaggcttgtaaggagaagtcaagcctggtggcgggtgtggggtgtgctggtgagccaggctgcttcactttgagaagtttgggcttcacagtaagagtaactggaagctgtaagggtctcagactgagagcattcagatttgcattgttaaaaactatcccaacagtctcatggacagtggatacagggaggttcattataaggtttggccatagagtaaataactagccttgggcaggctgcttaaactgtcttgatttcctcctctttaacccagattcagtaacagtacctacccgtaggctgtgaggattaaatgagttgctatttgtaattggcttagaacagcccctggtgtgtagtaaatgctttaaatgagtgttaaatagaatgcaaaagtctggtttctgagcagaaggttgcattcttctgacactgccctcccctcacctagcatcagactgacctgctctgtgcaaacccagactgctgccgacttggagcccacctactttccaaaccaagtcctcccttctctgcctgggtctgacttggacacctccgcgtggatttgacatatggctggccagacctggccgggctttcccttttcccagaacacctgcactgcaccccactggggattcaggctccatcctggcttgctaagagcaccaagtgctctccctgctgtgcaggccccaccctccgccttcgcaagttcagtggagtccagcagtaagcgcagctggcagtaagcacttccacagatggcacgctggcttgtacctgagctccctgactctgcccacccagccatggctgctccctctctctcccagattgcacttggtgttggaagagaacaccaccaacatggagacgaactctcttggggctatggtcagctcctatttgctttctgtatttgcggcagatttgaactgaaagagggaaaaaacaataacaagcaagtggccccatccttctctctaccttaagcaaggttcactctaactctctaactctgtaaggttcctgtttttacccctttccagtggattcatttttttgtaaatcatgtagtacatattactgggggttttttgttgttgtttttaattaatcatgaacgtcttctactgagtagtaatgttttaaagctactttgttaacttgcaattctaatttgaaaactgtagataggatgtcatgtagaaatggcaggtttccacttacatgacttaggagtgttgcctggattctcttttaaggatacggaggcaggggtgagctcacagggagaaagtacatgatctgcacaaaaggatgcatcccagattcagggtagagtttcccccaggggtagggctgttgaatcatgatggggaagggcagagggcatagaaggcttcttctgtatttctaatgtttactgattaagcttgaaggtttgtggaatttgacataatattttgtatctttttggatgtgtgagatactttatgatgaaattgaaatgaccaccgtgataatggtaaccactcagagtgtcactggtatgtgtgccacgtgcttgtcgtcccgggtctatggagcctgcctgcccatcactgaggcacccttagcctccaccctggattagactgtcatctccaagtatttgtgtatgaagttacatacatacatttatatgcacagatgcaaattcattttatcttgtaatgtgttatcacaaaatgcagtataggacttttttaaagatcaaatatttccaaataaaactttttcaaaaaatatttttcctggtagtaaaagaagcacatacatgtatggaaggctaggaaattgtacttaagtagaaagaagaagaaaaaaaatatatatatataatgttaatataaatgttagcagtctctagggtggtactattatgggtctctagcaccaccctagaaactgctaacatttggtgatagctgtgatctaaatatatcccctaaaattcatgtgttgaaacttaatcacccatgtgataatattaagaggggctttgggggtgattaagtcatgagggcagagctctcatgaatgagactggtgattttataagaggtggaagagagtgccctgggccctttttgcccttctgtccctttcaccatgtgaagacacagcattcatagtgtccgtttcctctagagggcacagcaacagggcatcaccttggaagccttcagcaaacactgaacctgccagctccttggttctggacttcccagcctccagaactgagacataaagttttgctcttataaatgacccagtctgaggtactttgccatagcagcacagactaagacagtgatgttttcttccattgtttttccattctcatttatggattatttttatattgatgagatcatttctgcgtataacattttacatctttcttcatttagtagtataatataaccattttaaatactattaaaattattcataaacttttcttttccttggagacagggtctcactctcaactcccagcctggagtgcagagcctcaatttctggagctcgagtgatcctcctgcctcagcctcctgagtagctgggaccacagatgtgcaccaccatgcccagctaatttttttgtattttttatagaggtgggatttctctgtgttgcccaggctagtctcgaactcctgggctcaagtgatctgcccgtctcggccttccaaagtgctgtgattataggtgtgagccaccgtgcctggcccctttgtaaacattttagtggcttacagtgagccactatataagcatattaatcattctctgctgttagacaatttttactatatgagaaataaccactatagtgaacatcttcgagcatagttcctgtcatcatatttgcatttatttccttaaatgtatgccacatatatcaaaggttctgaatattttgaagacatttaatatatttttttcaagttgctttctataaggcagggcctctgttagcccgtaatcggtctttgttcaggtgacaaacctctaggcagacacacccctggaagtccaagcttcatgatgggttccgggctgtgttgcctctgctcacactttgggcgcctcggtgccattcacaactgcactctgtatggaagaccctatttctattcctccaggagctcacacagagtacatgtttcatagaaccccatacagcttagctattcatgtctgtaaaaaacttgaattcattaagtgaaagtgccatacaggtgttttaccctaccctttttgattatggaggatgaacattcatttatgtgtttcttagctatttgtattttatgaattatctattcatattcattgttatgctcttagtgtttgtcgtatattttgtacattaatttgataatatagaatctgtactgtttgttgttaacattcttcttagtttgtgctcatattatttttctggtaaacacaagattttatttttattgagcacagccaagcctcttccctgatgatttactcccaggattttcagttctcagagttctttctcattcagatacttgaaaaatgttcatgttttcttcttgtgtattatttcatttttacatttatctctttgatttacattaaactggagtatattttgatgaataatacccggtgagaatctttttttctttttacagatagtttttgaggcaccatttattacataatctgtcctttccctactgatttgtgatgtgttctctatcttatattaaattctaatatctggatccttttgtagttcatgagcgtgatgattgggtgtttcacgcatgtgtgtgcaatgtgccacccttgaaccttgtatgacatcggcacgttacccatctgacctcaaaaaaaaagcaaagaaaaattatcatctctgttaaacatattttactgagtttaaaaacaataaagattccattcttaatataggtaaagcactgctcattgatgatatatatttttgtttcactgctaatgtttgtttaaattgacttctttttaatgtgttaactttaatgctaacatttctcttttacactttgaatcaaagtaaattgggtactttgacaaacagatttttttgtttcatagagaccacccccatgtacaaataaattgtaggcattgtacataaaaggcacttgcatttacttttaaagaagttaactttttctgtttatgttttttagggtgtattatctcatatactttcagcactcagatttgataaagaagttgctcttttcactcaaggtcttgggtatgcacctatagattactatcctggtttgcttaaaaatgtgagtatttaaaatttatcacttttgaaatgtttaatgctgaatgtgccatcagcaaaaagagtaaatggaaatatttcagtcctccagaagagatgtttaacttttctttgtttatctcttcttaccttgggcagacttatggccatgtacggaagaaatgtgagatgggaagttatgagaaagaaggaaaccaggaagggttttcctaaaccaaccaatcagcctctctttctagggacacatctcacttattcactcagagatgtttgggagaagagctgttcttagctattataaacacagtcttgtactgttgaaagaatcttgtatttcaaataacctgattggaattttctgttaaagcaaaacagaaaattcagtacatagttttaaatatttacctcttaatattaaagcattgttttcttctggcttaaattatagccaaatgtgagaaattttaacttacaaacttgatgtaactcttctaaaaaatgttatgagattttttaatgtttgttaaccattccggtgttttggaagctttgtacaataacaacttttttttttttttcaaatgaactgaattttaaatgaagaagtaaactaacttttctttaaatggatttggttttaattcttaggaaattaatgacctgtctattgttcattgcttaaataggaatgcagaattatagacattaaacataaaatcccaattattagtaaatgtgacatggcactgcttccttttcactctgacagagtgaaacatgagaagatgggggttgggggaatctcaacggaaatatcactcacaccaagaaaaatagaactgatgtaatcctgtttgcagcgtgagttaacctgcaactgattttgttttacagatggttttatcattagcgtctgaactcagagagaatcatcttaatggatttaacactcaaaggcggtaggtgttaaactaaacatccttcttctcaggtttcaaaatgtatcagtttggttatgagaggaaaattttacaattcataggaaatggatgttcagttatggttgtattttatatagaaagattattttagtggaatacatagcaaattggtgagttttttcaaactcttttaaaaatcactattttctcaactctcacagagcagtaagtaaatcatacaatgtcttttgtgggcccattaggtagaaagccctacatacacagtagggagcataaaagaaagagcagtacttagttttaccctgggattgctcactctgcaagaggagaatgtgcacagatgcaagtgtatgctctcacactagcctgccctggctctgccttcttctgctcccaacacacacacacacacacacacacacacacacacacacacacacacgatatttacaaggcaacatttgatgtgaacatatgccctattttaagaaacatgatattccaaaatctagactaaacaaatcaaagagattcagacaaattaaaaggcaattaatcacattacaaatgtttcttcactctgtaaaagaatctcagttttcattggtgggcatttcatttttgacatatcattaaccaagagaatctgggactgagggacttggtgatttttttttttttttgtaaagctattgctaattcaagctctatcagaaattgtctttgtcctcaacctttaggaatcctttgcacctaacccttaaactatataattattagaggaaaacattggagataatcttcattatgttggatttggcaatgtaagaagaaccataggagacatggagagtgtttagatttatttatttacatgtcaggtaaagacttggatttggttgtgaggtgaatgttgactgatggatcttttgaattatgtaattataaatttattcaaaaagaccttaaaaatcagtcagtgcagtgtgtatgtactccctacaccaaactcccaaaatatgcatcacagttgattttttaaaaagcagctgacaataaacaaaataatttttaaaatctgttaacaaatagaaacaaaggatcagaatgcaaaatatagaaatgacttgcaaaaataaatcataaagaggcaaacactccgttatagaaatgagcaaggaatataagcaggtcattactagaagatgaaaactgaattaataataacattaaaggcgttcttcaggaatgacatcagcaagatggcagaataggaagtcctagaccttattttccagtagagacattgacttaactacagcatacatcccaaaaaattatagtgagaactacagaaccaattaagaagtcacagtactgcaggcaagctcaaagtctagaatagccacattgaaattgattaaacaatctgtttcatgtcaactgtgatagcccttttccaggtctggcagcttggtgagattggtaggaaaaacccagcttgtggcttctcttccttgggagggaaaaagaagagtggaatgtgcatccaacattctcactttttaggaagcagactgaggaactgatttctgtctctactgaccgggagcactgatgaggaaatcgcatacagtaatccctccttatctatagggaatatatttcaagacacccagtggatgtctgaaactgtggatagtaccaaacctgattgccaccaatcataacacatttctgtattccactcacaactttaatgtcttttccatcgtaactaagcacttatcatatatgatggctgtaatttttgccatgtgagatgcaacgacaaaactaacagaaatttttttccttctttacaatttcacagatagatgatttgtttttactatagatctcagcaacctcagcatatgatttttttctttccttattaagttgaaaactttcaccttttcacttaaagaaagcactttacaacttctctgtggcatatccaaattgccagccccagtgctcttggactttgaggtcattattaagtattaataaaataagagttacttgaacacaagcacagtgatactgtgacagttgatctgacaaccagtatggctactaagtgactaacgagcaggtagtgtatatattatggataccctgggtaaagggatgattcatgttccagatgggacagagtgggacagcatgagatttcatcatgctactcagaacagtacacaatttaggccaggtgcggtggcacatgcctttaatcccagcactttgggaggctgaagtaggtagatcacccgatttcaggagttcaagacgagcctggccaacatgtcaaaaccgcatctctactaaaagtacaaattagctgggcgtggtggcttatgcctgtagtcccagctactcgggaggctgaggcaggagaatcacatgaacctgggaggtggaggttgcagtgagctgatattgcatcactgcactccagcctgggcaacagagcaaggtgccatctcgaacaaaacagtgcacaatttaaaacctttgaattatttctggaattttttcatttaatatttttggaccacgggtgaccatggctagctcaaactacaaaaagtaaaactgcagataaaggaagactacttttgatgccttggggccatggagaacaaaagaaagcttagtggtttgtggtagcaccagagaattgacagtgctgccgatggaggctggcatagctcaacagaattgggaggaagcacttagctcatgacctgttctttgggaggggaagagaagcctctggcttctcaggggcctactagagggactggtatctgtcttgcctgactcacagcactgacagagaaatggcgtagtttggaacaagagagctcagcagcttgttgcagcactggagaatctgcaataccacaaacggacactagaggggaggggaagattaggagctcttgaaaaaccagtaaagccctctaatttggaaatcacacgcataagcccagagaagatatatccctggaaaaggtttgagggacctccagaatgtctagccgggtccactggtgaaagccttcctttgtaccatgttagtcgataaagactgagagaagtagatgtttctttaaatgtacaaaatacaacaaaaataacaagacacaaagtaaaccagggaaacgtggcataatcaagggatgaaaataaatctacagaaacagaccctaaagaagcagagatctatgcattacctgactaagtatttgaaataattgccttaagggatctcaaggcactacaagagaacacagataaacaactaaatgaaatcaggaaaacaatatgtgagcaaaatgagaatatcaacaaagagatggaaactagaaaagaaccaaacagatattctggagctaaagaaccacaataagtgaattgaaaaacttactagaggggttcagcagtagacttgatcaaacagaagaaagggtcagaaaacttaaacacaaatcatttgaaattattaagtcagagaaacaaaaagaaaaaagaatgaaggaaagtcaagaaagcctaagacacttgtggaacaacatcaaatggaacaatacacacattttgtgagtcctagaataagagagaaaggggcagagaacttatttgaagaaataatggtgaaaacttcccaaatattaggaaggaattggatatcctaatttcagaagctcagcagactccaaagaatgaacccaaagaggcctacaacaacatacacaaaaatcggattgtcagaagttaaagacataatcttgaaagcagcaagaaaaaagtgacttgtcatgtacaaggaaggttccagaagattatcagtggatttctcagcagaaatattacaggccagaaaggagtgggatgatacattcaaagagccagggaggaaacaaaacaaaacaaaaaacccttccaatcaagaatactgcatctgggctaaatcatccttcaaaaaatgaagaaaaaaagacattcccagataaacaaaagctgaaggagttcatcaccattagacctgccttacaagaattgctaaagggagtccttcaagttgaaatgaaagaatattagcaacatgaaagcatgcaaaaatataaagccttctggtaaatgtaaatatacagacaaacacaaaatcttataataccgtgttgtatagtacagttgtccctcagtatccagagaggattggttccaggacttcccacacataccaaaatctatagatgctccagtcccatagtaaactgtatggaacttacagatacaaacgttcaatctttgggttctacatcctgcaaatactatatttttgatccatgatttagttgaatccatggatacagaacccatagatatagagggctgagtgtacataaatcactttttaattctggtatagaacttaaaagataaaagtgtaaaaataactattaaactgtgttgatagatacaaaatagaaaaggatgtaatttgtgatattgataacataaactggggagggaaatgtaaatgagtagagttttagtatgtgattgaagttatctcgttaggttgttagaactctaagatgtttaatgtaatgcccatggtaacaacaagaaaatacctgtaggagatgtacaatggaaaatgagaaggaaagcatgtcactatgaaaaaaatcaatgaaacccaaaggaagggaataagagaaaatcgtgaacagaataactactaggtatatggaaaacaacaaaatggcaatagtaagtccttctctatcagtaattactttaggtgaacatgaattaaacaccccattcaaaagatgtggaatagcaaaatagatcagaaaacaagatccaactatattctagctacaagagactcacttgagatacataggctgaaaatgaaaagatggaaaaatggcaaccaaaatagagcaggcatagccatacttatatcaaactatcaaaagagacaaagaaaaagattatataataataagagtgtcaattcagggagatacaacaattacaataatatatgcacttaacacagcatccaaatatatgaagcagataccaatagaattgaagggagaaagagacagtaacacaataataatagatttcaccaccccacttttaataacatattgattaaccagactgaagaccaataaaaaaatagaacttgaataatgctgtggaccaattggacctaataggcatatagagaacattctacccaataacagcagaatatacactcttctcaagcacatatagaacattctgtaggaaagaccacatgttaggccacagaacaagtcttaacaaatttaagaagactgaaatcatagtaactattttttctgaccacaagggaatagaaatcagtaacaaaaagaaaattggaaaattcacaaatatgtggaaattaacccactcttaaacaaccagtgagtcaaagaacaaattacaagaaacacagacaataacttgagacaaatgaaaatgaaaacccaacatatcacaacctatgggatgcagcaaaagcagttctaagcaggaagtttatagtggtaaatgcctacattaaaaaagaagaaagtgtacatgcttttgaaggaagaaaaaaaaagaaaataagaaggatctcaaatcagaaacctaactttacacctcaagcaactagaaaaagaacaaactaaacctaaagttaaaagggagagactaataaagattagaacagaaataaataaaatagagaatagaagaaaaaactaagagttgggtttttgtaaagatcagcaaaattgacaattccttagactaagaaaaaaaaagagaagacttaatagcaaaaatcaggaataaagaatagaaattaaaactgatgccacaaaaattaaaaagattgagactactatgaacaattatataccaacaaattgaataacctagaataaataaatgtctaaaaatatacagcctacacgactgaataatgaagaaataaaaacatctgaacagacctacaactagtaaagagattgaattggttattcagaaccttccaacaaagaaaaaaaccaggaccagatggcttcactggagaattctatcagacatttaaagaagaattaacaccagtctttcttaaagtcttccaaaatattgaagaagaggggacatttccaaactcattttgtgagcaagcattaccctgacacgaaaatcaggcaatgaaactacatgaaaacagattaatatccttcgtgaatcatgatggaaggattctcagcaaaaagggaattcaacaatacgttaaaaagatatgtataaacaccatgactgaatgaaaattattccttgaatacaaggatggctcaacatacaaaaatcactatattgcaccacattaataaaatgatgaacaaaaaccacatggatcatcttaatgcagaaatggcatatgacaaaactcaatactcacttatggtaaaaccttaaacaaattaggaatagaaggaaatgacctcaatgtagtaaagtagtaaaggccatatttgaaaaatccatagctaacatcatactcagtggtgaaaaagggaatgttttcccgctgagatcaggaacaaggcaagaatatcttcatcctctcttaccacttgtatttaatatagtatcagaagtccttgtcagaggaattgggcaagaaaaagaaataaaggtcaacagatgctccaaattctttccatccaaattggaaaggaaggaataaaattgtctctgttcacagatgacatgattttatatgttaataatcctaaaagatttcacacaaaaaaattgttagaactaataaactaattcaacaaagttgcagtatacaaaatcaacacacaaaaccagttgcattgctatacattaataagaacaacccaaaaaggaagtttaaaaacaatcctgcttacaatagcaccaaaaagaataaaatatttaggaataagcaactaaggaggtgaaagatttgcacagtgaaagctatacattgctaaaagaaattaaataagacataaataaataaaaagatatcccatgttcatagatgggtatggtttttttggggtttgtttgtttgtttatttttgttttgagatggagtttcgctcttgttgcccaggctggcatgcgatggcacaatctcggctcactttaacctcctcctcctggattcaagcgattctcctgcctcagcctcccgagtagctgggattacaggtgcacgccaccatgcccagatgattttgtatttttagtagagatgggctttctccgtgttggtcatgctggtctcgaactcctgacctcaggtgatccacttgccttggcctcccaaagttctgggattacaggtgtaagccactgcacccagcctatgcttagtattttaaatgcccgtactacccaaagcaatcttcaggttccagtgttatttctatcaaaatgtcagtggcgtttggtttttcttttattttttacagaaatagaaaaagaatcctttaatgtatatagaatctcaaagtaccccaagtaaccaaaacaattttgagaaagaaaaacaaggtggaagcctcatacttccttttttcaaagcatattacaaagccacagtaatcaaaacagtgtggtactggcataaaggcagacatattgaccattaaaacagaatagagagcccagaagtaaggcttcacatggaagatcaaatggtctttgacaagggtatcctgtctataagattgggaaaagattgtctcttcaataattggtgttgggaaaactggatatacacattgagaaaacaaatttgaacccttacctttcattatatataaaaactaactcaaaatagatgaaagacctaaacgtaagacctgaaactgtaggagaaaagtgtcatggcattggacttcgcaatgatcttggatatgacaccaaaagcacaggcaagaaaagcaagaatagacaaataggactgcatgaaatttttaagtgtctgtgcaacaaaggaagcaatcaacagattaaaaagcagcctatgtaatgggagaaaatattttcaaaccttaaatctggataagtgattaatatccagaatatacagagaattcctgcaactcaacaacagcaaaataatccagtttaaaaataggtcaaagacttgaatagacatttctccaaagaatatatacaaatgaccaacaagcatatgaaaagatgcccaacatcaccagttatcagggacatgataatcagaaccataataagataccagttcacacctattagaatggccactatcaaaagaagaaagagaaaatgacaaatattgatgaggatgtggagtacttggaacccttgtacactgttgctaggaatgttaaactagtgcagtcactatggaaaacagtatggagtttccttaaaaaattaaaaatagaattaccaaatgatccagcaatcccatatttgtgtatatttccaaataattgggaacaaaatctctaagagatatttgcacacccatgttcattgagcattatttacaagagccaagaggtggaagtaacctatgtgtccatcagcggacgaatgaataaagaaaatatggtatatatacacattggaagattattccaccttagaaaagaaggaagtcctgtcatatgctacagtgtggatgaaacttaaggacattatgcaaagtgaagtaaactagtgacagaaggcaaatactgcatgattacttacacttatgtgtggtatctaaattagtcaaacttgtagaaacagaagctaagggcaggtgcagtggctcacacctgtaatcccagcacattgggaggccaaggcaggcggatcaccggaggtcaggagtttgagaccagcctggccaacacggcgaaactccatctctactaaaaatacaaaaattagatgggtgtggtggcgggtgcctgtaatcctggctacccaggaggctgaggcaggagaatcgcttgaacctgggaagcggaggttgcagtgagctgagatcgtgccattgcactccagcctgggtgacagagcaagattatgtctcaaaaaaaaaaaaaaaagaaaagaaaagaagcagaaagtagaatagtggttaccttgggatgggaggaagagggaaatgggagttgttgttcaatgggtatagagttttggttttgcaagatatgaaagttttagagatctgttgcatataaggacatatagttaacactactgtactgtatagttaaaaatggttaaaatggtaaattgtatgttaatgtgtttttcaccacaatttaaaactggtctatgagcttttctgtgcattttcaggaaagtgtaaactaacaacatcagttagacatccattaggttatggtgagctttaggaggttgctgatgggaacataaataggcacaaccactttgcagaacaatttggtcttcctggaatttgggattccttgttagtctctcgatgagtgctctgtttactgtagcctccaataattatgggaagatcaagaggtagtgttgattgaggttgccagtaaattgtattctgggccttagaggactcccatatttcctggaggttgatagccattttgggctggcttctccttccaggcctccttcctccttcctccttcctgttggagtcaggacatttctgttatctcttgcctaaagacagtggataagaagaaagagtgtataatgtataaggccttggcagctggctgtcaggttgccccctgttccttgaattcatccccaaagtaactcttatcttttatagtagtcctctcttggcaagcttttagggctgtggtattttccttcaaaaagatcccacctacctaccatcaagcttttctcagaattcatgggtcaccaaaagcccccattttacagtattatatatttaattgtaaaaactcttccatcattgacatgattgtatatttagaaaaccccattgtctcagcccaaaatctctttaagctgataagcaacttcagcaaagtctcaggatacaaaatcagtgtgcaaaaatcacaagcattcctatacaccaataacagacaaacagagagccaaatcatgagtgaactcccactcacaattgctacaaagagaataaaatacctaggaatacaacttacaaaggatgtgaaggacctcttcaaggagaactacaaaccactgctcaaggaaataaaagaagacacaaacaaacggaagaacattccatgctcatggataggaagaatcaatatcatcaaaatggccatactgcccaaggtaatttatagattcaatgccatccccatcaagctaccaatgactttcttcacagaattggaaaaaactactttgaagttcatgtggaaccaaaaaagagcccacattgccaagacaatcctaagcaaaaagaacaaagctggaggcatcatgctacctgacttcaaactgtactacaagtctgtagtaaccaaaacagcatggtactggtaccaaaacagagatatagaccaatggaacagaacagaggcctcagaaataacaccacacatctacagccatccaatctttgacaaacctgacaaaagcaagaaatggggaaaggattccctatttaataaatggtgctgggaaaactggctagccatatgtagaaagctgaaactggatcccttccttacaccttatataaaaattaattcaagatggattaaagacttaaatgttagacctaaaaccataaaaatcctagaagaaaatctaggcaataccattcaggacctagtcatggacaaggacttcatgactaaaacaccaaaagcaatggcagcaaaagccaaaatagacaaatgggatctaattaaactaaagagcttctgcacagcaaaagaaactaccatcagagtgaacaggcaacctacagaatgggagaaaatttttgcaatctagccatctgacaaagggctaatatccagaatctacaaagaacttaaacaaatttacaagaagaaaacaaacaaccccatcaaaaattgggcaaaaaatatgaacagacactctcaagacatttatgcagccaacagacacatggaaaaatgctcatcatcactggtcatgagagaaatgcaaatcaaaaccacaatgagataccatctcacaccagttagaatggcgatcattaaaaagtcaggaaacaacaggtgctggagaggatgtggagaaataggaatgcttttgcactgttgatgggagtgtaaactagttcaaccattgtggaagacagtgtggcgattcctcaagcatctagaactagaaataccatttgatccagctatcccattactgggtatatacccaaaggattataaatcatgcttctataaagatacatgcacacgtatgtttattgcggcactattcacaatagcaaagacttggaatgaacctaaatgtccatcaatgatagactggattaagaaaatgtggcacaaatacaccatggaatgctatgcagccataaaaaaggatgagttcatgtcctttgcatggacatggatgtagctggaaaccatcattctgagcaaactctcacaaggacagaaaaccaaacaccacatgttctcactcacaggtaggaattgaacaatgagaacacttggacacagggtggggaacatcacaccctggggcttgttgtggagtggggggcaaggggagggatagcattaggagaaatacccaatgtaaatgatgaggtaatgggtgcagcaaaccaacatggcacgtgtatacctatgtaacaaacctgcacgttgtgcatgtgtaccctagaacttgaagtataattaaaaaaaaaaaggtcaaaaaaaattcttccatcatttctagcagttgggagtatagcatgaatgctaggacatccgtgtccttagttcattgcttgatgcagtctcttaggttacattttcatcttattttctcttgactagattaagagagtcaccattcttcataggtcttgcctttgagtcctcaggatgtgtagcagttctacaccagagctactcaaagtgtggccctaccaatcagcagcatcaacatccctcgggcagagaccaagaaatatgactttttaaaaacatctgtccagacatactctctggaagttcaagaaatgctgctctacactacttctttagaagcagttcccataactgcatatcaatccctggtaacaatctgaatactttatggtgacatgatagaattttatttacggtttttatttttgttgatgaattcctataaattgttaatatttttgctgtattcttgataatagtaaattctcataaagataattttttgccaagctacccatagtgatctattatgtgtgaacagtttgtcttttctcctcaaatattcaccttttctaaattgttcttcctgttctctaccacttcttaagtggcagatatcctttcaacatttaccttccatagtgctttatcatcgttctcttaccaccaagatggttttagatctaaaattaattaatatgctttttgagtctatcatctaagttgttaacaaaaagacacatttagcatgagttgtaaatatcttaaatttttggaatatatgagcttagtgggtgggctggtagaggaagaggtatgtgggggtgtgtgtgaaaggtgtatactttgcacatagcctagcagaatatattgcatagagttagggcgggatggatgtttgtgcaattgaaaggtaggccggagagttgcctgtgtgcatcactcatgtagcgtctcaaataggcaggcaggtctccagcctgactcatcaatcttcctccctaaaagatctctaagcgcaacttttctctcatctgaaaagaggaaatgagaagagtcagagattattactggggactgagtgggtggaaagactgtggttctggggacatttatcaagtattgcagttcatggctgcagattatatcttctgtttaggctggaaatgatccaggataattttcctgaaaaatttaaaaaatctcataaagacaggtagttcttgggtataccaaaatttgggcaggccaactgataaccttcccaagaacttcaaggtgcacgcagccttcatggctcctcttttggtctgaagtttgtcagagtgtggagatccaagttcaagtggagagttacgcaacactttccagattgaattacactaagcattaggtcttgactggttgccagagcagcacttccaaataatttctgcacaagaattcaactgcagaaggctagacggtaaccatgtactgctgggaacatcctttctgtgtggttgtattgtagcttccaaaccatctgccccaaaccatagagctacaggataagctgacgatgctcagaatgttgctccttctagatggtttgtagcaaagaataggatagaatttaaacattctgtcactgaattgttgactttacttggtggcaagtgaaactctatttaaagccctatgacaacaccatttatcaggcctctaaaaataatgcaaaaagaaagtaagctaattttcccactttttttgttcctctggcgatctgtgcatctgaaattatgagatcaatttctatattttctgagactttttgaatctttggaaatgaactttagacactgaagtgctaaaaaattagaaaaaataaatgcatagatgccttctagaaggaaaaaaaaacacaggaaaacagcatagcattgtttatatggtgcttaagtttgggagctcttggctgcttcgacatttgaagtcatacttgtgaaaggagaggaattagaaacttagattcataggtggatgggactctcctgactttaagcatatactggaaagtagtttgcctgttatgctgtgttctgatttaattgtttcaatttgtaaatcttaaaagtggacagagaacttcagatatgtagtagaaagttatgtggtattatgatacctattttaattgttattattaatgacagcaaaaattatgatggctgcagcgtggttgacagctgttttgcaaaggttatcatggtgtcagagatgttacctgatttcattaaaccggcttctacttgagatagaagaatacacttggcagaatttataattcactggagaactgtggacttgaaaagttttgttctcacacaagcttttaagaatccaagttaaaattttatgaatggtgatcacaaaagcttctaaaagggctcaaaaagcatgttacgcatcaaattgctttttaaattcaatcttctgataggtataaatgaactcagtccaagagattgaattatcttaaaaactatatataagggctcaacacattcagaaaagtacctggacaaatttatctggttgaattataaaattctttaaagaaaagattctaaacatcattcagtagagcaaattaggaatgtatcggatgtgttggtttacagggagcactctgctagcacaggcatctcatattcttagtaaattcagttaagaattttactgattgtatcatagctttgctttgactaggaatatcctgaactgctaactaaattaattccaattttatccttgctactcctgccagctgggatgccagcatggacatccttcagtggacttcgctctgtgccagggaatttgttcatattacttttgaaaaacaagcattcttaacaacaacaacaacaccaaaaaccaattataaactagagaataaacctcttccaaagtggcacaatctggcacaaaggcaaatttttaatctataaaagttgtttcagccttggcacagtggctcactcctgtaatcccagcaatttgggaggccagggtgggaggattgcttgaacccaggagtttgagaccagcctgggcaacatggagaaaccccatatctacaaaaaaaaaaaaaaacccaaaaaaagccagatgtggtggcaagcacctgtaatcccagctactagggaggctgaggtgggagcatcgcttgagcctggggaggttgaggttgcagtgagccaagactgcaccactgcactctagcctgggtgacagagcaagaccctgtctcaaaaagaaagaaagagaaaagaagattgtttcagctgataccatccagcagagtcttttaattgtggtccaggagactttaaaaacctctgtgaactgcttgtcttctgtccaagggtgagaaaatgaaaagcacaaataattctatagaaataccctgaaaagagaccagtagaatcaaataatgggaagagtgcaaaaaaagatgtaaataaaggggaaaaaatactccagagggaaataaatactaagcaatttaagactgattaaggatgattagtttttaatgagctacttttgctgttttggaaataagaacctgaggcaggaagtaactcctttattacgaatattttctttttcctccctccctccctccctccctccctcccttcctcccttccttcctcccctcccctcccctcccctcctctccccttccgtccccttccttcccctcccctttcctcccctcccctcccctcccctcccctctctcttttctctcgctctctctttcctttctttttttgacagggtctcactttgttgcccaggccagagtgcagtggcatgatctcagctcaccccaacctccacctcctggactcaagccatcctcccacctcagcctcccgagtggctgggactacaggcgtgtgccaccacacccagctaatttttgtatttttttgtagaggcagggtttcaccatgttgcccaggcttatctcaaactcctgggctgaagcagtccacccaccttaacctcccaaagttctgggattgcagacataagctaccacacctagcatgaatattttcattttcagtattttactagttaacattgtattttagttttttaaaagttttattataaaacacttatgtcatggaaaaactgtgtgcctgttgcccaggttttatagtgctaacattttatttatatttgatatttttaagaaaaagtttcaattagagctgaagcatccttctcctattccatttctttattctccccgctggagcaagcacgcccaagaagtggggtgtagattcttcctgccatgttttaacacttttacttcacatttcgctgtgctttaaaactttacataaggatggtgtattgtggatatctttatgcaacttgctttcttcattcattcaacttttgagatttatgtatgcagataatgtaggtacagtttattcatttaaactgccatatagcattccattctgtaaataaataatcatttattcatttctgtacaaattcacagcaagattgaatctaccttttacaaacagtcctgtttgtctccctaacctgtaagaagaaatggtagcacgttgctaccagttgttctccaaagtgtttgtgcttatttatttatgttcctatcagaaacatcctggagttctcttttctctgtaatctgatggatttcccactacaatttttttttttttttttttttttttgagacggagtcttgctctgtcaccctggctggaatgcagtggcgtgatgtcagctcactgcaatctccacctcctggattcaagcaattctcctgtctcagcctcctgagtagctgggactacaggtgcccaccaccatgcctggctaatttttgtatttttagtagagatggggtttcaccatattgatcaggctggtctcgtactcctgacctcaggtgatctgccctcctcggcctcccaaagtgctgggattacaggcatgagccaccacacccagccctcccactacaaatttgatgttatagtttgtattgaacaacaaacaacacattgaagtactaaagaattaattagggttgaaagtaatttctggacatcagaaaatggggataggaatgccctttcaaaagctactattttgattaactttgaataactatttgaccatttcaagtagttacatcaaagaaataaacagacaaccaacagagtgggagaaaatattgcaaactatgcatctgacaaaggactagtattcagaatctacaaggaactcaaatcaagaaaaaagcaatcccatcaaacagtgggcaaaggatatgatagatatttctcaaaagaagatgtacaaatggccaagcatatgaaaaaatgctcaacatcacgaatcatcagggaaatgcaaattaaaaccacaatgagataccaccttactcctgcaagaatggccttttagatgttggcatggatgtggggaaaagagaacacttatacctgctggtgggaatataaattagtgcaacctctatggaaaacagtatggagattcctcaaaaagctaaaagtagatctatttgatccagcaattacactactggctatctacccaaaggaaaagatgtctttatataaaaaaaaaaccacttgcatatgtatttttatagcatcacagttaacaattgcaaagatgtggaaccaacataagtgcccatccaccaatcagtggataaagaaaatatggtatatatacactactcagccattaaaaggaacaaaataatatttgcagcaacttgaatggagctggaggccattattttaagtgaagtaacacaggagtggaaaatcacaaactgttatgttctcacttattagtgggagctaagctatgagtacacagagacatacaacaagcttgtcgaacctgtggcccatgggctacatgcagcccaggacagctttgaatgctgcccaacacaaatctgtaaacttgcttaaaacatagtttttttgcgattttttttaagctcatcaactatcgttggtattagtgtatttagtgtgtaacccaagacgattcttctttttccaaaaagaaggaagccaaaaagattggacatcgctggcatacagagtgacataatggacttcagagactcagaagggggaggagagtgggatggggggtagtgaaaaaaactacacattaggtgcagtctactcgggtgatggatgcattaaaatctcagaatttaccactatacaattcatccatgtaacaaaaaactacttttacccacaagctattaaaataaaaattttaaagtaaatagtctaaacaaaaaatatagttgcatttattaatttcataaaaatgaaaactaaatttttacaaaaagaatatgcaggcccctacagtgatctacagaagcctttccgccatcctccccggttcactgggtgtggccacgttggtccccttgctattttcagatgctgagggcctttgcttttgcttttcatctgtctgcaatgttttcttcccagatatatacgtgcttgttcatgtacttccttcagagctctgctcacatatcaccttcttggtaaatttctgtcacttctgagtattctttacttttcagcatgacactcagtatcatctggcattatattgttcctctccctgatgagacattgtcatctttgcatctgtgtcatgtacacctcaaacagagccttgactacagtaggggatcaataaataggtattaaatgaacaaataggacaaagatacacaaatatataaacaaattctctgaagaggaaatacaagtgggtaacaattactgtctcacaagttatcaggaaaatgcaaattaaggcaaagaaatagcaatttttgtccgttaaatttgcaagaaatagaaacaaataatgatataattggaaagggtggaaaagtaaattggtgtggtcttttgcaaggcagtttttttttgttttgttttttgttttttgtttttttttttttgagacaggtctcgctcttgtctcccaggctggagtgcagtggtatgaacacagctcactgcagccttgacctcttgggctcaagcaaccctcccacctccgcccccccgagtagctgcaacgcaggcgtaagccaccacacctggctaatttttgtattttttgtagagttggggtttctccatgttacctgtgctggtcttaaacttctgggatcaagcgatctgcctgcctcagcctttcaaagtgctgggtctccatgtgtgagccaccacccctggccttggaaggcaattcagtatgcaaatactcacacatgggcacagacaggcatgggcaagggtagcaccacagccctgtctgaatagtgaaaaaccagaaacagcctcagtgcctactgatagtggcattgttaaattacagaacatgtttgttttaataataggcagcaagtttttaagaatgaggaacagctacatgctctatactgtggtttcatttgtgtttcacaaaacacaagactaaatttctatatttacaattacatatgaaaatacctagaatagcctccacccagaactttcattttatttatcattcactggagacggatttgttgagcacgtgctgtgtgtgaggagttatccctaggtgctaggaatagagcggtgggcaaagtaggagaagctgcctgccattgtagagcttctgccctcagaggaggaagcgaaccatgagtactataagggaatactgtgtaggtcaggtggtgaaaggtaccaggaagagaagtaaagcacgggtaagagggcacttgaagctcgagtgtccagtggcgctttctgcagtcccaggcacatcctgtaaatgtgcactgttcggtactgtagccgccagccacctatagctgttgagcacttgaactgtgactagtgcagttgaggagctggatttttaattttatttcattttaattcatttgcatttaaattgccacacatggtagacagtatagtgacatgggatgatcagagaagacctcacttaacaaagggacatttgagctgcaaccagggagctaatcatgtatttcaggcagagtgaacagcaggactttatttggggcagtcagaggcagaaaagacaaaggtaagagtggaaggagattaagtcagtgaaacagacggggacccaccatggaaggacttgctggctagtgaaagacattgcttattctctacatgaggtgagaagccattgcaaagctttgagcagacaagtgttgtgatcggaatttttaaaggggtgctggaactgttctgatgttaaactataggagtgagtgcagaaacaagaaatccagaggctactctgtcacccaggctagaggtggtggtgagttactctccacttaggaggacagtgatggaggtgttcagaagaggtcagatgtgttgctagtattcactgatggatcagatgaggggcctgagagaaagggaggaatcaggatttgggcctgagcaaacaagatagcactggggaaagggaacactgggaagggaattcaggagttgtgttttggacatattaagtgcctgtgaatataaagaacaaagtcctgaccatgaatgacactgaaacagcaatggtagctaaaagatttcttcctaaagaattggataaaagagaagtgttcatcgatggtgttagagtcattctctttatttagaggcaaaacaggtgatctgtctttgacctttttagcatgaaggtttttatatgtccttaattatgcatggctcttagatttgagtgattatttcttatttcttccatagaatggctcccgagcgagtggcgtccctgtcacgagtttgtgtcccacttattaccctgacagatgttgaccccctggtggaggctctcctcatctgtcatggacgtgaacctcaggaaatcctccagccagagttctttgaggctgtaaacgaggccattttgctgtaagtggcaaatgtttcctgtcatcctgcgtcgtttttccttttcttagaaggctgtggtgtgttggaaagactgtacgacagcagtgtccaaacgtttttgtctcagtaccctttatactcttaaaaattactgagtatcccggccaggtgtggtggctcacacctgtaatcccagcactttgggaggccaaggcgggtggatcacctgaggtcaggagtttgagaccagcctggccaacatggtgaaaccctgtctctactaaaaatgcaaaaattagtcaagcatggtggtgtgtgcctctaatcccagctactaggggggctgagtcaggaggatcgcttccacctgggaggcggagattgcagtgagccgagattgtgccactgcactccagcctgggcaacagagcgagactccatctcaaaaaaaaaaaaaattactgaggatcccaaaacattttatttttttatttttaacttttattttaggtttgggggtacatgtgaaggtttgttacataggtaaacacatgtcatagggttttgttgtacatattatttcatcacccaggtattaagctcagtccccagtagttaccttttctgctcctctccctcctaccgttgctcaggtaggccccagcgactattgtttccttctttgtgttcatacattcccaagagttttaaaaatctgttaaacccttattaatatttatcatatttgaaactaaatttttaaaaatgtgtttgttacttaaaaaataaaaataattttattacacgttaacacaaatagcttatttttatgaaaagcaatgctcttttccaaggcaaaaaaaaaaatgtttgacaaaagcagcattgtttttacatttttgcaagtctcattttctaccctaagactgctgaattctcatatctgcttctggtgggacgtgttgttttggttgaagtgtatgaagaaaatccagccccacatagatagtaattgggaaaggcgggaatattctagtagccattgcagatcattgtggataattctgctttgatagctcaccaaaatttgaaaatggtcattttttaaagggtagttgcaatgtggaatctgaaattatgtcagttaactttccatactctgttacattagaaacccattggtctgtcttgcactttcaatggatcttttttgccaacacacataattttgtagcattatgcatggttcatttggaaaatcttcattcattgagttatgtatatcttccaaacattgacatatttcatatgcagtatcaaaacctatagtcattactgccaccatggagctcatcagaaatgactttaagtattgggaagctgtcaagcttatgttggtggacatagattttccaagattctaatttctgcttaaaagctaaaatttatcatgggctacaaacactgtcagtcattttccttaggggactgagtcactttgctaattattgagaaagtatgtgcctaatcctaaaatgtgactgaccactgcctgtctgctagtcattctttcaggtcaatttccatgacaaaaagtggtcaagtgagcccactgctgaaagagttgtgcaggtgtacaagtggagtgcttttctccaggcaaccgtctttttttgttatgaagcagaagtgctttatgcacactttccttttcaccgtacagaattcttttttaaaagtatccttgagggcaacagtttaataaagtcagtatgttaaactgcttcatcagacattcatatgtgaaaatgcagtgtttcgactgtgtgtgtgtggtggtgaagagtagcgtgagggctgtctcggctctgattcccactgagacacagctgtgttacccactgttgcttttgcgctatcagtgcaaatgtcaacacggttattccaggaaaaaccaggagattcaaaatagttattcagtactttaagtatttccctaccacttgggtgtgtggccaactttcatataaaagagcttctgtgcttaagttggtgctgataccagacaagtacaagcaatacagtaagtccagagattctattgtaaggcagaagtacagttctcttggtgacatattaatttatcacatctgcatttaaattttttttcttcagactctgaatgattggtctcaaactgatgtggcagttaacttgcaccataacagtattcaaaatattgttgcataagacacaataaggtaaatcattaacatctgtaaaggcaagggaaaaataactttcctcacattttttgtctttatttacagtttagcccactttctctgtagcagatgtctccatctcatgagtcagagaattctctgatgtgtcagtttcatcttttcttttcttttcttttttgagacagagtttcactcttgttgcccaggctggagtacagtggtgcaatctcggctcaccgcaacctctgccttccgggttcaagtgattctcctgcctcagcctcccgagtagctgggattacaggcatgcaccatcacgcccagctaattttgtgtttttagtagagacagggttttccatgttggtcaggctggtctcgaaatcccgacctcaggtgatccacccacctcggcctcccaaagtgctgggattacaggcgtgagccactgcgccagccagtttcatcttttcttgatgaaacatctgtaggatgagaaattgaatcttttaatcctcatttttaaagccagtgatccattcttaaatgcaagaaaatacatcataaataaatgttacttttcaaatagaatattgtaaaattccaaaataataatctaaaatatatattaaaatatataagtaaaatatacactgtatatatacatacaaatatatatctaataaaattatctaaaataacttagataaaatttaaaaattagaaaagttttcaaaattaaaaaatatatattactacaaaacccaacaaagtgtacttatttcttcttatgtttccacgtaggcccaagaaaaatataagaattttttaaataatgattttttcttttaacgcatctcagttcttccctccctctctggaaacagttctttgaaccccactttgaaaattgttgcatggcctctgactactgctgtagtcatgactccaagttacgagtggctctgtctgcagtgtttgaaaacactgtgaatccactgtgtggtataatttgcagagccctctccgtctcagataatgagatccaaagcattcacatttccgaattcaaggtatacatgcaatgtgattttaaaatgatacttactgcttataaacttgacattttgttaagaatactgtggtttttaaatcattttattaatactatttacgttttcaatttttttttttttttttttttttttttgagatggggtctcactctgtcacataggctggagtgcagtggtgcagtcttggctcactgtagtctcaaactcccaggctcaggcgatcctcccaccttagcctcctgagtagctgggaccacaggtgtgtgctaccatgcctggctaattttttgtattttcggtagagacggcatttcaccatgttgcctaggctggtcttgaactcctgggctcaaggagtctgcctgtcttggcctcccaaaatgttgggattataggcatgagccactgtgacaggcccaattctttatttaaatactttcagtgagaaattggagaattgttacatatgtagacccttccttgctatacaatgcattttaaaaaaacaaaactacaataccattattacatcttaaaattgacattagttccttatcatcatcacatatctagtcaggaattaaattatcctgattgtcttagaatttttcttccagttggtttgttagaatcagagttcaaataaaaaaaaataaagaatcagagttcagatctacacattgcctttggtttatggttcttttaagtctctttcaatccctctttgttttttgttttgaaattatttgttgaaataatacggttgttttccccgttctccggtggtaaagcatgtccgccctcttgagtgtgataaagggtgcgtgcctctggagcacagtcctgtgggcttaggtggttcccttgtcacattctcagttctcacatagtcaggcctgttttgttaccttctgttctggttctctggtctcttgcatgtgcgtgcggcagtatcactgctttagtgctggcatcaactgtgttcaatacaaaataaggatcattccctttgatttctcttctttactagggttgttattagtttgttttgctatcattgcttgtcttatattccacataaactttgaaaccaatttttctagttgcagggaagacacccagtgttgttgggggaagactcctgtaagtatatagattatcgagagagctggcgttttcatgatgttaaggctgtctgtccgcctgttcaagaacacatacgttttaccatttgttaagcttttgtgatctgaagggagtgttgtatatatttttcacacattggatttacacatttcttgttcctaatgttttgttgtatttgtgttttcaatgttttcactgtcataaatggatcttctcctccatcttcaaatagattttcattgtgttgtttgttgcgtttggaaaacaaaacaggctcaaaaccaccgttgttcttacagttcagagtatttccattttttaaatctataactcttaaaaattaggatacatattttaatttcagtttatatgaaaggttataatccaggattttgtgaaagtgagatttaaaaagagaaatagaagattaagtcacttgattcgaaaaatggtcaaaatgcaggtttcatggctaaaaaaataaaatggccttttttctacctactcttaaaccttctgtcaaaattcacccagtaagtggagtgagctttctgaggagtccgagcgttatgtttggtccttatgtgagatactgagtaaagggcgttgtgaacgtgcggcgcggcgctcgattctttccttacagtgcccaacacccgcaatggagcacacgcttcacggccccaccactgatcacaccaactggcatttttactctccacggcgatttttcaaaatacttacaaagaatatttaactaaaatgctcttgcctttcactgtggcagctcccttcttgattcatctaggaatatatttcacaggagaatatggtctcagccacccccgtgtctagccttactctttcagcaagagctgaattaaagggaatctggaagtgaatactcctggtcttctgtgaaaccccaaaagctgtttgagaaatcactggccaggcgacgtgcccagagaacagctactcctgctctagcacagtgctcagagggacgctgagggcagcggctccccaagcaggcccacactcccttgcttgtaattttgcttgtgatagcatgttctccctcaacaactcataaaatttatttggtttggaaagttatgtctgctaatccataagggacagactgtccagaagtgctgggtggtcttcagtgtgtccaaatcctgtggcttcagctcagcaagttccccaagcagtggcgtaagagctggagcctctccatggacactttcccgtaggcggaacatcccagccacatgttgacacagcgaggctgatccaatcaatcagtgcaaattaccagccgcgcccagccccccctccccagatgtgctgcgtggtcatttggaaaccacatgctttctttgaccaatgcactctaacccgtgtttagccttccaactatttgcttaccacagtacaccagtggaatttcatctgtttgacaattggctggtgtctttggtcttggcttccaaatgcagtcatatattttcagcagtggtctgcctgtcttttaaacagcagatgcttgcccctctttatggtttagataacctagaggaacttttaaatttcttggcctaaatgtcaacttttcatgtctgtccctggggctgccgtcataggcacctgcaggctaaagacggcataaaaccttcctgggcgggctgctgaggtccttttgtaagtctggagtataagtaatacagcatgacatgtcctctgaggtcatccgaatccactgcttcaaaaatactgagaagcttgaagactggatggagaatttgttctatatgcctgaatgaatgagacactgaacaagtgaaaaaaagaatgaaggcatgacggtgatctcgtgatataataagaaatgtgcatttggtcttcatccaggctcctaaaacccttgaaatttcctgagtgatgaggtgagaagagcatcttttattattcataagtcccttttcaccacacctgagtgtaggctaatgaagtgactcctggtgggcccccagatagcctcgggatgggggctggtagccaaaggaaccaaccacacctgacccccagagttcgacctgatcactactggccagcgatttaatcagtcgtgcttacattgtgagacctccataaaaaacctaaactgtggggttcaaatagcttccagattggtggtcacatccaggtgctgggaaggtgacgtgcctggagagggcctggaagctcagaactttcccccaggcctggccccatgcatctcttccatgtggctgttcctgaattgtatctttcagaataaattggtaatggcaagtaaagtgtcttcctgagttctgtgagccattctagcaaattatcaaacctgaagagaggatcattggaacctctgattttatagctagttggtcagaagaatgagaggcctagacctgtgattggcatctgaagtgggggcagtcttgtgggactgagcccttaacctgtggggtgtgtgctaatgccagatggtgtcagaattgaatcactggacacccagttggtgtctagagagttgggagcattggtttgtgtggaggaagaaaatccacacagtgagtgtgagaagtgctctgtgagtaaaaacagcttctaagtagtgggagtgactgacatacgagtctctgaccactctaacactcgcagctcggggtggctctgagtgttaaatagggtggccatatgatttaaaatctagaccatgccacttctgagagttaaaagagatcccttttataagtatagtgggataacagaaataaacttacaaactaggacaaatacactaagatttaaatgggttgaatgactgtaatattcttagcacagtgcctcgtatccacagtaaataccccgtaaccattagcgtctacagccactccaccctaaatgtgcccagtcttgcctgatctcagaagctgaggggggttgggcctggggattagcgggtgctgtaggctttaaaaaataaaaataaaaagacaggcacagtggcacacacctgtaatcccagctactcaggaggccaaagcaggagaatcacttgaggccaggagttcaagtccagcctgggcaatgtagcaagaccctggctctaaaaaataaaaactgttggtggccgggcacggtggctcacacctgtaatcccagcactttggaaggctgaggcaggtggatcacctgaggtcaggaatttaagaccagcctggccaacgtggtaaaatcccatctctactaaaaatacaaaaattagctgggtgtgatggcaggtgcctgtagtcccagctactcaggaggctgaggcaggagaattgcttgaacccgggaggcagaggttgtagtgagccgagatcgtgccattgcactccagcctgggcgacaagagcaaaactctgcctcaaaaaaaaaaaaaaaaaaaaaaaaaccccacaaactgttaacatattactattaccattattgactctagtaattgtattatttttgacaatgtgtagtattaggtttttgcaaactcatatttttccccctaacaatcactgaactaaaaccagatgtaagcttaattcccattgctgaaagagctaatatggcttccaacaatgcttaataagaaaacaattcattatctatcagaagaacctaatttatgcttcttgactaacttatgtattagtagtttactcgtctgttatgctcttgcatatcaagttaccccaaaaaaggagcctaactagaattactcttgaggagccacagattcttttgaataccctcagcatcgctgtagccattttacaaatcaggaaaatgagacctctggaaatgaaaacgtaaattagaagaaagggccgacctacaatcaagatgttgggtttatgtttttttcaacttagataaggaaaatccagatttaaatgttgtcaaatcatataggtgagtgtttaaacaaagaaaagtcagcataataccaaggacagaaaggtggcaaagaattagcagtaactaaaactcccatttctattaatattgtttatccatgatggaaactgagagacttcctcacatcctttttttttttttttttttttttttttgagacagggtctcactctgtcacccaggctagagtgcagtggtacagtcatgtctcactgtagcctcgacctcccaggctcaggtgattctttgacctcagcctcccgagtggctgggactacaggcatgtgccaccatgccttgctaattattttgtatttctggtagagactgggttttgccatattgcccaggctggtcttgaactcctggactcaagcaaaccaccctccttgacctcccaaagtgctgagactacaggcctgagacactgtgcccagccacatcctgtttttttaaccttaataagatatggtcacaaattgagtcacagaaaactttacttttctaataaaaaatctgcttatattgacgtgtaattgccagacattctggtgtgtttgggtttgcacatttcttctgcttgttggtggctgccttttgagaagtgagctgctctgtacatgcagatgataatgatggcaacttttgtctgaattatgatgcattgcttagatcaggctgtcacctaaatacaactttaggatcaaacagtgttcttttcagttccttggaagtaagcaattctccataacagttaaatccaagttttgtgagtttgtctggcaacccaaacagccttgatctctttctggtttgaaaaggtggactgttgccagtgcacctttgtcttggctgaggaagccctggcctcccctctactgctcagacagctttagaacacaacctctcagatgggcctccctcatcaagaacctttcttgtgaagaatttaattctgcattctggttttgttttgttttgttttgtttttttgtagctataaaaatatttggagccaaaattatttagtaagcagttggaccaatttctttacctgctacctctttttgtaaaggatgagaaaacacaactgcctcactaaactgagtatttgggggaaacaaagtagagttttctaaatctcaaggaggtgtcttttggaagagtctgttggacaggggagagcgtcctgtccaggcttccctggctcatggcagacgctgtcactgtaaatcagatttctaggtggagccctgactggaagcctactgctcattattttaaaggagaaaatagtaatgtattacacataaattctaaatgtccaccccatttcctaaaacataactatgatacagaaaactctcccaattattaggtagggatttgggggagtcaagtttttatcttactctgttttcttgaattcatgattttggtcaattccaggcaggatggatggaaccattatagagaagaaaaaggacaaccttagcgtttctgtcactaacgtattgaacagaatgaaattttttagtttccctaaaaacatttttttcttttttactttattgtccctttaaattttccacagaatgaatgaatatatatatttatatatatatatatataaatatatatatattcattttgtcaggtcaaacaatacagcacaaggcatatacagaaaatgttcattacctcctcctcctcatcctgcagtaattctggtagccataccttatgcttgttaaacataaagtccatataaagccattgtctgctcattgtcaaaacaaaagcagcattacaccatagccacatcactccagagcctgctttttaaccagcgtgtcttaaatacccctcgcaggacacagatccagctcatttgaaataggggcatactccgtggcacgaggcccacactctgttccgccatccccgtgggtgcacactgcagtgtttatagttttgtccttatcatatataaggattgcagtaaatatcctcaaactgatgtttctatttctgccaggcaaattgacagcagtacgatgattaacacggggctgtgtgtcttgcattttcttcagtggcaccacatgactggccatgtgaagccagtgcctgcctgcctgtgaggagacgcaccctctgcctaccccagcactgggtgttgtcactctcctcagcgcctacacggagagggtgaaactgagaccacgtcggtgcgtttcccttcctttactgttaattagatgggagagctgcacatttttatcggccatttgcagttctttttctgtgatttgcctttttatttaaagccagcctggttcagaccaccaggtagaacacaaatatgttggctcggccaaattctgttaagcaagcatatcaagatgatactgcttcggcgattccttcattcaggggtgattacaaagagttaagtcactgaggttttagagcaaaatctatccaaatattaaacacaggtccataaacataatcactcacagcaattagtagggtgtgctctgaatcaaggctctaataaaaagacagctattaacacacatcgttttcaaactagaatgggcgcatcacgcactttactgactggagtgtgactcgtgtgcttgagtgactatgctaagcaggatgggtcggttcttcattggttcatgtgaatttgctgctgctcctggcggcctggcctgagtgctgcagcagcttccccaccaccacctggcgggatgaatgacaaacaccgtgccatggctctcggccaggatgtggtactggcagaagacctctcactgcagtgaaacgcctttccagtgacatacagattcgtgttacatggatcctgaaaaaagataaggcatgaggaaagctggtcaaagccagcactgctgcttgagaagggaggagccactgagaggcgaactctcctattcagagcttcctggctccatgatggaagctacgagcaccctctccacacccaggggtgttctgcttccccatgattactggacaggaacccctctccagggctccattgatgtggctagaattggctgaccacctggatggaaaagcctttcctcttcacaaggggcataagcacaggcacggcgtctggcccacccagtaaagctgcccactgttctgctgagcccaggcctggcttcttgcacccctcctcagagccaacgtggtcctgtactcactccaacctcagccgccctggcttcaagtgttaccagctgcgagtcctggtcctctctgacctcggctgcctcttctgtgcggggaggggataattttgtacctgttttgtagggctgttaatgaggattcaagtgcaagcgaaacagcatcattccagccactgcttttcagcctttcccactcctctgcgccttgcccgttggcagcctttcaggagcacactaggccccacctctgggccgccgcctgggatcactcccgttaccgccagtcctctgaagtcctgtctgcagtcctggcttcacctccactcctctcctctctctgccatgtgctgccatccagggcctgcccggcacactcagggttcattcgcccctttgtatcttctcgtgctctgatgacgcgtcctctgcttctgtgcctcctgccatctgcagctgctcctcctcccctgcctgcctccacactcagagcttcctcccttggggttctgacacccaaatgtgtaccttcagccaattcctctcccggagcttccaccttggatattcaaggacctattgaatatctctgcttggttgtgcctcagacactccaaatccacacacctcaaactgatctcttagtaaatcctccagaaatcatttcttctcttcttttcatctgaggaaatggcatgtccagtattgagggggtgtggcaccatggcagggctttgccaggtgtgggaggtggggagatgaggaacggggcctgccggtgggtcctggacaaattgaagctcagggtgtgagcgtgagatcaggaggctctgaggtgaatgtaccctccctcccttctcccttccccctgccttctgccagctcctccgcagtctccccgggtcttcagcctcttccctgctgctcttgccccacggtcaaccctggacaaggtctgcaggagctacaccaagcaagcagaaaaagtgaaacctctaggaactgctctccccatgtcccttcctgtccctggacccagttgctgggcttcacaccagctctgcagagaagtggcccaaaagtcatggtgaagggacaggccttgaaggggttgttgggtcggtgggaggcttacgcccccactttagttttccttattaatagcagtagccttgtttttcttggggcaagacaggagggagattaatgaatagacatcaagtttgaaaagcacccactgggaagcacccactgtctgggatgtgcaggtaaagggcaggtggctctcgggggcagctctactgtatcccagagccagcagttggggctcagagacagacatgtgcccctcatgctccctccagggaggggaagtggagccccaattcactgacacaagaggaccttaatatatgttcctttagaaacaaatgtagctacacaaaatggttgtgtctggggagtagtggggctcaggcctgtattcccaacattttgggaggccaaggcaggaagattgtttgaggccaggagttcaagaccaaactgggcaaaatagcaagacccccatctttacaagaaaaaaaatagccagatgtggtgacgtgcacctgtagtcccagctactggggagactgatgcaggaggatcacatgagcctaggagtttgaggttacagggaactttgatcacaccattgcactctagcctgggtgagagagcacgactttgcatctttttttttttttaaaggaatctttgattcccagtcctgctaacctatccagtatcacacttaaggtccagtgcatcaactaggccataactaccatatatgaaattggatttttttcttttgagacagggtcttgctcttttgcccaggttggagtgcagtgacgtgaacacagcctcctgggctctagcgatcctcctgcctcagcctcccaagtagctgggattacaggtgtgctatcaccatgccaggctaatttaaaaaaaaaatttttttttgtagaagcagggcctcactatttgaccaggctggtcttgaactcctgggctcaagtgatccttctacctcagtctctcaaagtgttgggattataggtgtgagccactgcatctggccttgaaattgttagaaatattttcaactttcaagcaaccgattataattagttattggatatttatgtgccaagcactgtgctaatcactgtacgtgtgttgttgcattacaagaacactgtgaaggagataggcccattttacagatgaataaactgaggttaacttctctgagatcatacagttagtaggcagtggcgctgggaccgaaacccaggtccgcatccctattgtgaggcatgattacgcgtgtttgaacatgcctatttcttcagttagggactgggcatcacgaggccttttccatcccgttttttatcgctccctctttcttccatcactagacatttgcttattctttttgaaagcaatttttttcctgagcatttctgatttcttaaggtgagttgaagtggaagcatattcacattattttgcaaatgagcacttggtaaatattcactgattctataaattattagccactgctgtgaccatgatgagaagtctcacaaattggattagtgattgcattttgaactttttttaatcttcttttttcagtgagccatttctgtttaaaattttgtttatttctttctgaaaggaagaagatttctctccccatgtcagctgtagtctgcctctggcttcggcaccttcccagccttgaaaaagcaatgctgcatctttttgaaaagctaatctccagtgagagaaattgtctgagaaggatcgaatgctttataaaagattcatcgctggtacgtactgggttttgatgaagggaaaaatccttgaaggagatgcttggaatcatttcttttagtcagagaatgaaagggggggatgtaaacaaaagagcaattggaacctttatatataatcgtgtatttacattttatttttgaaatcactaacatagggggcttttctgcatccttggagcatgcagggagagatctgaggtttacttgattgatatgccgtatatcacatgttcacaagaattgacatttgcacaacagactttttaaaaacagtatttcttatttcagcatggaaaataagtttttggaaatgaacatatgggtaagaggaagaatcaattaaaaacattcaaaaaataaacttgtagctcttcactagaggaaagatgaaataagagacacaaaaccccagaaaaatggttaaagcagcagaaccagctaagacttctgtaagttttcttttggtgtgaggccacctgccttcaccctcccctgcgcggtggcgcctggctcccttcccgctcaggactgtgcagctggggactccagcccacgtggacatccacctcctggcccagtgtctggcaccctgggctctcagtggccctcgccaccactgactcgccagtcatattcctttgtgggaggcagctctgtgggattggagcacattttgtaaggacaggaataaagaccaaggcaccctgaaaaaatgattcagaaacctgcaggtgccatggtcccgcagcctctgtcttccaggagctccagtgaactctgccctttttccctttagctttcgtaatctgcagggatgtggcacagagattgccttccacttcttcctgcttcctgcaagtggagaaagtgagttccaagagccacagtgaacggtccggtctttagttagtggccgggacactgggaaggagggagtgttcaccctcgcccttgagctgagactgaggaagtccctgaggttggctgtgcccacttttcctgagctcatagaacccctacctcctagaggccttcaacttgtttagttcagttgggacttctgtgttctttctttctctttctagttggagactgtctaagggaatcctaatggaatcagttgccttcctccgcgatcccgtttctccccttgtttcatggcccctttcacccttccccttggcctcccagggcgatgtgcatagggttgcaggtgctgacagccacgctgctctcacctgtacctcaggctgcacacacggatcccacctgacttgaaagtttaccacgatagaagagaaaggaagacgtgtatattaagactgagagagcccaaacagatttcttaaggataattactacctaaccttaccatccggaagagtcatatattaaggcaagaaataggaatgcaccttattttaaaatggttgcagtacaattcaaaataaatcatgactttcagaagccctctgacagcccattcctggtgattcaaggtcataaattacctttattgtctgctaaatctattactaacttacatgtgcatactaggatttcagtttctctggtcccttttcagtggcaaaatgatagtaactgggctatatgcttgcttccagggtgcttatgacattttccttaagtcttctccctattgaaaaattctagtcccattgccttttttccagcctttccttaatccttggattcttccctgaaccttctccatgtcctttttgcctgtggccctcatgcctgagcagcactgtggtgagcacagcagatgcaagacagagaacgcaggccgtcccattgcacataactgtataatgctcagtctccagtttgtagtttacagtaatctcccacgagtcacacagctttgaagtcagttgacttacaaaagcttttatcgggatcatgtgtgcagaaattcagagcttccattatggctaaagggggattctagagggtgttatttggtttaatttattgtggcattggcaggatgtgacctctctgtgcctcatggttcaaggacgtaattacaatacagacgatggctggaagcccctgattggtgtgggctgttctcctcagcatcctgggcctgcagtgccagaaagccaggcaggccgcaataggcctgtgacgtggctaagtgattgcaggggtaacctgaagagcctgcttcctaattgcatcatctgattcatttatcgcagtgcagtatcttggtgcagtgacaggactgtacagaagtatcagagagatctctaagactcagatagcacgagactgctgcgctgtgctccagaggaaacctgatgcctattacattagagttggattctgagagtaattaaagtgtgatggtctacataacttgtgttttatatagagcactgttaattatatttctctctcttgggactatgcagaatgagtcctggaaattctatagttaccaaaatgtaacaaaaacaaaagataaaagtgtggtacaggttgtacaaagtgaaatgaccttcccaaatgttctttggcctcttggactcgcaggtctgatattttccattaagaccatgaataatgagggattagtctcttattacctgagttccaaatgactatgtatgtatttaacatctaaaataaaagaaaagttttcaaaacccgttcacttttgaggcttcccctttggcttccgtgcggtggactggactgctgtcgagtcatgctgtctgccacggttggtagctcctacatcaagtgaggtattagccctagattgtcatttactgtacagactgaaacttttcaaaagcagatggtcttgtgttttccttgacagcatgggcacgggaagaccataatccatagcttcagacctgaccttaaaaaccgatgtcaccgacagcagtgaaagccacttgttaattatgcagccttcttggcattgttcggtttcccaaggctggccccaaattagaaggatgttatgttttccagttacaattttgtttgtggagcccagaaagctattctttggattccacattggaatgaaaagtgtctgcagggtgtcagggtggcactgtgcttggctggcaagctgcatgccagggccggaaggtacccgattctcatgccctcccatttgctggcagagcccgcccgcagctgggtccagaggagctagcctcaccttcccaggcagacttgtccccaaaagaaaggagcagaggaggcgcccaggaggcagagttgtttctgctaagatttgatatcagaatatgcttcattttctctcctacctaaaaatctttatggcttaattcaaaagattactttatctaataagaacttaagaataaaaagcatctagatacctcagtatcctcctcaatatgggataggttgtgtttttttccctcattctccaggtagcaattgtagcacttcagaaagaaaaagaaacttcctttacacagactcccagtatgcagctcctccttggtaaaatattgtgctgaagagttcactctacatcctgggtgatattgtcagtttgctgtgcttaagtagcttttcactaacatgccagggttttcttttcctgctttttcagtcttttcggcacttccttttgagctctttaatgtggtgcatgtaattgaacaagagctgaagtagataatttagcagtagtccagtagtgctggctgatgtgtatggctaaaagctgggaggttctgcatcttggactggagttgcactttccagaattagcctcaggggggcaccagatcctccagcatagtctctgtgaagaaagaggcccacgttgcgagtttccttgcaatggaattgcagttggggatgcagaccttgtggccagagatgaagggagagagggaaaaacccaaaaacaaagcaggggtggacgtaggggtcattgccactcaggctgagctgtgaagcagcagggggctgaggagctttcttccagcttgggctacccgggctaattggatagaggccactgggcaaggctagaaggacttcaggcaggggagggggtgctggggatcctctgtgtccaaacacagagaagagcacatgtaaatttaagacgcaaaagtacatttggtacttgttaagttcttaagcccaggaatgacagatttatcactaattaaacaataattgcattatggagtactgaaaaaattgtttgtgtataaacaacatctggtaaagattaaaaagaaagaataatttttccgagctcaaatttgttaaaaggaacctgaatgttttaaaacaaaatagatctgaaaatgtaaaagggatatttagagtcttatgtttagtattttgaaaatagaaaagaagcaaatggcataataaaaaatacatatttataaaggtgcctcattgtacatgatagatgtgaaggttttgtataaataggtttttctcaagccaaatcatttttcacttcaatagaggagttcactggtgaaatgactcttatggagaatcttctttttaagaagaaaggtattttgtagtgaatatgcacatattaacaacaagggcttcccactgtggagagaacagtggctcggaaacagctacacggtgggacgggattgtccggctgctgggtaaactggaggggaagctgcccatcagctgattctttaaatgacccatttcctaagtaaatatttaagctacatgcaagtacatgaaaataccaggaaagaatctattccaggcttaatgaacttcagcttctctgtcatctgctatttccttctttatttttaaggcgaatatatctatgaaaggtgatagatggaaagcacttgataattttttctgttccttcactgcctttttattttttctaaaagggatttgcttttgtctgtgagttaccttaaatcatagtataatttccctttttggtttgttttctgtccctctccttttccctattctctctctctctctctctctctcacacacacacacacacagaatcagcaaatgacagaaagaaatgcttcttcctgagaattctgttcttcttgttctcaggcctctttcaagtggcaagtggcttgtaataatcattggtgagttggtatgaaaataacagcttaagtaaacatcaaggaccgggcacaagagcctgtgtaatttgcacagttcatggtgcagagtgacaagttggcctctcccttgcctctcttccaaaacaggcactgagaccatggttattgtgtgttgattccatgttgactttgtcttcccttgtgttttgagggatgaagatgggctttctttctaggtggaggggagataaacaatgcaattctgggtagccatgaggggagatcagagggaaagctcttgttagcccaaggggatgcacacccagcagaacaatcgggtctatacaagagggagggcagaacccagagctctccatcttcgctccctagtcatcctgggcattcagtgaaaagcctgaggggggagataaggagggaaggacaagactcatgttattgaagacctcctgctgacatagctcccctcgagttgaaatgatctgcctgtggaaattgttaggccagatggagaagagagagcttgagaaggaacagattttggtaggatggagaaaaacaaacagatggaaaccacaaaaggtttattttatttccccgcttttatagaaaagataatggccgcagtcatggggcttcagagccctggcttgcagcgtgacctctggtgtgttaccggagtgccccaccttacaaataaaacaggatcagaggttagatgcctgcgtcatcactcatgaagatgctacagagatttaggggggaagatacggcttccaaagaagcgtgtattaaaaccttaattctatttggaagattatcttgataagaaaagcagcttaagattgcttttgtgatttgatgtcgctgggacatatgcctgacctgtagtactctagtcctcatgaggggactcactgaccctgaaattatgtgctcaaaaagtataaagagtgtcattttaaaagccatcggtgaggggtgcagatgagaaggagcagttcacagctgtaggggtagcaagggagactggttttcttttttttcagtgaggtcaggagatcgagaccatcctggccaacacggtgaaaccccatctctactaaaaatacaaaaattagccaggtgtggtggcacgtgcctgtaatcccagctactcaggaggctaaggcaggagaatcttttgaacccaggagttggaggttgcagtgagccaagatcaccactgcactccagcctggcaacagaatgagaccctgtctcaaaaaaaaaaaaaaggagactggttttcaaatcaaaatctctgccgttgctgtttctgcaggttcccctgcctcctggcctcttacctgttttaaaagctaaaatgggttgtggaagcaggctgagagtagccaagggtctgaaatatttggaaagaaagaaatctaagaggagagtccatctgtatggggaagaacaagcagattccacacagccagcaggcatttaaaacattggattgagcgattttgctagaaaacagcgcacagaagaggagcagatctaagctctcactctcttctaacaaactgagtaagagctgtcttccttgctcccccagtggttttcatagtagccctaatctacatctgatcatcattttctttgctgtttggaaatccctataattagtattgaatgattctctactagcatcaaacctatagaatggctctgggatagtttgaccatttagaaaaaagaaatttaattttaccattttcaagtttcatcttactttctatcaacgcatttccaagctcttatctgtctgcctgtgggcacataacagtgctatttgatcttaaacactcttattcaataggcatgttgttgtacaaactttgaaaattgctctggcaaacttagatgaatcacatttcttcaagacatacggttgcttttcccttgttttattttttcattatgaatacatagaaacttttatattttccgtgcttatatccggtgacctcttaataacttttattatttacagtgagactgggcatcaggagattaactgacatgcctaagttcgaagccacgaaataacctgcctctcctctcttgaacggtggtcctgccaaattattttcttgcatagataatgaatttatctgtaagaatatcaagttggttccttttagataaaaatgcacatcagtgaaggatgagggagcatagattatttaaagagtaggacattttaacttgcaaattagaaatcttgaaataattaaaaggagatttatcctgtcctgaaaaagtggcagagctcctgcctggagcccggcgggtccagcagtgctgaccagtggacgctagatggcgcgggctcaatgtcatcggggaggccgcgaggaggcgcggtcctgcctcagtgtgatccagggcacggccggagcagagcgcctccttttttcttgccgacgggggcctgtgaacagtgtttcccaaagctagtcatatcaaatgcactctgacttgaatttccaatagcgcctgatccactaacatgtgaatgctgctgtgaagcaggggtccccgccccctgggcgcacagcggagaggagcccctagccttcccgcccgcacctgcccctgtcagagccccgcgcttcgcttcccacggaaccagagccccatcctgactgcgcatgcctggaatcgggttgtcctctgatgatctgaggagcaaccgtttcatcccaaaaccatctccccctcccggtctgtggaaacattgccttccaagaaaccggtacctggtgccgagaaagttacggaccctgctataaaggatctgttttggaacacaaatgggcattttcatctggcatcatctcatactttgagctctggccaaaaagatagggaaccagggactgggccagtgaagctccccccagctcccagggctaccggaggccagcttctgcagactcaaataatcagaacccatcaccgaaatattcaaggagaaattagataacttttattcttcttcatgaacccccttttcatcttaacgcaagctgttaagtgcattaagatgtgatgtgatttagtccagcgtggtagtggtcactggtttgccaataataattctaaattgttatgtacccattaccgaataaacaggctgcaggcacgggcctgacctcgaggcacatctagccatttgaggaggtcacacaggcacacttcagtagaactggcagtacaggcaggctccacggcatgcgggcagagggatgtttaaagtttctctaatacttactgattctgtattatggatcgcctgagcttttatagaaaatgtgggacatacaggagtatacagaggaataagctgcctgtaacccctgcccagggagaccaccgtatgcacttgtatgtggggcgttttcagtacagcagtggttcgttcttctaaccaaaaggagtatgccagttttctggacatcagcagttcccagtaactcctttggctgataatagcaagtttctgagaaagtgcttgtgatatttcacattctcatggtcttctccttttacagcctcaagcagcctgccaccctgccatattccgggttgttgatgagatgttcaggtaaacgttacactgtttcttctagtaattgatgtaaaaaaggttccatttccaagcatgaatcagaaaatgttgtggtagtctctggctgtatcatggggaaattagagtttctgattccctcctgttcctctgagctttttggtaattagaggtaaaaactcaaaaatcagtgtaaatttaaaggccagtgcctaagaattaagataactttattttctttagccttttaagattctaataatagaaacacagaattgagttaggcattaatatcatgaaatattcatgtaggatttttctcagctcagaataaagggtagcaatatactcccttcaccatgtgagggctgaccaatatttttaaaagactttaaagctaaagaaagccaagaaaaataaaagtcattcttaacagaactcttctgaaaggcaaaatacaccatgcatgttctcttacaacacattacatttttattttgaaaatatgagtacttcttgggaaatgcattagatttacagacggcaagagacgaggagctcacagccatgaagctgagatgtggctggcagttagtgggagttttaaccatggagtactaagttagtgggagtactaaccatggagtactaagactggacgcccctggggagcttgtcacctgggagtgtcccagcccctcttccaggggagcccatatcagctctctctctagcccctcccacctaacacacagcagcagaggctgcagggcagactgcagactttggggaaaggaatttttactgtgacaataactcaccagtagtcagaacagtgttgggggtttaaagctagcaaaatttgagagtttttttgtttgttttgttttgttttgcttaaacaaacataaagaaaaattaattgtacaataatgcatggaagcgaaaccaggtacacacacattattttcctactttgctgggtggatggacgaggccattttaccctttgagcagcttcgtctccacttgtgaaagcaaaatgttgatgttgcgtgtccaggcatacaatacaaaaatatttgtacagagtatgcaagcctgtgtggaagggatttgcattgcttaataatttaagaaccaagaaagagagctctgcacgttgcaattttaaagaaaatataacagggagcgacaaatttatcctgttttcacacaaggactgaaatctgatgagttgagatactgctgaagcttatggcacaaaaaaagtgtttctacttttcccttatacagtgcaggttttcatgtttgccggattacttgttaaacgtgttctgatctgactttgcattgttcaggtgtgcactcctggaaaccgatggggccctggaaatcatagccactattcaggtgtttacgcagtgctttgtagaagctctggagaaagcaagcaagcaggtttgttatatcacatatattactcattcatcccagagaataagacgctgttgagagtattttggacaagagcactttattttcaataattttgatggactgttttgctcacaaagaaaggttcctaatgagtgccccaacaaaggttaagccattttaacttaacataaatcaagatctgtctgccccgtgccctgatacccagaagcatctgtctactattatgtctgagaactctgtcatgccagcatgcatggccctggaggacggctcttcttggccctgtgttgtgcactgtctgccgagcaggacactgccccctggctgcatctgagcctcccaggtcagcaggaggcaccctggggtctatatggcatgtgatgaataggaaagggcacttattacaaagcactcctggacattcttaattattagcatcttcattcttatcagagacccaaatgtgaattggcttccaggaaaggaggtggtaagagtgactgggaaaggcttgactaactagaaggggagtgaggaagggcagtgagcgggaggtgtgtgttagacacagtcagtaaaccaaaggccaggcccgcaccctgcagaagattgtgctccacgtccccagcagcagaggctgggcaacagctgccaagagtcaatgaccaattagagggacctcgtgaaacagggacctttgctaccagcgagctttcacctttcagcatatatatttggccttgatttctaacggccacagaagtaatgtttatgggacacattgcctgtcgagagtggtgctggtccagtgcatctcatctgtagagtatgtcacggcccctgtgaagctctccgcagtttgacttccgagaggagaactacaatgcttggctccaccagatcacaccccccgccaacgtcaaatagatctctcaggttttagccgatatttctacttttttttttttttttttttttttgagacaaggttttactctgtcacccaggctggagtgcagtgatgtgatctcagtttactgcagtctcaaccccccaagctcaggtgatcctcacacttcagcccctgcgtgtagctgggaccacaggtgcatgtcaccactcatggctactttttgtattttttaattaagtacaatttccattttatttttctcaagagaatagtccgtcttcagactttaaggactcaactccttacgtgggctttggtgggggttgtggggcagcatccgcaggtctaaattggagtaggggtgttcagtccttgtgggcttcacaagatcgattcctgactactttgctgtgaattgcacaactcagacagtaatgtagcttcaaatacagcttgggaagcacataggcatcaaagacgctcgcttcagaaatgtccctgactgctgcagcctccactgtgtttccaatgatgaatttgttaatagccttgtccttgggcacacattgggcacagttcgtgtcgcaaataggctgcacgtggccgcggccctttttggtacgaccgttgttccttctttttttcatcatattggaggcacggactggaggaagcactaatttttgtatttttattagagatggggtttcaccatgttgcccgggctggtctcaacctctgaggctcaagcaatcttcccaccttggcctcccaaagtgctggggttacaggtgtgagccaccacacccagcctgtttctgctttttaaagcaacaataaatatatttttattttattttattttttgagacaggctcttactctgccaccaaggctggagtgcagtggtatgatcatggctcactgcagcctttggcttcgtgggctcaagcgatccccccacctcagcctcccaagtagttgggaccacaggttcaagccaccacgcccagctaatttttaaatttttttttgtagagatagagtctctctgttgctcaggctggtctcaaacagctgggttcaagggatcctcccaccttgccctcccaaggtgcttggattccaggcttgagccactgtgcctggccaacagtaaatatttgtgatttattttttcccaccctcactttccctggagaagttagctgggctgtagcaagctgcgctatccatggtcccacctagaattttggaggtggctcggctggaaggcacagctggccctcacggttattttgagcctaactgtaaatgtctctgagcctcccttgtgcattctttgtagaccccattaggaacgggcctctggggagtctcacctgtggcctcgcggagcacacctgggttggagcagaggccacggaggagtgccactgtgctctttagggttagctcgcgcctctttttcttcttagcttcaccctcagcctctatgttggccgtgggcactatggattgggactgatgttgcagttgcttttaattgagactagtaccctgaccaggcatacgtatctaaggacgtgggaccacacactgggtcctggtgtgaggcaaggcagggatccaaaaacaaacaggaattcaccaccctcgccttcagctcaacaaaggaaaggaaagtctctttgctttgccaatgcctgcataggtatctgttagtttatttctcttcctagagctggacctgagtgcctgtctttttaactgatggccatctacatcttttgaccctctgccttcttgactgtccatttttagctaatcaaaacccttcatgtcatatttggtagatgcgtgaccctcttttctctctgtgttttattcattaattccttcttaataaaatgagtatctgtaaacctgatatctaataatctgaatatatgtctatccacgtgctcctccctgcctctctccctccaggtaacctctggtttgaattttatgtgccaggcgtggtggctcacacctgtaatcccagcactttgggaggtcgaggcaggcagatcacaaggtcaggagatcgagaccatcctggctaacacggtgaaaccctgtctctactaaaaatacaaaaaaattcgccgggcatggtggtgggcgcttatagtcccagctactcaggaggctgaggcaggataatggcatgaacccgggaggcggagcttgcagtgagctgagattgcgccactgcactccagcctgggcgacagagcgagactccatctcaaaaaaaaaaaaaaaaatgaattttatgtttattatccctttgctctttctgaaagtagtttgatcacatatatatgactgcctaaacaatgttttgtttagttttggttgtttttgcactatataaaacaaacaggagcagcatactctgtgcaatcttttgagacttgcttttccactcagcagagacttcttgacgttgccatgtgtggctgtggggaagtactgttatgcatagtccattgtgaaaacgtatggcagtgtagccatcctcctgctggtaggcacttgagatgcttccaggttttgttttttattacaaacaatgttgctctggacactctgggatagatacttaggagtggaagtgtatttggaatacaaaagttcaactttcatagatcctgccagactcatttcaaaagtgttggtgctcatctgcacttcctgcaacagtttatgagtgatcccataaatccacattctctcctatcatcagaagcactcatgtcagtgcttctgtctcttcttaccctttcctcttgtccctgttctgtttggaggacacagtcagctccatcaatatgccctatcagacagtaggcagaaattgaaatgggtgtgacaagccactttttctaagcctgcactgtggctcagtacagccagtcaggtcagtttctggttgcagccatgacagcatctggtaatgagctagattaaatcatctcccacagataaaaatgataaactccaggcaaagtatttttaaaaatctatttgaaggcactacagagcacctgaaaaagtggacagaaactggaggccatcagccctttaaagggacatcacacagagaggtctcctgcctccccccagctgccctcatgtgaggttggaaggcaggcagtgtggggccaggagagggccagaacttggcacaatctgattgacttaaggtgccaaaaaatagaagtgtaagctgccaaaggaacaaaaaaattgaggggaaaaaagaaaaccaatgtcaaaagatagacctaaacccaaaactaccaacaatgacattaatttcagcaattaaatggaagttaaatattctaataaaaaggcagaaacgtcagattgaacaaaaaaaatgaagacctggctgggcacggcggctcatgcctgtaatcccagcactttaggaggccaaggtgggaggattgcttgagtccaggagttgagttcaagaccagcctgggcaacatagtgggaccccagtctctacaaaaaagtaaataaataaaaaattagctgggcatggtgatgcatgcctgtagtcccggctactcggggggtgaagtgggaggattgcttgagcccagaacgtggaggctgcagtgagccatgatcacaccactgcactccagcctggaagacagggcgagatgctgtcttaaaaaaaaaaaaaaaagattttaaaagccattgtaatcaagacagtgaggtattggcaaaaagacagccatagatagatcagaattgagtccagatatagacccatacatatgtggccaactgatttttgacagagatgccaagacaattcaatggggaaaggaacgttttcaacaaatgatgctggaataactggatgtccatatgtagaaaaatgaacctcaaacattaccttgtaaagcacacaacagttaatttgagaggatcatgggcttcaacagaaatgttagaaagataaagcccctagagagagcataggataatgtatctgtttgacactgaggtgatctaagatttctcagaagcactaaccataggaaaaaatggataaattagacctcatcagaatttaaaacttttaggctgggggcatagctcactcctgtaatcccagctcgttgggagccccaaggcaggaggatctcttgagcccaggagatggagaccagcctgggcaacaaagtaagaccccttttctacaaaaaatacaaaatttagctgaacgtggtggcacacacctgttgtcctagctactcgggaggctgaggtgggaggatcacttgagcctgggagatcaaggcttcagtgagctgtgatcatgccactgcactccagcttgggcaacagagtgaaaccatatctcaaaaaataagaaaggaatgtaaaatttctattctttgatagatatcattaagaaactgaaaaagcaggccaggcacggtggctcatgcctgtaatcctagcactttgcaaggctgaggtgggtggatcacgagttcaagagatcaagaccatcctggccaacatagtgaaaccccgtctctactaaaaatacaaaaattagctgggcatagtggcatgtgcctttagtcccagctatttgggaggctgaggcaggagaatcgcttgaacctgggaggtggaggttgcagggagccaagatcacaccactgcactccagcttggcaacagagcaagactccatctcaattaaaaaaaaaaaaaagaaaaggaagaaagaaggaactgaaaaagcaagccgttagctaggagaaaatatttgtaatatatgtatacaacagaggacttgtgtcgagaatatatgaagagctcttataactgcctaagaaaccagtttttaaaatggacaaaagacttgaatatatactttcaaaaaagatacataagttggcagtaagcacatgaaaactgttcagcgtcatttgccatcaggaaagtgcagagtgaaacaggtaggaaagcaagcatacatagggttatgttcccagccactagaatggatgaaatgctggggagtatgtggagcaactggaattcacatacattgctggtgggcgtaagatggtacaacaccggaaaaccatatggccttacgatgttaaacaagcatctatctgtgacccagcagttccattccgatggcatccccaggagaaacagaaacacatgtccatgaaaagacatatgtatgcatgttaactacagctttattcatgacagccccaaactggaagcagcccaaatgcacatcaagaggagaatggctaaacagactatggcatattcatacaattcagactacttctgagcaataaaaacagaatgatctactcgcacacaataacgtggcttaatctttaagaaaatatgttgagcccaagaagccagacacaaaagaaaacatactttatgttccctttacacaaaattcaagaataagcaaaactaatctctcttgtcaaaatcaaaacattggttgccagggtggggtggagggaatgattgttaagaattggaaggggactttttggcgtgatagaaatgtgtcttcactggggtggtggtcacatggatttgcacatttaccaaaacctcatatacttaaagcccatgcactccatgcgttatagattttacctcaatttttaaaaaagcttctgtgccccttgggggcatagatagctgtagctctttggccctcgaaatgcgagcacagttttacacttttgttgttattttaaaaaccatgctgagccaggctcagtggctcatgactataaccccagcactttgggaggccgaggcaggtggatcacttaagctaaggagttcaagaccagcctggccaacatggtgaaaccccatctccactaaaaatgcaaaaattagccaggtgtggtggcatgtgcctgtaatcccggctactcaggaggctgaggcaggagaatcatttggacccgggaggtggaggttgcagtgagctgagattgtgcctctgcactccagcctgcgcaacagaaggagactccatctcaataaaaaaacaaaaacaagccgggcatggtggctcactgtaatcccagtactttgggaggccgaggcggccagatcacctgaggtcgggagttcgagaccagcctgaccaacatggagaaactctgtctctactaaaaagtacaaaattagtagtgcttggtggcgcatgcctgtaatcccagatacttgggagacagggaggagaatcgcttgaacccgggagccagaggttgcggtgagctgagatcgcgccattgcactccagcctgggcagcaagagcaaaactccgtttcaaaaaaaaaaaaaaaaatgctgaaatacctaacatctcacaacggctttggcaagtctttccaaaacagaagatttatttgtataattgggttcatgtgaagtagaactcataaagacatcaagagcataaatttattatttttaagtcccagaaggtgactttaaaaaggttaattattctggaaaatatgaggttattgggagcttatttttcaaaaaataaatgtttaagaaagtgttctgaccatgttagtactggtgggtcttttttgggcagaggactcagagttttgtattttcctgaccccgtttcaatcttaatgttcatgctctttggattttccatcctgtggcagctgcggtttgcactcaagacctactttccttacacttctccatctcttgccatggtgctgctgcaagaccctcaaggtgagttagggttgactttgcccacatcagaatgatttcctgggaagagcattgtcaaattatgacctcctcatcaggcccttatctacagcatgagggagacagaactggttatttctaagatccctttaagcccccaggatcccacattctgtggattttgatatgagagtctgcttggcttcccagttgtgatcacttaccaaaagaagaaaacaaacaaaaaaacaatggcctctggtaggtgttgctagtctgcctccagataacacaggctcttctggtgccaaccagatccaccagatgccaggaacaggctaagacttggctgagtcagaataaaacagtacattcgtttgcttttcattctttctactctgtgcagccttgttgcagaagaaaagacaaaatgatggatgaagctgaggaaatgcaggggaagtttcccctaaccaagctaagggaaggattttgagagagttcagtaaggtgcttcatccacagcctctcctgatatcctttgccagccttccaaaggctatccagctggggaagtgatggttccagccttcattcgactggtgttgatccaggaatgtggctgtgagctcacgcttaggagacatttcggaaatagagaataagggcatcctttccctctgaggcctgaaacctgatggaaggcagtcctgacatgggcacagactgcgccagccagaaaggggccttattggagcatgggaggagaggagacagaagggaacgagccagtcacatttcctttttatgccattttgggcctgccttttttctgagacttgagtgagtagatctgtttgagaaatgcaaatgattcaaagtttcagagcattttacaaaacctaaattcctcttcctttttcgagaagatgtaggttcttgcccagggtgatcccctaacactgtcttctcagatgctggagctaggggtgggatctctgggtgacagttttatgaaaactcttgggaaaactttattaacaagacagaaaaatgaggaattcactctcccagggttcaccttacgcttaggtcagatcagcaaagcctaaagtcagccaacaggggacgctgagtgagctccagaaaatgtactggagttgttagtgtctcagtttggaaatagtaaataaacggtgaggtggtgcatgggcatgggcccaaccctttacctttccgtttgtgtaacttgtagatttatgtccaaatataaataggtggcttcgggcagaagtacaagaacctcttgtgctagttcctagaagagctgtctgtatattactttgggaaacagtgttatggtcacagattgaagaagtgttttttagtggcatgatcttctgtttatcagaaatttatttcatacccattgtgaaggccgggagaggggtgtaaaagaggatcacttacgagccctgactgtgtagacactacaagtggaggaaatgcgaaataaacatctaaatagctagtaaaaggaagaaacgaaaaataccttcaaaaggctgtgcaccaagggccgcgggagttcagaggagggaggcgctggccttgtggagtagcagcagtttgtccatcactcgccttaccttccttgtgtgttcgattatagcatctatcactatgtgaaaacttttgcagatgctgcacagaactgcagatacgtgctgctcagctgtatttaaaaccacaggatgactgtgaaaccagagcagctcactcaagaaaagacatttgtttgcataatgctcacttattttctttcctggcctttttttccactgtaaacctgaaatcatattgtgaattcatcacagccctaggaaagcagtcaggcagtctattcctaattccttattggctgctttactacagtctccgtctattttgaaatcaacacattagtgatggaggagtgtgtaggtagaaaagaagaaacctagggcatccgcaacccggcatttcccagtctcagcgggggctgcttatgcaatctctagctacttccatgtacctgaatttaaaattacttgagggcaagcgtggtgattaatgcctgtaattccagcactttgggaggccaaggcgggaggatcacttgagcccaggaatttgagacaagtctgagaaacatagtgaaacctcatctctacaaaaaaattttaaaaatagctgggcatggtggtgcacccctgtagtcccagctactggggaggctgaggtaggaagatcgcttgagcccaggaggttggggctgcagtgaaccaggatcgtaccactgcactccagcctctgaccaagcaagatcgtgtcttaaaaccccacaaaactaaaattaaaagattagattctttgatgttcaactctgtgtgacatggacagatcttacttccccaggcttaagagataggtactggctgggaaaagcatgagaacagtattgggttccgtgaaccagaagtaaagggcgtctcccaaagactcttcaggtcatccctgcaggtggttcctcatgggcttgacatttcctcagttgccctctgacgtatctctctccacccgcagatatccctcggggacactggctccagacactgaagcatatttctgaactgctcagagaagcagttgaagaccagactcatgggtgagcaaacactgaccactcccaaatctacttcacacatggtttccctagatcctcatctgccctttgagcagggctgacagaggaaggcattactggtctgggaccatcaccaaacaggtgagcaccatggtgaagtgagaagtggaggaagcgcatggctgcacggatggcttggagcaggtcaggatgaataggcatgcgcatgtatgcatgtgccaatacctgtatcgaaatgttttctacattaacgtctggttttagattttgaaatatacaggcataacaataaaaagaagaggccttggaaaaagcagcacccacctgctgggaacccctccctggccgcacagaagggaaagggcacttgtttgggtcctgtggtcttccctctacctctctagggaaggagatttgaaactcctacacagtagggtggaatgttaaatgcttgcttttccttctctctaataaatctctctaaaatgagaaaatctattctaatataaattctgggttggttggtttgttttaaatttttagagataaggtcttgctctgtctttcaggctggagtgcagtggaatgatcacatctcactgtagcctcaaattcctgcgcttaggtgatcctcccactcagactcctgagtagctgggactacaggcgtgtaccaccacacctagctaatgtttaaatttttttgtggccgggcgcggtggctcacacctgtaatcccagcacttggggaggctgaggcaggcagatcacaaggtcaggagatcgagaccatcctggctaacacggtgaaacaccatctctactaaaaatacaaaaaattagccgggcgtggtggcgggtgcctgtagtcccagctactcgggaggctgaggcaggagaatggcatgaacccaggaggtggagcttgcagtgagccaagatcgtgccactgcactccagcctgggtgacagtaagactccgtctccaaaaaaaaaaaaaaatttttttttttgtagaggtcttgctgtattgcttcaaattcatgggctcaagtaatcctcctgccttggcctcccgtcgtgctgggattacaggtgtggaccgctgtgcctggcttgttaatttcttaacagtagtgttaggtaccctcttatgtgtgtgattttcttgaaagcattcacatttatgccttgctaaattccttgtatcataacactctttggcttcctctttcagagtataattttattcattgtccctgctagcctactaagactatcttatttgttccttttgccacttttcactcctggaattctctgtagtctcacaccgagttgacacagacaatgggtgacacacctatgtccagctccgtgattgatggcttgggtgccagctgctcactccttcctcaccatgattcttaccgacagagaccagacaaaaaaggcctgcagccaatggaggctgcggggttggccacatgaatagcctgcagtggccagtcggccccccacacaccctccctggttgtcctggtgttacacagagctggaccttgaagaatcttaactcggggacaggacgtagatgcaggtggcataaacagcccaccctgtgattgagacatgttgtgcagtgggtgccctgggtgtttttctcttctctctacccaccctctccaccatcactcagaatgtgtgatgtcaaatgcgtgaagactggaataaaacagcaaccagaaagggcgcatgtggtgctgcagaacaggacttagacctcgtggggctcccacttcaatccagaccttggagccatgagatacctttcaggtggccacatgggactgcttgtgcattcagctactggtggaagacagagggaaggaccagaccggtctctgatcctgatccagtcacgctgccaacctgggagctgggagcatgagggagcctcactgctctgtgcatctgtctaccctgacatggtgcctgcagggaagaggcatggcagagtcccctcctcactctggtacagcctaacccagcccacagccaacgtggcctccagagcatcagctctgaccatgtcctgggaaagagggacatgtctctgttgctcaaatgtagaacatttaaccacttgttctcagggaggactggggcaggaggacagcagtgtccagggaggcgaggacagtgcttagagcttgggaattccatgggccaggcagaggaacatgcaggaagatccaacaaaggggccaggaacactcctgttccagccactgccccagtccagaaggaatgttctcatctaatgtgatctcaggctggtctgttccatcctctccaagggagatgttcacctgctgagaccggcactgcacacaattagtaggcccttatctcaagcaaattctacccttaaaacaagtattgcaactcccatttgccagtgtggcgaggggatagcttcacaaacacttcaactttctggcattgatgcacccatgatgacagcagctcattaaaaattcgtagttgctgaaatatccacctgaactttgcgtcttgtcagaagggaaatagcccatgtttctgcctgcgtcctaccctccacctctttctccccatctcagaaggcagggaggtgtgccgccacatcctgccacattcctgttggtcatggccgcagtcttccttcttcagtgcctgtcctcactgaacgtacctggattaaagactccgatgtccaaaggcctcaggcctcacgggggtcctgagaggcactctttcgatgtcctgtgatggtgcagagtggcgtttggacaggctttctgaatctaaattgtattccttgcaggttgcacttcagtggataagtacaatttaagccaaccgttggcaaacgttaaagttgctttaaaaacccaaaggaagaagaatttaggttgtcaactgccatgtgttctgcctctgttccaggtcctgcggaggtccctttgagagctggttcctgttcattcacttcggaggatgggctgagatggtggcagagcaattactgatgtcggcagccgaaccccccacggccctgctgtggctcttggccttctactacggcccccgtgatgggaggcagcagagagcacagactatggtgggtagcaggccccactgcatgtgtttggggtgggctctggggggctgagaggagcttgcagagaggggctctgttgtgggcttggcttccatgacacctgagctctgcccacagatggcatatgtcatggcaacctgcaggcatggtgatctccagccttgtggtcagaggcgttctcctgtccccaccgaggtggccagagacgagacgctgccagcccattctcctgcaaaacgaagacccttcttccccaaggtcatttgatctgttattgctcagctgccatatctgccccagggtcgcgtcctccaaggcgtgccctgcagaggcgggctgttctgaggggtgtgccggcagcagagcctggccacagccagggccctgtctcgctccccagcagcccggccagggcttgcttccatcttgactgtctcctttcttggatcagtcaacagatcctcacattactggctttatttacatctcttactaaagtaatcagatgatattaaccactttgcttctgaaaaagaagttggtcatttcctaaataacagagcagctaagtatgggactggataactgtctgtggcaaagacagttgttattttatgtggaatataataattacaggaagcaatgctttgattaaaggcattggcacctcccttgcaagcattgatttgctaggttcttaaaacttcaactgccagtgctctatgctgatcttagtagttaaagaggacaaggctcattttgtatagagccctgcttctcttggctttggcattttctgttgtttgaaaacacacagactaataaagatgtctgcgtattttgtttaaaggcttgcatggcataggaaagaaaaatagttttagattttaaaaagttgaaatttggtgataatttattttggatcagaaataaagctttgtgaaaaaattataacccacgtatgtatttgaggattgctgtctgattaaaaagaaagctttttatttcttcccctttaaaagatcacgttaaactaaggaaaatcctggttgatgtttttaacagtaataagatgtacggggcacatatggtttttaaagcccttttatattctgtcttatttgattctgaataagctaagttggtagatatgtgttcaattccatcacagtcaaaaggttactgacagagaatcacttttgaagtataaagaaataaattattcaataacacttaatttctagaaagttctacattggcacatcttctactagctaacttggtccttttttatgaaaaaataaaacccttgcgtagttctccctcaggggatgcctaggattttggatgagaacgtattggctcaatgtgagtggggcagtggcaggcatccatttcccttccccccattctgtcacaggtgcccatctgcctggcagttcaatccagtgctcatgttggtgactccagagccccttccttgctggtgcctgcctgaggcattggtgtatgtggcgtcctgggaaggggattttagtttaatgaatgatacgtacctcttgttttcctgggttttgtgagctttaatcccttgatggtctgttgggaggcttgagagacaaactgtgaactgtgttagaaagcatgattcgtatgtgattgaattgaaattagcagtatctctgcatttgtgcatttacttaaaaaggcacaattaaatcagctggtggcgtatccccgcatcgtgtgctgggcctggcgtcactgcctctgtggatgtccttgaggtgaagaacatgggtgcaaagaccaagcgtgtccccgcccaggatgtgtcctgcctgtgagaaggcctgtcccactcatgggcaagccaccctttccaccagcagccagagttcatctccttttgccaacaactgaatcagatcacaacaaaataaaaaaaagtcgtttagatacccttaagaatcagtaaggtacaatgatgcctagagaaaaaaaggaaaaaaaaaaatcaggcaagggttcataccctttaaccctgtggttccacttctaggaattaccctggggaatagagatccatgcaaaggcttatgtataagaatattcagcacagcattgttcataaatacaacaatgggaaatggcctgaactttcaatagtaaggctactggccaaataaagtgtggtatatcctaaccatggaatagcattctgttacataccatgaaaaatcatgctcttggacgggtgtggtggttcatgcctgtaatctcagcactttggaaggccgaggtggccgtatcacttgaatccatgagtttgagaccagcctgggcaacatagacccctgtctctacaaaaaaataaataaagaaattagccaggtatggtaatgtgtgcctgtagtcccagctactcgggaggctgagatagatggaaggatcgcttgagctcaggaggcagaggttgcagtgagtagagattgcaccactgcattccagcctgggtgacagagcaaggctctgtctccaaaaaaaaaaaaaggtcttgaagagcatgttctatagatacagtgaactgaactgcttatagtacattatggagagaaaaatgaaagatacaaggcattatgtgtagtgagtggtatggtctcagtgcgtagaaaaaagacaagaagtatataaaccgaattattaacagtgagtctttttggatggtagagttatagatcattttaatggttcttctttttctcttttcaaattttccatagtaagcatatatgtctttataatgcaggataaaaaatactttaaaaagaaaagaaagcttttatctttctcctgaaaaacttaggacatgtttaaagttagttatcggtgttcaagtggaagcccatgagcatggacggcctctgaagggaaagacagtctgggccagacataaaggaagatagaccccatcttagggattattggacaagggcagaaagtcggttgtgggtcaagagaaaaaacagatataaaggcatagcctcctaaaccctgacatttttgcagacccagttagatggcagaatggccttgggctcccgtagacaccatcagacccggcaggctgggccggctgaggggcgaggtggggagagtgaggcctgccctgctggagcgctgccgctccccgtggaagagcccgatggtgcagtttctcacggtcttgtattgtggtcagaggagctcacacaacacacccagtgtactggagtttatgacagacttcattgaatgaggccttgacttccagggaaaaaaaacgcctcacacaaaatccataaaatcggtcatgggaattctcagaataggcctaagtattctttcagaagtgatggaacatagctgttcacgagttccatgtggcatttggagctatgggctttcggtttttgctttgctttgttttccaagtcacgactgggtgtaccattcttgtagcaagcagaaacatctcagcatggaatgagtattttttatgcaaaagcaacctgcagacttataattaccattattatgtgggttccacagacttgtggcctctgcttgagcattaaacacgtatgaacagattgttccggcatctaaaacaaatgtgttcttgtgtgtgcatgcatgtgtgtatgaccgtgcttgtgtacacgtgcgtgcatgtgtgtgtgttccccccgaccccccgccctgacccccaatatagcaagaagcaaaggcaagcctacattcgtatgggaacactggctcggcggaggtctgactgcgtggggctttaattgatttgtggctgtgataggcgagtcttcaaggagccttttgttctttttcccacaatataaaaatctgactacattctgttgagaacttttctctgtttccttttatacaaaaaaaggtcagttcctggcatggtgccctgactgcttggtgagcaagacgaaagaaagtcaagaaatttccattccgcccatttgggtttgtgtgaaatcgagtgtaaattcggccgctgcctagctccctctctcaggggccagtgcttacccgtttctgggggttgtttcaaagcaaataaataaatcctagaagtatgtctgtcctgcctcttcctaacctctcccctgtgaaatactattgcccaggtccaggtgaaggccgtgctgggccacctcctggcaatgtccagaagcagcagcctctcagcccaggacctgcagacggtagcaggacagggcacagacacagacctcagagctcctgcacaacagctgatcaggcaccttctcctcaacttcctgctctgggctcctggaggccacacgatcgcctgggatgtcatcaccctggtaagtctccctgtggtccagcatcctagtactcatttctgctccaggcgagaggtgggttacctgtccgagggtctggcctctgcacagtgtgtgtaccaggatgctgcccagcacagataaatggtcaaggaggttgacagctgggatggaccccagagcctgccccttccagcacctttatgtcatagaagagaaaacagaggctcagagacaggagatgccatctcctgggcccacggcttgctgccaaagcctgcggtagaagccaggtctcctgtccccctacgtacatttctttccatcgcagtgtgctgctctcctcctcctcatggaaagaagtaaggccacgatgagaatgggctcgcaaagcaaccacaatgctattcactgcaacagtgcaaagaattctgttaatctttaaaaaaattggtttattacaaagaaatccttcctgaagcccacttgacttgaggggtaaaaaacggtccaagtcaaaagtgagcactctttgtgacattagatttggcaatgatttcttggatatgataccaaaggcacagcaatgaaagaaaacaatagataaattggactttatgaaaattaaaagcttttgtgcatcaaatgatactgtcaagaaagtgaaaacacaattcacagaatgggagaaaaatatctggaaataatatatatgattagagtttagtattcagaatacataaggaattcttataactcaacaacaaaaagataaacaacccaattcaaaaatgggcaaaggacttgaacagacatttctccaaagaagatgtacaaatggccagtaggcatgtggggagatgctcacagaaagggcatgagtggtcagggaaaggcaaagtgcagcgagatgcactgcacagccatcaggatggctgtcagcaaggagagaaaagaaacgcccgtgaggatgcgtgggaaccggaacactcatatgcttcccggtggggacattaacgtcgtgcagctactgtggagaagaatggggtggttcctcaaacagccaaacttggaattaccatgtggcaggcagttctcctaggtctataacccagagagccgaaagcaggggctggagggccatctggcccagtgctcagggcagcactattctcagcagccagcaggcagagatggcctaaacgcctgtagagggacaagcaatgcaccgtgtgatctgtacccacaagagagtactgttcagcctgaagatggaaagaggttctgacagtgctacaacatgaatgaacctggaagacactgtgctgttgaaataagccagaaacgaggatgttgtatgagtcacttaggtgaggcacctggaagagtcaagtccagggagaggaagtgctagagtttcccaaggcagagggtggggagtcagtgtggggatcatggaaaggggcaggagacggccagtgctgatggctgtgcaacactgtaaacatactgcatgccaccaaattacacaaatgggtaaaacagcacattttatgtatattttaccacaatttaaaaaaatactcatctcagaaaaagcaccagcatgctggctctgggagttttgttttattttttattttatttgtacttttgttgacatatacatacagaaaatacacagcttgatgaatttcacaaaccaacaacacctgtgcagccagcagccaactcgagaggaatattcccagtccccagaggcccctcctgctcccgtccaggccgggcctgactgaaacgtgaatgtccatgtacagaaagtccccgtaacatgacccacctgccaagaaccagggccaggagattgtctccatcctggtaggacagtcctgtggagcgggcccaggctgtgcctcccaggtgctggtgtctcagctaagacgaatccgagtcatgagggtggcccagggctaaagacgactggctgccacatgccaggtgccacctctttgggcccggccccagcacagcgagaatgctttcgagaatctattgtgtactcttataaaatgcacacctgcaacaatgcggcccaacctagagggctttacactgagcgaaataagccagacgcgagagacaaatgcatgctctcacctatgggtgggatctaaaaagtcgaactcacagaaacagtgggaaggtgcttatggggggctggggaggggcagtggggagatggtcagccctgccctgtgacaaggacaattccagctcaggcacttcctccccaaccctgtggcccgtgtgagtggagaaggcttagcagcaggggtcagcgtgggagtttggtgactccagccctgccgacagggtgtgagagaaaatcacccagagcaagcaccctagagacacccaggtctctgcttcagttatcctgatgccatgtttccatctactcggaggaaactttcagtccacattcaaagcagatcgccctcaagactgggcccagagacattgctgggagtaagccagatgctgcaagggccagcctgcatcctgtgtggggcagtccctcctgacacgtggttcagcccctgctgcggatccacacgggaaccctcaggagcacagagggccccagtgctttgtcatcacatcccccaagtcagttccgccacagagaagacacacacagcagaagcccattcccagagcagacgccagtgtggcgctcatgcactgactctgtcagggacggatgctggccatctgggcacccatcgtggtgaaagcacctcctgggggctgtcctttcggatgttttgaaaccatctttattgacacatcagtcttcctaatgagaagccttcgctgcggtggccgcgtggcagggagggcctctggggaaggatccctcccaccacccctgcctctcctggcctttgtcagttcctctgccgacagcaccttggaaagagccgggtctgcttggcccacgagcaggtggtggccagatggttgctttggtgggacggcctttccctcctacagcttgggtctctccaccctcaggacctagcacgagcgcagccacctcccagctggtcccaggctctgccctctatcttggcatccagatttggagagcagtgccagctcaaggcaaaggccactatctctcttcagagcccttgcaccctcttggagatggcttgagcgagtggctccatctgacctaaaggacgcactggtcctgcagccccatctgcccacagcctgcctcctgtgtggcctctgcagtgagctctgcgcagtgggctcttctccaggcacctggaggcccactccccggctgtcccggaatcctcttctctgacctcggccctccgattttccccagaacgccatccatgaggccctgcccaacgtccctgcggttctcctgcctctctggctcctggcctctcgccaggcactcctctgccttgccccagccgtccacttgctccctcacttgtgcctgcaggaggccggcacagagcagaggactgcatggagtccacccctggggctccacctcctgtcctgtcctggattcacacttctccttctcctgcctcctgctgctgggccacagcaacaacagcaaaagttagctagattccgagatgcagagttcaattctgtagtcgttgaactcaaaatgaattgaacccactcttggtgcaccagccaaggccagcagggaggcaggttttccaggcggctgcagggctgcgaatttttgcatgtgactagagagctgggaaggggcccacccaggagtgttggtgtgtaaggaagatgcaaggttggatttgtaatgacaactcggcctttcttcagacatggccaagcccatcagcatgggcatggccagcccctgagcgggggacagtcctcccgctcagggtctgggtggtatattaactgaaaggggtccacagcaggctcacattgtttccttgatgaaggacaggctgcatctaccgaaggccatcagcactatgtgcctgtcatttctgagtaaaaaccaagtgatagcaatacagacgcccagggacacactggcatgtgcctgggctacagccggagcccccgtgctggctgcactgaccctggcgggctcgttgcaggccggctgcaggccctgtgtgctgccagcgggggccgaggagagcgaacgtcatggtccacaccacgtcgtttactcttagctctgcgtccccacgctgccattcacacagtgcgcatgcgacaagaggctccctttagtggtggtcaggaggtggaaggcccagttctgaagggtgtcctgggctgtcggacctgaggcagtaaaaccagaatagtcctgggaaaaccaaggcagttgttcaccctcccagaacggcccaacccttccagaggaagctgaccttgggctgctctggctaattaaacatttgcgggttctgtataaactgacacacactaagtgaatatatcggttactctttcaaaaacttaagccttcttaatactgcttgtgcttaaagaaccataaattccccacacagctaaattgtaagattctcacccttcccttttttcttaaccgaagtttttaggaaaatacttacaggcaccaacaagtacgaatgccttgaggctgtgtctcctgctctcccgcaagaatcaggtgttaaaaccttagaggcctattaaaaagcaagtaggtccggttgctagcccagggatgccaggggctgtttctgtgaaaacaggtggtattttccaattctcatgttcgtgtgagccttttgcagaaagtcaagccacagcatgctcatttgcctttgttccccacagtggatcatcccacaacttgtgactggcattctgagaagcacttctgattgcaagcagcgcttgtttgtggcctttatgagtctaaggctgttggcagctgagctcaatgcgaggaggctcgttaggaaatggcaccgctcactgtgtagccagccttggagacagacttgctatgctaatcaccttgcaaactagagcccctgatgctttactttggaactgatggaaatgctggatagggcttctttcagggactgggtggttatggtccgtccctggacaaaggacaaatctgtctggaaagtgttttaatttgccttctcttctgtcctgattgcagatggctcacactgctgagataactcacgagatcattggctttcttgaccagaccttgtacagatggaatcgtcttggcattgaaagccctagatcagaaaaactggcccgagagctccttaaagagctgcgaactcaagtctagaaggcacgcaggccgtgtgggtgcccggcgtgagggatcaggctcgccagggccacaggacaggtgatgacctgtggccacgcatttgtggagtaagtgccctcgctgggctgtgagaatgagctgtacacatcttgggacaatctgctagtatctattttacaaaatgcagagccaggtccctcagcccagactcagtcagacatgttcactaatgactcaagtgagccttcggtactcctggtgcccgcccggccagaccgtcagcttgataattactaaagcaaaggcctgggtgggagaacaggtttctagtttttacccaagtcaagctgcacatctattatttaaaaattcaaagtcttagaaccaagaatttggtcatgaaccattaaagaatttagagagaacttagctctttttagactctttttaggagtcagggatctgggataaagccacactgtcttgctgtatggagaaattcttcaaggggagtcagggtccctcaggcttcccttgtgtctccctggacctgcctgacaggccacaggagcagacagcacacccaagcccgggcctccggcacactctttccactctgtatttgctaaatgatgctaactgctaccaaaaggcccttgggacatcagaggagccggcaggcgaaggtagaggatgtgttccagaaacattagaaggcaggattaattcagttagttagttctcttgttaaatggaaatgggaattggaaattcctgataaagaattggcctggctgggtgcagtggctcacacctgtgatcccagcactttgggaggccaaggcagggggattacttcagcccaggagttccagactgcctggctaacatggcaataccctatctctactaaaaatacaaaaattatcggggtgcaatggcatgcatctgtaatcccagctattcaagaggctgaggcatgaggatctcttgaacccgggaggtgggagttgtagtgagccgagatcatgacactgcactccagcctgggcaacagagcgagaccatctcttaaaaaaaggcattgttagtgtaatctcaaggttaacatttatttcatgtcagtacagggtgctttttcctttcagggacattctggaattgtattggttgtacattcttttgtgtctattctgtttgtcaagtgagtcaagacttgcttttgtccattttgatttgtgtgtattagtctgagtcttggctccgttttgaggtatgagcaaagttttgctggattagaagttaacctttagggaaattccttattttggtatgtggcaatgctaatagatccactgaagatctggaaaattccaggaacttttcacctgagcctttcttctgagaaatgctgcagtcagaagggtgtgctggtaaagtattttggtggcagctgccatcatggtcattgccttcatataacatgcttcgtgctcatggtcattgccttcatataacatgcttcgtgccatcatgatccttgccttcatataacaaacatgcttcgtcagaggtgttggggttgaaaaaggagctgcatgcttcactggagttgagggcctctctcctgttctgactttaagccagaacttgtggctgggccatggaagctgtgactcctctgtggacatggtggcagcagggaacccctagagagaggggccactgggaccaggcctcctgttgtggagggactcctgggacagtcctccaccctgtcctgtggtcctgtgtacagggttggcctcttcctcctcccctgccaggcctctgcccatgccccttccttccttctcctgggactggtgaagctaggcatctggaagacttcttcctagcctggaagccctgacctcggcccatctgcagaatctcccagttccttcacagctgccgagtcctctcacgggtgcggtggaggcggccttgccggtggtgctttctgggcagccaggggttcctgggtgggaggactgtccctctggggacgtggcactgaagtgcctgctggcttcatgtggccctttgccctttcccagcctgagagatgctcaaaggtggggagctgggggagccacccctcggccattccctccacctccaagacaggtggcggccgggcaggcactcttaagcccacctccccctcttgttgccttcgatttcggcaaagcctgggcaggtgccaccgggaaggaatggcatccgagatgctgggcggggacgcggcgtggccgagggggccttgacggcgttggcggggcctgggcacaggggcagccgcagggaggcagggatggcaaggcgtgaagccaccctggaaggaactggaccaaggtcttcagaggtgcgacagggtctggaatctgaccttactctagcaggagtttttgtagactctccctgatagtttagtttttgataaagcatgctggtaaaaccactaccctcagagagagccaaaaatacagaagaggcggagagcgcccctccaaccaggctgttattcccctggactccgtgacatctgtggaattttttagctctttaaaatctgtaatttgttgtctattttttcattctaaataaaacttcagtttgcacctaatgttgtatccattaaatattacaatccttctctcaggaaaaagctcccccgatggccccagacagtggaagcttcgggcctcaggaaacctagatgtgccctggaagagaccgaggatggcttagcctctgggcctgggaaccttgctactaaatacctaaaaactaagggtcctgtcaccaaggaggaagcaggaggacaagggcaggcatctggcagggcctgccaagatcaggttacatgcgtttcatatctgtgttttctctaagccaggcttgaccataagcctcacttgaattgttctgtctcttccctgatccctgaagctgaaggcctcgtcccaccagcatagcccacccactcttgctcgctccgttgcttcacaggctgctgtcccctcctccagccccacaggcccctctgggaggcatgagtgatgcggccaaggcgagcagcgccgtggccacccccaggacccccactgcagtggggtttccagcactccccatgcttccggctatgggacactagggcccctctcggggtcaggagggcgcctgagggagcagacaggaaatgctaagacactcctgaggagcctctcactggagcagccatggttggcagggtttcgtggtttgttcttcaccctgtcctgcctggtgtctaagtggtgggacaaggtgctaggacagaaatgggagctaggacagaaatgggagctagtccaggggatgggaggaagccgagttttctgttgaagtggagaagttacgaatggggtcttgacagggaagccagagaagaagggaccttggtgagcctggcagagtgaatccacccaaaatgctgggaagtcaaaaccgagcctggccttacgctgcccagaggacggcggatgcactggaggatttgcacagtgggagcaaatgtgaggaatgttctccttattcaacaaggaatccaaaatttttttgctttccaaggaagaagagaaacagttccccgtgcttctcccctcgcctttttcttcctctgtttccagcccaggaccacctcccccagcccgggggctcgggtgctaaagttcttccctctgccaaatgttgggaaatccgtagattttgtcgaaaaatcctaagtcattaatcatcgctaagccattttacaaccaaagaacaaaaattaagatacagtaagtacataacatgtcttcaagcctcctcctaaaatccagtttcacaattggtttataccatgggtccaaatcacacccctcaagcccaaactggtaatggagagctcatagcaaaggccttccctcccgctcctgtcatggtgtcttactgcacttgctgttctgggcagggaatttgttcacccaggacttttggttgcaagcaacagaaacgtgcactgaatgctgaaagtaaaggggaactgatgaaaaaggtattgggctgatgaggcctggtgtgagccggccagcagcagtcccagccttgcttcagatgctctggcaaggccagtcgtgctgcccagcccttccggaccccactccagccgggagaaaggcccttgtgcccactcctttccacacccctgcccaggtgcatcagatggaggagcctgggtcaaaggcctgccagggatgctaggaaatcacgcatctggcttcagcttctttaacgttattgggtaccttggataccaccaaaagcatcacccaactacaggaaggggccaaacactgggcaaatggagacaataaaaatgtctccagctcattacagcatctatactttagcctatgccagagcattttagaaggttgcgtcccatgaaacagcccagcagccagcaccagaacaggcagaggtgagccttttcagaaagatgttttgtaggcacctaaatctgggtttcttaaatgcagcaccatgagcactttggaccagatgcctccctgttgtgggggtgtcctgtgcactgcagggtgt

SEQ ID NO: 15843 - DNA, 38326 bp, Human
attgatgccgaaggggaaaggaagcctccgaattactgccctgggaaaccactgttagcaaccatgatctagaacactctggaatgttgttaaaacccttttattcatttagtccattcatttagcatatatttattgatcatcccttatgtgcactctatttggtattggggatctaacagttaactggacaggtcaactgcactggtcctttcctatcataagggtagtgaagataagatagggatgtgctcatgggatgttgtgacttggagttggctggggctttggctagagcaatctcagtggagtactggacacagaagccagatgacatgaactgaagggtgatgaggaaatgagcaagtgggttcagtgagtgtaggtgacagctggagtggatgtgaggccaagaatttttttctttgatggaaagggtctagtagagaaggataaatgtgcatatgggagaaggggaaagactagaggagagagaagcagagatggcctggtctgtggagtatgggccttcattaagagcatgggcccttcatccattggcacaaaacagaagtccggtgagtggagccagatggtgagaccatgggtagatctcagtgagaggggagtcaaggtcatcagctgggaggaaggtggagaagtgagagaagtctgatggtagaagaggaagcatgaaatactcatcgtggagagtgaaagaggaatggacagtgctaatcctttaaactttctccctaccatgccttctcttccaatatgctcttcagctgcccccttgccctttccttccccttactacctttcctacttctcctggcctcagagactcagaacatcctagagagtcacagctttctgtgtccacctgctttgtgatcaactaactcatcactttattgtgctcgcggggaaatgggcccagagaatgtatggccagcccaaggccacactgtaactaaatgctgagctgaccctcaaagcagaaattcttaactcttttacttctctgccatgattctcttgttctgtcttcatccctcccacccatggatccctatgttaggccagtcattctttcaacatttagtgagcactctcacgtgctgggctccagagtgctcatattttagacaagaaaaaaaaaaaacgagactacatgtaattctactacaatgtgatccacgtaataatgacagagtaccattccacttgtgaggggatttgctcagtgtagaccttgggcaattgaataagaacccctaggagggcccctccaggtgtacataaaggatgagtaggactgttccaagcagggaaaagaggaagggagttccaggcagaaggagagcctgagaaaaggcttggagtcatgaatatgtgtaaagcacggctggtgcacctcccagttaggagtgagggctccagagccagatcacctgggtttggatcctgactttgctgcctcctaactgtgagcccttgagcaattcatttaatccctctgtgcctcaattttctcctcagggaaatgggatgataatagtacttcatagggttgttatgaggattaattgagttaagacaatgttcgctatgatgacaatggtagtgacaaagttatgggggtgtgtgactgctacattatgacattcctggtttcctggtctgtctccaccaccaaataaatttcctgagctcaacatgagagctggggcagagtaagtgctcagcaaccattttctggatgaataaatgaatgaatgagtggctgaaaagagccctgaaaacctcagagccaacgggagtagcatgggctggggtctggatgggtaaacccgcctccttcattggttccctccacactgaccatcctgtcctagagctcaactctgctccatcatcttcagagagaagctttgcagcaatctttcgaggaaggatacagctgtttcacgtaatttatgctttattttttctccctcttctctttctaggaaagaacagctggaggcagcatccaggtaagtttctgattatgaattcccttcttcacatctctgtgtcaagacagagcatcctgctccatatggtgtagggccccatgggaggtcatgctggtcccaagatagagtctttggggtcacactgttgctgaccaccatagtcctctgcctggtttccttctggttgatctgagggaaacttaataggaatcatggcagcagcctcttattgagggtctgggttctgtgtcaggagttctgcatatgttatctcatttggtcttcacaaccacaatgtaagataggccctaatatcatcccttgtggatgaggagattgtggctcagagaggttgggttgagattgagtggcaagaccaaaattcaaagtcaggtgcaaatattaagaccatgttattttcatgatatatcatttcatctgcttcttgggctcacagatggtaagttgactcgagactgtaattcatgatcatcatgactgtggaggtttcccagtaaaccacatctatctatatacctatatgacatgtagaaaccatttttaaacgattattattgaccaatcatttgtgagtcctcacaatcaatctcctggacactaagtccaaatgctctcctcctagtgctgacagaatttgggcagaggaggtgagaggaccctggactaccttataggggagccacttgagaacagtggcctttgggaggccaagtcaaatcctcccaagtgtttccatgaagccctatccacacaaaatcccacttggaagagacaattactgacagtgtcagttctgtttcctttgggtgtgttttcaaatgaaccacgtggttctttcctggacccacttgggactgtaagggcctttgaggagatcgtaaaggagggttaggtgaatgacagtaatggtgtcaggacattcactagagaatcttcagcagctcgtggctcccagaggcagagtgaaaggacaccacagagatctctgcagataattctatggaaaccaaggtccctggagaggacaggctcatcccacatcacacaccccataagcaccaggagtagatgatcaaggtctcaagactcccaacagggtgttctttgctttccttctttcatgaccaacagggttataaatcgtgcagattttgacactgcaagtgaattattaaatctacctttagagccttttctatacagacatgaagaaaattcattgaaatctgcattcaaatatcactgtgccctggattcagcacttccggtttaattagggctcagatagatgcattttgaggctttcctggggatgcctccctagaaaaggggcttctgatatcttgtaatcaacttgctcatgtccctttcaagaaccccccactctgccaagagcacagagggaaaatctatcccattattgctgggtgtttggtggctcacccacctcagagaagaagagcaaagtcattatgtaagtcactcagtctccttcatccagggttgggacagagtcagactggctgatgcattagcagttgagatgccaggtgtgattatagctgcatagcctacagatggaaatgagacctggagatgggatgcaagaattgccaacagaggaatcaattcctttacgcaggaggcggggaaccaagtgactacagaatgtcaggaatgtatgtgtgcattagggtcacacttgatggtatgcattttccaccttacaatagcttcttcaacaggccgacagccacctggtgttccaaccttcctttattcatatttcttttttttttctttttctttttcttttttgttttttgtttttttgagatgaagtcttgctctgttgcccaggctggagtgcagtggcacagtctcggctcactgaaacctctgcttcctgggttcaagtgattctcccgcctcagccttccaagtagatgaaatgataggcgagcaccaccacacccggctaatttttgtatcttttttagtagagacggggtttcaccatgttggccaagctagtctcaaactcctgacctcaggtgatccgcccgtcttggtctcccatagtgctgggattacaggcatgagccaccgggcccagcccctttattcatatttctaaatagagtcagatttggagtttatcttatcgcctccttctagcataggtagcctatacacttgtttatttgtcaggctgatgaaagaattatattctctgtaacttaacatgctggtgctatattggggataagaaaaatgactttccagtcaggttattggaaaaagctcaagtccatatttagttataaagctatggctttataagggctgtcttgaatgttttgatttacgtggacttgtctgtggaacataagcccagctgaattcttacaatgactgggaggttggctttgataattttatgctaagcattttacatatgtcatcttatttgattctcatgaaagtgaaggcagctgacaccctcccatcccttctcacctagtttagatgcccaactcatgatgccctgaggtaggactcagaacttccctaataaagcatatatactttataacgctcggcccctagtaagcccacggtagaagttggctcttttctttctgattaaccttagaatcagaaagcctgagaaggaagcataaaattatcaaagccaacctcccactcattgtaagaattcaactgagcttttattcctcaaacaaatcctcataaatcaaaacagtcaagacagccctcataagcgacagctttataactgactatgggcttgagttcttttcaataaactgatttgaaagttattatgtatctatacaaatataataaggttcttattttatatatgacataaatataatacatatttacatatacacctgttaaatcctctcttcctctctagaccatgagctccacaaggctaatactctgcctgaagtgtaagatgtaccccacatgtatttgctgagtgactataaaaaatgacctaattcagggatgagttgtacctctgttttacttatgaggaaattgatctcaagcatttacataacttacaactaagtcaaacactgaagatggaccttgcagatgcatagggagtccattagccttcctccgcatcagctggactctgcctgcaacacaggtggctgtcatgcccttgttatccatgagtgcagaatgacctcggctaatacaatggacgcatgatctcagctcttgtcttccctcagccagaaggtcttatctcacattttatgtagccccctccttcacttcctttgcaagcctgcctaatgtcacctcccaagagagatttttcctgaccctctgcccctgaccctgtctctatccccatgatcctatgatgattgcctgttatatatattaagtcagttgcctccaaggggctaagctcttttctgttttattcgctgcattatctcctacacctgacacagtgcctggaacagagcctgacacatggttggctttcagtagatattaactttgtgagacagtggatggatgaatggatagatggatggatggatgaatgggtggatgatggatggatggatagatggatggatggactcattattctacaagtgtcatagtgttccacccaacttaaactgagggaggtgtactggttcacataggcagccatcagagagggtgggaacccctaagaaacaaggactgggaccccaggattttctctctttatctcttatctctgtttctctttttgtgataattttactctcagccgactttctccatatcagtgaagcagtagatactaacagctccaaaatcacatatatttcctctctcttctgtccacctacccttcaccaaacaccagtttctaaaatcccagagaagcactcagattgacccagtttgagttacatattcacaccctggacaatctctaccccttgaagagtaaaagccgctactgtctaagctctggaccagatttccacctgttagagtgagtgggtgtggtgtaagatactatacttagcaacccccattagagtcacatgattgaagtgggatactcagttcttgaaaagaatagggcccttttttcctcaaagaatgagggacgaaacatcaagtagacaaaacacgataattgttcattgcaggcataaattctacctgtaagttttcaaattcctaataataatattgcattaaagaacgtgaacagttaaccatattaagactggcattttgtgttaggtccatcattttgaacagcaataataactattcagtagacatgcaacagtgctgataattatggacatctttttgatagaaactagcattttttaaattctcaaaatagataactgtgttgacagcagttgcttgcctgagcccagtggttcactctgtattttctaccaattcaatctgaacagcagccttcaggaatcttctcctctgtattcatatttggagagggaaaaaaatctgtcccaggtaccatctttatttcctatgtgatgattatgtctttcccactacagagtggtcaaatttagtagagaatcattctttggatcaaagaatccaatagtaacttacaaagaatgctgactgcttccccggcatagttgtaagcacaactcttcttcataaccaccctaagagataggtactatttttaatccccattttatagatgagaaactgaggtcagatagataagtgacttgcagaaggtcacaaagctagaaagtgcaagagcaagacttggatccagttggtctagctctgtagttcatggttcctaccactatgctcctccttccagctgttgggaacagttacctagtcagtcacagcaggtgtcccttttgctcgttctgttctcttctaccctttcttggcccacctagctgaagtccctgacacaggaggaggctatagaggcaagaaaaggcacagagccagggtcatctgtggtgtgaaagaacatttggtcagacactataattcacgctttgccttctccctgtgacatcagccacatgaaatttatctcacagagtcatgaacaatgttggcaatcaaacaccttccatgcttcaaaatcaatgactactaaaggtaaacatgaatttagagctcaatcaatccaatcccctaattttactgatgaggaaattgttaaccagagcaaaacaaaaggcttgaacacaaccccatagctattagtattttctcctgctatccagaccctgcaacattatcccaggctgcagagtaacagatgcagaggtgagatttggaccaattttatttaacctcagagggatcccagatatgtcctgaagacttagtctcagttttcctcttgggataatggggtgtggagggctatgtaattcccctctgaattatgaaccaattaagaaatatacctagaagtcaaaggattaaaacacaggttatcagacaccgcatgttctcattcataaatgggagttgaacaatgagaacacatggacacagggaggggaacatcacacaccggggcctgtcggtggatggggggcaaggggcaggagagcattagggcaaatacctaatgtatgtggggcttaaaacgtagatgatgggttgataggtacagcaaaccaccatggcacatgtatacctatggaacaaacctgcacgttctgcacatgtatcccataacttaaagtgaaattaataaaaataaaaaaataaaataaaataaaacacaggttacattttctgggtaaagcaaggttggctctgggggcaacactcctcaccaagtgtgtccttggaaacagcacagggacagagcagacactctcccagccagccactgggcactgagagctagagagagaaagaccatatctgaacactgacatttaatacagaactctcccaatcaaagaacatgggtgaatggctattgcacacaccataacccagttggataattcacctccttccatgtagagaagctagtagagctatcagcttcttccaaattcttctgaaagtattgacattgcatttttatgacttcaaaaatagggaaaagatggtcctccttatggttcatgtggccttctctctacctatgagcatggtatcccttagcacacaagaatgtgtctcggctccctgacttggcttcatcagtctgaaaatagaactttccactaagtacattcaccaagccctcatttgctattagatttctacagcagccataacaaattgccacataatgggttgacttagaacaacagaaatttattctctcacagttctggaagctagaagtctggaatcaaaatgttgcctgcccatgctccctccaaaggctctagaccagagtcctttcttgcctcttcctagcttcaggtagttcatgctgatccttgggcttttcgacccattcctccaatctctgcctcccactttacatggctttcttccctctgagtgtgtctgtgtcccaaactccctctcatttctcttataaaggcaacagtcattggattacaggcccaccctaattcaatatgccctcatctttacttgattccatcagcaaagaccctatttcaaaataaagtcatgttcccaagtattgggttagcgatactacatgtttgtgtggggcaacacaatttaaccctctgtgtttgccaaaaacaagtgtggtaggttgcatatggtgggaacctgtctcagcagatccaggatacatgactttgagatagatatttatgaaagatttagattgtattatccccctacaccactggggatactagggattagcaaggtgaaacaactcacacaggggctgagatttgaacctgtgtctgcctggatccctccagatctatggtcatttcttctctttaaccagggaataaaaataactaggtagtagagttaggaggtagtcatagccgtagggactgaggacagagtccagagtcagactactagacttcaaaacctggcttcccttgtaattagctgtgtgctcttggcaacttatgcaaactttctgtgtctccatgttcttgtctgtggaaatcataataatgctgaccacatgggctggctggaatcatacctatcatgtcttgaagagagctcagcctgtagtaaatgctctcttcaagacatgataggtgctcactagagatcagtgctgatcaactggtgtattattcagacaagagatttgggtaaatggagaaaacatttcttatgagaccggaagaaaataatatgtcgctctccacattcacatcagtgtcattggagtaccagctgcaaatgtcctggaatcatcctcatagatcctcagactcactggattagagggaaccaaacaggccttcgagttcagcagaactaattttgcaaacctgtttaactgagagaacccaattaacacatcagagttatttcaaaataatgatgctgttccttccaatccagtggtcagtccaatcacaatcctgcttcctccttgctttatctgtccttccccttccccagagtagccagtcctttgggaatcacctgccacctgagcccaaggtcccttatctctagaaggcagagattgagctaggtgatttccaagccgcttcaggtcctttgtgctataagtttccagccacaatagtagaattggaaccatgttgttttgccacgttagacgttgcacgttacagattacttttaataatgttggctatgtgattctgggcacattacagacttcactgtgcttcagtttcctcatctatatgatggttataataagggtacctatctcctagggctgtggtaaggattgcatgcttagaatagagcctggcccatggtaagtattatttaaaggtttgcttttattatcattgttatcctgatttgcaaccatatttccaggttttcttggcccggggttatttccatatggcgtagagctagtttaggagtcagatcaacctagatttgaatcctggctttgcaacacttttctccttgcttccatccatcctttcttcattctatcctctgccttccctaacctaaacactgagcattaagagctctgctttttgtcagccctgaagattctcagggaattgtaactcatatcctaacgggaaaggccctcacaatctgatgggaggagcagatgtgtcagctgaaaagaacaatgtagtgtcgggggtgctggcagggagatgttagagacacaggggcaggtgaaacaggcacaaaggaaggaaactcttaagctctaccagaaacgagagaacagggaagaatccactgaagacctttcttttgtcctctcaagggctaagtagatttacactgaactgaacaaagaattaaggtcctaattttcttccgtccatctttcattctttcatccttcaagccttgggtgcctaggcctgtgatcttttctccaatcacctgattctgttgtaggaaaaaaatgagttcttctcacatgaccaggaaagattaggcatgcaggcactttgaagagtgagaggttacaaaatatattgggtgaaaaggaaaaaagaaaaacaacacagcaaagtgagaggggttcccgttaacaggtttccatctctcagttggaatcccaggtcaccacctaggaacaggagaggccaggctcctcctccctgcaagcggcacaaacttcctgcagccccaccccatcatcccattgcacaggctggttggggattctccagggaccttaccagcctcctgcatctatcattccctcctctaaagaagtacatctaactgccattagaataaggataaggataaggatgaggacagatcttaactgcttcctgttgacagggggtgctgttttgggaaaacggcagtcaaattgccctcaggggcctatccaagggttcccacgagaaggggccattgcccaaggctccagttgcatgactggagtttcatggcctgaagaagagacaaactgagttattagaaaacacgtataaatatgaaataagagtgtgtggtaaggacagctcaaaaatcccaggggcttttaccagtttgtatggggagaagggggcaaaaagcctgattggctaaaaaaaaaaaaaaaaaaaaaaaacttttacccttttgatggtacatcaggcttctgggttcccttccgctgagcctagtcctaagccaaccagcttaaggtttgggacattaacttttcccagtttggaggatccatctgaagggagtgtcccataatacagagacacaattacctatcaatgaagagaggacaggaggaaaaaggaaaaaaaatggcatttttttcaaaggcgtcccaggggttcaggatgcatttgaaaggggtacagactgaagatgaatggctactcatctagaaagaggggaataggtgtccctggctcctttctcttcctagcaaatacctagggtacatgagggagggaaaatgaggcattcctttttctctccttcctccttctatctctgagtcctggtgaccatgaagggtgccacccatgggtgttaaagaggctttcacccatgttaatgggggggggcttgcggggtaggagtatccactattacccacatatgccctctttctcctgctgtcaatagccttgaattacctagacctcatttatgccatgaatactagtgtgatataagagggtgtttttatccatgaaatgggaagcttggcttaatcagcaggaatcagtcatgcttacctgtgctgtgccttttaactgctgttatcatctgcctctggatccctcagatccagttttctttcctagggctttgacccaaagcttggaattgagtttggaacaaaaatgtgtcttggggggttgcatggactccttatcataagctgaatactaaagtgaagctgtggaattgagtccttctctaacaagggagagaaaaggatgtcttatgacacatacaggcagagaaaaggatctctttggatgcatgtgcttggctttggttttctctcttggtcttactttcccaaaaaggaaacctctgggttaggggcactctatttattcctgtcatctggcgggatttgcaagataatggctcagaactagaatattgatccagatttttacattacccatccctcttgtttcttctgagctgcagccagagattgctggttggttcacaggaacaatcagggttagtctaaaatgtaggcaaaaacttttaaaaacaactaatgagttgagaatttaatgacaaacttataacaggttttgaaacataattcctctctctccaatactcatttttgtttaaaaaaatcatgatgggatagagttgtttgcaaaatacattttagtcttatacttggcctgattatttgcataaagtgcagctagaataattatgtctacataggccttttagattggctttgagggaactctgtcccacaaggaatctcagataagaccttttaaagcagagcccagccatgggtttgtatcctcaaatacttgtgagttgggtgatcctctcctcttaaggtcccaagataaacttggaactcctgggcctgttagaaaatgacattttttactgaccacaggtcaggaaccctgtacagggactgtgtaggcaaaggtatgaggccagtttttttccaaggggcttgtattggctctgcaagtcaagcttgactccttaaagagaagaatacccttccagtcaaagccttggtaaaacaaccagtttctacaattgtttcctgttgcaaaagaaaatggattcttattgcagtgatgcaaacaattgtattgccatgagaagagaatactcacaactagtttccaaattctaggacaagcaggcagacagaaagaaacatgctccaaattttgttcacagagtataccttactcagttgttaaaggctgtaaatagttcaaaataagtttccttgactctgaaaaacaaaacaaaacccagcaatattccaagcaaaagtcaaaaagattgctttggttttctgtgagttcattcggttagctcttgttttgcttgatattcatgaacattttagctcttcatgagtcctgtacattttttccttattccaatggcacaatctccaaagttatcagaaacctgtatttgagagtgtctgccaaagttctgtagcttattataaaccgtcttttgaaagagattaaaacaagacaacaattatcaaatgtccggggtcgttagagttagaaacacaattgacaacgaagtttgattatctcatggtatccaataacttaacataaccttaattatgatagcatatacttagacattagaattttagaaatcccatacaattctggaacatatattgatgttattcaccaaaatatagcctaaagaagattgtataccactgtagcaatcccatgtacgtaaacatgtcaaataatcctatttacttctcttttctggatactccagaggccctctgaaacatccaaaaatccagatatcaggaaacacagttttgaaactgaagtttgatttgggcaagcctgttaaatatgttagaggcttaaaacacttgacattatgaaatagaattacatactaccataaattattttgccaaaatgatgactcagaaattttaaaaaagcaaaaaccttttataaccctttacaaattttgctaaagagaagattaatgccttgagaataccttgttgtgcttttattttaatgctcaatttacagaaaaaccatataatacccttttgtatttaatcaatatattcacacatggaattttgtaagattaatttttacaatccttccaccatttgtttaaacttttagctttattatatctaatttaaaacaattatttagccttaggcaagaatttatatttttatgcctttttctaaccttttattaaaaacacattttactgttcttacacgccttgcacataaatctatttccagtagtctcaattacatgtcataatggtaacagttagcaattttttaatgtagaacctggtaatttgttttgattatgtgctagatgcagccaaggtttgactccttccagcataactaagggtgtggttagttccacatgtccccaggccttaccagttgtgaagctggcaaattgaaaagttctcaaaagccaaaaaagcagcctataaccttaaaacatttagccaacctaggatctgacctgcataatttagtccacctatttatattttgatgacatctgcttcttaccaataattattttttataaccaacaatgtttttatttttcaacgattaaagccacgtgaaattaccacagcttttatcttccctttaaaaaatatttgatccaagcacttaccttcttttaggccaattaattaaagatctttttacagacatcacacacacacaacacatatataactacacagacaggcagaagaaaacccagtccccataagatcttttgtttgccaatctcctatttggattattgacctccaggtactattaattcctggggttccatgaagaaaacagaggtctctcccctctcatatgtgcattaaaagtggcaaggcaaaaatggagaaaaatatttcagtcaaccaaaaaaaaaccttttcccagcaaaacaaggtccaagaaaaggaaaacataaagtccttgtaaatataactataacttggataatccacttttaattaaggtgagcactccttaagaaaatccttttaattcccttattagccaactttagccataccaagcagccaatgtttctggctttcaaactttactaaaggctcagagaaaggaaaatccaaggtggttcgtggagggtaagggaatcaacaaaccacaaaagctcacatatcaaaccagaaaggactaattccctaggccaggattgaatctaggccacccaaaggctaaacaaagccctgccacgaggttacaggccacgccctcaaggatgtaaatcaagatggaggcctgcagcaaagtttgctaccagccatacagaaagacgtgcaaagcacaccagaatggctacagcttaagactaacctcacaaatactttctcacatttaaaactctaccaaaaatacagtgatccccatcattcccagcccaacaaaatgtcttccaaaaggaaaaaaaaaaaaaagctttgtttaaaagtcgtctgctgacagggtagagaaaaggaggttaaatccagggctgtgttaactgctgacagggtggagaagagaaaaggatgactgggggaagaacctcttattcttatggcaaatggtttctgcaccagggagagaagctaaactattgtgggacagagctggactctctggctgggggaggggggaactctgtggacacgtggcagggaatgccagccagttgcttggggcccaggcagcagttgtggctcatacttaccctgcatggccgttggacactgcacacacatgaggcacacactacagccatgcactccagtcggtagggaagcagggacaggcagctgcctggcccaactgtcccgcgcgcgtgtctgtggcccttggggtgggtgtggaccacctccagtattgtattgtaaaaggaaagatagttgtcattactgttccaaaacaaagaagataaatgccatagaaccaaaaggctcagaagcaaaagttaaaggttttgggtccccattccaccctcctttcctcagatcccatgttctgggcaccaaaaaaatgttgtaggaagaaaccgggttcttgtcacatgaccaggaaagattaggcatgcagacactttgaagggagaggggttacggaacttagtgggcaaaaggaaaaaggaaaaaccactcagcaaagcgagaagggttcctattaacaggccgccatctcacagatagcatcccaagtccccacccaggaacaggagaggccaggctcctccccgctgcaagcagcaggaactttttgcggccccaccctgtcctcccagtgcacaggcctgttagagattccctgggaccttccccctcatctgcctcctgcatctatcaattctatatgaaaaatctctagaaatgtcaattggttagatcagctaagaagcacaaccatgtcccaagaaaaacgcacagaaaacctacatgaacggcaaatctttgtttctagctacaaaataataaattcctctgtagagaaataaagtgtatggtcagaattctccagtaaaacagaaccaatggaatatagcgaggtttataacaggagatttattataggaattggctcacataattacagaggctgagaaatctcacaatctgctgtccgcaagctggaacaccaggaaagccagcagtttaattcagtccaagtccaaaggcctgagaaccatgagcccaaatggtgtaagtcctggagttcaaaggcctgagaaccaggagctccaatctccaagggcaagagaatatgaatgtcccagctcaaacaaagagagtgaattcacccttttccctccttttgatttatttgggccctcaaaggattagatgacgtccatccacattggtgaaggctgatcttttctcagtctactgattcaactgctaatctcttccaccctcacagacacatccagaaatgaagttttatcagctgtctgaggatcccttggctcagtcaagttgacacataaaattaaccatcacacaaaggataggagttatttggttctcccagctctaccacgaacagtgtgaaagctgtaaagaaattgccagccttggcaacacggtgaaaccccgtctctactaaaatacaaaaaattagctgggtgtagtggtgtgtgcctgtaatcccagctactcgggaggctgaggcagtagaatcgcttgaacctaggaggcggaggttgcagtgagccaagagctagcctgggcgacagagcaagactctgtctccaaaaaaaaaggaaaaagaaattaccatcgtcttcttcaatgtttataccatttaaggaaggcccgtcaagttccagaccccctttcttttggccacttcacgttcattatcatctcatctccagttagcatttcccattttattttaaagaataaaatatcttaagaaataagcactgacagcaactttcatttatagtcttttcttagagagaaaaataggacaccaaagcctcaaaaatttggcatatggaaggtgacaggtgtttattacctgtctgctttctctgtctctctcaggatagaccatgtgttaggaagcctctaaaagtactcttaaagggaactgcagatcttttgttagtccccaccctttccacatgaaaagattaaaggatgaaagaatgaaggagagaaggccttgactcctataaatgggattggctgttctgtgctgggcactcagtctgcaccattgtactgagcactcatatcaaaatggcacaagacagattaaccctttcttcgaaatctctcttttttgactctagtcacactgcttccattcatccgtcatccatatatccattatccatccatctatcatccatgcacccatcttcatccatccattcatctatcatccatttatttatccatccattcatctctctatcatccattcacttatccatccattcatctaccattcaatgaatatttattaagacactcctgtgtaccagaaaccattatagagtctgggaatatagcaatgaataaaaaagacacagtccccaacttcttacttgacacgatgcctctcagtcttcctaaaagtaacatgtcccaaactccacttttgattttttctccacacttgcttgttcgaagtcttgcccaactccaaaaaaaatagcttatgatggttataatacgggtacctatgtgattgcacaacttatctgtgcaacgagaaaccaggggtggttatttatcaatctttttcctcacagcccatctagaacccgtcagggaatattggtgtactagttgaaaattgatgtcaaagttctagtcttcttactccacccactgcaatcaatcaccctactccacagcagtagcatcttttgcctggatatcttcagtggcttccttttcagtctctctctgttgtttttgcttcccatggatcccttctccaccaaaaagcccattgtgttctttttaaatttttttaaaattgtagtcagatacacataacataaaatgttgctatcttaaccatttttaagagtacagatctcggccaggggcaacagctcacgcctctaatcccagcactttgggaggccgaggcgggcgtatcacctgagctcaagagtttgaaactaatctggccaacatggcaaaaccctgtttctactaaaaatacaaaaattagccaggcttgtttgaaactaatctggccagcatggcaaaacactgtttctactaaaaatacaaaaattagccaggtgtggtgatgagcacctgtaattccagtaactcgggaggctgaggagaatcgcttgaacccaggagcagaggttgcagtgagccaagatgacaccattgcattccagcctggatgacagagtgtagaccctgtttaaaaaaaaaaaaaaagtacaggtctatagtatttggtgtattcacaatgattatgaaaccaatcttcagaacattttactttgcagaactaaaacttcatttctattaaacaacgctcccctgttccatgctcccaggccctggaaaccaccattctactttctgtttgtatgagcttgaccacacttgatatcccatataagtggaatcatatagtatttgtctttttctgaagggcttatttcatttagcataatgtcctcaaggtttattcatgttgcaacatgtatcaggatttctttccattttaataccaaatggtatcccgttgtatgtccattcattttttaatctacttatccactgatggacaacatttgggttgcttccaccttttggctgttgtgaataatgctgcaatgaacaggtatgtgttttttaaaatgcaaacttcaaatactttctcctcaaaaatctttgtgggccccacgtacacttagaatacaattgaaactcctattttctatttctgtttaaatagtatttcatttctaaagtctctgacttatctggactctgatctcatctggtgccactctgcctctcacttagaatgttttggccacatgccctccctttggtgccacagtccagtcctcatgcccctcgcacccacatgcagtgcttccgcctggagagctcttgcctcctttctttgaaatccagcttcttgcctttcagatctcagcttctgtctccggaccaccatcatcttaatccttgattactgaaactggtttcctaattcatcttcccatctactcaagatgccttcctgagccaccctacctgtcaacctcccattcttcattactgcattctcttggtctccttgtcagatttctagcaatgaatgtgtctgtttacttattatatgtcttcttgactttatcataagttcattagagacagaagtcttctcgactttatcataagctcactagagacagaaaaccacattggttttaatcaccaatgtatgttaacaagttaccttgagcctgggatttactaggtgtggaacacatttttgttgaatgaataaatattagcttcattttacagatgaaattgaatctgagttaatggctttcctaagtgaaatataaactacagagcagagattggaactcagttctcttacttcaaagtccacactctttccactatacagcagtccctttctcagctgaggttagacacattttgttaatcagaagattgaatgttttattacttccttccttctttcaacattgtaataatacttttagtgcttgcgacattccagatactgtgctagatcctgtatatacaagttgaacatggtagtttcaggcccaaaagcttaccattcagtttttcaacctcagcactattgatatttgtgacagataattctttgttgggaatttcctgtgcattgcaggatgtttaacagcatccctggcttctccccactagatggcaatagtgctccccattattatatcagcagtagttgtgacgaccaagtgtctccaggcatggccaaatgtgccctggctgggggttcaaaatcacccctagttgagaaccactgatttagtaagggagtccctattaagtgaaatatttccctgtagtggccgagtgccatggatgagaaaagcctgaagtggactaggggcacagagaatggatgtctaatggatctcagtagccactagactgaacgtccagatgtggggctgatgcttggaccatgttttaggcaaaagtaagagtcatttagatgaaaaaaagggatgaagattttcccaggtcgagttcacagcacatgcaaaacactgaatgtgaagaaactacacggagttgaacatggctgaagttccccatgctgatacctgaaggaggagcccaggacaagagccgtattgtccaggatagaacaaccttgattttccttttccatgcccagtccacctatttgcagtttttacaactcatatttggaagttgtttgcctgcacttaacatgtcaagagccctagctttcgaagaaaatctgatgtcatctctggggaaggcttttcttgcaagatctgcagtgccctcctagaacaacaccttaattatgcactggaaatccatacagcgtagaacagagttgggttttgagtttcagcagtgaactttgccttgcatttgattatcctttggggtcttggatttcaggcaacacaattaagaagtaagctgatcatccactttgctggaggaagaattccataagcctcttaggtgcaatggctgtgagcaattctgagccgagacttctgactttgttccacgcatctggattcctaacaccatctaaaccgccatctgtgaccaatggcgttttaagtgaacgtggccaaaacaatccagaccgtttgaggttggcagtgaagcatttaaatatctaacaagcaaatcctaaatcccagcacagatagaaccaagagagtcctctcattatcttccttatattcaacaattatactgaaacttcaattcaggaaaaagtggctgctattaattttgtcttgcttagtttatctggaattaagctcctcatatacttatctcatacggaagtggagtagaatgacaatgttgaactttttaaactagcattaagaagtattgtaaaataatatatgaatctctcaaactcatttcagttcatttaaacaacaacaacaaccaaaaaaacctttatttgtggcccagggaattgtatccatccttttcacacacatcgtcagccttctactgcttctgtgggaaaaggattacttactcagttaataatgacagccagcatctattgagcgcttcctgaatctcagttggctgagcactcgacatgcattacctcatttaacccttaaacatctatgaaaagcatgggcttatggtcatcattctgcccatgaggaaactggagaccagaaagcacaaatgatgtgtcctaggtcacatggtttgtcaggatgcttccaccaggctggttttgcccatgatcttagttgccgtactgaacattcagatgttctgagcagggaaatgtgctgtgtttaaagatagccaggcagagtctttgccttgctagcactgcatagtccagtggggcgggcaggcatggaaatgtactgtctccatacagcgcagtgccagaaagacttcaatgtgtgttcagctcagttcctgcttcattcactatttttagcccatgggctctgtcctattagtcatttatctagtagcagccaggaaagcaattccaaaaatgttgacttcagttcaaggaagatggagctggctgagcattggcgtttttctaaatttatcctgggctggttattaatggagttcctcaatcaaactgctggaacagtgctgggtgagagagaacagatccagaggaagtcaggaataacaactgctcactgctcattcatatactcattcattcattcactcgtttgtttttcaaaggtttcttaatgccttccgtatgctggactgtaggcaagaaatgttacagaaattatcacatgtaacactccctaaccctctatgaagcagatgttgttaggccgccatgacagacgaggacctggtgttcagaaagcacagggtgactgtgtggcagaaggagtgttcactccccttccagcagccacaacaccatgacctccacactgcacccagcttcaaaggtagcagcagcttctggcaggggcacatgactagcctaaccagacatgctcttcagaaaacacaaaattatcgcaaacccatgcagagctgatttgatcacccatattcattcactctctcatttatttcacaagtacatgagggaatgcctcctgtgtgccaagctctgtgtggggtaagggagcagaagctgctgcattgagtataccactgggcgaaaacacgcaatgtggcactctctggaaagtaccacaaaaaaggactttatccttcgtgctcactagggtaagggggcaaaagctgagaaatggaagaaattaacatgtacagagcacctgctctgtgtcacactctatgccgaatcctggataaacatcatctcatagcaaccagataaagcagggaatgcttatccctactttacagacaaggtaactgaggctcaaaaaggtcacagatttgccgaaggtcagccagatgggaagggtggacttgggcttaagtcaaggtgcaactggctttttgcaccagggcaactttatattggcattattaaccattttctttgtaccaggaactcttctagaagtatcatgaagcccatggaccccttctcagaataattttgaatctataaacaaaatacaatatacaaaagaagctgattatatggaaacagcattatcaaagtctttaaaattttgagatgtagtcatatatgtgcatctttgtgatgaacctggtggcagattgaataccaccataatttggaagccagcatgagcataaacagtaccttgaaataacaggatataaaattatctgtgatttctgttgtggcaagtctcaggcatttaggatattactggagtttgttgcccacattcatactggaaagagatgctaaattttcattagaagttagtaaattaaaaatgtatttttccccatccaaactcacggactgccaaattctatccatgagggtctgtttgtggacaccaaattaagagtgctgctttacgtcatttgtgttgtcagtttcttttcaaggaggaatcctttgataaggatttgtctgtgtaaatcactatctgggtaccatgggatgatacacaggaaaggcaggaagttattgatgcaggaaatgggcatggggaaagatgaatctctgcagcatactaggatgagctaggcaatttatagcgggcacctcatgtaagctacatttaatcgtatgggaaaattgacattcagagaagtcttgcccagggtataagagctagcaggctgtggagctaggatttgaaccacgccctgtccgattccaagctgctgagtcagattcagcactgtgaaatgcacggtccccatttctccttggaggagaatgtgtgagtctttatggagggatgggaaattttaagagcctgcactgaaggaggaaaattgttcacttttgcttattttgtagccaaaagctgggtctcttggatcgggttcgcctttctaatcctcgtggtagcaatactaaaggaaagctatttacccctctgaatgtagatgccatagaagaaagtccttctaaagaaccaaagcctgttggcttaaacaataaagagcgtttccgcacggccttccgcatgaaagcctacgctttctggcagagttctgaaggtaatgcctttttatctccctccctgtctcttccacttcttcctcccccaagtccacttccttcctcacctctccctttgcccacttaagaacctttgactccacaaggtaactctctcccttccctcgacaagccaacttcttgcttccctaactcctcctgtcccttgggctgaggcattgtgatgtattcccaggagtctagggctgcaggctcccaagttaggagcctggaaacctgtcaccttggtttctaagggtccgccccgaccccccgccccatgattggattgttatggaggtcaacttgaaggatggggcggtgccaggtgcaaagcaatttagagaccagggcacgggaagagtggcagaaaagcgccctctggaggctgtaggagccatggcctcatgtgcctcttttacttatgcaaagggaggacatgcagaaaagcctgtttcctcagtgtctgagcccacccaggccctcaatcctcattgtatcattcagttctctccaaggcctctgatgtgtgcggctcagaaagtgacttctccaaggtcaccaggatagagactgacagagcaaaagtcccagctgaggcctgcacagtgtgtgttgtttgctggcttctgtgtcctttgctggcttctggctctgggggccactctggaactgcggagctcacttctcctccctgctagccttttccctcactaccagtcatgagctgcgcacacttttgacttggacttctgggtaatagaatgagggtgccaagaaaggctgaacagcatcacagcttgagaataccgtggagtcttgcaacgtggaaataaagactctggggattgacacatccagaggcgtggaaggctttgaccgaacagtggggtccccaagccttttccaggtctgtggcctgccgttcatatgtgtgtctccctcccagatgccgggacaggtgaccccatggcggaagacaggggctatgggaatgacttccccatcgaagacatgatccccaccctgaaggccgccatccgagccgtcaggtaatgcccccacggtcccacctgtgcctgtgtgcctcccccgctccagctcaactcccacaggaaggggcttataaaattatcttgcactttgggaagggggaagagaagcccctccactaaccctgagttaggtccctgaagtatgtaaatactgtatgctgccccagaaaaaatgatccagacgttagcaagtcatgatgggtgactcgtaggtgcctgccttgttataaacacgccccacagccctcctgacagtatttccacctgctatgttctgctctgtctgtaactaccatgtattttaaagggtgtcagagtggagggttttcttcctgtagaggcttcttgctcaaaatggtttttcttctgcctaacttcatccatatagtttgttttaattagttcgcatttttaacaagataataaattatagtatttttttgtctgtatcagcagagaccataatccattctacctatttctgttttgctttagaattctgcaagaaaatgaaaaaaagtatgctattacctaaactttatcagcatgtaagcacttcataaaggtagcagtgaattctagaaactaaggtgaattctccaactgatcatggtattttccgcaagattcccagtccaatagatagggaagcacagtagtgttacagtgtgtagacctcagcaaagccttggacgtggattttcctgacacctttatgtaggatatgacagaaatgtggttgtatgaaaacacagctatctggattcctcactggctgaaagcctttattcagagaaaaccagttaataaacctgtgttgacctggagggtgatctctgctgggacactgcatagtctagtctctgccgtcttcttctcttcttttagcattttcattgatgtcttaattcagaggtcatcaaacttttcttgaaagggtcggatagtaaatgttttaggcttcctggtccataggtctctgctgcaagtgttcagctctatcattgtagcacaaaagcagccatagacagtgcctaaaggaatgagtgtgactgagttccagtcaaaccttactatcaaaatcaggcagtgagccagagttggcctgtgagccttagtttatagattctcacctgtatggaactatgtaaagagaaggcttataaagtggcacaaagatgggaaggatggcaagcaaattagatagtaccataatcaatataccaaaaataatgtttagaggctgaagccacgagctatgacaaacaaaatgaactttgaatgcaccattaaaacgacttgcgcaagcaccagatggaagggcctgggaagggctgtgacctcctgacactgacctgtgattagggatttgaacaaactctgtgctcaacagaagttaactttatgatgaggctcagggaggaaccaataaaggatggaggtgaggctttgatttcatctaccagttctgggtgccccactttataaggaacctgagaaaactcagggaacagaaaccagcttttcttttctaggagctcacaagtaaaataattaaagaggctcttgaggatgagatatatcagctgtcctcaaatagcaagcagtgtgacagtgattaagagcaccagccttgtcagcaccctgtctgggtttgaggaccagctcagcccttattagctatatggccctgggatgatgctgaaggttcaaatcacaatcacatcatctataaatggatctgttatcaggattgttcataaagcattaattaagctcatggtctggcatacagtgaatgctcaataaatgttagctcttattaatactatgatttacttattattcaaatgattgaagggagtaatcctgatggagatgtactaactctgtgtgttccaaggggtagaaccagaaccaaacgttggaagttcttccagcaagctcttttatctttggttcttttctccccctgccctggagtttgctagccttctgttatagctccccgcactctccacatgggatgcacaaatgcctctactttgccttgcagaattctacaattccgtctctataaaaaaaaattcaaggagactttgaggccttacgatgtgaaggatgtgattgagcagtattctgccgggcatctcgacatgctttccaggataaagtaccttcagacgaggtgagacagtcacatctggagggactgcgctcccctcaaagccctatgaaccttagagtttaaggtgagaggtattcagaaataattcaaaatgcagggagagattttaagaagacaaatatccacgaagccttgtggatgtctaggccaacaaagcaccagatcggacagactgtgaaatagctgtatgacattgccatggccaaggtcagcaccctgatcaggcctgtcagagaggagaaagcacacatttaaatggcttctgactgtgatgctttcgatgttgccaacaaaacaggatcatccgaattaaaccgaatccagctgcctaattaattctcaatacaattctttaccatatttaaaaatgttcatcaggtattacttataatagtgaaagatatggaaatagcatcaatgcctaactaataattgccatcatttttattgaactcctgagtactccacctgcgtgtttatactcccttatgaaatcacaagatattgcattagagtgccatttttccaatgaggaaactgaagctgaaaggacagaggacctacccagctagcagggagcagagctgggaatcaaaccagctccaactgattagaaagtctctattctctctaatacaccatatttccttaattataaaacaatgggtaaggaaagaatggtacctgctctcattaaaatgttatgcagtcattggttgggcacagtggctcatgcctataaccccagcactttgggaggccaaggcaggtggatcagttgaggtcaggagttccagaccagcctgaccaacatggtgaaaccccctctctactaaaaatacaaaaaaaaaaaaaatccaggcatggtggtgcacgcctgtaatctcagctacttgggaggctgagacggaagaatcgcttgaacctggggggcggaggttgcagtgagccaagattgcaccactgcacttcagcctgggtgacagagtgagactgcatctcaaaaaaaaaaaaaaaaaaaagttatgcagccgtaaaataatatttagaaaaagtatataatgagattttttaaattatatgatttgtggatatatatgcatgatataattaccaataatacatgcggacatgtgtgtacacatatatatgcatatgtatatatctatagtgcatatgtatgtttatatgtcatgtatgtcacagaataaatatactctgcctagaccttgtgatgatgttaactaatatataggtatgatatgattctaaacacttgcacacatatgcttattcagaaacacacaggacatgcacacactttcccatatcagggcctggagaaaaggagtaagacttcccctgagagactgcagtggctgtactgagatgatgactccatatgtgattttttttttctacttttaaaatgtatcaaatctttaataagctgtaaaaatgccctttgaaaaagcattttgtaaaaacgggcagttatgatgtcaatagccatggaataacagtcaggaaaccaaaatcctattgcagttcactctctgacatgtgtgagatttccaatggacacgcgtcctctctgggcctcagcttccctgtccgagtgatgttgtcccactggagtgtcctgctagagaacaggaacatcacactgactgggttggaagttaatgatgctatctgtcagcttggaggtgtaattctccatggcctttctcttttctttttttttttttttttttttttttttttgagatggagtctcactctgtcacccaggctggagtgcagtggcgcgatctcggctcactgcaacctctgcctcccgggttcaagtgattctcctgcctcaacttcccaagtagctgggactagaggcgtgtgccaccatacccggctaattttttatttttagtagagatggggtttcaccgtgctggccaggctgatctcgaacttctgacctcaggtgattcagcctcccaaactgctggtattacaggcgtcagccactgcacccagcaggcctttctttatccctaactggaatatcaactttgacttcctagtatagtggcaggcacagagtcagtgctcactgcctgccgaatgaatagatgtgtgaacaaattttgagcttaacatgctgttatttatgcaagtatggctctccgagagacgaggatgaagcatgatgtctaaggcatgccagactccaaaaataccagccaattttaataagcatagagtggactatgacagtggcatagtttttgctacttactaagcaaatgtgtttctagcatttgtggctggagggtgaacatctggacctctgattgcatatccccagccatgctgaccttgcggggcaagagagaaagaaagtgccgtcagtggaggagcagctgggtttccaaggaggagacggaaggagccatgactgtttcagggtgcatagtcttaatggtcctggacctgtgataagccttcaagcctgctttccctcccaccccgtcccaacctacagcgtgataggcaacatttctttcctattggtccaggcatagagcaggaaccaatgactcacagagtaatacgcagccataaaaaagaacaagatcatatcttttgcaggaacatggttggagctggaggctattatccttagcaaactaatgcaggaacagaaaaccatatacagcgtgttctcacttacaggtggtagctaaatgttaggaacttatgaacacaaagaaggaaacaacaggttctggggtaaggtggtaggagggagagtagcagaaaagataacccccatgacacatgtttacctatgtaacaaactttcacctgtacccccaaacctaaaataaaagttatttaaaaaggagctggtgcctcatgcagaaatagaaataggaatggaagctggtgttggatctatctttctactggccagagatgcccacagagcagcagtgatgtgtgcagctgaatatgtagcctaggatttgtctgtaaagctccctaactagatgtttttggaagggatagaagaattggaagaaaagacaggtttgcagtccacctatgacatttcctatgaaaaaaaaaaaataacaagatgcagccgtcacctctctcagtggtttgtctgcctccctctctcctgggatagaaagatgctttcagtatcaccagatcaaaacaagcggaagaatataccgaggttataggttctctctggctctgtctttctctctgtagctagtatgcactctctctttcctctcctctcctcccctctcctctcctcacttctcctctcctcccctctcctctcctcacttctcctctcctctcctctcctcttatatattccaaacccttatctcattctagagagaatagaatgatttgttttcctgtcaaaacaaagctctgtgtaatttaatccctgctctgtttgtttctttcagaatagatatgattttcacccctggacctccctccacgccaaaacacaagaagtctcagaaagggtcagcattcaccttcccatcccagcaatctcccaggtggggccagtggacatggactgatgggccaggggtgcaaagtttgtaaagcatccccacccccaaacctctgctggggtcctttatgtgggtgaagttgtcactctcctaagtaaaatgaagaaagagtttgaagcttgtttcagttggtggccatttgaaaggtttctgtacaaaaatgttctcactcctcttcccagaccatgtggatgacatttcttcctgtaacttttgaaagtgataatagccccacctgtttcacactgttacaaaacaagaggagacttatgagctttattgaaacaggaagaaaacttcatatcagcagaacccagagcattctccatcctgcataattacctttgagttgattgatacccctcccaggacaaagccagagaagacactcagatatcagccccctgacaacattgtaacacagagagctttgtcccttaacagagcagctcttctccttccaaagcttcaaaattttgaataagatgttctttagaaagtccactgcctaaatttacatctctttattcccaaatgtcttcaaggcaggtaacacaatgagtgagggagttaggcttaagaaatattatgaaccttccacttataaaagaatcaagaggccgggcatggtggcttacgcctgtaatcccagcccttcaggaggctgaggcgggtggatcatgaggtcaggagctcgagaccagcctggccaacatagtgaaaccccatctctactaaaaatacaaaaattagctgggcgtggtggcgcctgcctgtagtcccagctacttgggaggctgaggcaggagaatcgcttgaaccagggagtcagaggttgcagtgagccgagatcatgccactgcattccagcctggcaaaagagtgagactccatctcaaaaaaaaaaaaaaaaaaaaagaatcgagagcattaacgtgatgatagaaagcaacttaatattttaatatttaacctcagtcctggggatagaatagggagtgatgggaccgtgggcacctggagaatgcgtgccccatctaaaagaggtaggaatgaagtctctaccttcttttagaaatgagcgccctaccttcttttagggatgcagatcctctgtttccagaaaacagaatatccagcttttacatgaaattctcaatttttgagatggcttacatgttttaaaaccccgtgcaggccaaagaaaacactagccagctggatttagcacatggaccaccagtttctgacatctttttaaaatttagggcttcgcagccaaagactatcctactaagcaggattcagcagcctatgagagagagaaatcaactattgagaaagtgcctagcatgaatggtttctagcaaatagctagactccctgaaagttctatctgcaaaaaaaataaaaatgttgaaactaaccagaattaagcagatattaacagtggataaccaaaaatcaaattcagcacacatttcaattccattcctcaccagtgtcatcttttgcatcatgttcaagatttgggattcttcattcttattaaaattggccagatgaaatatttatacccactgtaagtaatttcagacattagatgaccccttctccacctgcacacacacactcagagtaaaagtctcagatctcaaatctaagaatgaaaggctaaggaatttaatttaaaggaactagatactctaggtactgttaggtgctttataatgtttaacacaaagcaaagcctccttaatagcagcttgatatttggcttcaaattttcctacagtggaggtaaacatgagataccagtgttgaatgcagaaaaactctgacttttcctgactcacatatgcctccagagttgattggtgctcttttatgccacacaagtgtgagggtgagaacgatggctctgttggccatggcctgcctagccgaaattaccttgcatagcaaaaatagatataatgatcttatagaagtgttcgcttcttcttaggaatgaaccatatgtagccagaccatccacatcagaaatcgaagaccaaagcatgatggggaagtttgtaaaagttgaaagacaggtaagtcttttcttcctctcaccaaaaactggatctgtgacatttattttcaaatgccatttcttttttttctttctttcttttttttttttaagacgaaggttcactctgttgcccaggctggagtgcaatggcgcgatcttgactcactgcaacctctgcctcccaggttcaagtgattctcctgcctcagcctcctgaggagctgagattacaggcgcctgccatcatgcccagctaatttttgtatttttagtagagatggggtttcaccatgttggccaggctggtctcgaactcctgacctcaggtgatctgcccaactcggcctaccaaagtgctgggattacagacatgagccactgcgcccagtccccaccattgtttttcaaagggagataagatacttgagtactactacctaccattcaaaaaagatatggaaatcaaatcactgattcagcatttactgagtgatcacgtgcaagttaattaattgttctgagcctcagttttcctcatctgtagtatggggattataataccctattaggttgctgtgaggactgagttgatacataatattagcgggcacagtggacacttgataatagctacaattatcaagcatttcatggtgaccccttaggaaatgctagtgacctgccactgcatgttgtgtgtcctccttttctcaatgtccaggcagtgggttgcctgcgtgaagaggccggaaggagggcaggcacaggtgagatccattcaaggtggaaagagaaacccgctcactcacagcaccatgcagctcactcttgctttcacagcaaacagctcataatctagcatcatctgcctaactctacattagataaatggtactgccagtttttcaaggatcatagtaatccttttgttttattcaaaaccctaaatgggacccgtgcaggagaggtagaagcaaatctgaattattcctttttgttgtatcaagaattttgttttcattttaaattttaatttataatttccactctatttctcagtgtctgttctcttgcctgtgaaatagagataataatagtatccatcttgggggattgtcataaaattcacaaaagtcaataaagtgcataagacagagtcagattgtaacttttctaactgacccttgtcagttattattgaggctcagatgctatcctggcatctgctgatcatggtgctcatatcctcacctgtaaaatagggtgatacacctgacgacagtgtttcctggtgagttgtgaattgtcaaagcaagaacatcacacacgtgtgcacatacactcatgtatattcattcacaaaagttcaagtaaggtgccaatttaggcaggcaagagcaagctgctaggtagggtcttcagttctgagaagctcagttcttgctaaccactgcccttgtatttttagggcttaaatcaccatgtagaagaaacatagactaacagtccacatgcttctgtctaaggaaatgttcctaaattgagaactcttgctccttgacccgggcaacattagcaaggccacttcctcctctaggggacacagcaggcctgtaacacttcaaagcatctctctgctttccgcctttgcttcctagaagaccttgcctaggttttctctagattaacattaatacctggtgtgcaaggcttgcaagtaggaggcacaaaataaattattagctgtttctattattaagagttgcaagaattatcttcccttctgaaaagtaaatacagtattagaatatttccttccggtcaggcgcggtggttcatgcctgtaatcccagcattttgggaggccaaggcaggtggatcacgaggtcagttcaagaccagcctggccaagattgtgaaaccccgtctctactaataatacaaacattagcctggcatggtggcgggtgcctgtaatcccagctacttgggaggctgaggcatagaactgcttgaacccgggaggcggaagttgcaatgagcccagatcgcgccactgcactccagcctgggtgacagactgagacttcgtctcaaaaaaaaaaaaaaaaacaaaaaaaaagaatatttcctcccaaccaatagcaacgatccccaccctcagagaaagtggtaattcacagctcctttgattttccaggttcaggacatggggaagaagctggacttcctcgtggatatgcacatgcaacacatggaacggttgcaggtgcaggtcacggagtattacccaaccaagggcacctcctcgccagctgaagcagagaagaaggaggacaacaggtattccgatttgaaaaccatcatctgcaactattctgagacaggccccccggaaccaccctacagcttccaccaggtgaccattgacaaagtcagcccctatgggttttttgcacatgaccctgtgaacctgccccgagggggacccagttctggaaaggttcaggcaactcctccttcctcagcaacaacgtatgtggagaggcccacggtcctgcctatcttgactcttctcgactcccgagtgagctgccactcccaggctgacctgcagggcccctactcggaccgaatctccccccggcagagacgtagcatcacgcgagacagtgacacacctctgtccctgatgtcggtcaaccacgaggagctggagaggtctccaagtggcttcagcatctcccaggacagagatgattatgtgttcggccccaatggggggtcgagctggatgagggagaagcggtacctcgccgagggtgagacggacacagacacggaccccttcacgcccagcggctccatgcctctgtcgtccacaggggatgggatttctgattcagtatggaccccttccaataagcccatttaaaagaggtcactggctgacccctccttgtaatgtagacagactttgtatagttcacttactcttacacccgacgcttaccagcggggacaccaatggctgcatcaaatgcatgcgtgtgcgtggtggccccacccaggcaggggcttcccacagcctcttcctccccatgtcaccacaacaaagtgcttccttttcagcatggtttgcatgactttacactatataaatggttccgctaatctcttctaggatacacatttatctgctgttcttacttttaatcacgattggaccagtacagggagaaattactgatgagccatgctatttgtctgtttggttggctggtttgggttttggtttggtaagcagagaaagtagtttaagttatttctaggatcactgccctcttgtgtaaaacgctccagcaattaactgtttttgaaagcaaggaaataattttctcaacaaaaccacattgtgtatcagtggggctgcctactgagctaacattaggaaaggaatgagatagtcattgtgtctctaaaacaaagaatttaaacaaatatttaaggcaaaaccttttaaaagctctccaaaagacctcacttggcctgatgttacttagtatcatgcctcagtttccttatctgtaaaaagtggtggtaatcccaagtgtagcatttctgatgagttatgaattggcagggagaaaacacacacacacacacacacacacacacacacacacatacacaaagttaaaatagtttccaatttatgtagccaaggacaatggaatttatcagaagtgaagtgcccctctgggcaggagctgagttcagtgcctttaaaatgaatttccaactctcatttcttcccatgatactgaagtacaaaatatccatctaaaatagaaattaaagtcaagaaggcacacagaaattttctagtccaaggacttccttttataaatgaagaatcttaggctcaggtaaagtgacatacccagagtcactcagttgtcccatagagaaccaggactcaaaagtcaggtctgcccactctccctgaccttgtttcccctcaccacaccattcttccatttatataatgcatcctagagattgtgtcaagatatatgactttgtgtcgcgtggaaagcacccagtttatccagcaggagggggatttccacttttattgcaaaacatgcttgcttgatgcaatgcatttcagatctagaaaaaaataatgcaagcaagctacatttacagatgtgtaaacaggcaaaatttccagaaccgtccaattttacttttccaaatttatggaaccaacccagattttttaaatgaaaatactaaaaccatatgtaaccgtaagacaagctaaaatgtaagcagacagcctgggaagcactgccctactgtacaggtgtgatattaagcacaagccatcctctggcctcttatgagatgttgttattctctgaaaaactttgatggaaaaggtttctgttaggcttagactgaattagctaaatgaccatgccacagtattattgtatcactcttctcacacacctaggcactggttgtggatagttgccatggtgacaatcaagataatccagatgacctaaacaaatgtctgtatgcagctgacactgctattctccctcacagtcttgtcaagagccacagtagctatggcagacatttggttgatggtttcatcatttcctaatacgagagtctggcactatgttggagagaggaatcacttcctcagagataggttcctttcaactcacatgtcaacagttactgtacaaaaagctcagaatacagtaatgattagagcttgacccctgactttaggaacttagaaccaaagcccaaagtcccaggccaagggcagacattgtgagcagcagaagggtgttttttatggagagccccataaatggatgggtgtagaccttgaagtctgagatgggaaatataccagaatgctcaatgcatcagacatgaagccccacgggcttccatttgacatgctggcaatctgaaggacaaa

SEQ ID NO: 15844 - DNA, 68580 bp, Human
actgaaattcatacaactaaataagtcagaggtaatgaagatagaaccagtaaccaaactgtctcttagtctaatgcactttgaggaattatagatacattgtgtcttacaatatacagaatattgcttttatggtttactaatcacagcattctggcagtggcttttttgttttttgtttgtttgtttgtttgttttggcaatgccctttagtctgccttctaggcccctaaaacagcacagctatttctcactaatctttgtcatcaattcgtttcctgggttaaattccttcttcccaaacacctccctgtagacagggatcagagaaacatgaactgggcttctctgttccctaaaggaagatgtccaccagtccaaagagagagagaacagctaatatttggtaacccacctgctagcagcaccattgttctttattagcaaacccattgccctcaatgaggtgcacctggcttgctttttcttaacactcaatctgccttcagagctggagctcgtaagaggcacagcctcccattctgctacaaaaattctatagtctcctcagctactttctctatcatttctcattaaaatgatttattatacagaaatgaaatggcatattgtattaaataattataaaatagtttaaaatttcttttgtacatttcaatcatgagtatttgagaggaagctgaaaccagttctgatgacaggtggaaggtagtaactaagttagcatcaatgcattcacttcaaaccacttgaagaaatgaagtgttatttagtttcacagagctgcaatctccaaatacacacatttgttctcagatgacagcagttcttcgaattaacagtgaaaatattaagccgaaggaagactttttggttgtcttgacaggttgacttgagtgttatgccatctcattaaaccaagccaagtaagggaagaaaagattgatgaggccatagcccaggagtgaggtcaccagctaaatgtgaccgcatagcaacaaaagaagtttgactgataaagatgtgtccccacggtagaagtccttttccctaaatgagtccttcaggtcaagaaaggaaatttgttgactagattctcttagcttgctcccataggcatgtgactaatagcactttaaagtctgttgtgaaggatataatgattaactgaccatttaaatcctggaaaggtcacattagcagcccctatcagtgcttcggagccaaaacagtagagtgtgaaacttgaaatccactgtgagctcagaaaatgattaaagtcagaagtgatccctggctgcttataaatgaagtccaagatttctagcattatcaataacagcagtaggcacaagatcattgtgggtgaccaaaaaaaaacaaggtagttggattttcctatttttttaataagcaaagaaaagcagttgggctaatggaaatattagttattagctgtaaatttcgtaaatgaatgctgcttttaagagtttaagagcctgtctgatcataaatatttcaaagagcacactattaattcaaaccaatcaataatacagtataaccctccagctaagttaccaatgagaagaaatttattcatcagttttattcccaccgaatctatatccaaaggtttgggattgattatagcaagatgtgttgtcttattatcaaaatagtatttattactcaaacatttctaaagcaataacctgttatgactttttaactcattgagtagaaagttgaatatttactgacatttcttgaaaacttgcaacccgcctgcaggaaagaatctgacatcatcacactgtgttttccttaacttgacaggaagtcaacttcaagcagattgacttgaaacgggatctcatttaggaagcataagtgtccaatcaaaaactgtgtatttttttaaatttggaaaatactcaagttccagttgcttatcattctccttcactttctgaaaacctggcaatcccatgtggacttctggtagaatgagcaatgcaaagaactggcttggacttggcatgtccttgtacttctgggggctgatggaccttacgaccaccgttctctcggacaccccaacaccacaaggtgaattagaagcactcctgtcagacaagccacagtcacatcagcggaccaagaggagctgggtttggaaccagtttttcgttctggaagagtacactgggaccgaccctttgtatgtcggcaaggtaagaaatgccaagtagaaatgacccgggtagtggatattgaaattgaatatgaattgagtatcaaagttgacctagcctttatctgagacctgagaaaaactagaacaagtggtacgttacttgacacctagctaaaatgtaacttctgctttgtcagagaccagtctgaaaggaaagatttatttccttgtccatgtctctggtatgaatgggaaaaagtgggaattgggatttggaggaaaaggctcagaccctgcaagagctattcaagtcctaaaagaggcagcagcagctgtctgggaatgacagaatgggggagagggaaacttggaaatacaagaagagtacagagttttttgctttgtgtttttgtggggtttttttcagagcatttccagaggtattgcctgaggtgcaaatttaatgaaaaaaataaaaataaaacatttttcatttcagaagatcttagcatgtgctttaggatagttggagacaataaatatatttataaatgttatatttgaattctcttgatttaatctatcattatttcatctttaatcctggatttttcctgtgtttactttattggggtgttaattacagaccattttgtgaaagcaaccaagtgagagagaatgggagacaagaaactaattagaaaataactaattcattcaaatggtaacttaaacgcttgtttagcacagaggctgggagcatgggtttcagattcaaacacaggtgggttcaaagcccagccctgccaattatttctagaggaactttggacaggtcaccaagccctgctcatctcggcttcctcaaattcgaatgagattgagagaactgctccttctcaagtgttgtctacccaagttctttccccagtgtccactcacttcttaacccaggtatctggctttggtccctacctctgacccaaagctgtgttttcattgcttctcaagacctctctactgcccaatcacacctcccagtcacaaactcagacactgctgacctgtctctccttgactcattgtcctatctgtgccatgaccttcacaatcccgtttttccttcttttttctcagccgcgtttgtgggtcctctccttccacctgaccccatttgttggtgggcttgtcagctttgccctagcctcttctccacacactcattccctgggtggactcgccacctctgcagttttgaatgccatgtctatgccaatgaatgcaaaacctctatctctggcttagaccactttgggttataaattctactgcatatgtgacatctccacatctactcataggcctttccaatgtagtgtgtccagtaagaaactcttgttttttttctcctaaacgtagtctgccccaacacccacccatcatttcctaaaaccagagaactggggatcattcctccctttcccctgcccacacattctctccctctgcaaattctgctagtcctatgccagaatcaaccccaaatcctgcatttctcttatccctgcttccaccatcatctgtcacctgggcaagtacctagcctcccaaccagtctcctcatgtccacctgcacctccctcccatctgttctccaccatggtctttttaaaatttaagtcacatcatgtcactcctctacttacgtctcttcaatgttttcccactgtgcattgaatcctccagacacctccccacagctaacaagaccatccctttctggatcagcctgcctcctggcatccacccatggcccatgctactctctccctcattctcgcgttgcagcggtatgacctttgacagttcctacaacctgtcaagcactgcctttactgctcccccataatgaaatgcccttcccctggcttctctcatgacttccttggccactctctaaggcaagcccctctgttagactctctttcacagccctaatcacaaccaccatatttgtttcttatttacatgtttattgtctgaagcctctgactaaaactagaagctcaatgaaagcaagaacattgctcccattttatccccaaggcctaacacagcatttatcttatagaaggtgctcaagatgacatttaataaatgaatgtctcactgtggagtaaggattaaataagctaatgcatgtaaagcactttgcacagtacttaatccagagtaaaactttaattatccttaacctgtagtagtaaatagtactatagtagcaatagtattaatagtggtaatagtaacagcatttaaggagttcattatgggaactcaacgctcagtaatacctaatgcagctgcaaatcccttggcctcaaaacctgtgacttttcattgacttctcctttccttatctccttttaccttcacgtgcaatcggtccccatatctgccaatatttctgtgccagtttctctcggatgcatctcctcctctctaggctcggtcatgaccatgatcctttgctcttcctgattagattaactatgccggtgctgcctgtctccctgtgaaaagactcttcccatccctcctccaggatgctcagcgcattcctctccctgaagcaccctttccatcatgttgctcctctgattaagaaagcactacagtgcttttgaatgctatcagagctcctagcatgcagttcagggacttcctcctccctcactcagccctcgtgcacaatttctcaaatcaggtcctcatcccaatcaagctggacctccttaactggttctgccacacataccacgtttgtccctgaccccacatgtgtgcccacgctgctgccctgcccaggacaggccctgacttccgctcatcaggccacattcaaattcctcaaagttttagcttaaaatcagacaattctatcatgaacatatcttgtatctactcagaattccaaagacttctagcttctccatatctatataacatttcttccaaatagacatacatggccactgccaagttcaagaaaagagtatgtttgtattcagcaattttcagtaattacttatgtgcacataaaatttagggctctcttccctcctcccaagggtagaaattgagacgccactccccaactttgtctacacctccctgacgctgagtacttggcacagaactggccacacacaaagagtgcagaagggtagctcacgttttattggactaccacagtactatgtgtcggtcacaatcacatcaaagcagatcatttaatcatcataacaatgctgtgaggtgagtataacacagggaactagactcagagaggttatttatgttcattgcccaaagttagaccgaaggtagcagggaagcccagactgaaatacacatcactcctaccccaaagccccagctttcatttacattgccttgtctgtggtcagtggctttagactaagcccagaggacacacacaggagtcagtggtgtttaggtgggatcaggaatctgagccaggctgcttcctgaacccttgatctctcacgctgggtagttcttagctgtgtagcacccttgcatactcacaattagtgctcgccctttccaaataaccccaaccaagatacaagacacccatgcatctcaacagtcatctgatccaatcctcataccagcaaccaagcgaagatttttaccctgcattaggtgtgttacctctacatgaagaagataattatatattcacttttcccttttactttcttttgaaagggaattcatccactttcattctctttacccaggggcattctgcttgtgaccttgagctccggaagatgtctgtttagagagcttgccagagtatttgcttatttcagaaaggagtatggcagcaattatcagctgtaattggtatggccttacaaaatccacactgggctttccagggacaaggcagtgtcaagttaaagctagattatattgacatatgcaaagagagggatgctgagagcttgtgcacgaatctgtgggtccaaatcatgccgaggttaacaactacatggaagctgcctaaccacaaactgtaagcactcactgcatactcgaaattactcaaggtactctgaaagatgacaaaaggagtgaacatcattcttgtttttgaaatcctcaatcagctaagattcttcaggacctgcttgtacttcccatcactcactactcccttggctgaagatcttaaaaactaaagaatgattaggataagtgagacattcacttgtcttattctgcctaaaatatttttttaggaaggaaaaaaaacattttcccaagatgtacgtaactgtgctgctgactctgctcggaagcttcttaccttcctccaaatagctggtgcgcagtcagtgttagttgaattaaatatgggcaaatataaaacacatttttattacaccgccaatttgctgagtgacttggagaaaagctgttaatgtctgttctttgccatttttgaaaccaaatgtgtattctacggctggtaaagcggaatattaaatgtgcattgctgcacgggttattaagctggtgtctctcagccccatgctcacctttccatactctgctttgggtgctggggctgaaactctccaagccgtaatttctcctcttccaaccatctcctctcccaggtaggttctgcctgccggtagaaggtactagagggagcccaggaggcaggaggagggaggagtgacttgctcctcatcacacctacttctaagaggtctgagtcccagggaacaggggcacctcctcgaagctcctgcggccccagcccaaggagcagcactgcttcctcaggggtctcaggcccagcctcaaggggctcccctccaaacctgcagatgccagaatccccacctccctcctgtgttgccccagccagaggggcactggctgtttttcctggagctgcgctctctctctgatgcctcggggcttccttctggcctttcagccctccactccaaattctccctgctgaaaccaggtgtgagttttgttccctgactacacctagaactgataggcttatgggcctcagaaaccacctctgtgtaagtagatcctgacatgcttcaaagctgagatgcttcctgcttccctggggctgttctctacccgctccccactccttttccctttccccgccttcttccctctcccctccacccttcctctcccacctctctcctcccttcctctcccccctctctcctcccttcctctcccccctctctcctcccttcctctctccttctctcctcccttcctctccccctctctcctcccttcctctcctcctctctcctcccctcctctccccctccctctccccccctcctcccttcctctcccccctctatccctctccctccctttccctttcccccctttctccccgccttctcccttcctctcccttcctttcccttccctcctttctctcccctcctccctttctctccccctcttcccctgctcatgtgcacacttgcacatgcagaccggtgctccgaacctcctggaaagctgctcctagctctgttaaccagggctagcaccatccatacggaactttcgccctcccccagacccttcttccaacacagtttcattgcacacttacaagacgtcaggcccacatcaagatgaaggtcacacggaaagcgaaggcctcacactcaagcgtcagcccagactccagggcaccagccagctcccaggagtcaggggcgccctgtggtgagctctgccgctgtcgctgtcgtttcttaaagcgcttaaagcgcgctcacctgcggcctgccgggatcacaggtgtgctgaatatttcaaggatcacggaacaaacagttttatttgataaatagagcacctcggaacagtcctggggtggcctttctgtcagcttctgtttttccttccctacatcatcagcagtgccctaaattaaaccaatttcattaaaagtcctatgccacatgccataaaattacatacatacactgttatatatataaacatacacctatatgcatacgtatacatgtttttaatttaaaacaccttctgaaatccttgttctccccacacttctgttcctctgcctgagaacacaggtccaaatggaatagattttcatttgtttgtgcccaggtccaaatgaaatgcctttctattctacacaacaagagatgggcacctctacttttttaactgcataaatagaagatttggattgtaaaaaaaaaaaaaaaagaaagaaagaaagaaaaaagaaaatactgtatacgaaatgaggaaatgtgagaacttcacattctaaataaaataagtagaaaaaagcccacaactattttttcggtcaattttattcccttatttctctttctagataagacgcagctgagttcccctaggcagcaaaaccattgcctgcatgatttggccttgagtcaatctgagatcagctcaaagccagccacaacctccaaacccatccctgtcggaggctgttgtggatgcatttgcaggtgttttattggtgttcatgctgtttaatcctcagagtaacactgtctcagccatgcttcaggcggccttctgcagcttttaccatgagactgtgcataacaaaaaagccaacaggttgtttttgcctctctgccaccctcctggaggtctgtagggagtagagaagagctgagtgtgctaatacccttttctctatgcacgtgtatcatggttggccccatttatggccttcctataatgggaaaagcactgtgctgggtgcctcacgtgcattaatctctaatgatcccagtgaaccttcagaataagtattagtgctgtcctcacacttataaggaaattaatggttataaacataaaataactcatcaagggccctgaatttatagctggcctagacagtgttcaggccagatatattggcctccctgccccaagcctaatcctggctgttttatcaaataatctcatgaacttcaccctggactatgcaaagtgctaacaacccaggcaacaatggagtggctgactaaatttaactaactgttttgttaccacctttagaaagagaccattacctatagggttgctcaaaattacagggttcttgccacccatacatactatctgcaattaattagatattacagatgcagaaatatgtttataggcctgagattttaaaaatatagtactcctggactccttttgagagttattaaaagtattctggctgggcgtggtgactcacacctataatcccagcactttgggaggccgaggcaggtagatcacctgaggtcaggagttcaagaccagcctgaccaatgtggccaaacccccactctactaaaaatataaaaactagacaggcatggtggtgcatgcctgtagtcccagctacttgggagcctgaggcaggagaatcgcttcaacctgggaggtggaggttgcagtgagctaaaatcatgccactgcactccagcctgggtgacagggcgaaactctgtctcaaaaaaaaaaaaggattctgagagcaaatatagctgcatggtcagataaaagcatgtccctaactcaaccatccacatatagatttaagtgactcagttatgaacccaagaaccagtcccatctaaaggagacacacaccgatgtaaagaatcataaccagcagttaaattccatttgacacctgaaacacaagcccagtcctaccgaatgaaactacagaactaggatcacagaatgggaggaagaatccacggaggtcattcacttttctcactgcagtgcccttaacctttttataaactacttccatcagcttatcagccaacttgaattgtcataaaactgtttgatactccaaaacttacggcaatttcttcattttaacacgtttaggcttatccattttatttttatttttcttaagtggaaaggcaggaatcctccttattaaatttgttcttattctaacattggggatcttcactttccagagttcctgttttccatacttatcagggagaagaattttgtttaaataatggtaagttcaggatacagaatgggacatggaaaattttacttaatcaacctacacccactccttgatacaatcgtgtccaatgcatactagttctttgtcgacaaacttattaaacatttgaaaaatctccttatgtaaagggaggttataagtttgtaacaaactgaaaatcaatgtgttttctgacacctgttgacattcatgatgagaattaggtgctttcctctcccagcttcattcagatatggacaggggagacggatccatcaaatacatcctctcgggagaaggtgctggcatcgtgtttaccatcgacgacaccactggagacatccacgccattcagaggctcgaccgagaggaaagagcccagtatactctaagggctcaagccctagacaggcggacgggcaggccaatggagcccgagtcagagttcatcatcaaaattcaagacatcaatgacaatgagcccaagttcctggacggaccttatgtggccactgtgccagaaatgtcccctgtgggtaaggtggtgactcgctgattttcacaaatagcacctcctatatatatacacacacacacacatatgcacatgcacacacacatgtagatacacatatattcagaacaggagagcatgagaggagaagctcaccaattataaagcaaccaaaaatgacgaccaagccctttggctggcaggaagctatatagacattggaatcaaccagagcaagtaataataataagcctattaatgttttttagttctgattctttaaaaacaaaatattagctagacagatttgtttcataagggagaaatattttgttattatcaaaagagcaatagggttaggcgcggtggctcacgcctgtaatcctagaactttgggaggctgaggcaggtggatcacaaggtcaggagatcctggccaacatggtgaaaccccgtctctactaaataccctgtctctactaaaacaccaaaaaaattagcctggtgtggtggtgcgcacctatagtcccagctactcaggaggctgaggcaggggaatcacttgaacccgggaggtggagatttcagtgagctgagatcacgccactgcactccagcctggcgacagagtgagactccatcttaaaaaaaaaaaaaaaaaaaaaaaaaaaaagcaatgaagagcccaaaggctgtgtccttatcagtcattcagaatttaaagcacaaataactcttatccctactaaacaggtacaagataagagttatggaagcttgacctagaaaggggactctcccaatgaagcaaacacatttgcaaatgctttaagatggaccgctcaggattgcatccagcctttagctattagacttgaacaggtttctacctcttctcttccccaggtacctccgtcatccaagtgacagccacagatgcagatgacccgacctacggcaacagtgccagggtggtgtacagcattcttcagggccagccatatttttctgtggactctaaaacaggtatctgatacaagggtcgagtcagaggtgtttattccctgataatttataactgctgctatgacagacccaactctcctttttaaggactctccagggagtgtattaaccagagaagactgctcttagctttaggattaagagagcaaactagcactgccctgacaggtaagagcagcactatgcatagacagtgagcagtgtctgattggagaggcaaaaagcccctctgcgcaaacacacacaaaataactccccaatagccttcaaaaaatcctatggttatatttattcccagggactaaggtcttttataaccccatgaagacccaacaggattgacacattcacctgggtcattagagaactagaagcattgattgtgaaactggaaagagccttgggggaatcatccagtccatcaccatttgcttatcagataaagcaattgggaaattgagagctactaaagttcatctagtgtagagaggtctcttgacatgtggtctgatgttctttctattgaaccaaccactgtgcactcagcagagaagtccaaaatgaatggttgctggggcagacaggttttgatgagggaggaaagaccaggtgggatgtggcccccaaaaggcaggtcctgattgggaagctctcacagggaggacatcagagagaactgaatgggcgaggagcaatgcggcagaaaagacaaacaggagtttggtgttttgtttgcttatttatttctgtcttacccgagagctttgactacagaatttacctttggatgtatgaaagatttcatttaatatgtttgagcttggcaaagttattgtgatatcattattatcttatacttgtgccaggcttcccctcttattaatactttcataaacattgccatatttgagcttcccaataatcttgtaaactagcaaaagatataggaagtattattacttccattttatatgagggtaaacatgggacctaggagtaattaacaaggaacttgagtaaagaaacttacagccacagaataaagttaatggtgaacactcaaagtcacctctttatttgaaaaagaaaaaatacatttctattattagcaacctgatcgaatttttttcccagaagtcctgagggaaaccagacattcagaaaattgtatcataaaagtagtaagggagtgtaaattaggaggaggaaagaaaaaagattgcagttagagacttctataaaacagtaactttaacaattctactaagggcaagggggagaatgaagagaggaagggtgcccacagggaggaaaaatgcagggaggaagagggtaatgtgtcctttatatcctaagaagagtcttagattattttgacagctcccggggggcatctgtagtgttaaggtcaaaaatacatgaacagagagttatagctgtgcccatggggggccttttaaaaaagaaaatgctgcatatatcactggagaatgttatactacaatgcaatatatacattataggggtaaactggggacggattattgttcccagtcccttccattttcatgcaaaaggtctatctagccaagagtcatgttgtaaagctgtagtaagtaagcctttaatctttgcctacagtgtagagaagtcaacttttttaagttgcagggttaaaagggagacaaaacattactgtacaggcttggcaggatcacaacacatttcaacggatttggtgtaggcctctcttcttaaatgaaaccgtatctgctgcttgctctctggggaaattcatatcttatgcatggtaaaaataaacagctcacagagcatctttcatgtcctagctcacaaaattaaaagcacagaggtaaacagaagaatgtcacaaaacagaatgaatatgtaacaacaggaaaatccaattagaattccaaccctgcttacaggtagtagggaagcaagaaaaagcaggaatgagttacctaaagaagagccattcacactacaagggctctaggggctgaagaaactgagggagaattatctaaattcacagatttgtagacttatgaggctttgttttctggacccaaagcccccagttttccttggtgagacagcactgtctgaaatcgccttggaccacaatttcccagatctgtaagagaaacattgctgccacctcctgttcactttcagtaatgttgccagaagaaaccagccctctgagctcttcctgctggaataaaagttttcattcaccactggtttcagtacagcccatttttgaagctgagatttttttacctcaaatttaaaagcacaggtgacttgcacctcacttctaggcattaatggtgcaccagggagacacctagaaaccaatctttaaaaactggacctgtggttttatttttataaacaaagtcatttctatcctccaggtgtaattaggacagcgctcatgaacatggacagagaagccaaagaatactacgaagtgattatccaagccaaggacatgggagggcagcttggaggattagctgggaccacaacagtgaacatcaccctctcagatgtcaatgataacccaccccgctttccccagagtgagtacctaacccaagagagcacagacctcgggcccagagggacgcacccgttgcagaggtgcgggagaaagcccagtttgagtttcctcattaaattcaattatccatagattcctttcttacattcatcatgcaattctcgcataactatttgccttcagtgttccagcttcccatagtactaaaccaggatttctcaaacatatttttccattttctcctccctgtggaatctttttagactttctttcctgattgccacgcccacccaccccacataaaatgcaatactaaggaataagttttgttgggtagaactggcctttagtgggccacaaactagtaatgctgagacttttttcatcacagccctggaaacctatttttgcccccagggggccatattgatccattgagaatgcattcactgatacccaaagctgtagatggacacacctgcccatgtgacgatcttcaccaatcactccagtaggtaccaagcacttgcttggtgagacccctggacatgaagggcacaggaggcttggaatcctgtctctgcccttgtgaagcttcaaatccacttgggaggacacatcctacacacaagaaaaattaaaccgtagtagcatttgctgccacttgaacagtgcaagatgatgccttcacacaaactgagatgaatgaagcctccacagaaggatgagatttcaacagggggctaaagaatataacaggtttacataggcagaaaagaaaacattccagaaggggaagtcattcatttacttattcattcaaaaaatatttattccaggcactattctatgaatggaacacaaagctgtatacagacaaaacaacatctctaccatcctggagctcatttgagtaaaaacctgaatggaagaaaaaaaaactgctgcctggaaataagttttcactgtcactttacgttcaaagactcctaaaattaaaacctgctctttcaaatgtgctgtatctccagtggaagccatagaaacgtttttgagcaagagggagacataaagaaaggctaatttggtagccatgtagaggaggggttggcaagggcagagactaggagcaggggagtcggttaggaggcatttagagtggtccagacttgaactgctaaggacttaaggaaatagcaggatgagtggaatgggacaaatgaggaaacatggacttctgcctcttgatttcctggctaagggaaccatggcagagggtggagtcaaagatgacaatgacgttttcactctggatgacagggagaaggattgtactactaataaaaatagaggacgcataatggaacgagtggcagtgaaggagggagacaaattcagatttgaatatgaagtgacagcaggacaatcaggttgaatgtccttaaggaaagtggaaatatagagctatgaacgtggaacagagcccaggaatgaagacataagtttgagaagcagatgcctgaaggaagcagcgggagaaatgagagcaggaagtgcaattccaggtgaaacacttagctagggaaacggggcttaaaaaagaaaaactaaactaaaaggaggaagagtctagccagactagccagactgtcagatgaatagttgcattttgaatcagccagaccaagctaaccttcccttgtatctatgtaaacacaggagatctcaaatatttacatgcaaatggaatacacaaagtccccatgagcattcatgatggaaaaagcaggatactagataagcatttcacaaagggtgcaagtaactaagttcctaagttgcttggtccaacagtgcagaattcgtattctgcatcacagaacagtttgtgaaatgccacatggatggactttgtgttgctttggtgattctgtgggttccatcttcattacttcatgaagggctcatattactcacactatagactataaattcttgaacacccttgaactacttggctttttacatttgacactagacaggtgtctctgatggaggcagaagggacagtagaaccagctaattacatagctcaggttattacatagctcaaaggtagatggattcggacatattgccgggagtcatgttaccccaaacatggcagcttcacaatagcagaacactatacaaggattactggggttttagtcttgcctccgaaaccaatatctttttttttttttttttttgagacagggtcttgctctgtcacccaggctggactgcagtggtgcaatcacagctcactgtagcctcaacccccaggctcaagcaatcctcccacctcagctcctgaatagccagaactacaggtgcacaccaccatgcccagctaatttttatattttttatagagatgggattttgtcatgttgcccaggctggtcttgaactcctgggctcaaatcatctgccttcctcaggctcccaaggtgctgatattacaggcatgagccaccacacccagcctcaagccaacatcttaataccattctaaagcacacattttaagttgtcactttttcaaaatatagttttaatggagactccaggatagagtggaagcatggattatgtttcatggaagacaaaagagaaatataaaaaagtttaaatctctgtgtctctatgcattctacacacgttatcgctgcttcctcttttttgaccttttaaaactttgcattctctcttcattaaatagttccccatctatttgctaaaactaagtttagatgaccttgatattccataaacctatcttggctatactcttatgcctaattaatctaatgagtcttcattgtaggaattccattttgcttctttttcacaaatattactataactgattgtggaatgttgacaaaatgatacacctactattttacattgaataagctaagccacctttaatagaaccaaatataatgaaacatcaagatctcaagctatttatttataatataatgtatcatgtagaaattgtatgtagatgtttaaacatataacatagctttattgggatgaggaaaactgtaggcagatgcttgtttttcccaaaagttctgcaacagcaaagtgtaatccatcaacaactttggaagtaaatggaaagagatcatgaaatccaattccctgccagcttagtacaaactttaaagatttcctggctcatgtttgtaaagaacaagcatcatttcttctcctgcgcaaggcagggtgctgtgagctggctgggtgctgtcaacctccctgattctttgtgaaacttgagccctcacacctgaggctatagcttacaaagcatattagaataaaagggaacacgtacatattgaaaatgtgattgtgtgatttttctttgttatttagtcagtcacattatgattgacaaaataacaaaaaacgtcaaaaagttgagccccagaaaaagtaagttggtaaaaatacgaattcatggagatgaaagtgaactaaatttaattgtgagttcaggatatcatgtccaaaaggagatgaccaactctgagcttcttacatatgtgagaacctttttagtattttattctggaataagaaaacaagaagcatgaagggtctgtccatggagaggcaggctggggcagtctggggtgtaaggacacactgaggggcagcacatggagctgatggagcttgctctccacggctgccccccctttatagatcactgatctccatgacctctgatcaggtgttgctagagacaggcactcagcacacaggccaggccatgaaaaaaaagatggacatttgaagcgtaaacagaataaatacgcactttgtgaccacaatgtttatcactctcagaaggaactgcaatttaaggaaatacttcagttcactaggaagcactaaaagatttgaatccaaggtacttcctaccactcaagctacagtcactaggactaagtcgttttgctttcaccctgttctactgaagcctttttgactcctccttattgaacatccaatacaggctatggcctgtatgaccgtttgctcagcctttctggaccttagtttttatctgtaaaaactcaagttttactttttgaacccagaaaaaaagatattttgcacagcactcctgatatgataatgatgaggcattttttatagtgacggattatcaagaatgcgtgtcctggcttttcttcgtagaacattaccagatgagtgtgttggaatcagctccaattagctccactgtcgggagagtgtttgccaaggacttggatgaaggcatcaatgcagagatgaaatatactattgtggatggagatggtgcagatgcctttgacattagcacagatcccaatttccaagttggtatcataactgtgaagaaggtaatccaactcctttttctaaaacactttcatgggtgctttgaatgtttatgaaatgctagtaaggactgttgtattattgatatgcattgcttcaaatcatctgataaaagtgctttcctattatttaaaaaaaaaaacacacagaaaacctcttaacccttatgtttacatgaaaacactggctgtgccatcattttactgaaaaggtaccaggtcatgataaaaatatattataaatatatttctaaatacattccttctacccagccacttaaaaacctgttgtagcttaactttctaatgatgttaatgacttgatcaacatttgcacttgaataacatatgcattgtagcataccatacctaacaataaagtaagccataatattatttatgaatcaataaataacatgcaagggttttttaattgcttctcaaagatctgtaaattctaattaaacttgaaaaagctttatcaaacatagctgctgaatggctgttatcacttgaaattcctttgttttataaggtaccaagataagctatcaattctttctgtgacataaagcacatatggatatactgagctagaagataaaactttttaaaaattgaatctttaactccatagtaaatatatatctaatgaaatacattaattttaaatgatattctcaacaaatttattgagtgccacctatgtgccagatattgttacaggcatttaatacagagtaaataaaacaaccaaaaacctctgccctcatggagtttacattctagcaagggaagaagacaatcaaaacatcaagtcactaaagtagtttattagaaggtaataactgatatgggagggggagccaggaagcagaacagaacacaataagtgaggccaggaaagctaagatgatttcaaacttaaattggatggttggctaaatgcccatcaatcaaagagtggataaaaaaaactgtggtaaatatatataatggaatactacacagccataaaaaggaatggactaacagcattttcagtgacctggatgagattggagactattattattattattattatttttcgtgttcgagacagagtctcactttgtcacccaggctggagtacagtggcgcaatctcggctcactgcaacctccgcctcccaggttcaagcaattctcctgcttcagcctcccgagtagctgggactacaggggcacactgccatgcatggctaactttttgtattttagtagagacagggtttcactgtgttacccaggctggttgtgaactcctgagctcaggcaatctgcccccctcagcctcccaaagtgctgggattacaggcgtgagccactgcacccagctgattggagactattattctaagtgatgtaactccagaatggaaaaccaaacatattctgttttcattgatatgtaggagctaagctttgagggcgcaaaggcataagaatgatacagtggactttggggacttggaggaaagagtggtagaggggcaagggataaaagactacaaatatggtgcagtatatactgctcaggtgatgggtgcaccaaaatctcacaaatcagcactaaagaacttactcatgtaaccaaatactccctgtaccccaataacttatagaaaaacaaaattaaataaataaattgggtgattgggactggtgtcacagagaagtggcgtttatgcaaagacttacagtgagcagactcataccactgagttaagcaggttgacagtgtgggaggtgccctacaaatgactctttgtgaaaagcatacgtggcagtcctagagagaagaaatgggcatgaactattgaggaaagcgttccaagcaaaaggacagccagtgcaaaggctttgaggtgggaccatgcctgttgtatttcaagaacagcaacagtggggtcataaggctgagtggaggggggaactcttaggagatgaggtctgaaaagtaacaaaggagccagatcatttaggaccatataagctaactataaggactttggtttttactctgagtaaagtgggaaatgactgaaggatttttaacagatgtatgacatgactcggttttcattataaatactcagtaggctgtgttgaggtcaggggagtttaaggagagaaggacagaaagagggagaccagctgagaagctattgcagtaatccaggtaagagatgatgagggtttcacctaagtagtgggaatggaggtgataagaagtggtcagaatctgtacatattttgaaagcagagccaacaggatttcctaaaaacgtggatgaggatatggaagaaagagaagagtcaaccaagcaacaagaatggaattgccattaactgagacagggaagtctgcaagtagagcaggtggcaggggtgacaagtattggaattcagttctggacatacatgtgacatttctagagtctattagacatcaagtagagacgtgtcatggctttggttataagagcgaggagtttgtagaagggtcctgcactggaaatatgaatctgggaatcataagcatatagatggtacttaaagcaaataaaacaaatgagattccaagggactgagcatagacagaaaaaggacagtgaaacgagccctgaggcacaccaacatgaagaggtcaggggaagtgtaaggacaggcaaggagactgaggggcgaccagggaggcaggaggataatggaggaagtgcagtgtcctgaaggcatgaagaacgtgctcccaagggatggagtgatcacctgtgacaaatgctgctacaggtcaaataagaacatcaggaattcaccacagactttaggaacatggaagccactgacaaccttgacaaaaaccacagttataacattaaaatgtaactcaagttaatgggtgtttataacttttttctatgctatttgatagaactgaattaacactgcttcagaagggaataagggaccagttcatatgtttgttctgtatttatttaagatgcaatcaatcacagcaaaggaacagaatcacagcaaaggatccagaattccaccaaccagaaatctttctatcctgtaaacaatgaccttgacacaatgcaaaaggctgagattgacttctaaatcatcaaataaatctagatgtaattaaaatactataatttcttattctcattctttgagaattaataacacatgctagaattataataggtgattaaaataacaatactattttggtatatgtcataggttcccctactatgtggcatgcctcaagtaaacaataatacattgctaaccataactagtaactgtaaataagggaaatgctcaaatttttgaattattgggttttttctttctttctttctttcttttttttttttttgtttatttgtttgaacagagtctcactctgtcacccaagctggggtgtggtggcacaatcatggctcactgcagccttgacctcttgggctcaagcaatccttccacctcaccatcctaactagctgggactataggcatgtgccatcacagccacctaatttttgtgttgttgtttgtttgagacagggtctctctctgtcacccaagctggagtgcaatggcatgctcatggctcactgcagcctgtagtcccagctactcaggaggatgaggtggaaggattgcttgagcccaagaggtcaaggctgcagtgagccatgatcatgccacagccacctatttttgttgttgttgttttgttttgtttttgtagagacaaggtcaccctatgttttccaggctggtctcaaactcctgagctcaagtggtactcctgcctcagcctcccaaagggctaggattacaggcatgagccaccgcaaccagctttactgtttctttagtacgaaaactctattcaaacaattaagcaaccagaaaaagaacttttgggattctcaatatttaaatgttatcttatgtcttaaaataatgtctgagataattctaaataataaaatattaatttatgttagattatcacaatatagtttagactgtattacaagccatttgttttaaaaagtctattacctgtaacaactctgtctctgaaagaaatctcaaaatgtgttttcttcagctcccttacctgcagaaaagatgaagcctcttaagacagagtactgtttttcactgtcattactaaaacgatatccatgtttaatcaaaatacatatcaattttgccaaggtcactttgatttctcttctgaacttatgagctgccagaaaatggaattaagaaaaaggtcaataagttgggtagatggacaaatcacatataataaatattttagaggccactgacagctcagtctacgcctttgcaacaacattcactcagatgtctgctccacgcccatcttcccactttgtcattaataatgtcatataaaattgaaacaaaagttctgcttttgatttatttcccttaggcctattatttgtctaagaagcccatactttttcaaaaagaggaattgatagaattgggtcttcaggaccccacactgattactacccagtaccttgggtctttttagcttttaagtaatcaatcagtcgattttcagtctcttaaatgcttgaagtataacttgaaatatataattttcaggatgttctttattctgaataagcatgatgtaccattttctagtcttctgcatatcttccatcttacgacaagaagaagcaattgtttagagtccattctcttcttaggcaggtcataaagaataaaaattctatatttcatcaaatctgagatgtcatgaattataaatctcatcattgtcttatgggtcatttaagaacagttcttgccaatttaaataatacaatactttcttatttcttagtttagtgtctataaagtactctcgtaggcacagttagacaaatttgtttcaccaatgttagattcactccatgccgctgtttccatgccattctccctacacaataaatcttgtttcaatgccaaatcataatataatatatttaaagacattttaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagacagtttgttataatttctgttcttttacatttgctgaggagagctttacggccaactatgtggtcaattttggaataggtgtggtgtggtgctgaaaaaaatgtatattctgttgatttggggtggagagttctgtagatgtctattaggtccgcttggtgcagagttgagttcaattcctgggtatccttgatgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttgtctcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatattgttatgtgtgaatttgatcctgtcattacgatgttagctggttattttgctcgttagttgatgcagtttcttcctagtctccatggtctttacattttggcatgattttgcagcggctggtactggttgttcctctccacatttagcgcttacttcaggagctcttttagggcaggcctggtggtgaccaaacctctcagcatttgcttgtctgtaaaggattttattcctccttcacttatgaagcttagtttggctggatatgaaattctgggttgaaaatttttttctttaagaatgttgaatattggcccccactctcttctggcttgtagggtttctgccgagagatccgctattagtctgatgggcttccctttgagggtaacccgacctttctctctggctgcccttaacattttttccttcatttcaactttggtgaatctgacaattatgtgtcttggagttgctcttctcaaggagtatctttgtggcgttctctgtatttcctgaatctgaacattggcctgccttgctagattggggaagttctcctggacgatatcctgcagcgtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcagctcctgaggcttctgcattcttcacgtagttcacgagccttggttttcagcttcatcagctcctttaagcacttctctgtattggttattctagttatacattcttctaaatttttttcaaagttttctacttctttgcctttggtttgaatgtcctcccttagctcagagtaatttgatcctctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcctctgctggggggtgcctcccagttaggctgcttgggggtcaggggtcagggacccacttgaggaggcagtctgcccattctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaatcaagcctgggcaatggcgggcgcccctcccccagactcgctgccaccttgcagtttgatctcagactgttgtgctagcaatcagcgagactccgtgggcctaggaccctcggagccaggtgcgggatataatctcgtggtgcgccattttttaagcccgtcggaaaagcgcaatattcgggtaggagtgacccgattttccaggtgctgtccgtcacccctttctttgactcggaaagggaactccctgaccccttgtgcttcccaagtgaggcaatgcctcgccctgcttcggctcgcgcactgtgcgcgcacccactgacctgcgcccactgtctggcactccctagcgagatgaacccggtacctcagatggaaatgcagaaatcacccgtcttctgcgttgctcacgctgggagctgcagaccggagctgttcctattcggccatcttggctcctccccaccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtagaattgaacaatgagatcacatggacacaggaaggggaatatcacactctggggactgttgtggggtcgggggaggggggagggatagcattgggagatatacctaatgctagatgatgagttagtgggtgcagcgcaccagcatggcacatgtatacatatgtaactaacctgcacaatgtgcacatgtaccctaaaacttaaagtataataataattttaaaaaaaaagacatttgagaaggcaataaagctcaacatgtgcagtaccaacaatgtgtagaactcccctaaagtacaacatggacagctttgactaggtctggcttgcatgggcagtaacaactactgcttagaaagatccctttgcctccctttgacactagggcacttataaggtgttatcaattggagaagcaacgctatttctaaaatatcaaaatatgaaaaactgtgcatcttacattactgaaatacattaataaaatctgcatatactatcactcaaccagtaaatgttaatactcacattgggaaactttttgcactgttcaatgtaacaatttttttaggtttttgctacgctttgagtttctggttttgctaggcagtggggaataaaaatctgactaagtcatagcttttgcccttgagtatggggagtgggatcaacacagaaagaaatatttgtaatacaaaagaaaagctataaaggaagtataatagtgtgctgtgagaacaaagaagggaatacttaatcctccttaattagtaattgaagtttcattactattttgtgccataattttcatgactcaatttttaaggatataatggctttttgtttttgtatcctctaacttgaagaagtttcttgaatttggaaattggattctcagatattattacttttttattttctattatgaatacagaaataaataattatttgatatttaaaataaaaaggacacaaactattcaagaggaaaaagccaaaactcattatcaagtgtgggcaatttaaatgttaagagctgagcagagtggttgcagcttcttaggatggaggtgggaggatctcttaagcctaggagtttgagaccagcctgggcaacataagcaagagtttgtgtcagtacataaataattaaataaataataaagtttagacaattgagggcaatgttttgtttccattttaaatgtggaagtgagggagacaataatcttagatagttttaaagtcttaagtaacttacttaaaaagaatttcagtaataattaaaaactcacgctagtgctttcaacagatgctggaacaattggataccatttgcaaaaaaaataaagaaataaacctcaattatacccccacaaaaaaactcaaaatgaatcatgcacctaaatgtaaaaacctaaagctataaaatttctaaaaggaaacttaggagaaaatctttgcaatcctgattggacaaagatgtattccatattacatcagaatcccaacctaccaaagaaaaagtaagacttcatcaaagttaagagtttctgctcttcaaaggacactgttgtggcaagatggctgaataggaaaagctccagtctgcagctcccagtgagatcaatgcagaaggcaggtgatttctgcatttccatctgaggtacccggctcatctcaatgggagtggttagatagtgggtgcagcccagggagggcaagctgaagcagggtggggcgttgcctcacctgggaagtgcaaggggtcagggaactccctctcctagccaggggaagccatgggggattgtgctgtaaggaacagtgcattctggcccagatattacgcttttcccatggtctttgcaaccagcagaccaggagactcccttgggtgcctacgcctccagggacctgggtttcaagcataaaactgggcagctgtttgagcagacaccgaactagctgcagtttttgttgttgttgttgttgttgttttgttttgttttgttttgttttacccccagtggcacctggaatgccagtgagacagaaccattcactcccctggaaaaggggctgaatccagggagccaagtggtctagctcagtggatcccacccccatggagcccagcaagctaagatccactggcttgaaattcctgctgccagccctgcagtctgtagtcgacctgggacactggagcttggtggagggaggggggtccaccattactgaagactgagtaggcagttttcccctaacagtgtaaacaaagccaccatgaagttcaaactgggcagagcccaccgcagctctgcaaagccacggtacctagactgcctctctagattcctcctctctgtgcagggcatctctgaaagaaaggcagcagccccagtcaggggcttatagataaaactcccatctccctgggaaaaaacacctgggggaaggggtggctgtgggcacagcttcagcagacttaaatgctcctgcctgccagctctgaagacagcagtgaatctctcagcacagcactcaagctctaagggacagactgcctcctcaattgggtccttgacccccgtgcctcctgactgggagacacctctgagcaggggtcaacagacacctcatagaggagagctccagctggcatccagcaggtgcccctctgtgaagaagcttcaagaggaaggatcaggcagcaatctttgctgttctgcagcctccgctggtgatacccaggcaaacagggtctggagcggacctccagcaaactccagcagacctgcagcagagggacctaactgttagaatgaaaactaacaaacagaaaggaataacattaatatcaacaaaaacaacatccacacagaaaccccatccaaagttcaccaacatcaaagaccaaaggtagataaatccatgaagatgaggaaaaaacagcacaaaaaggctgaaaattccaaaaaccagaatgcctcttcttctccaaaggatcacaactcctcaccagcaatggaacaaaactggatgcagaatgagtttgacaaactgacagaagtgggcttcagaaagtgggtaataacaaacttttccgagctaatggggcatgttctaacacaatgcaaggaagctaagaaccttgaaaaaacattagaggaattgctaactagaataaccagtttagacaagaacataaataacctgataaagctgaaaaacacagcatgagaacttcgttaagcatacacaagtatcaacagtcaaattgatcaagtggaagaaaggatatcagaaattgaagatcaacttaatgaaaaaagcataaagacaagattagagaaaaaaagaatgaaaacatatgaacaaagcctccaagaaatatgggactacatgaaaagaccaaacctacatttgtttgttgtacctgaaagtgacggggagaatggaaccaagttggaaaacacttttcagggtattatccaggagaacttccccaacctagcaagataggccaacattcaaattcaggaaatacagagaacaccacaaagatactcctccagaagagcaaccccaagacacataatcgtcagattcaccaaggttgaaatgaaggaaaaaatgttaagggcagccagagagaaagatgaggtacccacaaagggaagcccatcagactaacagtggatctctttgcagaaaccctgcaagccagaagaaagtgggagccaacattcaacattcttaaagaaaagaattttcaacccagaatttcatatccagccaaactaagcttcacaagtgaaggagaaataaaatcctttacagacaagcaaatgctgagacattttgtcaccaccaggcctgccttaaaagaactcctcaaggaagcactaaatatagaaaggaaaaactggtaccagccactgcaaaaacataccaaattgtaaagaccattgacactatgaagaaactgcaacaactaacgggcaaaataaccagctggcatcataatgacaggatcaaattcacacataacaatataaaccttaaatgtaaacaggctaaatgccccaattaaaagacacagattggcaaattggataaagagtcaagatccatcagtgtgctgtattcaggagacacatctaacatgcaaagacaaacacaggctcaaaataaagggatggaggaatatttaccaagcaaatggaaagcaaaaaaaaaaaaaagtaggggttgcaatcctagtctctgataaaacagactttaaaccaacaaagatcaaaaaagacaaaaaggccaggcgtggtggctcactcctgtaatcccagcactttgggaggccaaggtgggtggatcacgaggtcaggagatcaagaccatcctggctaacacgatgaaaccccatctctactaaaaatacaaaaaattagccaggcgtggtggtgggcacctgtactcccagctactcgggaggctgaggcaggagaatggcgtgaacctgggaggcggagcttgcagtgagcctagatcgtgccactgcactccagcctgagtggcagagcgagactccgtctcaaaaaaaaaaagacaaagaagggcattacagaatggtaaaggtatcaatgcaacaagaatagctaactatcctaaatatatatgcacccaatacaagagcacccagattcataaagcaagttcttagagacctacaaagagacttagactcccacacaataatagtgggagactttaacaccctactgtcaatattagtcagatcaatgagatagaaaattaacaaggatattcaggacttgaactcagctctggaccaagcagacctaatagacatctacagaactctccaccccaaatcaacagaatatacattcttctcagcacgacatcaccagtctaaaattgaccacataattggaagtaaaacactcctcagcaaatgcaaaataatggaaatcataacaaacagtatctcagaccacaatgcaatcaaattagaactcaggatttaaaaactcactcaaaacacacacaactacatggaaactaaataacctgctcctgaatgactactgggtaaataactaaattaaggcagaaataaggttctttgaaaccagaacaacataccagaatctctgggacaccgctaaagcagtgtttacagggaaatttataacactaaatgcccacaggagaaagtgggaaagatctaaaatcaacaccctaatatcacaattaaaagaactagagaagcaagagcaaataaattcaaaagctagcagaagacaagaagtaactaagatcagagcagaactgaaggagatagagacacaaaaaaaccttcaaaaaaatcattgaatccaggagctggttttttgaaaagattaacaaaatagatagattgctagccacactaataaaaaagaaaagagagaagaatcaaatagacacaataaaaaatgataaaggggatatcaccactgatcccacagaaatacaaactaccatcagggaatactataaacacttctatgcaaataaactagaaaatctagaagaaatggatacattcctggacacatacaccctcccaagactaaaccagtaagaagtcgaatccctgaatagaccaataacaagttctgaaattgaggcaataattgaggcctaccaaccaaaaaagcccaggatgatacagattcacagccgaattctaccagaggtacaatgaggagctggtagcattccttctgaaactattccaaacagtacaaaaagaggaactccaccctaactcattttatgaggccaggatcatcctgataccaaaacctggcagagacacaacaaaaaaagaaaatttcaggccaatatccctgatgaacatcgatgtgaaaatcctcaataacatactggcaaactgaatccagcagcacatcaaaaagattatccaccacgatcaagttggcttcatctctgggatgcaaggctggttcaacatatgcaaatcaataaatgtaatccatcacataaacagaaccaatgacaaaaaccacatgattatctcaatagtgcagaaaagcccttcaataaaattcaataccccttcatgctaaaaactctaaataaactaggtattgatggaatgtatctctaataaaagctatttatgacaaacccacagccaatattatactgattgggcaaaagctggaagcattccctttgaaaactggcccacgacaaggatgcccttactcaccactcctattcaacacagtattggaagttttggccagggcaattgggcaagataaagaaataaagggtatttgaattggaaaagaggaagtcaaattgtctttgtttgcagatgacatgattgtatatttagaaaaccccatcatctcagcccaaaatctccttaagctgataagcaactatagcaaagtctcaggatacaaaatcaatgtgcaaaaatcacaagaattcctatacaccaataatagatagagagccaaatcatgagtgaactctcattcacaattgccacaaagagaataaaatatctaggaatcaaacttacaagtgatgtgaaggacctcttcaaggagaactgcaaaccactgctcaaggaaataagagaggacacaaacaaatgaaaaaacattccatgctcatggataggaacacgcaatatcgtgaaaatggccatactgcccaaagtaatttatagattcaatgctatcctcattaagctaccactgacttcttcacagaattagaaaaaacttctttgaatttcatatggatccaaaaaagagtctgtatagccaagacaatcctaagcaaaaataacaaagctggaggcatcacagtacctgacttcaaactatagtacaagactacagtaaccaaaaaagcatggtactggtaccaaaacagatatatagaccaatggaacagaacagaagcctcagaagtaatgccacacacctacaaccatctgatctttgacaaacctgacaaaaacaatcaatggggaaaggatttcctagttaataaatgatgttgggaaaactggctagccatatgcagaaaactgaaactggaccccttccttatgccttatacaaacattaactcaagatggattaaaaacttaaacataagacctaaaaccataaaaaccctagaagaaaacttaggcaataccattcaggacataggcatgggcaaaggctttgactaaaacaccaaaagcaatggcaacaaaagccaaaatcgacaaatgggattgaattaaactaaagagcttctgcacagcaaaagaaactatcatcaaattcaacaggcaacctacataatgggagaaaatttttgcaatctatccatctgacaaaggtctaatatccagaatctacaaggaacttaaacaaatttacaagaaaaaaaaaaaacaaacaaccacatcaaaaagcgggcaaaggatatgaacagacacttctcaaaagaagacatttatgcagccaacaaacatgaaaaatagctcatcatcactggtcattagagaaatgcaaatcagaactatattaagataccatcttatgccagttagaatggtgatcattaaaaaagtcaggaaacaacagatgcaggagaggatgtggagaaataggaatgcttttttacactgttggtgggagtgtaaattagttcaaccattgtggaagacaatgtggtgattcctcaaggatctagaaccagaaataccatatgacccagcaatcccattactgggtatatacccaaaggattataaaactttctactataaagacacatgcacacgtatgtttattacagcactgttcacaatagcaaagacttggaaccaacccaaatgcccatcaatgacagactggataaagaaaatgtggcacatatacaatatggaatactatgcagccataaaaaaggaggagttcatgtccttttcagggacatggatgaaaccaccattctcagcaagctaacacatggacagaaaactaaacactgcatgttctcactcataagtgggaagtgaacaatgagaacacatggacacagggaggggaatatcacgcaccagggcctgtcaggggtcgggggctaggggagggatagcattaggagaaatacctaatgtagatgacgagttgataggtgcagcaaaccaccatggcacaggtatacctatgtaacaaacctgcacgttctgcacatgtatcccaggatttaaagtataataataataataataataaaggacactgttaagagaatgaaaagacaaatcacagactaggagaaaatatttgcaaatcatacatctgacaatggacttgaatataaaatatacaaagacctcctcaagaagacatagaaagatgcatcacgaggcagtaaggaagtgccaatcagaactacaatgagataccacttaacgcacactaggatagataaaaattttaacactggcaaaaccaagggctgacaaagatgtggggtgactagagctttcatatactcctggtgggaatacaaactggtactgcctttctgaaaattcatttggaagtttcttataaagttaaaaatatatttactatacaatcccacaactccagtcctaggtatttaccccactgaaatgaaattttatgctcacacaaaaacctctatgtaaatattaataggtttactcataactgtcagaaattggaaaaaaacacaaatgtatctctagtgaagaatggataaatcaactgttgtgcatccatacaacagaatactacgtggaaataaaaaaagaacaaactcaccaggcatagtagctcacgccagtaatcccagcactttgggaggccaaggccgaggtgggcctatcacctgaggtcaagagttcaagaccagcctggcccacatggtgaaaccccgcctctactgaaaatacaaaaattagccaggcgtggtggcacacacgtgtagtcccagctacttgggaggctgaggcagaagagtcgcctgaacccgggaggcagacgttgcagtgagcccagattatgccgctgcactccagcctgggtaacagagtgagacgctgtctaaaaaaaaaaaactcctcattcatgcaacatggatgaatctcaaatgcatcatgctaagtgaaagaaccctaactcaaaagattacatactgaatgtagtttatctgacattatatgacattcttgcaatagagacagaacatacatgaatcagtgtttgccaggggctgggtgggaggggagaggttgactacaaaggggcacagagagggtcacgggggttttgaaacagctctatagcttgattatcacggtagacacatgactgaatacactagtcaaaacctgccaactttatactaaaagagaaattttaatgtatgtaaatatataaatgtatgtaaatatcttattttttaaaacatacaaatttcacacaaaattagaaaaacaatttaaaattaaagggaaaacaagttttgcctagctcaaacctaacacaaacaacggtgtccacaactgtgttacaaatacataaagaattttaagagcgtataaatgtaatttaccaggaaagaaaaatgtttcgatttagggagcaagcattaaatgaattggtaaaatagtccttcaaatatatcattaatctgactggcagatttccctgtttatgaaaaccttgccttttcaatgacaactagggaggcaggctggcaggtggagatgggcgtctgggtttgaatggggcttcttggtttggatggaaatggctggcgactcatgaaacgggaagcactatgtctgctactaagtaaatggtaaacaagcagtaacccaacaacagcaacaaaacaaaaaaaactttattaaaatttgaaaataacaattatatgaatgcattaaattattacatgtaccctgaaaatatgtacatctattatgtatccatttttaatgtaatttttttgagacaaggtgtctctgtcactcaggctacggtgcagtggtgccatcatagctcactctaaactgagctcaaaccatcctcctgcctctgcctcccaagtagctgggattacaggcacatgccaccacacccagctaatttttttttttttttttttttttttggtagcgatgtaggtctcattaggttgtcttggctggtcttgaaatcttggcctcaagcgattctcccacctcagcttcctacattgtcaggcttacaggcatgaaccactgctcctggccaaaaagttgacttttttttttttttttttttttttgagacagagtttcactcttattgcccaggctggagtgcaatggcttgatctcggctcaccgcaacctccacctcccgggttcaagtgattctcctgcctcagcctcccgagtagctgggattacaggcatgtgccaccacacccagctaatttttgtatttttagtagagacgattttttttaagtaagaaaataacaaatctagttaaagcagcacctaccgatatttttttctgaaaagccaagcagttgtttaaatgggtacatgcctctctctaacatgaaatgtgctgccattcaacatattttatgaaaaaagtgatgtttagctagaaaaatgtaagttattgctatgttgacacacaacttttaagttctagtaactgctttgctatccacttttattttgtgggacttaacattccgagatgttctgaaatacttgttgcttaaaacacacatgttcatcagctttaaacaacaatagattagtcttcagaaatagcattttaagttcacgttctgccctggagcactgtatttattttgaaaaaaaaaattctgaagataggaataaatcaaaatagagaacaaccaaaaaaattgtattttacgcgatggaattttatagacaaaattaaagtccttgtggaagagctgtaaccacgtcagcatactccaggcttctgagcttcctgcatcttgggttcttcaactctaaaaggtcaaataagggttttaaaggggattgtcagcagggtgtggtggcttatgcctgtaatcccagcactttggaaggttgaggtgggtggatcatctgagatcacgagttcaagaccagcctgaccaacatggtgaaaccctgtctctactaaaaatgcaaaattaggcaggcatggtggcacatgcctgtaatcccagctacttaggaggctgaggcagaagaatcgctttaacttgggaggtggaggttgcaatgagctgagatcacactgttgcattctagcctgggtgacagagcgagactccatctcaaaaaataatagtaacaataaaagggattgtgcatgatgaactaaatatacaaacattgatctgacacagcacctgagaaccttgtgtggcacagtttcttgaaaagaatcaatattgcctttgtactcaagaataattttttaaggaaaaaaacaaaagcctaggcctcagttgcatgaatattctaatagatagatagatagatagatagatgatagatagatagatagatagatagatagatagatagatagatagaatagatatatggaatatatatggaagtttgtgtttggaatacaaacttgctcttaattgttgtgaagtcttttcaaatgagcaagcacctctaaagataatgtgaccaaccgtcctggtttgcctgggacagaatagagtcctaggaaatgaaacttttgattttagaactgagacagtaccaggcaaattgggcccaggagtgaggggattcctgggatctctctaaagaccaggctgattgaagggtagacaagttaaagccaagtttgcccagaataaacgggcaaactattatcaaactggcttccttaactatctctgcagtgactgatatcttatcttctttacccaaagtgttgaaactgacattaagaccaagaactacagaacaagacaaagatttcccttctttcccgtttacctttttcccacttaatgaattggagaatcttcccaccagccatcaatattgggcatccttttgaacgttgacatattttgaatcttgaacctcagtggcgaatcaattttcctgtcattgcttttcagcccctgagttttgaaagcaagaaaagctacaccttaaaggtggagggagccaatcctcacctagagatgcgttttctgaacttgggcccatttcaggacacaacaacagtgcacatcagtgtggaagacgtggacgagccccctgtgtttgaacctggcttttactttgtggaggtgcctgaggatgtggcgattggaacaaccatacagatcatttctgccaaggacccagatgtgaccaacaactcaatcaggtttttccacagatttcaccttttccttatatgctggaatcttcccttcccttgtatgtaattttctagcacttttccctttgtttctttcttctctatcccatttctggagactctcctctttgagttttttgtgttgtttttttttttttcccttaaataacatggccttgccaggttgtttagaagtgtcattatatttataactcactttcaattggttgagacacacatacacacacacacacacacacacacacacacacaccccttagttctcaatcatggtcctgttgacatttgggggtggataattctgtgttgttgtggaggggttctcctgtgcactgaaccatgtttagcagcatctctggcctttacgcacgaaatgcagtagcactctctgagttgtaaccacctaaaatgtccccagatattgccaaatgtccagggaagtggtgtaaaatcaccccaggttgagagctactgattcagataaagtataatcagacacacagatgtcaaaatgttaaaatccattgactctcagtggtaaacataaaggaaatcatcatgtattcttccatcttttatgaatctttgacatgttttactttttaaaactggggaaaacaatatatactacatatattccacatactatagaaagagcagacatagaaactacttctgttgtcagcaacttcaatgccttgtagactggccagacagatgggtctttgtatggcaataccaagtatctatctctccaaagcatgttttggaattaaagattccaaccaagatgcttccgctcaagaagatgagaactgctcttacagtcatggccatctctcaccaactggaaccaaagtgcaaatagttgatggacaggttgacaccacaaccttccagagcagctgccaaacctatgaagcgtgacacaaaagatcagaattccaaggatgtcggaagccatctgtcacattaattgttgaaagccacacagtaaaatgaatctggggctttagtgcagataacacattttaaacataccgcactttatcaaatgccttttccgtcagctggctgcttctctcacctagtgctgttttgtatttaatgaaaacgtgcttctgtagtttaacaagaacggctttctccagagaataaccatactaggggcaaattcacttcctctaaccaaccagtaaacattttacatgttcaggcattaaaatggcaaaaacgattttatttgaattctgatatttgattttttcaaaggcaactaatgtattatataacaactttatagatgttgtatttcaacctgaagctttttaaatataaactaggatggggagagattagtcaaccatattatccccaaagcaatcacaatgaaaacaaaacattgtgtgtattttcagaagccaagaatatataccttctgatcctaatttattaattatatatgtattaatccaccataggctaattaatctattcctgtaacaaaagaccctatgagagaaactttaaagaataaaactttcaccactggcatgaagtaaaatgaggtagacaaaatgaagaaatcttgtctggctaacagaaaatgctgcttcagatgatgaccaattgaaaactatcagttggccagcacatccgttagcatcagggaggttcatattggagtgtctggctaccccactagaacccaggcaggatgaatgcaagagtgaacaggccagaggcacagggcagggtccactgggctgttctggggcaggactgcagatcctgagatgaaaattggtgagaacaaggccacaaggccagaggtaataagacacggctcaggcacagggggcaacgtgaaattccaatgatcagatctggggataattctccctctgcattttggttacaaagaaagagaggaattcttattgctaggtatgaggtccctgactctttgtactatccaatagcaacaaagaatggtccctggacccaagaagaacactgggggtcctagactctcagagggaaaagcacttaaaactcaatgaactccctggctctcatttcaaaacccatttgggaattcctttcttctgttatctttcaccaaactgctcttcttatccttatttttcatattaaagttactttcttttaaaataatgtgtatagttatatgctgcatggctaattcatcatctgcatttttgttacgaagaataaatgagatttatattcttaaagagaaaatatctatcaaataattcaaaaaatcaacacatcaccggaagttaaaatgttacagataaaaggccatttaacaaattattaggacttttataatctcctttctagaaagttgatggtgtgttcaggaatatatgctggtcctcacttatttataatccccaaaacaaaatcaccagatttagtgatatttacatgaaaagacaatgtttggatcccctgaatttttaatacatgctcaaggactttttggcaggcaggatactgagccatttggcaactgaaagaggcttctgctgatgtggaaactgcctgccccccagttccttcccagaatgtgtgtggatttaaccagcctgctcctgacaccccacctccaaattgctcccaaattcagaggatgtcctcagctaagtgacaagcagggagtccggaaagcaccagctactgctggctctgggcagctttgtacctgcatgatgccgattctgctcataggaggttagaatgtaatggttaagaaaagaaaaccacctacataattcacgagtgtgtcccaatttcctcgttttccatctgtatctacacctttaatttttctcctgcctcctgaaaattaacccagcatcctattcagggaaacaaaggctattattccctcaattctggccccattggggaaatcagagagggattcccctcgatgagggaggcttctctgaggaaggctcctggtgcgtcagcccggcaatgctgtcaggggtcctgtgggttagttatttctatcactccctctcccatgcgacattcactatattgccgtaggtctgagtatagaaagctgctttctcataggctgcctctccccttggcatcatgcctgcagcctggagagctgccatcagggacatggctccgtggaccacatggctggctctctgcatgtgtcaggagctgaaagagaagactgtcatgagccaatcggtgtttttttattttatattagagaaaattcaattctgaaaatagtaaactttaaaagtaaataacaatttatgcttaaaaagtaataatctagtccattttaaatgaactctgaagcatgtgtttttctttattaaaaaggcaactattcgctgtcactctgatgtgatctggctctgtgtccccacccaaatctcaccttgaattgtaataatctccatgtgtcaagggcgggaccaggtagagataactgaatcatgggggtggtttcccccatgctgttctcatgatagtgagtgagttctcacgagatctgatggttttaaaaggggcttcccccttcccttggcactcattctctctcctaccaccatgtgaaggacatgtttgcgtccctttccactacgattgtaagtgtgctgaggccttcccagccatgctgaactgtgagtcaaacaaacctctttccctataaataccctgtcttgggtatgtctttattagcagtgtgagaacggactaatactcgtatctttaaaagataaagtcttgtttccttagacaatctcttatagactatgtgtcaataaggcagcatggcctggtggctgggagcagaacctgcagccagactgcctgggcttgattcccagcaatgtgaccttgggcaagggacctaacctgtctactcctcagacttcttacctgtaaaataaggatcataattgtgcctacctcatggtgttattgtaaagattaaatgagtccatataggtgatgtgtgctgagcagtgcctggcttacagtgaatgttcattaaatagggtcacaggcagagagaaacattaattttcttccttaaatttcctaactcttagggagtcataacttaaatgattctgatttctctagctcttactcatcagctttctctttaattcctaattcctaaatagccatcctgaatctctgcagaaaaaaaatatacattgtatttgatacaatacattttaccaacgatatatatgcacaactgtatacatgtgtgtattgtatgtatatatatatatatatatatacacacacacacatatatatgaaaaacaaaagctttacatcaatatttacccttactgcatgtgatagtttggcatgcatatattctattctatttcattttctttctatgctaatcataacccaccaaattgatttcacaatccactaagctacatctgaaaaacaatgcactatagtaaagaaaatgtttattccctccaaaattgctgcttctccgtctctacaacgttaagatatggattacagttgctggcaactttaaatcaaattttgaacccaatatatttcccagtccctatttaaataatttttaagaacatagtagttataattttgtatatatagcttcaaatcaaacacagtagttataactccataaagatggcttcaagtcttacctcttaaattattacctgtgtaattgcataaaagtgacttcagctagttgcagtggcttatgcctgtaatccccactacttgggagattgaggcaggaaaatcacttgagggtaggagtttgaggagtttgaggccagcctgggcaacacaggctgtttaaaagactttgtcttttaaaataaaaaataaaaaaaatttaattatccaggtggggtggtacctgcctctagttccaactactcaggaggctgaggcggaaggatcactggagccgaggagtttgaggctgcagtgagtttggtcatgccactgcaccactccagcctggatgacagaaagagaacccatttctaaagaaagaaaaaaaagtgacttatttaagcctcagtttccttatctgttgattgggataataactacctcccagagatgttggaaaaattttaaaagaagctgtgtattaagtacatagtaaagtgcctgatattcagcaaatggcagctattgtaattactggtcttttaaaaacaggattgttttcttgttattgagttatttatatattttggatattagccccttattttatgaaaagaatattttctcccaatctgtgggttgtctcttcactctgttgtttcctttgttgtgcagaagtttttagtttgatacaatcccattcatctatttttgcttttgcatgtgcttttggggtcatatccaagaaatcattgcccagaccaacattgtggagcttttcccctaaggtttcttctagtagtttgatggtttcaggtcttaacatttaagtctttaatccattttaagttgattcttgtataaggggtcagataagggtccatttccattcttctgcatgtgggtatctagttttctcaacactatattggagagactgtcctttccccattatgtgttcttggaatctttgtcaaaaatcagttaattcactgtagacccatgagtttttttctcagctctctatcctatttagttggttgatgtgtctgttttaattccagctgttataattactatagctttgtaatattatttcaaaattaggacaaatgaccctgttaaaaaaaatgtgcaaaatgcctaaacagacatttctcaaaagaagacatacaaatgaccaacatacatgaaaaaatgctcaacatccctaatcatcaggaaaatgctaattaaaaccacaatgagatatcacctcacaacgttagaacgtctgttgtcaaaaacatgaaacgtaagtgttggctggggtgtgtagaaaaagggaacccttgcacaccgttgatgagaatgttagtacagccattgtagaaaacagtatggaggttcctcaaaaaactaaaaagagaattaccatatgatccaacaatcccatttctgggtatatatccaaaggaactggaattaatatgtcaaagaatgtctctactttcatattcactgcagcattattcacaatagccaagatacagaaacaaccttagtgcccatcaacagatgaatgggtaaaaataatgtggcatacatacacaatggaatattcgtttcagccttaaatattcaatacagctttagaaaagaaattctgtcatttgcaacatggatgaatctagacgacattatgctaaattagccaagcacagaaagacaaataccacatgatctcagttatatgtagaatgtaagaaagtcaaactcatagaagtagagagtacaatagtgattgccagaggctggtgggtaaaaaggaaaaagaatcaaaaagttcaaagcttcagtaaggggtagtaagttcctgtgatctattgcacagcatggtaactgtagttcataataatgtattgtatatttcaaaatagctaaaagaatagattttaaatggtatcattgcaaaaaacaaatacatatgtgaggtaatagacatgttaattagcctgatttgatcattctatgatgtatacatatatctaaataccacattgtacgccataaatatatataattattacttgtcaattaaaaaaataaaaatggctggacacggtggctcacacctgtaatcccggcactttgggaggctgaggcaggtggatcacttgaggtcaggagtttgagacccgactggccaacgtggcaaaaccttgtctctactaaaaatataaaaattagccagggatggtggcaggcacctgtaatcccagttacttgggaggctgcggcaggagaatcacttgaacccaggaggcagaggctacagtgagctgacatcatgccactgcactccagcctgggcaagacagcaagactccacctcagaaaaaaaaaagaattaaaaaataaaaatgataaaaattacttggcctttaccaaggactacataaggttctcattgatggttctcaatcatggctacatatcaaaatcccttatggagggtttttaacatccacatgcctgagcctccatccatatttattgagtcttccaagatggggaccagacgagataacacaggtgagataacacaacagaattggattgccaaatcaggttcaacaggaaatatagatcctacccaggagctagttaactaatggctcaaatgatacagacaacagcaaaacatgagtcattctccccttggagagctctgaaactgtcaggcacaggtgcctataaatgtccttttcttgcataaagatgcatgttggtccagactgaacatgaaaagtagaagcaatggacgaagtgcattgctcgaacgcaaagatccatttttgtgatggaacatttgcttgttatacatcattaattacatagcttatatgacattttccagtaggctgtaccccacaaatttataaactctaggtttatttacagtaaacaacctagccagatccggtccatcctgctaaaagcataccacagttaaggactctccagctagcaaatacattaccattattgtatttgccagaaggtgggtcattagcatgttaagaaagggcctggtacaaggcttcttttctcaatagttgatacaaattataaggactggaaccactaaactacaccttttctccttttctagtttcagattagcatttgagaactcatttgaatacaattctttttaaacaaatatatacaggactcgatactcaggatgtcccaaaattcttggggtaattccaagcattacgtagcataaaccatatttaaatagcttacaacttccccaagactgtcggcaccctgtttatttcattttttgaatgagaaaattgaagcaatatttgttttgtttattggaggaggaggtgacttttgtttctgaacaaataaaaccacgaatgcagtcttccagtagccataactcagaagtggtggaaccatgtttcatatggtaggcactcagttgtctcatgtggtatgctgtcatatgcttacccaaatgcaaatgatgtacgtaatccatgtttctgcagatactccattgatagaagcagtgaccctggaagatttttctatgttgacattacaacaggtgccctaatgacagcaagacccctagaccgggaagaattttcttggcataatatcactgtccttgctatggaaatgagtaagtagcacagtaagttggtctccatgcagtgacaaaatataggtgttatagaaagtggaagtttctagaacttgttgtaacaaaaattatatcctttaagggaagaaatggaaatcatgctttatgcaagtaagtaaatgcgttcagttcaaatacttttttgaggctcgcttgtatacttagtcctgtgctagagataaaagcaaacaaaacatggaaaacagtgaaagacagcattcttatcccaaggagctatgaggaaaagggaagattcctgagaaatctaacaggctttcaatctttaatatgattgtgaatgtacaaagagtataaaatattactgtatgaaaggaagcatttataacatatcactcttattatacaaacatatacatatccatgcccacaagaatttgagataccttacaataaaaggcaaattgattaacgtaataaacttataaatggaatggaagattaataactacattaatatatattataaacataataaaaattagattatgtactactacattcctttttttttccatactggtgatagtaaaggcttagaaaaatggcagtccctaacctattggctatataactaaacagccattcaggagggcagtttggcaatatgtattgagattctccaaaatatttatactctttcaggaaatctactgctagtcatcatattaaggaaataattacagatatcaacaaagatttaaatgtgaaaatttccactgccatgttattttaaaataaggagaaaatggaaattacttaagtgtctaataataggagactaaataaattatggtacaacctatagtaaaatgacaatataatacagatgctttcaaaacatattcaatgacaaaggataaccttaccctaaaatattaatgttctgaattcaatctttctattttgcttaaatgtaacttctgtgtcagggggagggtgtataactccaattttagacacccatgttgtataatgtcatatatctaatggatatctctggtggtaggactgtggatcatattcatggattcatctatgcttttctggaattttcattattccttagacaaacaccactgttataatgaagaaataaatcttaattttgctagcatattatggtaaccaagcaatagaagtatttaggggggaaagagtagagcataattttttgggaaagaaaggaagaaaaatatgattcagaagaacaatgcattttgggatttagtaaaattattaaccaagaataatttctgtgtctcgcaatttctgttttgtctccttggggtggtgaccaaaacagaaaaagacaggaggagcactaccagagctgtgaaactgtctctgcatggcagtgccaagcaaaagacacagatcacaaagacacagctccccatgagtgtctatgaccccagccaaagatatggatttggtgtgtgtttgatcctgtaatatcctgttagtccctaagcagaaataaatgtgcagtgttatctttattccagtgaataactcgaaacctttgcaaatgtaattcaaagaactgatgattccacaggaagaaagccaagcagtgccacacagtatgcatccgattggcaatgggctcttttaaagcccagaatacagaactgacctgcctttaattccaagacttgaagtctgagccaaatgggagactgaaaacctctttttaagattcgttttttgacacttgctccctttgtctcacccttcccttcatactgctgatagcaaaggttcaccaacacacaccttattctgtccaaacttctcatgtccggccacactcttagtaggcaacacatggatcctatgctcttgctaccatctccatgtacttcatcctctcctttcaaatccagactcaccaagtaaataactactttgttttttttttgtttgtttttttttttgtttttttttttgtttttttttttttttttgagacggagtcttactcttttgcccaggccggactgcagtggtgctatctctgctcactgcaagctccacctcccgggttcacgccattctcctgcctcagtctcccaagtagctgggactacaggcgcccgccaccacgcctggctaattttttgtatttttagcagagatggagtttcactccgtgttatccaggatgttatccaggatggtctcgatctcctgacatcgtgatcctcccgcctcggcctcccaaagtgctgggattacaggcgtgagccactgcgcccagtcgtaaataccgacttctagcaaaaaccattactctttttttttcttttggcattactaaactctcagatttggttttccttgtgttccctttagacaatccctcccaggttggaagtgttcctgtcacaatcaaagtcttagatgtgaatgacaatgctccagagttccccagattctatgaagcttttgtctgtgagaacgccaaggcaggacaggtaaggtggcctgtgggtggtgcactctgcttaacccctaacttctggaaacaattgttagataaccaaattcaccatcaaagccattttgactccagaaacgaacagttcacaaaacagagtccctaattcccgtatatcaggtttcaaccatttatttgttaagacaactatttgaggctaggtgtggtggctcatgcctgtaatcctagcatttttggaggctgaggcaggaagatagtttgagcccaggagtttgagaccagcctgggcaacatcgtgagacccaatctctaaaaaagtgaaaaaacaaaaaactatttggaacctacattaccttttatggcctaaacagcactttgagggtggccagatgcacacaatggccgtataaggtatgtgtccacctggaaactgaattgtgtagcacccatggcagtaacacctgctctgaggcctggaagtgagagaccaggaagaccaggaaaaggaggaaaaagctactcttttcccgagtgtggtaccaattcctcaaaatatcttgcagtaggacaagtttattttctatatctttccacctccctttcttaacttctggcaagaagtaccttatttagggactccctggcctatctcagaatgctgccacctagaatgacctaccttctctccttcctcaattaaaacatccattttcttagtgctgctcatgtcaggtaagttttgagaggaaagtaatccaaaaggataaaggtctacttatttgaaatatacctccataatcttcagagacatatttgtgtattttttaagtatgcccttaaacctaactgaatatttagttgatcaaattctaagtggtgtaattaagaaacatctggaactccatttggagtgcccatgtagcaatgcatgtcaggctgttgcctgccctataatctgtccatctcctccattctgctcctgcttttgtaagatgctttcctcccctgtgtatgacccagcaaccctacagatcccctaatagtcctcatctactgcccttccccaccctagtatatcctgtggtcctgtggatgctggtgctggatcaatgggctggaatggttttaacatgaaagctggggaagcgcatattgataaggcagggactcatgcattggtaattctggcccctgactgtaatctaactttgccttcatgtattagtccattttcatgctgctgataaagacatacccaagactgagtaatttataaagaaaaagaaggttaatggactcacagttccacgtggctggggaggcctcacaatcacggtggaaggcgaaaggcacatcttacatggcagcaggcaagacagactaagagccaagtgaaaagggaaaccccttataaaactatcagatcttgtgagacttattcactaccatgaaaacagtatgggggaaactgcccccgcaattcaattatctcccattaggtccctcccacaacatgtgggaattatgggagctataattcaagatgagatttgggtggggacacagccaaaccatatcacttcacttctctcactccctgggagtagtacctccagcatcttgctgcacagagagactaggtctgcataaccaaaacttatgttagctctctgaactcaccaaagatggactcgacgacacatctttaccatttactcagccaaagcaaaaagtgatttatgtccctcaggggaagaaagatgttccatcacgattctgatctaaatttatctaacaatccttgaaatttggtgcaatggtctatagccctcctaaaagattcttttcaacaagtctaggataattctctttccacatctagtgaatttctagtctactaagacctgaaatgttatgcagccaataaaagttataatgcagaatttacagcccaagaaacgatccatgttattataagtaaagaagggaggtataaaaactacacctacatgcttgcagtcatgtaaaattatgactgcaagtgaacaatgatcgagagggaagatgcaaaaatagtataattactgtgctaaggtagttgagtttaagtgaggagttttgggtctttattttaataatttttgttttatattataaaatttatatatatgtaatataaacttgttataaaattatatgaatattttgttatgataaaataagctaattttaatctataatacaaagagggtgataagtagcagagtaaattaaacctccttccccccaaaataaagggcttcagagtaggagaggttgcattctaacaagtgaagaacatttcaactatctctcctgtttttgtaatcaaacaaacatagtccccatttctaaatgcatcttttaatagtttgttatacagtgatctgaagtacagatctttcacttcaagttcagtctgtcccatttgtcacctttaggccaagatactgaaaatattaacctttgatttgggctctgggaaatgttttgaagatttttcaaaagcatacagctcagagatacatctggtttataaagtatcgggcctccttgtgtttacttgttggatactgtcctccgcttcacatctgacaagtccagacacatgcttccctcttagtaagcagccttgaaggaagcccataaagaaatcagataacatacttggtgatggacaagggcggaatgaaaccagctgagcagaatattgcacgacaagtggggctgaggaagaaatctgacctgctgggagaacagagagcaggagagcgggccatgcgctcccaacccagacttagcgatttgtatcttcactcactcatgctttaaagccctgtaagcaaccagctctgtgcctcaggccccagtctcaccaatatatacacaatacgcaggccagatattctgaaacgactttcccaactatgtttatcaaattacgtagaatcacctatgtgtaacatgcctcaagaaatatgttacctctctatgtgtttggcactacaagcaagctgaaaagtgccggctctgtctccaggcgggataggacaggagggtaatcctggagtgtgagcagcactgatactaggattggctgtgagcaagtttatctccattagtctcctggccctcaccttcctgggaactccattccccctactttcaggttcaatagttggggtctccaggaggcataccctgagatggagttccagtataaggtgtttattaaggagggcccttggggccagcacctgtgggagggaagtgaaggaagcaggactgggcaaaagaagtccagctgccatgcagactaactgccttagctgacttctcagagagttccagaactagagtttccccaagttgagatgggatagccagacccgtatactatcacattaattagtcactggatgtcgccctggaaggatgtggtgaccatgggtgtctcagtcggtttgtattgctataaaggattacctgaggctgggtaatttataaagaaaagaggttcatttggctcatggttctacaggctgtacaagaagcatggtgccagcatctgcatctagggagggcctcaagctgcttccatgcatggaggaagggggaaggaagccgacatgtgcagatcacatggtgagaggaagcaaggcaggaggggaaggtgccaggctctttttaacaatcagctattacaggaacaaagagagtaagaactcaactcatcaccaggacgactgcaccaaaacattcatgagggatccacctggatgaccccaacacctcccaccaggccccacctccaacaatggggatcagatttcaacatgagatttggtggggtcaaatatgcaaaccataggagtgggtaggtggctctctgcaattggcaatccctaaagggactggtaggtgacggggaaaaatccttcattgaagggggatctgagcaacacagtgtccaaaaggccccgatgggagctccccctaccaccacccccagttatttaatcttcagcatattgtgagagttagctttagctcccctaatttacagatgaagaaatacaaactaagcaagcccagctgggacctcaaactgacctttgatgtcctggttcctatggtggtagaagcacagctggcttttaaacagcaggattggcaagtctacagggctgggcccaagatgggtaggaatagtctgtgctgttgcttggtagaagaggaaacacatatgaaggaggctgccgttcaatgcctcttctgtaaccccctcagcctgccagctcctgttccagtcgtctgtttcacacagatttctttaatagcttttacatcatggtctcccagacttcatgcaacttactcctttgaaaaacattatggaaaaggcaaaacgtggccagtgagtccaagaggaagccacctgacctcctgctctccccactccagagttctgcttctgactcttgtctgttctgcatttctactctggggatcctgtgctatctttgctagctctccctcctgccaacaaaatgtgactctctgtgacccattccctcatgtctgttttctgttaacctgacatggccaatgccaatgggtcactcacttctcttcaggtcatggtcattcttaaataggggcttcttaaagacagcaatttagccctgaaatattgggccagtgatgaggttaagtagatgaggtgagaagaaaatatggggtcaagcaggactttgtggcacccgagccctttaactcaaagtctcttattttttagactgcctagaaacggctggccgtggtggaagaatatatgttattttgatgtctaacatctgaagtatttaggtaacatttatcctatgcctactaacatactcaagcccaaccctaaagcaaaattaaatcccaaggtgtgtgatggcatggagactgtgcagggaagtttcacatggaacgggagagttcccttatcccccttgcagaacaggggtgtgccctgctgctcaaacccctaggggaagcatgcagacgggcaggtgcagaagccatggggagcgcttttgggctctggcccaaaggcagcgtctaggactcctgaagcccaagtgggcgtgtgttacagtgtgctcactctcagctacgccttctgcagacggcttgtattagctcaatagaccctctgccttatcacaaggacacagggccagtgtgacagcctgagttcttgcccagtgaactggaaaaatcagatcacacatgggctggaaggctgagtgcaacgtttattgagtggtgaaggtggttcttagttaaatggatgggaagccagaagcgggggatggagtgggaaggtgatcttcccccggattcgggcttcccagtggccagattcttctccaactgtcccgggctgaacttcccttggcatccgcatcattccaccatcgctagtctgccagtgtctgctggtgtgctcctcttctcctctcaacatccagctgcttgtgtctgtgcccgctaaggtctcaagttcatatgggtacagaatggggggcgtggtgggccagagtggtcttggaaaatgcaacatttgggcccaaaaacaggagttcctattctcacttagatccgtgggcacaggccagaggatggagccctcaccaggaaccctgcccttctctacccagcatttccctgcccctctcccataccaatgatatccttctcataaggtaaaacatcccaccatcgcgtttccgggtttgggatttaactgggccctggtgctttttcctttggctccaactcacctgatttcatgtccctccctcagctgatccagacagtgagtgcggtggaccaagatgacccacgcaatggtcagcatttctactacagcttggctcctgaggctgctaacaaccccaactttaccataagggacaaccaaggtaatcaggtggatggttggctatctgtgcttttctacagcataggccagctactttgggttactgtcttatgcaaacagtgtcaaaggctacctgttccataccagcagggaggatgttaataattcagtgtattttttttttttttttgagatggggtctatgttggccaggttggtcttgaactcttggcttcaagcagtcctcccatctcagcctcccaaagtgctaggattacagacatgagccaccgtgcccagcctcacagtgtcttttaaagttttgtttcagaacaacaaacacagagaaccctttgccaactctaaaactcattcagtcagtaagtcggcagatgtttactgagtgcctgtcccgtgccagaaacactgcaaagcacagaggcaaaatccttcattcccactggtagcagccctgttcatatgttctgtaacaacgggaaaaatctgagaaagatagaaagtgatctaggataaaaaataaaataaaataaaataaaaaacccctgggggcacatttctaggcagagatcaaagcaggaaacagtaaaaagctctccaaacaataaggagacaaaggataatagagataacaaagggcaaatacaggaccataaacacagttttggcactgaaacagctttattactttagaatgatttagagaaatactttcaggtagggttccctatccataaactgctccccgctatagctttgatggaacagaattctaggcccctcttttccaacaagcattcagaccagctaaggggctcatagacccagcacactcttctttgggcacagatgggaaaaggaaggacttttgttctgtagccagatgatttgcttcaaaagaaaaaaaaaggtcagggcaatggaaaaaataagttaaactgtcaaatgaacctcatctgttgttaactctgctgccagctagccagctgaccctgggaaggtcatcacttcttgagactgcagtagcgtcattttcattccgattctaaaatattaattgccgctttgtaaaaatctaagcaaagggtaacaaaaagtcatgattaggttaggcacgcctggttttagtttcaaacatcaattatttgagattaaaagtattacttcaaccccacatgacagttttctgctgtaaaacttgagattctcaaacctgttttcttctaaatgggaaagcattcttctaagtcatcccttcaacctcctacatgtcaccataaaaatactataataattctggaaggaatggtaatatgaattataaaggcagaaatacttcaattaaatatcctgaagttcttattgggtcaaaattttgaactattcatttatctgcttcatagggaaactattcccgcaaaaagtgctttcaacctaggattggctttacaaaggcaaccctggggggggaaaataacacattgtaacacattatattttttcttcaactgttcagctaagctatcattctaatgagtgaaacaaaatgcagcaaaatgctgcaaatttcttaaagaggactttgggcaccaatttatggaaccaattccttaaaaagatgggccaccggcactggatgactatagtaagacgtgactcatctcttggaaggtttcccaaaacagaagtcagcacatcttcaacagaaagcatgaactcttaatctccaaatgacaatttatctcacgagtatcctttactggggctcattttaaaactgaacaagtctaggcacagtggctcatgcctgttactccaacactttgggaggctgaggcaggagaactgcttgataccaagagttcaagaccagcctggacaacacagcaagaccctatctctgaaaaacatattttaaaaattagccaggcatggtggcacacacctgtagtcacagctagttgggagcctgggacaggagggtcacctgaggccaggagtttgagatcagcctgagcaacacaccaagaccccatccctaacaattttttttaagtagccagacatggtggcatgcacctgtagtcccagctacttgggaggctaaggtgggaggatcatttgagcccaggagttcaaggctgcagtgagctatgatcagaccactgtactccagactgggtgacagagtaagatcctgtctctaaaaaaagccaccacaacaaaaactgactaatatagggcagatctactgtcaactacctctgttcctgtgcctgaaacatgatgtccttttatgaacacaacagggcactatctccagtaaagcctttttttacttttcagccccaaaacattatgaaaagaattatgtgtatatagtactttacagtttcaaagtattttcccataccttatttgatatttacaataattctgtgaggctttaaggaagttattaatccctctgattcttattgtcccatctgatagatgaggaaagtaagcaaatggcccaagaccagagtcaataagctgaataagcattaaaactgggattagaaattgagtcctgttttaccatgcccccccactacacccccgccccacacacacagtgttctgtgtcacctcagaaaaaaatgctgtttccaaataagttactaaagtcctcattatcacattcaacaaaaattttccaagtggctactatatgccaggccccttccagcactggactcagcaatgtgatgctctgatatttttctttaatcttaaataattcttagatcaagaaacatatatatcgtaggtataatacttttatgaatttcggctctagtcagactttctaaaagtctcatgacctcacctggattaaaccaaaaaaattaaaaaaaagttctgattagagaaaaacctgctttctgaaaaaacaagcaattaaaactacaaagtggaattgatagtatttagctattaagtctggaacacagaaaggtgcacgggttgtttggtaggtggaaatatgaatataatcctcaggttggcatcctttctccattgggaagaaaataagaagtagcctgtatcaaagcaggaagaggttatgcttatctgaattttttttgacagttaatattactaaactaaataagcagttatgtagcacaatggaacatgtacatgttttggagccagagagaccagagttcaaatcccagctctgctactaactaggttagtggcttcaaacaaataataaaatcactctaggccttacttctatttctgaaaacgagtaagattattactatgtccaaattgtgaagattgagtgagatactgcatgcaaagtccaggtacatggcacatgagcctttagtaacaatagctgttagcataaaaagcagagtggaggaagaaaagttaattaaggggtaatgtgttactcagaatagcccagattatgctatgggaacaactaccacaaaaatctcagtggcttagcacaactacagttaatttcttgctcacatacagcctgctgtgggtctgagctcagcgtcccaggccgccccgctctgcatctcacaccctgtggttctttctcagtaactacagcaaggaaagagcatggagacttacacaccagctcatacagacttctgcctagaagtaacacaaatcactattgctcatcaactaaagcaaatcacacagacatacccacatttaagaggatagaaaagtgtaatcctttattatgtccaaaatgggaagaagaaccagaaatattgataatcactaataatgttttcttaggttaggctctcaaaattttttgtgatgttctagactctttcctatgaaatatgaaacacatccatgggacctctgtgttggtggtattagctttgagaatcacttcttgcatgtcctactacatctctcaaatttttcctctgctgaaaataatctgagctttgcaaaagtatatctactttagaattcaaacctacaccaggaaacttgagaatgtagattttaaaaatgaaaactcccacaacacaatatgtgaatataaatgtaaacacacacacatacacatcccaactttgtagaaaatatctaataatttgactaatcccctttaaaactggaggaaagatttctagtattgatcagtaacaaagtttcaccaagttcattttaactgcttaaagtgagaccaccaacccaggagaaataacaaggtgtgtcatatgattaggggatttcaaagaagcttctactaaatgagcaggttctttaggaaacacaggagttggtgactgcatttcagaagcataaaagaaaatagtaaaagacgtgaattccagacaaagcggcaaaaataagtaatctgccacagtcacacaggctcctcagcattcttttcctggaggcgcaaagcagcactggggccttggcaagctgctgagcaggaacaaacagtgaccacaagtcaccagtgattgttcttttctgtcaagctttcccagggacatttttgttagatctgaagtctgacagtttgccttgggcactttatgtcacaaaggataagacagactcaaaaaaaaagaggctttctcttcttaggcctcagggttttgcctaaaagcaagcaaaaagcatggtttctgaatccaaatgctgatccaggcaaacccgccatggttgaccactaccagggaatatctgactatcctctttccttcctacaccctgcccctgcccccttgctttcctcaatccaagaaattaattcaccttcccttttccaatcctggaacccctccttctttcagataacacagcacggattctaaccaggaggtctggtttccggcagcaggagcagagtgtctttcacctgcctatcctgatagcagatagcgggcagcccgtgctgagcagcacaggcacactgaccatccaagtgtgcagctgtgatgacgacggccacgtcatgtcctgcagcccagaggcctacatgctcccagtcagtttgagccggggcgccctcattgccatcctcgcctgcatctttgtcctcttaggtgagtaaggggctgctttcccttctgtggagtcctgccagagcgcactcagacatttgttcattaccttcctgacacagctattcagaactggtcttccacaccttgcttactcaaaaggtggtagagtgaggctgcacaaaaaacagtaaagaaattgaggacagtcccttcttcgaggtgtctgtggcaagatcaaagcacatatacttataaagtatctactatgagctggggcaccacacaaggtgctaggattaataaaacagacaagtcctggccttcctgagtttacttcagaacaaagcaggttcattttgacatcatagaatcaaaattacaatttagacaggatttgatgatcacctcttctaaccccttcatttaagtagtagctaagtcacaaacgggtaagtgacaggctcaaaaccaaagtcagaggcacagccagggctgaaatgcaggcaggctatatacactgggcacccctgtggctcaaaggcactgcctttctcctaaatgctcatcccgattctggaggtggtattacaggaagggaagagggataaggtatcctggttggaaaagtgacagggatagacgccacttcaaacagggtagtcagggaatcccttactgataagacctttgagcagagagctgaaggaagtgatggtgtgaaccacacagatttctggagaataagctgtttggggtgattagtacacctcctaggcaccatggccatctaaccaggaacagtgactaaacagggtcagtttgcctctgctgaagaaataaggacataacaggctagcagtggcagaacactactggggtaaggaacccttccttcttcctctcaagtcatactgcaaggtggctccccaactccctggtatgtaaggccatccttgcaattcttttctaattccacactcaaaaacagtgaaataaaaacacctaaaccaactcttgcaaaaaagaaagtatctgtacatatatccttgctcttcttattgaactaatctatagcatatatatcatgcttagagaaaaacagatttagtagatactagtattattcaatacaaaagaagtccgagttttctgagggaaaaagccctgaggattgaaattagaatagaggtacagatattcacatacacccttgatcccaagttcacctctataccaagagacagaccaaagaaagaagttcctgtgtaaaatgtcaacacttgattttctaggtaggtccgtgcaatgtgcttctcaaaatacatttaaaaatacaacatgtggtttaattttgttgttttagttcagtcctacgtaaagagaggaagagtataaataagtaacctttctaagttcttggatccctgtgtcaagagaaaattgttacggtttctggtccctgactgcattgacaagtaaaacctccctgcaattccttgagtttccataaggtggcattgggagtcctttagcacagaagtggacgacctgtaagaggcctttgaagaaacttgttcctgggaggaatttccagactggctgtccttacttctatctttggaaaatgtcgaagttaaaagttcaccctggcccacaaaaagccatcattacagaaatactgatttaaagagactggcttggagaggctctcaagttaaaaatggtgtgcaagggacaatttatcttatcccttcccacccacgatgatgtcttgtcttttaaaccgtacagaaaaagtaaacagttttcaggagctaaattgagcagagctgtcataaaatcctcacagttttaagtacccttacttctaagagtacacatcccacattaaaaataattcatcaaactttaagatttgacttgcatttgtcaacaaaatactatattttatagacaactaaataaattaattctgacttcctgggtttttttttttcatgtctcatatatgtatctagtgcctagaaaatctcataagctctacgcaccgtgcctatagtacacgaagaataaaccatccctagaactaattctcttctgtcagagaagcctttcagctgaataagaccattttcctcaaaatctgattttcagggcatcatgtaatatttgttatgtaatatttgttatttacctaattagattaccttaaaaaaaaaaagacatgtagctgtctttatttttcaaaagacggactagttctatataaacggcctaattctccatgaccatcagaattctctccagcaaggtattcaaaagacttccaattttgcttcctagcgttatccaaaataccgcccctaccacttcaaggtcacctctgtgaagccctacccagtctcccaggtaaaattcactggccctgcctctgtactctcccagtgacacttgtggctctaacagcccttatcactgtctgacttgcattaattatcagcatccataatctccttagattacaagctcacaagagcagaatccatgtcacactcaatattgtttccccattgcttagcatagaggattaaaaatacttgggtttaataactttactgaatcctgcaaacacagcatgctcacttcgaatctcacgtctccaacctgcatcaatccaaatcacactccaacctttcaggctcgattcaagcccacgcttccttagagtcctattagtctctttttctctaggaatcccaccctcctttcagtccacgcctcgtatttttgcacacagggaaaatacacatgagcgtatcatcgtttcctgtgtatgttttgtcaccaaagctatctgggaaaatattacgtattaatgtcattaattgcaattgataaaaaagcacatctacattcaaaaaaatttttaaatcattgttgtgagttttattagtcggtaatcttttactgcatgtatgaatgtactccactttctccccttggataaactggggtcttattttgcagtgctgtcaaactgtcactgttcaccagctataacaaagcacaccagaaaaaaaaaaaatcaatagcagttctacagctaaaacctcaacactcttcctggaaaacgttttcagagagataaatagctcaatgggattatctctatctctcctttaaaccccagcgaacacattctaggggggaaaaatgcatttgttgggataaaattttatccaaacctgcaagggcacatctaacagtgtggtgtttctttgataacatgatgaattatataaaaggccactgctcattctctgccttccataaatacccttgggtccagaaagccacaaccacctctttaatgaaaggcttctctgaggaacctgagtttattggaccccagggatcacttatgttctgttgttttttagaggtataaaaagactacaactttggtgcacacttagtatgtgtgtctctatgcatattaagatatgattatatacagagtagaatcctattaagatgctaatatacggaagcagaattccacctacataataagactttcacattataagaggataaatgtatatttttcatcatataaacagagcacgtgatctggtccttagagtatgttggtccatagcaggcctttgtgctttgttagtgggattttaaattgggtgttaggtgtagacacacaatttcaaaacagcaagctgatggtaagcgactataggcaactttttctaattaaaccatttgaagaaatacagggcttcattgtccacaacctgacttacagaaagaggacaaagtggacttaaattagaactccccgaggtttcagatatccaaaagctatctctgagccctccactcggtagcccttcccctatccgtggtgaatcaagactacttctagtcaccgcacacacagccacatctcctcggtaaacacactctcctttttgttcctggcagtgctggtgttgctcattttgtccatgaggcggcaccggaaacaaccatacatcatcgacgacgaggaaaacatccacgagaacatcgtccgctacgacgacgagggcggcggcgaggaggacaccgaggccttcgacatcgcggccatgtggaacccccgggaggcgcaggcgggggccgcccccaagacgcggcaggacatgctgcccgagatcgagagcctctcccgctacgtgcctcagacgtgcgcagtgaacagcactgtccacagctacgtgctggccaagctctacgaggccgacatggacctgtgggcaccgcccttcgactccctccagacgtatatgttcgagggggacggctctgtggcggggtcgctgagctccctgcagtcggccacgtcggactcggaacagagcttcgacttcctgacggactgggggccccgcttccggaagctggccgagctctacggggcgtcggagggacccgcgccgctgtggtgacggaagccaggaggcaggcgcgcgtccaaatccagacgttctccgcgggtgcttcgcggacaaggtgcagccaaccacacgagcaatactgtgctggagagtgagaatgggggtgagcaggcgaacagagctctctctggatcagctttacttgggtagattaagttaaataagcaaaaggaaacccagaaggaagagggcagaatctttaattacctttttttcttttctttttgatttttctgacactgtgtgcgaaggcttggagtccaaggtgttctgacaagggtggcttttctctgccattcgctaaggcctttgtcacttttccaccacagaaaggctctggccttggatacagagatgccaattgaaagcagaaagttctactctcgtatctgttttttatcttatcttattctccatttaagagttttgctggctcaaaccacagaaaccaacccacaagaaagaacaaaaaacttgttactcagtgaaattaacctacttgttctgggatggatggaatttcccgtaacccttttgagacaaggttaagactgaatcagccttgcatgggggtggatgggtgggagggtgggtgaaggaagagacattgactttatgctcaagtttagtggctgaaccaagagatgttggcattacagctcatccaacgccatcaagttagagtgctcgtgtctcctctcagctatttaactgtgcccctgcaaaattgttcagaatgaaaccagaaaaatctgcctcttttgcactgtagatgtctcttccatgtgccaaatgtggagattagatgctacaaatgaaagccaaataaaaaagaagtatctgacaaaagcatgggttagagggctttcctaatctgtgtgaggtcaatccaagggatgtttacatactgtagataacctacttgaacaaaaatcagtattatagagaataaatggatgtaagaaaattacatgtacaagttttgtatatttgttaataattttggtaataaatatgatgtactgcatctcagtaccttagcacttcttttaataaaagttaaatagaaggaaaagtctattgtgaatttgtttaattgctgaacaggtagaagatgactttgtaatcctgatctagcctcaggctcccggggttggggctaatttgtaaggcaaaagcaatggaaaagaagtgtgaggctgcattctgtttcagtagctaaccatatgaacattatggttcaaactgttaagcttttaatgaacaccctccatttcttcatccctgaaaagagcaaagggtggtttggtaatatcaactatacaatggtgaatttagcccatatttttcattttgcaaaaggttattacacatagcccccaatgaggcaggctactgtgctacttacatctctatttcattggcaaattgagctcacagatggttgaaaccatattttattcatctttccttttgctacaatagctagcatactcttctgcatacagtaggtgcttaacacttcttggctacatgatgggagggatctctatttgacattctattactaaaaaatattttacacaactatcctcacaactgaggacaaattgtgaacaaaatcattccctgagagccttgattatagcaacagttctcaaattttaatgtatcagaatcacgtgaagaaattgttaaactacctcacccctagaatttatgattcagtcgatttggggcagtttgtatttctaacatgttcccaggagatgctgatgctgctggtccaggaaccacattttgaaaacctctgatatgtagttactcactctctaacacatgaagattaaactatgtcccatctgtactgggtcccatcttcccgcagagtggtgttgtgaattgttttctcagtaaaacatgaacagtttacagaaatgtaaggaaagctgatgagggtctgggaggcagtaggatgtgcttttttgcatattacacattacatggtaccattacatggtacattaacagccaccaaattctcttcagccttcagcatactaaccctttcttcccatgaaaggcaggcagctctcacacatcctcttcaaggatagagtgcaatgtaaaaataaatacatttaacaaagcaaaagaaaaagcatggacttgagtccaaactaggctttacaatataccaattatatggatgtaggcaaatcaacctctataacattcttccttcctaccacagccctgaggataattttgtgagtatttcactttgtactgcttatgttacaactgagaacagctgttatcctaaccacagggcgttatcatgccccacatcctgcaaatgtggtccccatgatattgggcatgaagtaattaaacaaaatctcctgaatcttctggtccctgggagg

SEQ ID NO: 15845 - DNA, 133559 bp, Human
  misc_feature (1)...(133559): n = A,T,C or G
aacccaggcaatccaagagcagtttaaaaatagcttggtatggtcagatttgtgataaatgctagatgggatacaaacacttctttattcaaaaaatgcttactatgggccgaacatgtgctgtgtcttgatgatattgaatattaatcacagccctcctgaagcttttagttcagaacagttataagaaaaaatctcatcccagaagtcagttcgtaggcaaaacaaggcaaatatatgtaatgttaccagaaaaatctgaattgaatctaaagattgtactacatgagccagaataattgagcattttaacacagaaaagtatttcaaagagctcaaagatgaagccaaggtttgatacctggctaccaggtgaatgatagtgcccctgacagaaaagaacatacagggaaaatccaagctaatatctaaaaaaagatacggaggtcttttctaagcatcttgaatttgggtgatggctgacagctgagtggaaatggaccatgaaatggtcatccaagcagccctggatctggggagctttggggttggagttagaacttttaaaatgcattaatgttaggtaagcaacataggatggtatctggaacttaacaggagtccataattgctgtcagaattattagcatagaattcggttttaaacattgactaaattgaatgggcgaggtgggggaggcatggcgccagttaaatagccaggagaggctggactggggacagaaaagtgtgcttgactgcacaagaaatcagagataatggtacggacaagcctaagcccatgtaactggtatccgaagaattactgctaaggttaagtaagaataagtgcgtaagagaaagaggacactttccattggtagagtgagaaaaatgaaaggaaggtagttggaaatgatctcttccccctcctaacccctatgacagaacacccagtcatcagattaaagcgagcaccagagcaggggaaaacaaagcgtgctcaactccaggggctgcaccgcgctctaaagaaaagaccagatcctcttccttccttctttccttccttccacaccttgcaagaggtccttttttcccgcactgggggtaaatataaacactttgggaatttagccatagggggccccccacggggggaaaattttttgcaaatttaaaaaaaaaaaaaaaaaaaagtagaatctagggcagtccgaggagattgaaagggcaaaactatcaagcaagaaaactgtaagttctgattagttttatgactttgccttcatgcctcaggagctcaactgatcacggctttcacgacaggctaaggtgggtgttggaggggcagcttgaaaataccctcaaaactctcctccagctccgtgctttcagatgcaaatgcctcacggagagatggatgggctgcagcccctcctactttcacccctcttctttattttcctgcgaaggaatccatctgtacagatccgccaggcgggaggtggaggagggtgcgcgagggtgcgcgcgtgtgtgtgtgcgcgcgtggcggccgagcggctccgtcttcgcgttcttttccagtagcccccaccgggtctctgggaggcgccgaagtctcagtggctccctgggccggcctccgacagcgctgacagcaggcgcccgccgcccaccatcgtcgccctcttcccctccctcttcggccccggctccggcgcgctctctcctcctctcctgcgcgccctctcgccctctctctggccgcgcgctcccgctggctccggaccctgcgtctcagctgcccgggggagccggaggggcccctcgcagtgagcagacgcagcgggcccccggcgcccgaggccggggcagggtccccgcgcaccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccagtctgcccgcgcgcggagctgcgcgcactgggtccccaagagcccgcgggcgtccggcagccgagcgcacgttctttcggatgcacacgcccgggtccctggcgtctgacgccgtggggagggcagcgaggccccaggtgagtgtgtctgcctgcgcggggctggggaggcgccgctgggcagatgtgcgcccttgctgtgcgcctttggaagcaggactaatcagtgagcggagagcgggcggggatgtccgtgtggagtttcccttggcgtccccaagttactgcgtgttgcagtgagatgtggctctgcaaggcaggacaggcttgtggacggaggcgggggcgtttggcccggaaagccggtgttgacagacaccaggtgcgacacgaggagtagtagttgagggtaagagcaaatcccggcactctccaggtgcagcggcaaacatgggcaggctggagcactctcctcaaagaggaccacaagcaggctcctccctcaacctcggactgatgggggcacaactccgcgccggctgtgccgccgggttctgcagaggtctgaggctggaagggggtatgcgccgctttgggcaggagtcctttgaaccattcgctctggacaccttttacctttcgtgaaggtggagctcacttcagggtgctttgcttttttcccctgtaattagtattctgctgatctggttcatctgcatcctgcgtcccctccgcctggcagtaccttaagtgtgcgctgggaaaagggcgccctgcttctctgaatgcatggtggacttcttcatgggtgcacatggtacactgctacttgccggtattcaaccttccagtgtggattaatgagaaaagacccgttattctgtaccgcttcacgttttagatcgttaaccctacggatttcttaaatgtcatagttcaggtgagtaaagattggcaatgagttcacccagcactgggcaaatggcaaactattgagaaaccatcaaggattgggtgtatcaaggctttggagatctgcaaattgaacgaggaatgtacttataacatcttttgctttgcaataaatatcttgtctctattagatcgtttattaagtgagacctttacgtaagacttgtcctcataatttctgtagctactagacaggtgttcagatcatttttcatagagaagtagataaacataactttatacaaaaaataagagaaaaatgtaagtgacttgttaatatatggcccttgccaagtgacaagtatgtatttttaaaagcagataacacctcacacaaaaaatgtgtattttaagagtttaagagcagtagcagtctttttttctaaaggaaagtttgcatagacacaatatctaaatagttttaagagagtctttataaaggcaaattgttatgggagaaaagagctaagaaaaaaaattaattacatttgaagcgttcagtaactcaccaagaattacttctttcctaaagaactagttagactttggtttacctaggatattttcttgttctatatgtcaaggggaaatgcatgaagaatccttttctttatttttaaggctatttggaacagtatgaattaaaatgcaaaagaattgagacaggtaggaagactggcaactttgtggaagtcttgcttctgtgttagtgtttaatatggagtgggatagcagagcaattaggtaacatccaacgtcaatagtcttatctgggaaagctagccgagtctgtctgaggaaagaaaaataaagaaaacaataatcagtagcacagaccatcaccctgctaaaagctattaaggtttgcagctttaataaaagggcattgtgcacttacaacgtgagatattattgtaattaagggctgcaagaggtcattagaattgtgttaatcactttacagactcacaagtcttcttaagtctacttttattgatttaatagcacagagctttttcctttcttataaaaggataattgtaaagcatctatattactgcaatttacccttgaattgactctagtgtttagtgtccaatgaagaagagagggtggagagcacgcggagttggccactgttcagccttccttggcctaaaaatcaaatgactgtctctcctgggcactagtgtctttactggtttccctgttattcagcattttgcttttttgatggcaaagctgatataaactcctcagagtgtatactgatataaggaagtgaatatatttttgtgttgagcaaatacttttttgtcagatctttcagaaataatttataaaatactaaactcacaaattgttctgtgctgtggatatttattgctgaatggttacaatcttcctggatttcataaggttttacatttattgcattaatagcttgtatcacatcacagttctctctctcttacacacacacaaatgtcttttacttgattggaagtcttcaaagccttagcttaaattggaagtttcaggaacttctaaaataactaacatgcattagttgattgcaaagggtttgagatggaagctttttcttccttggatgaaggaatcagatgctacttggtggggtgataaaggggagctgaggacaaggaaagaagacatgtgatcagagtcttgtgtgtgaccatctccccagcgtctgacaagcagagcagatctagctgtaaccagcaatacacgagtgcctcctctggggatttgctggttctgcagaaagatacccctgcaagcacttcccccttgtttttctgcaagtctcacagataaaattaccagttcaaatgaatatgcagacatctgtccatatcttcatttcagattatagtatagattttcattctggtagaatctcttttctgctattttgcaaagtgtttattgaaacctgctgacttttattgaagtcacataaatcacacgtggcccaaggtaaatacaagggcaaattaaaaattatagttgatacagctaagatttcttgtaagaataaattataaaaaactctctgaatataattttaccattttattacataaataactcagaaagattgtgccttgttactttgtttactttttaatttacgaatgtttcttctagttaattataaactcttgtttccccttttaaaaaattcatttcacccatggcagaagttgtgcttagttgaaattgagtctgtaatccactttgagaagttttctttctgtgtttgataaccagatgcacactacaggctgtgtgattcatttccagggcccctgcctgcatatttaggccagttaacagtaggaggttgtggtctgtggttgtaatgttatctggcccagggagctaatggatttgatcgcagtttctttacgtgagaagtcacatatcacagagagtccctagcctcactaattaaaatgtaaaaaattataccttttaagtacaaaagagagagctctttcatcagaattaaaattatcgaatgtgatgttaaactttaaatggtatacagatgaaacaaattaatgttagtatattactatactagaaactgaagatagcaacattaagtttaggatgattataatgcgaatatcagcagcaagcagtcatctcaaaatataggacttatgtcaccaaccaaaagggtacaataggaatgatacttattttgccaaacaaaatggccccatatatagagtttatatcctaatatactgtcctgagttggtaccctatttctacaatgttcactgggctgttgtttaaatttcagtggaaatagttagctaccttgtgtcatagtgtagtaggaaattatttttggattccagagttgtttagaagggaaaaagcaattttaaatttggatagagctcactcttcatttttttgtaagatagaaacatacaaccctagacaataggttccttcaccctttcttcttagtctgcattttctgcccttctgaatgataatgatggttaccattacctacttagaaaattaaaacttatggtcgtataaaaatttaagtacagccaaatctactttgtttcacttttaggaaagatgataagttccaaagatcacacattgcaaaagcacttattaccagaatgagcaatttttaacaaatactttaaaatactcattacatacagttatgcaatggatattggatcagtacctagctgtgtgaccttgggcatttcactgggaatctgtagatttccattttgttcaaagtaaagcaagggctaccttggtttttctaacatctattgcagctcaaacatgtcatcaatctgtggttccaccactttgggaatcttcaaacttaaggagcagcagaatttgaagattttaaaatgtttttcctctaacatgaaccctaatgaaaaccaaactattacatttttcagtattgaaatggcatcctctttatttatctcttagacattgtcctgaatagtgtggctggtaatgttgtggttcgaaatgaagtgtggcttcagctctgaaaacattctgtccaggactgttttctctctagtgttgtattatggcatctgctcagtcatgaataggaggggattagaatatattttccccctttggcattcccaaaaatgtattaagggattctacaataaaaataggcaaaagcaacaatgaataagtactatcctttacacaaagcagactactctaactctgtggactgggataaatcacagggaggacctcagtggtaacaggtgacagtggcagctgtactggggacacaagagcaaatgaaagtcttcagagaagacagtggatgaatcagcaggcagtctcttcatggaatttaaataaaaccattaaatatccaaggaattcctaaaaagaaacagacttctcctagactatacaaaacaaacaaaaaaacaaaaacaaaaacaaaaaacaaaacaaaacaaaaactagtaaatagaaggttcatcttaaaacaatggtaatatgtttcatagttcccttgctgtggaatggtgtcatttccacttttaaacatgtacatctttcaccctacttaaagattcattaaaaacatgctgctgcctaaatgtagttcaaccttaaagcaatcttggaaatgacagtttccccccaatagctcaacaatattttttctattttggtgctattattccaactgtgatgtcttgtactattatgtttcataggtcagccaacaaaatgtctcagggaatatcagttagattctggaggtgtttgtcagacaaccattatggatttttctgattctctattaagtacactgacagtcctcaaatgtcattcctacacttgtttttctagaaaatgcaaataattgaatttagtcttggactatcattctccatctagtcataaactataccagtttttaaaagagaggcataacttctttaaatcagcattaccaattgataataagctgtgtgttagtgtgttatatattaagtctatttcaaaacagtttcagaagacctgcatctgaggcagactccagacagcagagagcatgagcagctgctccttgcctagaatttagagaaagtttggtggaatgtggtctttaattgtgataagccattgcttatttatattggactgcaacaaacacattccagttcaacattaagtgccacaaaaccaaaaatagtcctatatttccttttagtatagctgatagttatatatcatagcacatattatttctagaaagcatacagcactgtgtactttttaaaaaagcagtctagaacatatgaattaattggcagttagccatgttttaaaaactactcttgtggtgatatgttagtgtgcagtggctgaatatgatgtatacttgttatgtttttagcatgttgactttgaatggaacaggttttggaagactcgcaattttgctgattagtaattgatatgctaatgcataacagttttttttttttttgcatgaaaggacctttagtcattgtttgtaagtttgaaaacaccatttgattaagagcacgatagtcacttgatctgttaaaagtggtttcctagagatgtcaagtggaggagaaattccaagaaaacgttatagtaatgaatttgttttggtaaaataacattagctgttaaagttaagtggataataaacagtctacttgaaactaatacactgccacttagtttaacaaaaataattggaacaaaatggtagcatgatcaagtgatttcatatcaaatgacgttgatttagtaaatactgcttaagggatttttacctcttgttttttctttttgcttcagtccgttcaaaatatatttttcagtgttttattttatattctgatgattaagatctgttatgcttatcacagtactacttgtgattttcatgtatttcagtttgtaaaacatggaaaaatattataaattgtttttcaaaatacaagttttagccttaaaatatcaaacaaaaacattttaaatcttcctcaattttttttccgtttcagattaatcatttatccagtaaccatcactactactccctgagacatctgtgatttacctctgtgcccttctctcctcagatataacctgttcttgtttttctcttcagaaatgttccagtgtccaaaagtttgtaaagatctgtagacattccttcaactgtatatccatatatatatatattttttttttctgcactttttaaagaactagtaatagtgaagaggtcagctctccaaaccacatgcatggatgcagagtactcatttttttctgacatgaatcttgtttttaactcctgtatatgaaactcagataggaaaggaggtggaagatagaagataaacaacatagacttctaaagagggatgcagtgtttttgctttaggcacagatttgtgaggcaatatttaatccattgtgaaaagtcaacaatttgttactgactctgtactcaagttcatttaaatgtaataaaagttattgtggtatctttctacatgttgatatttgtaagaagataaaaagccttataaagaggttatacagtgtgtgagaaaaatctcaagtttaagtttggattacttctggttgacaaccacaaagaactacaggctttttaaaataatgcttcagagcccttatttctttcatgatacccagctcaggacagaatgaaaccagttgaactgctatactcgcctttctcttgaaaatgagatttgattgaaaaagaaggcaaacatttgtgaaagactgataaggaaaggtggcacctgacctgaggccatgcgactcttcccctgctatagagggcatatgttcctgggagagttggttactgccaaaaatactggggaacacgtgaaacatcctcacttcagatcacaatggttcacacactgttttctgattttccaagtgcattccacaaagagtatgacagagacacttatctcaaaaaagaaaatttcgtcctctgataatatacacaatgccagttaaatatccttgtgcactctgatagaacttggatcaaggtaaagacaatttagctcaagaggttggcaaatacttcaaatactgcagagaaatataatggaattttcttgaaagtgattgtgacttataaacatggttgacttaccaaggaatttgtatcttgacttgttatacggttaacttttcatatcaaaaaatgaggttgatcataatgaaaatgagcattatgtaaatggtttccgaatgtcaattatgtgcctacttcagtcgtagatactacagatacgatagggtagatctccttcttcatcaaggtttatgtttatactagctgcttttaaaaacccttgattaaaatgagttgctcaattatcaagtatcttcccttcacagacattatttcaatgactttaatgtaacccatgccatgttctgtaactcccttctttgatatgttctagctaatttgataaatctccagtcttgttgaatggaagagaaataatcttcaagagcaagaagagtacattaaacagctcttcttaaagtgaatgttgcattttataagcaagtcaaatgtttattttacattcctataacttccttaaatttctctgcccattatcttttttttttttttcttttttcttttggagacagaatctcgctgtcacccaggctagagtgcagtggtgccgtctcggctccctgaaacctccacctcccgagtttaagcgattctcctgcctcagccccccaagtagctgggattataggtgtgtggcaccatgcccggctaatttttttttttttttaatttttagtagagacagggtttcaccatgttagccaggatggtctcgatctcctgaccttgtgattttcctgacttggcctcccgaagtgctgggattacaggcatgagccaccacacccggcccccattatcttttattattaacaatgtgtattttatcacagctttaaaagagctaacaaaatcaattttatataattgtcaaaaagtagaaaagtaagacctgaaaaaagaaatagactttataagataattgagttcagctccttcattttgcaactgtggaaaataaaatcccggagcaatccaaggtcgtacaaagtggtggagcttgtaggacaatgagtcctgtgctcttatccctagtccagactgtgtgcttcgttcctcatcagtaaacacctagtgaactaaaataaatttctccagctctgatatttgtgtttgatttctaaaaaattacagaaggcatgcctttaagaaataaagaattatacatatatatatagtactttggcgcctttgtattcatcttgattttttgatttatgaccatatggttctctggaaccaactacaactatcaaaatgctttcacttggtgtaagagttgtctaaaacatttgaatatagataacattccaatgaaaactaacatcaacccataaactaattttaacatagccagtttcaaactaaaaaatatgataataatcccaagaactttttaaaaatacatttttgattgccaggcactatttttatcatctcatgatttgctcatttaatcctatgaagtagatgccattattatcatctttgttttatagatgagagacttaaggttttatctctggaacgtcttagaatttaacttattcaagattacgtagttaagacatgactgacccagaatttgaatatttatccgatgcagacaccaacagtctttactggtaactaactcctcaagtattgaattccaaaagctcatttgctatttaggtttttagaagttggatgtattgtcactctctgaaacaatgttaccacatcccctcaatccataaagtagcctaaatggtataattttgctctattgcatctaaaaactatattatcaggagccaaagtgtttatgtcattgtctttaagagagaattcattctcttgagaagggagagtggtgaaactggaactgttctatggccacagacctcacatgcttgtctcagccacctgaccagatctctaaaccatccctccccatccccaggagactggtttaccactatatgaaggaagaagctacatgactttgccccttcccatactgtcagccattcctactgaagaccactcttcacgattctcatctcatcactggactaatccctacactagtgcaccatgtccagatcaagtttaagcacgtccctgcctttttaaactgtaggaagcacgcctttcaggtgggttagtcagacctacctacaataaacttccaacttaattaaggggcctacattggaacatcaaggcatgatcccaagttacttgttctttataagtcaaaagctagaacaactggccctctagggtggtttctaaatggaataaatttatttttgatccttggatagggtatctggatttgggtagattgtgttctctgcacagggtgcagttaagagttaccattctggtggctctcaggtacagtaattagatgaacattggcttttccttaaatgccctctggaatatcaaaactttatagatatatatttttaaatgtatgcattcattttaacagttcattgcccaaagtcattggaacctgttttttctagtcatgtgaacgatttaaaaatttgataaatttgtatgtatgtatatatttgtttcacatttcttttactacataatagtattttcttaagaaatttgactatcaaaaatatttttttattgtataacagacactcttcttacagaagggacaggtagaaagactgaaaagcttatgaggatagtgcattttctgccttaataggagacatcttttggctttatgttctcaacactatatttttctcctcttcctcaaaaaaaaaaaaaaaaacagaaataggcaaatgatacttctttgccttaattgttctattgttgatttatttataggaagtaaaatgaattcataaaccaaagtgcaacatggtgatttaagtgaggactttgtcataaattctcatttctttgtgttttaggggtatgttcgaaagtttgttttgtaactgattttatatctcttgcataatcagaattctgtaactgaaataaatagacattagaataaaagggcttttccatgcttctgctaaagcacctcctggatgcatgccagcaatgaatgggcctcacaaatacagctgttttctcactcttctgttgatcaacataattcaattctataaatgtttatgtagggaggccctactatgcacaactcatgctgcaagatgctcaataaataattgtaaaatagcaaataaccgcaatgcaatagcataacctaacatgctacacagcatacatgacaataagttcaaagagtggaaaatggaaactactgagcttttcagctgaccacaatcaaatcagaacacatcaaaacagctggtgttctgtgactcagaatcaatcaaccagttttgcatcacctcatacttctttatttctctttacagtttcacagaagagatttaaaccagcatgtgtccttcccatttggttaaatttctgctttgagttgctttgctttcacattctaataccaacgaatgaaaatcactgtaatataaaagaaaaaaaataaaggctaacattaaaatgatttttaaaatgatgccgctacatttgtgtaaaataaaccatatgctcaaataaaatgccctagaagaaaagtgatattttaaagtagtgttatgaaatgaagatagttctgcatcagctgtatttatgtaattcacaaatatatcaatgtatattataattttctaagtatataattaatattttaattacacaaattatgatatttgtataatcttggaaatttgtatagtcttaagaaaatcaatagtagattagtcaatgaatgctaaatattattatgtgttttggttcctgacaccagctcttctctttgttctgataggtacttactacaccattctttggcgaaggctattcagcagtggtgacctcttccaatccaacactctacagattattatctctggactcccagctgacaccctgccggaggcaagagctactaagccaactggaactgtgccttttctcttgtcaaggtttttttcttacacaggaaaaagaaagaaaaaaaaaagatgaagttgggcaaagtggagttctgccattttctgcagctaatagctcttttcctgtgtttttctgggatgagtcaagcagaactctcaaggtccagatcaaagccctatttccaatcagggaggtcccggaccaagcgcagctgggtgtggaatcagttctttgtgctggaggaatacatgggttcagaccccctctatgtaggaaaggtagggtattgtgacctttcaaagttgtaaatgattattgtccatgtctatggtttgatgaaaaactgctatatatatataaaatttattttttgctatggggatggtaaacacaagacatcatttctatgaaagagtttatgaaggtttttggcgatagccactgcgaagttgcaatcaaggtataatattcattacagtgaaactgtatattagggaatgatgcttcattcctagaaacagatgaggattctacagaggcctagtttactctggttgtaacacattgataaactgtcgttaccaaagtggaacaagactattcataaaaaatgaagagtagtgggttcttacagccagttggtttcagttgctgcttttggggtattattaaaatgatgtccagactaacattaatacttaggtgtccttccctgatacttgcagtggaaaaactgcaaaatgaaactattgaccctaatgtttctaaattatgaacaatttaaacccacttttcttagcagtcttgttttgatagggggtgtgtgtgtgtgtgtgtgtgtgtgtgtgtgtgtgtgttaggttgctttaaacattttcctttggattaaaaatgatcatggacagaagtcagttagaaatgatattagacaagtgatgggcagttcatggtgcatttattgggtgaccaagtgttagctggatggacattttgtttttcacagtttcttctgtcttaatatttgagaaggagattttcactggagagcttcctgaaccaaaaggtgcttctagaaagcatagccttctctctgccatttggcatatcatgttctcggttcctagtctacttccggttcaatttttttaatatttgtaaaggcctactgaatttctcaatttggtactgagtcctggtgaaggttttctaaatagggtatattagcacaaaatctgtgcctctgtatttttacacttcactctgtcagttttatatttgtcttcctggtaaaatgaagcatagctacctactgaatttatctataaatcagtttttcaactttaaaagatagaggaataatcctggtgatttactgcatgggtcgttttttcgtttgatcacaccttaagtaagggccaaaattatgtttattgatgagcatctacatcaatcaaggtaatttgtattatatttattattttatttatgtctctatattttataaatactgacttttactaccttgtaaacaaaaggacattaataagttaaaggtttctagggatgtgaattaggatttttctttttttggtccagttacagcattttcctacctaagcttatgtaaatacagaggtgttttgtgtactaatatatttttatagccattctaccagtaacaccgtcatatttactgtacatatatatgctaaatatctgtctcactctctttttacttgttttcttataaagaaattgagaggagtaaccgtaatgattaggatttgattaggaaactagctcttaatttcattcatttttaatggacatttaacaaagtcatccaattttcttaaatggacagagctataatattcaagtaatgtataaaaggaagtaatagttattaagcaaaatcatattttgtgacaatgtaaaattttctaaaagcagcaaaactgtttccaaagtaaatgccatttaatttggtattaaataaagttgcttgggtgaagttgacattttaaaaatctatatagttttaaaatttaaatggccttcttttgaatttcacaaatttcccataataattcagaatgcttattccataaaactcctataagtcaatttaaaattatgaagaggtgtgtccctatgttacttaaattccatatgcaaacaaagttgttgggcaaaggtgttatttttctaagagaaattgtgtagtttcttgattaggtaacaagaaatattatgtacctctcttccaactaatcaaagaaggtcacttatatttacatgacagaagttagttcgtgtttatcttttgcatgctgtacattgggagttcaatatcgcctttcatagtaaattgtccaggatggaaatggatttaattttttaaaaaattgactaaaatacagaaaaagggctgtaacataatttgagatggaaggagaatttgtacacaagagagacaaatgcaaggccttacaggaacaattttcatatatccttggaaaaaaatggcagagaacttgattactatagattttatatttgagatgatgaaatgattctttttattaataatttggtggtctgaataagcagagatataacaataactttgacttaagtacgttttttattacttgggtaaatagacacattttcctttccttttttcttttttttttttagttttgggaggtgatgtctgtgcccagaaatgtttgtaggacagaaagaaataaaaattatagaagaagatgtgaagaaatggctgggcagataatcatagaaagaaaaaaagaacctaattaatcagtgcttttcacagatgtgtattcaacctaggccacttagatggtcacattcttagtcatcctaacacaatctagctatttgggtaatttggaaaatataagtgatgactttgatacattttgtaccttaacttgatcacataatggataactaccgtatgtgtcaaattgacatcatttttattttcttgctctaccactttctactagttgtataacttgggggcaaattgcctaatatcattaagttttagttttctaatctataaaatagaaaaatggtatctacaattcaattctgttactcaataaatccgattagtctttatgacctacattcaattactctggacattattatattttatatttcattacatattaattataaattaacttagttatggatcatctattttgttacatgtgaaatgttatctgtgtgattcctcagatgaaagccggtattattttatgttctaatagtgtttatatttattccagttaattataggaatgtctattttgggggagcttaataatgcagcttttagaaattatttatatacaattaaactatggcagagatataattagtgggtaaaaaattcacagaaattatatctgtgagtcttttaagactttcaaatttcgagtccatgttaatggcaggtgaccagcaagatcaattaaatgactcttcagtcaataaaatttgatcattaagacattgaagataatgaggctacaatatggctttcaagcatattattttaggtagtttactgagttgctttttacatatgataaccaaagaccaaagtagaacattctgttgaaggggaccaggagtgcttctagaacccttactcaggaaccacccgggctcagacttctgggctatgctagactccgatggtgcaacctttatcattagcttcccatcattttcttgtgaaataagttgataaatgtatagacttaaggaaggagtccttggatgttactctgagttctgttttaaaaaataatagtgcccctttccttacatgtatgttttaattaccatcatgcctgttttcttgtttttatatggggagaaggaaggggggaggatcctttcttttctccttttcactttatatcacccctcccgtggctattcacagtacataggaggtcccagtttccacccatttcattggatcgcactgcatttcttcagcccagtctgttaatcaccttggcattactcacttaacgtcctgtaactgtctgacgtaaaaaaaaaaaaaaaattgtctacaaaaccactcagcctctgttccaggtattaagtatttttcatctttcctaaccgtaatgggatgccagccgatcgctgtgccccaggccattactttcactgaaatgtgtgcttcgtgcctcttccacagttgcttccctagctgttaacatcactctttcttttttttttttttttttggctactcctctttcttccttactcattcagggaaagtttatacctattaccccagtagaaatcaaatacacagaaatgcagtttgcaggattggctttgctttaaatttaagcttacttggaagcattggtgagcattttcaatgcatttaattatacctcagcagtatctctcaccaagaaattatctacctcctgatatctaaagatacattcagtgttccaaaaaaggaagtttcatattgaaaataggttgtgtttatttttaaaaacttgagttacaaattagattccttaactggaaaattttatgttagatacagaaaaggtcaataatgaatgccaagtatgagcgacaagaaagagcatagtcatcatagcaaaatctacagtttatagattttattgagaaaagacaaacaggaaaagtgtcctctgaaaatgtagattgcctaatgccaggtcaactcttagaagaaaacaaagacagtttattttttctaggaatgagtagaaaccccattttcataataactttacaactagagtcaatttgtaaaggcatttgttctctgtcagtttgctgatagatgtgtggaattcctggtgatttcaaaaggaatttggacacggatcagctctatcagatgcaaataagttcagatttttagaaatacttcttggcagttatattcagctcttataatactgcaataagcaaatacattgttattttgtttttttcttaccattttgtaaataacatgttagattgtgccactaaaatgcagaaacccaccatttattcggcttaatatggctaattaacttaaaaagtcacctcagttcagaaatgaaggttataattaccaaaggctttagctatacagctaaaagttggacagagtggaagactctcagttatatgcctgattatagccaaactaggtactctagattgggctccacatttcctgattgtctgtgtatgttgatcaaaatcatttaaaaattctgcctttttaacaatgtttgtgtttatgtgcaatctacttgcgtcctattttgtgatgaaaacagcaaacattttcaactgcagtctatatgcgttgttgttttttttttttattttttggttcttgttttgagatggagtcttgctttcttacccagactggcacgtagtgacgcaatctcagctcactgcagcctccgcctcccggttcaagcaattctcctgcctcagcctccccagtatctgggactacaggcatgtaccaccatacttggatggtttttgtatttttagtagagacgagggtttcaccatgtaggccaggctggtttcgaactcctgacttcacgtgatctgcccgcctcggcctcccaaagtgtatattagctgtgttttaacattgtatttatattgaggttttaggtgcaaaggacaagatataaactgaaacgatgattgagtttttttctctacaaagtgcgctgtaattgtttggacaagctttatgtgcattgctcatagatacagagtcacaggatctgcagccctccgtgactcaccaggataaacgacagaattagataagcagcaggacagtcactgagactttgctggattgagcatatgtaggcaaggactatattgggagaaattgggtcctcatcgttttgtatgatttatattgattatatgccttaggctgattacctgaaagaaacactagtttgtacaaacatggttaacattgtatccaagaaaatctcttttgtatgctgctaaacctaccctctgtgtttactttcttcttttctctctccttttttttttcaaatatttatcgcatacttatactgtgattgataatgtgctagatagaagcattaaaaaataaactctttcataaaattcacagtctggttgataagccaagcaggtaatcccatggcagtggaaagcagtaaattccaaaactaaccaacagctgtggaggtggttcccacagaggaagaactcacagatccaagaacaaacgcttgcatgaggacacctggtgcacctctgtgattttgtatctttttaatacaatcttcaaatcaaagcaaaagcaaattatcttcttagaaaacagggcagagttttctaaaactatactgagagaagctttatatagtagaaagatcagtaagcagaaactccaggttaaagtagcaattttcttgttattttaaacacagccctgaaacaataaattttgattttctcatctgtaaaatgtgatcaaattggtaaagttttaaacttttttattttgaactaatttcaaacttataaataagttgcaaagtgctattctctaatccagcttttgcaaatagtaatatcttacgtgactacagcaattatttaagctaggaaattaacattggtacaatactatttactgattaacagcatatattcaaaatttgccagttgttctaataaaatattaaatacttgtttctggcaggaaccagttcaatatcacacctttcatctgtcctgtttccttatattttccagtctgggatagttccttagtctttcgttgtcattcttgacccataattgggtagaacattttataatatgggcctgtctcatgtttcttcttaatgcatatgtttcagggaatgtatttttggcaagtataagacagaagtgatgcttttcccttctcactgtatcacgtcagaagatagaggatgttgacgtgactcattcataatgatgttgaatttgatcccttggttaaggtggtgtctgccaggttccttcacggaatgaacattatctgaaagctctaaaatcttgaaagagatataaaataacctaaactctcattacagatgggaataaatactactgctggtttgagggaggtgcaagggttgattcagtacaatctgttgtccatgtttagaatcaggagtgtgagccagatttaaatctataagacagttaggtaatgttcataattttatgcagcaattgactgtttctcaaaaatacatcaatttaagatgtcaaagggcaattgattttgcttattattttttttctgaaccatgcaatagtattctttatagtccaaaattgcaagaaagtttcactaatatagaggttaaaataagagctttctccccacattgcctacaaaatctaaataattgttttgcattgtgaggttgggccccaaatacttagccatcataattacaaatgaaacattgttttggaataataaacacttagaatcctataagttaaagaactaacacaagacattacaatctgatgtattacatgttaatgtatttacagggttgaaatctaaacaactcatggaattacattcaatgttgaaataaattagtaatggcagtttcttctaattattcttgtttaaaacttatattcctgttgcctagtcagtacttattaaatctttggaaagccttgtgaattagaaaggtgatgttcttatgttagagttcaagtaatatatatgtttggtaataaaataagtagaataatggaacagcattagaattataattgagaagagctagaaggcatatcagaagtctacattgaataattatcattttttcaaatcttaaaattttagaagagttagaactaaaatgaatactactttgtcataataccaaccaatcatattttgaagatagatataatttcagtatgtatttgtctgttctggtttccataacaaaatatcagattagataacttaaacaatagaaatttctttctcatcgttctggctgagaagtccacaaagtgccagcaaagtcagtttctggtgagtgctcttggcttgaggacagcacagccttctccatgtcctcacatggcagaagagaaaaatttcttactcttttaatgaggctatcagtattatgggattcaggtcccaaccatataatatcatttaaccttagtttacttgcaaaagacatacctacaaatcagtcacattgggagttagggtttcagtttatgaattctgaaagggggagggtcacgactcagttcatagcaaatacctaaattcattataattcataagaaatgaacgaataacaagtaattgttgacaataataatgtaatctatagtttagttttaacaagtagaagtttacatagcaatttcaaaaatgtattagagccgtaaacagtggctcacgcatgtaatcccagcattttgagaggctgagatgtgtggatctcttgaaatcaggagtttgagaccagcctggccaacatggtgaaaccccatctctactaaaaaaataaaaataaaataaaaataaaaaacaaacaaacaaaaaattagccggacgtcattgcatgtgcctgttgtaatcccagctacttgagaggctgaggaagaagaatcacttgagcccgagagatggaggctgcagtgagccaagatcatgccactgcactccagcctggtctagaaagtgagactctgcctcaaaagaaaaaaaaaaacagtattagaaaaatagtttaactgaaggtttagaaattttacccacgtttgcttcaatcagctgtagttctcaggccaagagcctgagaattaccttctgtccttttgccatgcaaacgaaaaaaaagagagagccaaacgacattgggggaaaacaaaccagtatggggaggccatctccatttctagttaggctagaatctttgtcttttttaagataaatgcggaagagtaatttctcaagatggggctgtgttataggaatggtaattaaagcaccagaaccaaaatgattaacatcattctagcaagttgtgtgtgtaaacagtgcagaattatctgataagaatgcttcccttagaatgtttgcttatctccttcgttaaaatgctgacatgttttaaggtatttaactgaaaacacacaatcaaaatttggacaacacatacataatgttcaacagatgtgagtttgaaagatttgtgatgatcaccagtgaaattagtcaaaccatgcttaaattagatttttctgatttgtgagtcatttaagggtccatattggagtggaatgtgtatggagaagaaaagattacacattccgcacttgattctttgaaatgaagaagaaataagataaaaatcggcattttctttcccataaaatatctgagaaactcagttctgtatttctcatctactctatccctgacgcagtttacataaatttctcaactgaatcgtaagagctgaatttaggtggttaactgatatgttttgcttaatctggagaagcagatactggggagttctagtcattgcgatttgatttaattatacctaagaacatgtagccatcaacagttaaaaatgattaccaaagaaatagatgaaaattatcacatttgtaaagctaaagtcatacataaggcttataatgaaacatagagtctgtaatatggtataaaataaaaggaactgcactataggacatagacacaaccttagaacagtgatttttacaagtttaatatctaatgaggtacagtttaaagcttgctattaaaattaaaaacacaagctttattacaaaggctaagttatcttctagactgatgatggaaaatacatacgagtgagtgtggattcagggttagggtcagaggaggaagcgcattctgtttacgatccaattaagatttcacagtggatatttgtgaccaaaacaatattcgaatgattaacatcttataatatatgtatatttttctcagtgctgctctcttcacactgtctatggcttccaatttatgtttaatttctctgttaactctgggtacatcgataaagtccagtttttcagttttttacttcacttttaactttgtgctcaaccagagctaaggcatgtgtgtaaggagtagaaagtttaaggaggaagaagtttaagctacctcagaggttcaacagtcatacaacagctctttttattatttttccaagcatcatcttggaattcaccaaaaagtataaattgtataattttggtcctaaaagacacataaatcacaggtaatgattttatcaaattatataaatgccttaaacttgaatataaatattatatgaatatcacatattttcactaaaaagaaagaatatattgttcttattattgtattttaatattagagtgtcttgggctttgaactcatttactttaggttcctgaatacagaaattctttgtacaaatccctgatgagtgatcaggtagcctgaggtccatctcttagtggaagcaggaattgtcttgaaaatacacatttcagagtcacatgatttgggtttgcatactggctccctaacttacagatgatgcgacttcaagcaaacagcctatttcctcatttttttcatttataaaataggaacaacaatactaacctcacaaggctgttgtacacataaaaagaaatacaaatgcacatgaaagcctgaaatatggtatgaaaatgtatttttaaaagttagtgagcttaatgaggaaagggattgtgtccaatccaagcgtaatatctgtatgttctcagtggatggttactgcatgtatgggacgcttatgaaaccatgagcattgctgtgagaggattttgagttttaggatgacacttatttctaggaggtgaaattacatttggctattcaaatatttgaaggcagcatttttacacccccacactaattttaaatgaacacttaaaaaaaatgaaataattattgctcccaagcattttgtatgacatgacttctcaaactgtccttatacttagctgggcttgcttttcagcatcctaaaatatgaaggtcagcattgaacctcaataatctgtgataattcataagtcaattcaaaaaataaaaatcaagatttttatttctgttgatattggcataaattctatccctctattaatacaagccatgatcttattattattattattactgttattaatattatgatcatctcttgaggaaaacaatctaagaaaaaataggatttgagactcaatatatatgattagaaataactagtgaataccttgaaggaagctataataaaattaaacatttttatgccaaaatgtctctcttcaaaaattatttttcttaaaaaatgttaaatgagaaacccaatatctcttctttcatagcaaattccattatttgcttttgcttacccttcccttcagatcttccacattcttatttggttttacaaattaaaacgacctttttcaaatgctctctcctccaagcacaatgatagcctattgcagtggtaatacattgcacagctgtgggggcctgacacttcattttccatatggtactgaatctgttgtacctgagtcagcacgatttcctcggggccgtcattgggagtgtctacagctactctcatatctcagataatgttgagagccctgggttccaggatagtctagtccagtggaaagatgtggggcctgggagaaagagaggtctggatttgaatgatggttatacccccctgatgatgcaggatcatgaatatcaccatctctctaattcccttgatggtcctggctttattttaaaatcttccataaagcaagctgaaggaaataaataatagcaaaagaggcggggaagggagaaaagagctaggttgtttgtgggtatctggaatgttcaatgtatgatccatccttctctctcaaagcgaagatagtaagaagatttcagtttgtttcctgataagtaaagtattgaagatccagacaggaaatgagtgttgaacccagaaagtaaggattttagaaaagtaagatggaaagatggaagctttttgttttgttttctcatagagaattagaagttatacagcaattcctatgttgtatgattgtctttggctatgttacctaacacagatggcatagataataatgaattatgattatgccagtgcatagagaggaagtttagcctagtagttttcactgtggtgctgggtgtggaagatatgactgtgagtctcagcattgctattaactttgaaatggctcagcttttctccgcttaatttctgtaaaatgggtttaacaataggtctcatgtaatacaattgttatcaagactaaataagttaatatatgtaaagaacttcttgttttatatacagcaaacattcattaagtattagttgttaataatagtggtacatatttttattttgcattcaattgctactttctataactggcctaattcaggtgttttattttcaagcatatttttaaaacaacctaaaggataaggcagggatgtccaatcttttgtcttccttggaccacgttgaaagaagaagaattgtcttggaccaaacataaaatacagtaacactaatgacagctgatgaactaaagaaaaaaaatacacagtgttttaagaaagtttattcatttgtgctgggctgcattcagagccatcctgggctgcatgtagcctgtgggccttgagttggacaagtatggtctaaggaaaaaacaaggaagaactcaagcaagagttatcacattggccacttggtgacaacagccaagtcctttaaattacctttccttgttctctcgtctatcaaaaagggactgttatgccaggtatccctcctcctcaaagttggagtcagctttgaatcagataactcctgctaaaatgctttgaaatatagaaagtattaaatgttaaataagagttatttctgatggaaagagcagatgttagttatatttataaattattagagtaagaacagaactggcaacacatacatcccttttggtaactgtttttgagtaatacttgggaaatatcttttggcaattattgaagagtgatacatgttattttatactttattttatttttgtttagagatggaatcttgccattacctgggaccacaggtgcaccccactgtgcccagcaaataatattttatatataccagaaacacttccaggatttggctgctgttttaatagtttacatattcagaatcaaatcagaattaaaattacatgggacagcttttcaaatcacacatttgaagaaagtacagaacacacacacacacacacacacacacacacacacacacacagagagagagagagggaagagagagaaagagagagggagagaggattgttctattctcaaatacttttcaaatcctgaaagctaatgaaatccttgagagtttcccaggaggcaagagattctagtgtcattaggattctactgaagaaaagtgatgcttaatggaactagataaatgagattgcttgttaatctctcagttaattttctctcactctctctccttctttctctctctttttcttgaccatgccttaggtcagaacttcattgaatcatcgaattcattgaagtttggctccaacctatcatatcgccgaggtttaccaatcctatacttcataaagttctaaattcagaatgtgaggttgacaaattcatttcagttccacaagtggtagcatttaaatatcagcagcttaagtattcaaaattaatagattgcatttttagaatggtgaaattctgacagtttgcagggaaaaggtgctgaatatcttgatataatttacatacttctataaacaggcatttttatacctttggaaagataaatgagtagaaaccaagtattttacaattctaatagttttactgacatgtagagggaggggcatagactgtccaaaaggggaactattgccaggcttttaggagctgccgttgctaacaaatcagtttgggtaggcaggtgttctagaaaaaccagaagaaaaatgaagatcagagatgatttttctcttcttttcacaaattaaataaaatgaaagacctgatgctgaaagtaattatccacaggggcttcctgcagtgtaattctgcaatataaagctgaaggaaatgtgaagacgagtatttcttcataaacaaaaataattatgttggttgactatatccagatgaaaagtacatgagttttagggcaaactctctacatttgagtatgcaaatactcaaagtttcttgataaaatgcatgttaaacgtaccaaaagctccagagtctccaaaaggagatttattatatgatctccgcagtgggactagcctacaggtgaaaagtaaaactctccaaacgcgaagcaaatttatccactcaaatggatatatttatgttttatccatccaagcagaagcatctggttaagtggaaagcatacttgtatttgcatgacaaattcatcactgcatagggtaacatgcttcctccttactccctgccatttatgaaatgaaaagtctagtaggaatgcatgctctcctcccacccaccaccagagtataattactactcaccaaattataactattatgtaatttttaaattttaaagagtatataagaatatggccattacaagtgccacctttgttggtttgttgcagtgtctccttagaaaagctaaattctagattcacatttgtcagagcttgattgtatctctttgagaagtgttatcagccatttagcaattttggtctgtatttttcaggggctaaatgagttttcctttatattttatgctgatctacaagaaaatgctaaggatacctgtgtctatcattactatttttatttagaactagtgccagccgggcgtggtggctcacgcctataatcccagcactttggaaagccgaggcgggtggatcatgaggttcaggagtttgagaccagcctggccaatatggtgaaaccccctctctactaaaaatacaaaaattagctgggcgtggtgacacgcacctgtaatcccagctactcaggaggctgaggcaggagaatcccttgaacccaggagggagaggttgcagtgagccgagatcatgctactgcactccagcatgggtgacagcatgagactctgtctcaaaaaaaaaaaaaaaaaaaaaaaaaacctagtgccatgctgactcaaaagcatgtaaccctgaattcctacagaattgtagaacatgatgggctaaattacaaaaccaaaccaggaaaaactgcacagaggaaactggtttctttttattcccaggatatccaccatccttcaattctcctcttctgcaatcagcacttaaaggactctgagagtgagcaccttttaaaattttttgccccaggcgtctcactcttttttttttttttttttttacataaaaatggtttaataagttttggaaaattcaaatgaatattagatatacaaagggtaattttatcatattaagaaaaatggataatgaaagtttgcatatagagtttattttctttttttttgtttgtttttcaatgagacgtcaacagtttatttcataataaataaatacactttgattgaactaaagattcagggtctttaaaagctgtcaggcataattgaatggttttctgaaattttacagtaatgttcatagcagcacgtccccacaaaacacactcatttaatgtttctggttcaactaatggtttttatttcacatttggcatctttttcttctacaaactaatagattctccagaaactattcacctgagatttctttttctaccatgcctgtcctttgcaggattgtttgaattttcaagagaatttgaaacacttagtctctagacagtttctttcaatgtagccctttgctcttcagacatatgtgacaggagtcaaatcactgtttgtttgtttgttttttttaatggaaaaaatgagtttattttttagtaaattttgtagatgcaaaggacatatctggtggcaactggaatcacagaatgagcattcagaagccacaacagaaaatgtagatttagaaatctttcatacagaattggaagctggagccataagaatagaaaacattctttttttttttttttttttcagtcattatttgtacagctgtgtgaatttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggttggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagattatatctcatagtggttttgatttgcatctctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgctaaaattttctcccattctgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctggggtttttatggttttaggtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctcagggctctgttctgttccattgatctatatctctgttttggtaccagtaccatgctgttttggttactgtagccttgtagtgtagtttgaagtcaggtagtgtgatgcctccagctttgttcttttggcttaggattgacttggcaatgcgggctcttttttggttccatatgacactctcagggaaaaacaagggtagggttggcagttgcccactgcagagatagaattcctccttcagttttgcacccttaactgccttgtttgcctctctctattcctgtttttttttttttttttttcggagaaaataggaggatttttctgtccaaatctctgatgctcatttatttgcactagctatggtcccatcttcacttgagtcgcatatgttcttcatcaatactcttcggaagtcaatgcagctataaaacacaaataagaatcttcccaagatggtgttggaataggaagaattgcatctctttcagtgttttaggagaaacatctggcagaacttaaattcgattctgtctcatagctacatcattgccagtttatcagagaactgacactgaatcctcagattcgagagtggtgcttactgcccttttacatagattagcctcattttacttttctttgtatatatttcaaatatatttaattttatgtcaaccacatttggcaggcagtaaaacatgattgggaaaagcagcattaatttaaataaggaatcaggttaacattcaaattttatgttttaaatagcatgaaataatctgaccatacatataaattacatacaaatatatgcaagcatacataacctaactatttttacacagaatattttgtatacttgaatgtggcttttttggtacaagtttggaattatttcacattttagacattttaaaaggctacattgttggagagaaggaaatacaaaacataatacatgtaattcaaatcctttttcttaccttttccacttttttcattctattccttttttaaaatcattctgtcacatcttaatagctgtctgactgatacttaagaggagaactacaaatagagcaaacaacctttctagctaccctattggttgatttctttctttctttctttccttccttccttccttccttccttccttccttccttccttccttccttccttctttctttctttctttctttctttctttctttctttctttctttctctctctctctctgtctctctctctctttctctctatctttctctctttctctctttctctctctctctctctctctctttctctctttctctctttctctctctctctctctctctctctttctctctttctctctttctctctttctctctctctttctcccttccttccttccttccttccttccttccttcctttctttctttctttctttccttccttccttccttccttccttccttctttctttctttctttctttctttctttctttctttctttctttctttctttcttcctttctttctttctttctttcttgacagagtctcactccgttgcccaggctgtagcagtggcaccgtctaggctcactgcaacctccacctcccaggttcaagcaattctgccacttcagcctcctgaatagctgggattacaggcatgcgccaccacacctgacaaatttttgtatttttagtagagacggggttttgccaagctggtcttgaactcctaacttcaagtgatccacctgcctcggcctcccaaagtgctgggattacaggcatgaggcacctcactcagccggatttctatttgtagatagaagtggaatgtggggtttacaagtatattaaaatagagcaaaattttcttttggatgggtgataattcatgtacagttgactctcatctatgatagttatttctatgcagacaccatgaacactgaattggtgcatagggaaccattgctcttaggggaaatacaagattagattcttgtgagactatggtcccaacgttttcatgaactgatcaactcttaactgtgccttatgtgtgtttctgtgtaatttaatacattatttaatatatactattgattcattaacattaaactcacagacaacacactataactaatgcctggaaaagctcatttaacatacatgtttcttccctaaggcacatcacagcctttttgtgcctaggaacactggacagcatttcagtgctatatctgggcgtcattttaaacagcaaaaccacaaacagaaagtacaaaataggaaaaatgtgtcacaaaacagactgcaaaaaggataactgtttacaacatggaagcagaatgaggatagataggggtgttgctttcttcaaccttagttgggaatgtgtgaatcagaacactcagatgttatgctgctctgtgtatgttcaagaatgaccacagataaatacattttattgagtagatgaattgccaaacacaaattcctacaataataaatatcaactctatctattcaggaaagagtaagcatttggaccacagtgcatgaaaacttcaacattctgttattagataatgaatccaaccaaatgaacaatccagagaaaagaaaattgacaataataaaaggtaaattaacagaaagataattataagcaagaatagtaatagttgaccattctgaaaagcttataacatcactcatcatccagcatcctttctgaaaacaaaggatttttaaatcactttatgcacatatgcaacataggaggttggcaaaataatgcactatttcttaacagccatgtctcttgtagaacttcaagttaatctacaaatgaccattgtgtcttaactttagattatgaataccacattagtcaggtatttgcactaacccttaatagtatatacagtttctatggaaaattcagtggtccaaaaatttccgtagaatttgagaggacgttggtgggctgaagatagctccttgagggtcactgatgtaggctgcaatgggggttcacaagtgcctgacaccgtattttattagtctaacctttttcatgaaaatcctgactacagctatttaaggagtagtcttaatagctgaaaatgaagatagagaaagacaccaagaatatgacacagtttacattctagtgagggacacaacaaaatcaaatttaaaaaagagtgtaatagatgctgataaatactgtagataaagcacataagaaaatagaaataaaggctgtcaatggagaagtcatgatttttattttatttatttatttatttatttgagacagagtcaggctctgtgcaggctggagtgcaatggtgtgatctcggctcacaacaacttccaccttcctggctctagggatgctccctcctcagctgcttgagtagctgggaacacaggcattaccacccacagctatttttttttttttttttttgtagagattgggttttgccaagttgcccagtttgctctcaaatctctaggctcaatcacccatctcagcttcccaaagtgctgagattacaggcatgagccactgtgcttagctgaaaagttgtaatttttaaaagggtggtcagcttcacctgaagtgatatttttacaaagcccagagagaaatgcaggaatgaacaaagtggacacctggggaaagtgaatttcaggcattggaaacagcaagagcacagactctgaagcaggagtggcctactatgcttgaggaagtagaaaaggccagcgtggctagtttggagtaagtagcgtataagaaaggagaatcagcttctcacaaagttggtgaattatctgacccaccatataattccagtgggtgaagtgctctttgccatattggtgttggactgcagttaaaatataccattaggagaaaaagtcctagaacatccctctttatgtctactgtagaaatactggccttaatcttgttaatttcattccacagtattctttttatgaattccttgagaaaagtcattaagtggtccttatatcaggaatcattccacttcatctccgtgttgaatccttaaatcgctaagcttttgatttttgccacaattctcggaacttgatttgtgacctaacaaatatgtcgagaagttctgcgtagcatgttttcattccctcctattacgaattcttttctgtgtctccacattttttacccttgttcatttatgtgttacattatacttggagtccttgtaagccattaaaactcccttccagaggaagatgtttataataggcagatgaataaataaataataatcaggaaattgaacttttgttcttttatggtatctgtggcaactgcagttcaattaatgacttttggattgatttttagttaactagaagtttggttaacttattgcgacaatccacttgcaaagccgtacatttaaattacaatttggctgaatccagtatgttgtatctgacaagttttatgaaactgattattagagaaccatgacttgtctaaaacaagcatatttgtcatataatatatgtcatatatatatatattattaggcgattctcaaataatgggaacaaatatgacatatagtgttctgtagagatagcatgaaaatggtatcattttattagaatatgatgacagtgttgtagataaggttatgtacaacattaaatacaatttagtaaaaatatgtctggttaaagttgtagcatggaattaattgagtcatttttgaggcaaatactggtcatttaagaatcacattctttagcgtagagcttttattagtagaaggtacattaacaataaattcttagcctgcattctaagacagctctgcccaatgcagtagatattacttatataggagaaaacctctaaaatctttgaaaaaaaagaaaaaaaaactaagtgacaaaacaatgaaaaaatatctaatggagtttagggaaacttaatatataatattttcctaatgacattagttttgagttcattgtatacattatggagggagtattaattttattctgattttgatattgccaaataaaaagcatgaaaattatgattgcaaaattctttcctttagaagagttcctttctccttaagaaagtaacacaaaaattaaaacaaaattaaacttttcaacataagaaatataatttgtaaaagtacatatagcagtagaatatgttaaccagcatattatactaggatactggatattcagtttaaaacacattataaatacatgtggtgttgattgcacctgcgtgtttcccgtacattagcatgcagcttttggttccctaggccccaagatattacccggaataaataaatggtagtgattgatctgagctagagctgcccattaatatggttgtaacatgaatggataacaatgaaatttttaccgtattatttaacatattttcaagcttctgtctgtagactgaatgtacctgattatatcagggagatcaatgagaaagtactttttttttcaagctaagtttgatttcattgacaaatgacattagaagcatacctaacatttaaagtaataaccaagggtagatatgagttttgtggggtctcaggctgacataaaatatatggattttaaagcttcaaataacataaaaatttattttggacattttacaaaattatcattacattcctaagcccacaaccgcccccccagttcttggactttagaatgacctatgcaagtgtgaggctctaaatcttagcctgcattagcttcagagtaaatctacctctgcatagcaaaccataaatcagtactgataatgtttaattgaatatattaatataatgtctgtgatgggattcagcccttgtttaaaatgatgttgtaaaaggatagctttaagaggtatgataacgctgataactctctgagtcagagataatttccttggctgcttctttttctctctctctctttctctttttttctttgagataagatcttgctttgttgcccaggccggagtgcagtggtgcagtcatagctcactgaagccccaaattcctggtctcaaacaatcatcccacctcagcctcttgagtagctgagactacaggtgtatgtcactatgcacagctaattaatcaaaatttatgtttttagagacagagtcttggtatgttgcccaggctggtctcgaactcctggcatcaaatgatcctctggcctcagccccccaatagctgggattataggtgcaaatcactaagcccactctatttcctaagtttcatgcccatcaatgaaaacttttttttttccctgacacaagactgtcacatatttatatgttttcaccaaaacagattcaagatcattatcattagcagcatttgttgacacatgcagccaaaaagtcaggcatgaaacagaaagtttttatggaaaattatttattttaacatttcaatagatttcatatatatgtagaaagagcttttctgacaaaacatttcatcgttttaaatgtatcaaattatgcaacatacattccttctacatataagaaggattattagaacttgattgaggggtggttatacactgttccaaattattgcttctgttgctgccatagttggtgctgctcctgctagtggaaatgattttgacatcagttcaatttaatttaacaaggatttattgagcgtttgccacttattctacaagattcaacaggcgtttacctactagcaggaggatggagagtagttaccaaatacaagtaacatattttaaggaattcttcatctaaatttcaggacatttggtctaagtaatgagggtccagacagaaaaaggacaaatttagagctgctttgattttaaattctacacaaggaaagactggatgggctttccagatatataaaggcaggaactgcaaagtcataaggcagagctgtgattactcatttagtggtctgctcttctctcgggtgagagaggagctgctctcagttttgcattctcagcacctagcagatgatctgatgtgtgtgtttttaaaatacatttcacaggtgaacatagctacaatactacaatttttaagtagtctgagcctaacaggactattcagtcagtagatatatgagtaatatatttcctgaaaaagttggtgaaatttaagagaaagcgagtaaccagttagtgtgaagagtggagaagagtaaatcccatttactttttaacagattaaatgatactaaaatcaagtgttgaaatcatgtcttaaaatattaggcaaagagaaaaaacatatattaactctaaggatctttttttccccactatttttactgaattccacccttcatttgaacacacattgaaaataagcttgtataatcaggaattgattcaagtttatcaggtgaacaacttattaaactgttcagctctggacacaggactggttgcttgcaaagcatgggctaaaatgaatatcctgactggatgtaccaaggacacaccactaaaattcatagcaaattttacattactgtctaaaatcatcaattaagtttacagacagaagtcttgcacacagggaaaaatatgtggtcatcatcactgaaatagttggcttctgagtgctttaatctactcatcctaagtaacatataaaaaatatgaaattctaaaagaaagaaagagagagggaatgagagagaaagaaaaagaaagaccctacatatcacatggtgtgtaaagttcatgttggtagctgcaagtcatgctgtgtagcgcgagcaggtatgtttatagataatcacttcagatgcagagatcacaggggccatctgccggcttgctcaactaatgcatttgcttgagcctctagccacctgcagccttctgaaaacaccacctcgtggaccagatagagctttttgctgatgccacttgccagacacttgtgcagttcaaagaacagaatagtgaatgctatttttatatatttttaatggaaaaaaggaaagagttatacctgctttcgcttagatgaaaaagtttccagtgagtaaaagttttcaataagaatctattctgtacatttctgccctacccaagtttagatttgacctatagctaacacagtttgcctagttgaaaatcaaacttatgggttaaggaagtgtaaaaaacaagaagaaatacgtagtctataatggtcctatacaaagttatattatcatgaatatttttaaggatatttattaatttactctttaaacaaatatttatagtttatgtagtttgtacacccatgtggccatactggggattttaaatatgcaaagaaatattcttgtccttcctgcagattgtaatatgaggaaacatacatataatatcagtgttgtttgctggtgaattttattaatgtgcagtgggagattaaggaaagagtatcaaaatcagcctgggacatcaggcaggtctttaaagaggaggtaatatttcagctgagccttgaaggatgagaaagtgactcctaaataaatgggactagagaaaaagatagtgttgttcaaaagaagcagcttatgcaaaggcgtggagacttgagaaaatacaatctgtttaggcgtctgtaattgattcacatggccaaagtataggacaaataaaaaccaagacaaccagcaacagccagccacatcatgaaagtttaatacatgtgctatttttttgtttgtttttttttgtttgttttttgataagtttgaggatggttctgagccaatttgcattttagaaacatcaattctgttacagtcaaagtctgtaacatttgggatggtgggtaagacaggagacagaaaaccaagtcggtgagagtttattccaggcaggatatggtgaggactgaaaaatggtcatggatgaatttaaaaggatcagataaataacaattatttggaaagtagaatagttgtgagatgtttaacagttaagtatggagttgaggatcttaggaggcatctaggcagagggaaaggaggtggggaggtgtcttactcattgttgcatttacagcaccagcaaggggacctctcacatagtaggtactattcaatgaatgacaaatccactgtttctggctctaggtacaatatataagattaagttgcagtttggccatgttaaatttgaagttgcctgagggaggctgggcgcggtggctcacacctgtaatcccagcactttgggaggccaaggcagacggatcacgaggtcagaagatcgagaacatcctggctaacatggtaaaaccctgcctctactaaaaatacaaaaaaattagccgggcatggtagtgggcgcctgtagtcccaggtgctgaggcaggagaatggcgtgaacccaggaggcagagtttgcagtgagccaagatcgcgccactgcactccagcctgggtgacagagtaagactctctctcaaaaaaaaaaaaaaaaaaaaaaagaagttgcctgagggatatctatgtggaggtgtgcatgcatgaaatagtcaaattcctaagtatagaggtatatgggaaaaataattgaacctagttgatggtgaagcatgcattatttaatgtctctcgataaagaagagtagactgtaagcttgattgttaacagggccccttgagagtgaagtgtaagaataagtactctacaatacactgatttttatattctctttctcctcctcattctctttttctgttcacccaagtagtcaggaatactattttaaaaaatgctacattaagtagtcttagtagtctttataggaaaatcattgttatagactttgtataaaaggtaactgattgcctgcaatctcagcactttgggaggccaaggcgggaggatcacttgaggtcaggagtccaagaccagcctggctaacattgtgaaatcctgtctttaataaaaatacaaaaattagcctgatgtggtgttgcacgcctgtaatcccagcagctcaggaggctgaggcaagagaatcacctgaaccacggaagcagaggttgcagtaagccgagattgcatcactgcactccagcttaggcaacagagtgaaactctgtctcaaaacaaaacaaaataaaacaaacaaacaaaaggtaattgattagtttaaaatggacccactaaagtatgaaattcctatgaacagttgctgtgtttgtaagggtacattatttagacaccttgaacagaaaaacaatctcgttacttacaaaaagggctttcaaaaatgtaaaaagtgtttaacttaaagatttcgtgaatatttttacttatgaggcaactttcctttacatttataaaatatttgaagaatgatttaatctgaatattagaaatgacacctttgtcttttagtctttggttagcatcttcatttgaaacatgaaacatcagagagtacatgtatgtgtgtttacatatgtgtgcatgtttgtgtatgttacaatgttacacatttaatcggtcagctctttgtgtatatttttacatacaaattagtagcacagtttgatctgaaaccctgttctttctatgtgatgttcttaatccagtagcgctaacataattccctttatttaatattatgtggtttgtaagctatattgttttacattatttcactggagtcttaaaaaaatgaggtagaggaagcatcgttatcactagttcatttgtacatatgggaaagttaagccgagagaaagtttaataagcagtagagtcaaacctccttgatcacagaccatgctctccattccactctgggccattctctatttaatcccatgtcagatgctgtgaattctcagtgcatgaactagtccaataatgttacagtgtagcaagcttatgtcaagacttattttctgttctttaaagatacagagaatggctgatagaattcttaggagtcttgtcacatgacgtaatgtatgtaatcctgcgatgctcactctgggattctgttcagtaaacactgtccctagtttcataatttctttagaatatggcagaattattggggaaacaaatacaacttgtctggtttaaattccttctgctctaatggttgtgtgtattctccaatcatccttatctttcatctgtttctctgtggcctttattttcaatggctatctctggcttttaattaagtggcctttgactaaataaactttctctgcttagtacgctaatgtgtttatactgtacgcagacattaaagtttgaaaactacattaactatttatcacataggggcatgttagatctttttcttaagtgcccctgaggctgatattctctgcatttaaaaatggctcttaaaagttctagctatactccatggagccccagaatgtctgctgcagccagtcttttttttttttttttttttttttttaaaactgacaaaatagggaaaacatcttaaaaaatttgggaaaaaaaaaaaaaaaaggacaaaggagggttttctgatttctgtactcgggaaaagtgaattgataaggcccctagggctcaaaaggaggtcaatgtctgttgaatacaagtgtaaagaatcaaacaagtaaaccttgaaaaggttcccgtgtcatttccctcaaaaaagcttgcaggtgaggcagcaggcaatattccaccctagggctgcgtgttagccattttaccttacagtgttttcaccttataatttaagaaaggacaatgcagatagaagaatctatgtatcttccttctaaggtaatatgtgtgtggataatactgtgttctggaatagtaggttttcagcttttttgctttttctttacatggccacagagttgcattctaatgttgtagcactgtgccctctagagaagcaaacaagaaaaaaaaaatcaaaacactcttcactctatccgttgttacccagtctccagaagccctcttatccatgcaggctgattctgttaggcctgcaagaaaactcagctctttgccaatttccacaaaatacccaattacatcaagcattttgtaacattttaaaaatcattattaaagataagggaggcagcgggcagtgcagtacagcatccctcttaacaaatcctcatctggtattctgcccttggctgtcccacctctgagaccctgccttggagggtttaatgtattttccttgatgctgtactccgtggagcatcagctactggtttatctcactcttctttagttgtactgggagatttagtaattatctcttacaacttgagcatttgtgtgcagtgggtgagtttctcactctccaccccatgaagtttatgaaacattttttttctaaataaatctaaaaaacattctgaggccaggcgcagaggctcacacctgtaatctcagcactttgggaggctgaggtggccagaccacttgagctcaaacgtttgagaccagcctggggcgaaaccctgtctctacaaaaaatataaaaattggctggttgcggtgtcacgtgtgtgtcatttcagcttctccacaggctgtggtgggaggattgcttgagtctgagaggtggagtcttgtagtgccactgtactccagccagggtaacagcgacacccagtctcaaaaaaaaaaaaaaagagagggagagagagaaagtccagcaaattccagcaaatacatttatttctattttattacaaaacagaaatatttctctctgcattaaaagcctgtaaaacaatattatcacagctaagtctgtagatcggatctcaaaaattaggtaaagatttattgttaatggtggtgattataagttgcctagaacatctcatcacactgtactaatcaccaaagtatcctatcattcagtgtgattgcaaaggagacttgattttgtaaagaaaataagagtaagataatcttagaagctgtgaagaaaacacatgcagtagcagtaataaacaaaatgctggcattgactgaagctgttgtcatcatgtttctttgaacaacacataatattcatgacttcatgtgctcgtaaggagcacatgaaaagtgtaagactttgatttggcttttcttgatttttattttagatgagtgcagaatatgaataattttgctatagaatttgatgcatttgattgtaggaaagctgtgggtgttatattgttgctttgcaaagcctggtgcattcccagggcagaagggggaatatagaagaatagagaattagaagtaggaagtaggagacaagaatcagaaatagcacatactatcaattataagatgcatctttttccacattttaccttgcaaaatcaggatacttgttatgataaataacatgttaaagtgataatacacagtttttttttcttttgtggtagtatataagattatggtgtacattacagtcaatgagaccataccattgaacatattgaatactaaactgatctttaatgtggaaagttgtagggaactatcgatgattttgttccagagaagaatagcgatgtgttttaataagattcacatgacaatgatgtaatactatggattagagatgttgagtaggtgaccttttaaacatctataagtcttttctactatacaaagtataaattgctgtgctgttaatctatgtgagaaataaaaccatccttattcagagcagtaatgggtggagtggagacaaagagaaaggaggtcattgagctgtggagatggaacattgtgaattgacaaccagttgggggtcgggagcaagggacaaggaggggttagaaaaaaaaaaaaacctgaaaatttagttgttttaagttcacgtttttgccttaataatggttggatttttcgtgtggggaaatgaaagaatccaagctcttctaagtcatctcttccgagaggagatgggtgggagtggaaatgggcacactcagggcggtgtggggggtgagaatacaggcttcgttgttggggagacctgcagtcaagtctgtgaaattattgtgtaaacttgggcaaaagcctgaatcctcttaatcatagttttctcatgtataaaattaggacggtaatgcctaccacaaaactttgtcagaagaattaaaggtccctttaccacagtgtctgacacgtaattatgctcaataaatattagctgttaattatttgaataaaagagctatacaacaatttgtgaagtggagtgaataaaattcagggttgcaaatatgaagtaaagtagtataaggaacagagaaatagtagtgatgggattttgaattagaatggatcgagtgtgccaggaaattttccatcatgatttcatcattgctaaaatgttcccatttcacatagtactgaagttcagagtcagctcataacaatgattactaattttttttatatttgacacatgtccattccgttgtaggatatgtttttaaaattataagcaatgtaaaagaaagatgattcagttggcactttttttccccaacagcaaaggatgttttagttaatggaagcaacattgataataggggaggaaacacccatccaaaattatgccctctaggaatgtttctctataataatatccctcagaagcaggtttctaccaggaaatcattatcatcccagtactgctgcaaggagttttgggtagttcaaattgaaatagaataatacatctaaactatgtatctataatgtgacaggatgaagtacagagaaaatgtataacgttgtaaatctcagagaaatgaagagcaaatgaacactcttagtgtgtatatttgtgatactaattggatttgtgcatgatattagataaattataattaagtaccattcataatatgtcctttcaaataaatgcacttgtcctgaagattgcatgttcaggtaacatattatattgacacacttgaaatggtttggctttgtgtcctcacccagatctcatcttgaattgtaatctcatgatctcctcatatcgtgggagggatccagtgggaggtaattgaatcatggaggcagttcccccatgctgttctcatgatagtgagttctcacaagatctgagttttataagggacactcccttttgcttagccctcattctctctcctgcccccctgtgaagaggtaccttccaccatgatcgtaagttccctgaagcctacccagccatgcagaactgtgagtcaattaaaccttttttaaaataaataaataaataaattacccagtctcgggtatttcttcatggcagtgtgagaatggactaatataatatcctttaaagatattttgtgtatgttattgacatagatttttaaatcaaaatttagtttcttctgttgaattatcttaatcaaattgcaagctagtatacacaagaaaacacagatcgtcactcccaagcatctggaaataaataacccaatgtccttttttccacaagccattactaaatagacattttgaaattatagaataaattttttttggatacaatagtctgaaaatgttctaaaaacactcctgactttcccaaggtggcataagtacaaaattcctatgtgtcaagttataaattattttaaaataaggcaacattacacacccagaactcagtctcccatgccttgtgcagttcctgggatgtacaatatacattaggtagctactacatatttattgactgtgttaattattgtagtttacccacatttatttagacgagatgtacagagtttcgggaatagaagagatctttaagaccccttggttcaacctgttttgtagatgaacaaagtaaagatcagacaaagtaccgatggccccaggttgtccaacatcagagcgacacaagggcacgagaccccgaatcccatggctgtcatgcatgttggataacacaggcttgaagcagttttaatatcatgctgactcgcttgagcaattctaattatgttgctgaagaggttgtttgattcatcttgaatcccagttctatggactaataaataatcgaatatacttctatatttgatactcatttgggcagaaggagtgaagagtcaaactgtgaaataaatgtagccgttaagaaaataggaaacctattacagtttaaaaatctaaacagaaattaaacagctgaaaagctaaacagaattttgcagaaagtagtcttcctcaagcagtggtgttactgattcttccttgcctgttcctcagttccgtgatgtggtccactctctccaggtggtgttagtggtggcctcctgttaacaccagagcaaccaatatgcaaaaacaaaaacaacaacagcaacaacaacaaaatcatggccagtctctcctaggaaaaccaatatgcctttccagagtccatgggataatgttaatggctatttgagaatgtcgtattctcccatcagcctaattattgactttattgtggtctttgcctgtttcttccacctcactctcttttttccctttttcttcctattgatttctgccaattttattacatttctttatgaaaatgtttatccttagggatttaacaactgcagtcaagatggttggtgtgcaggaaagcaggggatggaagtttctctggttgcagagatgagtccccaagagggcttagaagagactttgttttcctcatctatttctaaataatattttgcttagagaagaaaacctctcttaggcgtccttaggtcacctggggcagagtatagtcttattattctttatatctgctctattttagaagagacaattacatatcccatggagggtcttgttatgtgaaccaggtttgtttttcatttagaagcattagtgttctgaaattgaaattatgccagagactttttgaggtaagcttttaaaaatttgtaacttctcagcaaattatttcaaacgttctgcagacatgcttattttccctcttttatagctagttaataaacctatttctcctctgtctttcaaaatgatagtacaatggaagaacatttacctcaaacttcctctgtatttctctcttctttttaggccagtggctcttaccttgggtatgtagtagtttgacccaggaagattttacaaataaaatagcctgggagtatggatggatattctgactgaattattcagtagtgtagtctgaacatcacagcacttgagcgaacataagatactcaacccttggcatagagaactaaggaggagggcatgcaaactgggtcgctggcttccctgagctaaggcaattttgcttctttctcttctcaaataaagaacaccagaatgaattcttcatgctcttgggattggtccattcacagtgtgaagtttccataaatcaaagcatttgagagcatggaaaaataagagtatgtcagatatctactgaaagaaacgagtgacacactgcctggggctacaacttttatgaattttgccatttgacagcctttgcttcagtggcttcttcttctgatcagcaagtacacatctctcaacaaatgacataaatgttcccctctgtcacctgtgcctctgaaggagagagcatggtatgcatgagtaccaaggagccaagctctgtgattcattagttactgagttggaaatgtgtgtgcatgctgcaggtcaggttgcataagaaacagacctggaccagggatttacccatagggaatttattggtgtgcattcttggaataaacacttgtgagggagaaaagaaggaagtaggattgggcagtaaaagttgttgagcaaagcagcctaggacttggctgaccttgtggggaggtcaggagtagggaagggtcttcatagttgtcttgagctaaagggaaaaggaggagctttaaaggctcacagcagccaatcactggatgtggcctgttcttaagaaagatgtgttatctttggtcaaggtggctctcttcaactgaggatgatttttggaaaggccttagctgagatgtgttggccaccagcacacgaatgtttcatttggtgaggcacgcaggggatctgggaggctttcgtgacgtgccctagagtcagccccttgcacactcatttccacttgcttcatgtggtaagttcaggaaacagttcctgcatacatatgttaggccctctttcctgctggaattcacaagaagattaggaatctccaggttgcaagtggtactcatcacatccttctcatctacaactcctccttggacaggctctttgacttgtccatttgccattaagatggacaagagaacatcaagagacactctagtgcccagatactaacagaagcccccattaggtaagagaagcccacctgctcctgatgatcaagataggttacacctacgaggattgtgacacttgtcctagtctgctggtcccttggtgccaggagtcccaagagaatggggcagacataccttgtgaacctggtaggatcaccctgctgtaggaaagagaagcatacatcaacccccagtgagtcaacaggagtgaggtaagaaggacaatcctggccgggtgcggtggctcaagcctgtaatcccagcactttgggaggccgaggtgggcggatcacgaggtcaggagatcgagaccatcctggctaaagaggtgaaaccccgtctctactaaaaacacaaaaattagccgggcatggtggcgggtgcctgtagtcccagctactcgggaggctgaggcaggagaatgacgtgaacccaggaggcggagcttgcagtgagctgagatctcgccactgcagtgcagcctgggtgacagagcgagactctgtgtcaaaaaaaaaaaaagtacaatcccactctgatcctttggttcttggtcttcagtgttctacttacccccagaagctgtgtgacatacccacagtgaatactccccaaattagcttctcattcttttgggtttccctgaaacatgaactatggcaaaaaggaaattgtttgccctctctctctcatgaatgattgaaatagttttcgtgtgatttagaatttaagtatagccactataaaaaatatatcaacacatgctattttatgggtacataaatatacactgcatacttcttcttctgtactatttttagttacagaaaggacagttcccttttgagtaaaatatataaaacaaatcaaaacagattaaattttatgtaacaactctagaagacattttctttttactttttatttttttgagacgaagtcttattctgtcgcccaggctggagtgaagtggtgtgatcttggctcactgcaacctccatctcccaggttcaagtgattctcctgcctcagcctcccgagtagctgggactacaggtgcgtgccaccttgcctggcttattttttgtatttttaatagagacagggtttcaccatgttagccaggatggtctcgatctcctgaccttgtgatcctcccgccttagcctcccagagtgctgggattacagccgtcagccacagtggccagccaactctagaaggcattttaaattcaatatacttaaaagtaattaactatttccagcaccaatattattgataaaaaccggtttgtgtgctggtggtgtttctgacctggagtgctggttgaaaatagatttctggtcccaaatcaaagattctagttctgtagacctcaggcagagctcaaaaatttgcattttaaccaacatcccacttgatgttagaaactagaaacctacatactaaatttcacaaaataataaagtgattagcaaaatagtaggagaagatgaataaactattctatactctttaaaattttttaaattatttaaatagatgtttatagaatataggttataatatatttatgtgataagacctctttttatagatctcatgccaaaattaattattctgtattataccttggtggattctgtgtgttactcagtcagagtatccctagaaaggaattgatttcatcttttagtcaagtctattcctggaaatcaagttcctccccttcattgtgaaactaactcttaggagcatcctttttgtcccaacttaaatatcatttctttaaaaagcacttccctgaaccccgggctcagcttggttttcctgccatatgatttcttggtgttcttgcttttgtgtggtcaccaaaattacaattatttgttcaactttctacactgatagcataccccactgtaagctcatgaaggcgggggttacttgattcaagactttaggctccctcttgttaccccttctggttttcatccacaagtcccaataagccagacatatagtagatagtccatagttatttttaataggtgattagtatatgttgagtgtttagatgaagaaacaaacaggctagattcaatttatcaggacaatctagtttaggcatcgggatatgcaaattgtatccatctagtccacataatagctactgtgcactagatgatactagttttaacgtggtacttcaaataacagctaaagggacacttttaatctgtaatttttacaaagatgctagaaaggatgaactagacaaatactaaacacccaagagagaatcattgagaccaacttttctaaataaatattaccgaatagcaatgtatatgcacacttttgatggatttagagttaacagtcagagcctccttaccaagatctagttagtaagtttaagagttgaatggctaagtcaccatctgtcctcttcttggctagctccttttcagtttgccctccttgttctgtgttatcgctgacgttctgtgtttgtccatatctttgtctaggcattggcttccattaggccacattgaacaaatattattcttatatcagaattgaaaagatactttagaaaattctctctttagatgatacaagtgttgacattttctcccctcaaccaaatgcagactctaaaattttatttccattgctttagctgttattgttggtattttctaatggacaaagcagtgtagtgcagacaactccaagaaatagtttgcaaacaccttatgctattggtgtctgcgacacgtacatgcataccttctccaaaatgccaggtacaaaacatttgtgcaagtcttaaggatgagctctcagattgctctctgccttcattgtggtgagtttcttccagtcatctctaatgttatgacagggaagaagtgttagatggacttttgcctagaagcattcaaaagagttttcatgtagggtttttattcatgggcccagtgcttctcaatggacctgtgatgaaaggctaaggggttttttgttgttggttgtgtttttgtgcacacatttgttttttaagaacacactatactattgtcactggatgctagttttgtaaaatgcaataaaaataaatttcttagatgaaaaaatcagttcccattattttcattattgtatttgggttcaacagacatgaaattatttggtgagctgactgtaacagtttctaagccattcctctcaaattctgtttttatcttaattcagaaaaaccaatacctcactttgagtggtgatacttttgccttggttatagacgttttctgctcaaccagccccattttaaaaagtaaaattaaaagttcttcttttgataaagagcttagcctctccaggggttgcttttaagtgcttctagcctatttcatggagtttacaactaagagagcaaggtactctcctatccggcgagccctcaagtagagaacatgaagcattcacaattacactaagcgaggatgaagcctcagcttcaattttgatcattaagaattcgactgtaggcagatttcttaagttgtgtgagagttgtggatctggcctggagacagcaatcagagataggatgagtggggttttctttagggaagtgaatgtagctgtgtggaataaagaatgcttctttgagttgctgtcttttggtccctgatgaaaaatctgtgtcggtgaacacgaagctctaagtaaccatgtcgtaggtacagatccttggaaccttttggttccaaggcaggactgttttccctaaggaatgcagataattatattacaccactatatggaaatgtattaatatggatggaaattttgattttacaaaattacttccaaatgcatctttttattttatcctcacgtcaacattcaaagccaattgtacatttacagatatggatctataacagatgaataaactgggacccaagcaccatcaagacagcacaacatggagcagaatggagattcagtagccatacctggggcttctttgcattgaccttccaattgggccactctgcctctaagaaaatggaccgtgaccccctagaatggctgtttctcacaagtgaattactgtgaactttttctgagaataaaaacaatatgagtagtattttttcttttcatttgttacttaataaaagaaatgatatttagggcaatattaccattacctatgcacttcctgaattatgtctctttcctttattcttgtttgtaaaacaattaatatcttcttaaaccacacgtcttcattagagatgctttataagtgaattgtgttccattaccttgaaccacagtaataattataaattaggaatacttcaaccagaaagaaatgactcatacatttgttttcatctgtaacatttattcaacagcttgataattgcaatatatacagtggtatgtggaaaatatttattaaaagacataatagaaaacttgtttataatatgtatattcaggcatttttacttctgccaatcattgtttaaatctaccttctatacttaaaattttaaccttgtaaaattttaataaaattaccctgtatgggttctaataatctggaatacacttttattctttaaaagtgaggaatctagaataagtaaatcagtggttaaaaaaaaaaaaaaaaacacacacactttttactttgccatcattacttcatttgttgacacaaatgcaatagcagtataagttttatttatattacagtgtattttttcttattccaacgttcattttaaggaaaactttaatacaaagctgcaattattgtcatccttattgtcaataagtcagtgagcatcacagaggttttagtttctagtttcgtttattagtgttaaagctttcacaatacatattatctctttcataaaatttcaccttatgtttatagatggtctttttgtggcatgaaaatttagtatttttttcaaaggcaaagacatcaaaaagtgcaactctaacattataacaatttacctttatgaatcccattccactgtatcatctcaagtagtggtcacaattatgcaagttcaagtgtgaatatatttatctccattttacagggctaagctttaggtagtaaagataagatcatcagtaagatcaaataacaagcagagtttaagaagtactagaggaaagaaaagttggttaatatattgaattgattgtttttacctttatctcttaaattgaggatatttgccattatcagacttttatttaagcagatggattgaaagtggtagaccaggtagttcatatcatgcttagtctggttatatagatgtaaaaagatcaccagaatagcagtgcattgctcttttagttttgggctctacaatctttaatttaaaaataaggagggtaaaaatttaatgaaggtaatggagattctggcacccaaggacatgcaagcacgtttcaaccctcccttaacacacgtgtgtgtgtgtgtgtgtgtgtgtgtatttatgagagagagaaaaagggagagagaactactgtataaaagctgaggaaacaggagtaagaaagatgcctgtttctaccagggctctgtctcctggggaacataaacatgtaagtgtgaaagtacaaaatcacacactaaatgttaccatgagcaacaaagcaaggcatctgaactccatctaagtggttcagaggattatggagaacaaaccagagatacaggatgttttttgttttgttttatttttttttctttaaaaagctattaaaacttaaatggacagaaattgaaataaaacaaatactgctgtttttcaaagtggattataaatttaccaaatttaatacaacagactttattaagaatgtagaacatagtgataaaaagaacttagttctaaaggagtttataaattaaagttggatataaaaataactagattttcaatataaagcagaattaaatgaattctgtcatagaaattgaaacaagaaactacagaaaataaacaagacagttgtaagacttcaggaaaagggaatttgcatcgagctgaattggatgtctgtgagtgggtgtgttgggaagcatggaaatgcttgctatgctcaggcagtgagaactagtccagcatgcttggaccatagactacactgtgagatgtgggaaaacgaggcctgggagatagtatggagtcagattgggactcatgcctagaattttcggttaaatccatagactgtgggaagcaattaaatatatttggtgagcatgctgaaaaggccaaagaaggaggatcaagagtcagccaagtaaatgttccattcactttgaaataacttcaaaagagttgaattctcagcaaagatgtactttccataggctctaaaatgagcatgaacatagcaatagatgctttctggaataaacaggcacaattggctggaccatcgggaagctccgggccatgcccaggggccgatccatcatgaaagtccttcaggctaacattgttgtgcaaatatgagatattatgatatctcagtgttatctttcagcacttattgataaagatactcttgtggacaaaaacgtttaatgaggggtgtgatataatttaatatatgttttagaggaaataatttgattatgacaggctaggcaatgtgagttattaaaattaaaaaaaaatgaggtgttttgcaatagcccaagtgaaaggtttgaagattctaaactaggattatgattcagaatgaatgaaaaagggctcagatacaatagactcatggtggagggtgctctatcaagcagggcctgatggaacattaatagattattcagaaatatattttaggatacatgtaaaatgtgatttgcattcatggtctatgtagtttatgagagtctgattgatatttcttacatattaatacatgatgctgacataatgacacaggatttacataattgcacctcctcctcagcttattttttgccttatcatgagctagattcagctaaggattctatgcctctccctttttgtgctcatttgaaaaaaaaaaaatctttaaatagttacttcgaagtcaaaacaaatgctttgaaaaggatttaggaacccaggcagtaaaggtaagttttgtctgcttattaatagagattttttttttgttattgtttaggctaatctcaggttcacatttgcaagggtatctgtgagtacaatagacctaggtgattcctattctgcccccaaatagagcacaaatacttgtctttggttgcgtttattttgtttatgtacttatttaccattttataggatcatagtttgtttttttcttggtcaaaggttttcacagtagagagtaacatttttctgttcaggttgtaatagttattctcaaaggtgtccatgcatgtgtgtgtgtgtgtgtgtccgtgagtgtgcacgtgcctgcagagacacttgtcaacttaagaacgtgatttgctatttctacacttggcaacatttctcttctttgctgagcattctttttcatcaaggagagaggagttttttactaagagtgtggatttcactccacctgttaggattagtataatgcacaaagtctcacagattaaatgtctgaatgcctcagataattatgtacctgttttaacaattcaaagttggtcaattttaaccacagatgcttacagtaactttgcaaagacactgagtttagactccaagcaattttctgcttgtgaattttggcagtggttagaagcctagtgatggtaccagctgggagaaaattgtcagcgatgggaagaatagtaaagtttaggacttctgaaacaggatgtgtgcgtgggggtggggtggggcacggctggggcatgggtaggtaatagaagagaaagaatttgattgttgaatgattggagaagcaagcagtatgaaacttttaagttctgatgctgtcagtaatggagaacaactgacaaccccgtaatgtttaataaaacgcagcatcagagctcaggttgaagttcacagtcaggacttactgtgtgatttttcttgaaaataaatttattttgtctctcatacttggaataccacagggacattgtagcaccatgccaggaaaacagtgatcagttggtgggaattaggtaaatgaatcataagagcttgttctgtaaatgaaagtcgttaatgtgatttcagtgtaaaaaagctttgattaaagacatgacccatgtatataattgatatttcttgtggtcttctggatgttcttctaacattgcacgccactgtcagcagtaacgtgtaggtaagttgctaccaggtgccgccccataggagcacagatgagggtgagggagcattaggagagcagcactgagcgttaagcggcccggggactggaagcttaaaaacaacttattttcatccatcatctgcatttgtcttgggagtcaagtcttttgctatgtgctgctgagtgtagtggagtttactgttatgtaatggcaagaaggaacccttctcataagtcataaaatgcacacatggaaaccactagaagcactgagcttcttgaagatttgggggggtgatcaggtggggttggttgcatagtcccttctttcctcaagttcccctttgcatcagctcttgaagaccctagcacacagggcaacaattcctatcctggagcctggatctcattatagggagtggggatgtgggctttagaccagcctgccagcttttataatcctggatctgccagagagttggccaggccacttcaggcaaagttcttagcctttctttacctcagtttcctcgtctgttagtaggattaagggcagatgtgaatattgaatgaattactatgtaaataatgttctacccatgcaacaaaccttcacatgtacctccaaacctaaataaaagtttttgctttgttttgtttttaaaaaaagaatgttaagcatagtgactgacatctaggaagttcttaataattaaaactataataattctcatatttcaccctttgtattataaattagagggagatacatatataatagtaaccctaaaaatgacttaagacagttaaataattcacaatagttgaagaacacaccttttccctacactgaataaacatatggcttaggatccactagataattcacactgaaaaaagttaaattataacttgtgccagaaatttactttttgtgttatttagtcctacagaaaccaaaaggtaaatcaggtattcaagtacttggaagcagaggataaacatagccgttacagtgcagggaaagaatcacttacagaaattcaaggtacaaaaggcaatgtcctcaacagctacagggaaggatgaaaatgtactgtgtccatactttccttggtgtttttttttcatatgttatatatctttagcaccttgtcttttaaaaaatgcaaacatagttcttaagggcagtgaaaagctttattatttggtaaattgagtttttacattcatattaaccaaagtgcagaatgatggcagttatagggggtgaaagattgttgaaatgacggattgagtagcgcgtttgtcaggttatgaagttcagggaaatgtgtaattacgtgtgagtttcctgaggttcctctgttcaacattatgttctgacatacagcagggacagttccagatgtgaaatgcaaatcgggaggtgctgccctgctgctgatgctgtgcttgatcatgcaaatctaatgcagttctgggtatttcaacaaagcttttagttgaagtcccgtgcatgtattgatttaaaattcctacttgagagagcagtgtcatttttttcagctccaatttttaaaatacggaacaggacttggagacagatttagagactggacatccagccacactcgttaatcacagagtgtgagtggggacagggcagggaggagggagagaagggcacccttaaataatatgggggtttctaagcatattaaatggtatattggaaccagatttacaaatgttctatagaaagtttctttgcttagaatagatcaaatcaacccattatacatgtttactgaatgcctgctctgttcaaagaagatggctaaaactggcaaggacagatcaaatacaaaataacactacaaccagttcccaactttgggactgatataaaatacctttggaaatgaggctgtttacaggaagaaatgaaattgtcttgctcacatgtacaagctgacacattctaatagcctttctgctgtgcacaataagtgttcagcttatctttccaagaacaataaaatttcatgtactcctgcctgacataagaattatttttacatatctccatatcactgactctcttgtaagttaatctcatctcacatgaatttttcaccagcttcactctgatgttgataaaggagatggttccatcaaatacatcttgtcaggcgaaggggcaagttccattttcattattgatgagaacactggggatattcatgccaccaagagactggatcgtgaggagcaggcctactacacgctccgagctcaagcgctggataggctcaccaacaaacccgtggagcccgagtcggagtttgtcatcaaaattcaggatatcaacgacaatgaacccaaatttttggatggcccatacacggcaggagttcccgaaatgtctcccgtgggtaagtaaagaacactctgcttttgtagcttgtggccgatttggggagatttgtatttaaaattaaatcatcattaagtactgaaaaaaaaaaaaccttactagtatgtgtgtattgattgtcagttagggtgaggggaacatttgagacatgttggcagccagtatccattaacttaacttattaatttatttgtatggaatattaggaaattgtttttatacagctatttcagtgttttcaggaaattacttcaatcttacattttttcaacttgatatttatttatatttttaaatgattacagtgatgcctcagaagttaacaaacagaattcttccagacacaggccagtgatgatcttttacttttctttccatgatattaagatattgattcattgttctaaacatctctctatggccaatgtatcaagaaggccatcaatggctatccaggctaatatttggattaatatttggattggctgttctgtttaattgtaatgagtatgcttgaacctacaaatggccatacacatgccaccactaattattttaaaattttaagatcagggatacatgtgcaggatgtgcaggttagataggtaaatgtgtgccatggtggtttgctgcatagattatcccatcacctaagtattaagcccagcatcactaagctactcttcctgatgctcttcctcctacccccaaccctccaacaggccccagtgtgtgttgttccctgacatgtgtccatgccaccgctaattttaaaaaatttctccaaaaacttaaatgcatggaaatttgtagtgaatttatagcaacggtaaggagatacccatttggagatatatatttaaaacatgaaggcttttttattcaaggccttttgtcatcgcgccattactagaaagatacccagtaaagcatttctagtgtttatatcgaataatcaaaattctcttttaaatttcatttattcaagtacttttggaatagtttacagcaagtatgtaatttaagcataggaaatcttataaaaaatacaaagttattagactggatgagagatgggttgattattatatatttatttcctgctgtttttaatattgagagtttatttaaaataataatggaacttgtattttaacacatgggtattttaacccatgtgatttattaaaaaaaaaaaaaggtcatttcattcatccaatcatgcaatcaacatacctacgacactgaggagtggggttgcaaagatgtgtatcatgtgtgctcttaaggggatcacagtttagtgaacctaaatttctgttcctattagaagagagaggggaaattatttgggttaccaccatggctctagctgctagagaaataccaaatgacaaggagacagaagaatcaatgcttgtggccaggaagaatttgaaccacagtggcatgatcttactataattagcacatatgtaagcattgctagcatttctgtgaccaaacaggtgtattcacacttcctcactaccgtccacaccttccaagtgcttcctgctgctcttgcttaccaacaagagcagcagcaacagtaactgttacaagattttagaaaaaagaaagggcacattttcctccccagattagtaacgtttagtaacacaggaattttcgagatatgtttgagcaattcaattcaatttcgtactcccagatctcatggacattttggttgttcttcattggcttgctaaggttttcctttcctgcatagaatatagatatgtgaactttttgttttagaagctaatagtgcactgttgttttgattttgatggtactctgacatgaaacagcatgaatattatgcacacttgaataatgtataagttaaataaattatattatttaagtgtgcacaatagtcatgctgtttcatatcacagtaccttttcttttcttttctttttttttttttttttttttgcgagatggagtctcgctctgttgacaggctggagtgcagtggtgtaatcttggcctactgcaacctccacctcccgggttcaagcaattctcctgcctcagcctcccgagtagctgggactacaggtgcgcaccaccactcccagctaatttttgtatttttactagaaatggggtttcaccatgttggccaggatggtctcaatctcttgaccttgtgatctgcccgactcagcctcccaaagtgatgggattacaggtgtgtacctggcccatatcacagtgcttcaataatttatatttaagttatatacttggctgattcaaatgggtttggaattttcttatagaattattttctgatgtcttcagggtgtacttgacaccaattcagaccactaacttaatataaaaactggaacatagaacatggaatacctaaactacataacatacgttgtatgggcttacagtttatcaaacactatagttaatcaaagtgcttaagtctaaccaagtaaaatagccatcaaatagtatgatatagaccatgcaagctttcagtgtttaatattcaaggatcattttttattggatgttagctaatcataaaattttaaacacactagtaagcctttaggatactttatttattgccagaagaacatagacaggcgtggaaagcttaaatttatttgtgaatatgtgtgtgtatctggtgtgtgtgtctatatgtgttaaatgagataatgaacttttcagaaaaaaatgtgttattgtacacagccaaacttactgaagtttagtttttattatttggtttaaaattgtttgctttcttttaaaatgaagttggaaaataatgcttaggcatattaccaaaataaatattgtaaagatgatacatatagaggaaagagagaacatcaatgtaatttattacaactttttgaatattcaaaatttaattcttaaaaagatttaaaatacgcattatttaccatcttgtccccaccagacatccacagggcacaatcatctaagtccataaaataaaaaacttcaggctgggtgtggtggctcacgcctggaatcccagcactttgggaggccaaggtgggcagatcatctgaggtcaggagttcgagaccagcctgaccaacatggagaaaccctgtctctattaaaaatacaaaattagctgggcatggtggcgcatgcctgtaatcccagctactcaggaggctgaggcaggagaatcacttgaacctgcaaggtggaggttacggtgagccaagattgtgccattgcactccagcctgggcaagaagagcaaaactccatctgaaaatataaaataaaataaaataaaaacttcaggatttaaagaatagtgctgtacacttaactttcataatttccacgtaattttaaagaaaatggaattggcaatgaaatatatatagaaaataaagtggatttatagcaaaatgggcattaatgacttgcttaagtcattttgaaagagatatttacatagaaatcaatctaaaaatatgttagctttaaaatgttgtattcaggaaattatttgtaacaaactaggaccttaaataacacataaagaaaggggcttgttccatatttaaaagatagcatatttactaaataatagtatataactaaatatataaactaagtaaacatgagtctctctaatattttaaagattacattccaaatggaaaaaaagaaaaacagatcagaagaaatgctttccatattgaatgtgtgaatatatagtaaatgaagaaagaatataacatttcatcatataacaaagaaaaaactattgatgcaatttttaaagtttccatggctttcctcttttacgaggggtttggtttaaattttcatttcctgttttgtttttagatcaattggcagagaaaattaaaaacaaaatcccaaggagatagggtagccacctaatatacagttaggtgcatcaaatattctttgtcaattaatgacattttgatttctatctggatcttcttaactatgacagttgtatacctgcaattacttgagtgtccaagatgctgttgtcttgctgctttctagacagtgattgagtcttatagaagctgctcttgatgaaaatatattacctgagcccaatggatgagacacctaaagtttcagtcccatccaattcagagtatatcccagcctaatgtgcatcatcgatggtattttttttttgccagaatattttcttatcccttaaacatttcaagagttttattaatatttatgatctctttggggctggtttacttaaaaaaatactgtatccatttttttatgtgtcttgaaaaagataaatgaaaattttcaaataagcttaatgtggaatcagtaacattttgtacgttttttgttttgtggtatttggaagtttttaattcagtggttttgggattggcatctagggacctcagtggtacaagtgacagcgacggatgctgatgatcctacatatggcaacagtgccagagtggtctacagtattctgcaaggacagccgtacttctcagtggagccaaagacaggtaaaaattgaaatgtgacattcttgtaaagtcatcatttgtttgctgcttagaattaatattatttctaaatatagttgacactaataacataccattttattatgcttctctcaatatgtctactttggtaagcatgatattattgaggatttatcaccttttaaaaatattttattttattcatcagtatcttaacaaagttaaaaataatgctatatattcaaaagtatttcagcttctatctcctgaatgcttaagaaaatttcgattctttacctcagagctttacctgtgttttgttttgtgttttcattcacatgggaaattatacatggtaatatttatatctcaagtagaaacctctctgccatgtaatataataggtagtactttcagtttattcttccagatgttatttttctcagggaaattagttgaaacataacaattagggtgatgatctgccaaatcaaaaactaaactaaatatatatatttttttaatttgggggaacaatttttactgagttgaaaagtggtatggatagaatatgtagttggtttgttctgttttgcttttatgtaagctgaaactgtttacattaagactataacatgggacattgttatcttggttattaattgatattttaatgtattcagtttttctggtcctgtgtgtgtagggaagggcaggtgggtgcgaatattagcgggtgtgtgtcactgattttttaaatcactgtgaaaatccacgttttctctttttaaaaataattttgcctttatcatggagttagaattattcaaatatatacatttatgattatgaatagtcatcagtacctgtaatcctaaatgaatattttaatgccattgatcctgttttccatgtttaccaaaagggcaatattaatttattctcaaatcactgtggggataaatgttttgaacaccttttgagaatgaccgttgtaatgtgcatgaacagagaagtaaattcaaccttagctcattcattacagctttcatagagatggaatgcatattttacaccagtgtagtgatagggcttggaaaccacatggaaatctacaaaggaagaagcagtcatgattaagcaagtattaaaggagaagtaaatgaaagtatttgatttatgatatgaatcctgtgaatgtggaaagcgtgcttctgtttgactgaatgatagatctgagaaacctaaattcaaacacccacctcttcccttctatgcctgctcttggcaacctaaaaagacattgacaagtttctgacaatatgctcacaatcatacactcctgccttatataacttgtccaaaaatagcatgtattaagtccaaggataaaatattttgctgctactaatgattggcttatgattttggctttgctgcaaaataacaggatttccctataaccctatggagacaaagccataccggttgatcaactagacaatggtatatgtcttaggattagattattaatacttcaaacctgattttaatttcagagttgaaaggattgtgtgttacaagagaagaggaaagtttagtttagttttttttttaatgctgtaattatggtaatcgctggaacttctttttacatggtcatgaatgcagagacattctgagcatctttgtcctctctgctaatttataatatgtagagtacatttcttgtgagaaaaaataaattgcatgtttttctgactgaaatggaaagttttcagacctaaagggcatggggaattataaatcaaggttcagttagtcttgttagtcttcctttcctgatgtctgtctgattcatttatatgtgagaaataacattatttctcctttaaatctaagggttttttgggaagaaagtaaaattttgacaggaaaaatattgaaattatgctaaataaaaattgcataaccataggcacaggccatcactgttaggtgcatttttataaatttcttctcaatttctaagaaaataacatgactaaaatctcagagcacaaatttcatctatagcactgtttacaggctgaatgaccagagggtaactatattttctgcgtcaatttctccttcccccaacctagaatgtgagtagttgcaaaacccagtgttgacagttgactttaacaagcaaggtagcatgacactggaaacaaggtaaagcaacattcccttgaaacttctcaccacctaatttcataatgtcccaaatttactaggagattatggacattacatttattccattaaacatacttaggagtattctaaggtgtatctgtttattttgtaacctgcaagcaaacagataccttttttggatctgtgtgatatatgggaggactggctacctaattcgtagcttaaactgaacatgtaggtcctttgttcttaaatgattaagtttaaatacatcatcagcaaatctttaaactgagtacagggtcggaatgacggcataggtcatctagccatgaagcaagctctggaaaatggattgagtgttaaacatcatttgtcatttaggagttcttttttagacataagaagtataactacgtggtggctgcattatatgttgtatgcatacctattacatcataattttatataagaggtattgtcataacaagtgaccccttccaactacacccttcctacacgcccggttctcattctatgcaagagtgctgtctcttttgaaagcttgctgagaacatcccctacaggttgcaaaaagaatcccctcctcaatgactcttcatttgctgccagcactggaattctttgatgttccagaagcttccaactttactacttcactgttgttggttcttctctgtctttttatagctctctcatatctacactagagatagataagccaaataatacagagcttaggcacaaaatttagaaagaaatagaaactcattagcagatttttatcttaagtgtaaaacaaaatgagcatccaaaaacttttgtgattttgttttataaataggttccccctcccaagagttttctcagctaatcagtaacatagtttctgtatagccagggctgtgtatttctttcatatttgatttactgataaatgtttgtaataaaagtgccatacttgattttattgcctattatatgaaattcatttataatttacattgcagtatttaaactattatcatcaaaggatatttttaaaaatagaaagcaagcctgaaacatttgtgcttatttcagtttctaagttcctttgaaatttaactttcaagcatcatgagtatttttttaaatttgaaacttctttgttcaggatctatttcctcatgcatcagtgtctacatttgcaggaaagagtgttgcttgacccaatctgtattcatctctaaaattctacaaatatgtaactcaagacttcacaatgtcttgtgttacaaattgtactcataatagagtatttttaaaatataaagcggtatatttattttcacaatgcaattcaagtctcaaagatacacacacctaagaatgtctatacatcccattctccatttcatttctaatttacttttagttaactttgtatgctataaggttttgagttttttcttttttaatttcaatggttatcaatatgttacagaatgaattgggtttattacaattggtgaattgctccaacaggagctcttcaagggaaagaagatggcagttaggactcagaataagtttacaaaagtgatcattgttatccagtcagaatgtgcatgggggagtacttctcacctataacataacaggtgatcatattgcattaaaatattcaatcgtgtctttaatagcaaaacatcatattggaattttcttcctgaatatgtactatatttctaaacatcatgtaacataacactcattgatataatgtaaaacagaataagctaatattggtcacaagtatcactgagatattttaagtactaagaatacatattgacagaaactgattacataaatacctattcagttcattaccagttatatctattattctcattcactagggaataatcacacagaaataattatctttaaaggagttaccaagagagctaacatgatatccaattagttctttaaaacaaaagcaaagccaacagccagactacatgtattttaaatgatttttttgctggtgcatcattctcctgtccatgtttcaacagtgctctcttcattggctgctccattttggtgatggccataccaaatggctttagttcattcatggtccttatgaggtaggagagtccagcaggactgattttccggtcacaaccttgttgaccaaaataggatctggtccagacaggataaagtgaaaaaactggtaggaaccagcagatgtcgacataagagatcgctagctgccctcattgctcattggcataagacactcccaccagtgccatgacagtttataaatactatggcaacaacttggaagttaccacctgtctccgttgcaatgacctggaagttactgccctctttcctagaaatttcaaaataatctacccctcaatctgcattgacccactcctcgatttgcatgtaattgaaattgggtttacgtaagtataaataaatttgccaagagaccacagattgcagagttcgggcacgctgcctgtgagttggcactgctccacaaagagcggtaccatttaataaaagttgctgtccaaaaccactggattacccttgaattctttcttgggcaaagccaagaacctcctggactaagtcccaatttgtgggcttgcctgtttagtatcacttacctcttgatatatattattaagtccatagaagctgtaaggaaaccagtatctttaatgtctcattgtatggttttagaattcttagaatagctacagacaaaaaaggctgtaatggagagagtgaggatcgtgaagggctttgggagttggaagtgcagatgacccagatcctggttactgtgagaaggtacttcctcagttaacaggatccctgagaaagctggttttgcaatattgagattcctcttgtaatggtagtccagtcaaagtgatatccaaaaaagtttatttagttttagtgagaacaatcctaaagggttgagccctcacagcgtgaatctccccagcccctggttattaatccttgggttcatgtggttgtctaggctcctgagggtaattcgaagcctgaatatgcagaacccgtgttcctttgcttccctaaagtgcgaaagatttcagaaatggctatcgtctgttacatgaggtacatataccaaatttttaagaagattcaatagtagcagaatatgctttaaaaaaatcatctgaggctgataggacattagatcatcagatttttttcctatacttaaaaacagcttttgaacaatagcaatataagtttatattttacatgcacaatgctttttgtgaacatggattataaataaatgaaaagttctgagttatggtatcagatgatatagctatagaaaaattattcacaaagcctaaaatatgagccagtgtctttttcaaagagcccatagatagattttttttttgctaagcgtaagtgacttaaacaattactgattattattaagcatgaaagtctcacggagttataggtatccaattggtcaagactagactttactagttcagtcatatgatattaacaattttctctgtgtgtgtgtatttatatacacaattatataatacatgacaaaacacaaatgaaatccaatgtatgagaatgcttttccaaatttagacagtttttacttaaaagtgagcaaatgccatacaagtagaaatctattattagtgggtgttcttctttcaagtcaacttttcccaattatattattcttgtcaaaaatacgttcaatagttgaggaatttggagattacctttcctacctgcattgatttgcaaactttgtgatgatttctgccttggaaaggtgttatttataggctcacttataaaaagacaattagaagtgtgaaaaataagtgagaaactttgactaccagacttctatcttaacgatgctatatttcctttcaaaaatccacaaagcaaacccatgagaggatgaggctgcagtgtttcctttactgattagttgaggggttatagacttctctccatcacaataaatgtgcacagatgataacacacatactgatattagaaggaaaaatgagagatgagtcaaatttaaaaaaatatataaaaaataattgggacttcttttctacaaataactcattttgttcacattttttcatataaatgaaatatgtgttggtcatgttcaaaataagcaatgctcaatttttaaaaatggggttacagaaataaagataattaacagcaaaaaataacaaacaaacaaacaaacaaaaaaaaagagaaaagaaaaaggtggagatatgtcccagaactctcacacaaagattgtttatgtttggtggcagtattagggaagtcaatatttgctttgttgtaaatttaagttaatagaagtattgaaaagcaaacatgaaaaatccataaaatcattatggctctgagaagagtatctatatattagatacttaccacctggacctaatttgtatatatttttttcatttttattataatatttcaaagatcaattataaaatatgtagacacacataaggattcattgaaggtgttacttaaagtgagcctggattgccgtgacaatagcatccaactacacttagtgtattagaataaatgagtaatgtcaaaaaataaataagcaacgtggacttttcaagtaagtgtaatttgaatgcctaaaatatagatctgttgctgatgtatgtgtgtgtttgtgtttgagagctagtgtgctcagatttaaacaaaaatattgttgctacagatagtaggaatattatttaacttgaaaactgatagtaagtggttatgcatttttataagttgttgagatggaagaaaaagacaagttcattgctgcgtacttgtacaggtgactgtccattattctaggtaaaaggccattttatttatttataaattgttatttccttaaccacttttccatgaaacctaaagataatcctctttattcagtattgagaaaaccacgttaataatgttttctctgttttgtaacattgtgtaaaactatcatatttctttggtctttaatacacagtaaaattatttaaagtaaacaaaacaacaaaaggcaacaactcaagagggacttactacttgtatcagtattctttgttagtataaatgcagtgattcatgatgagttttactgggatttgaaattttacaggagtcatcaagactgcccttccaaacatggatagagaggctaaagaccagtatttgcttgttattcaggcaaaggatatggttggtcaaaatggaggactgtcaggaactacatcagtcactgtgaccctaactgatgtcaacgataatccacctcgctttcctcgaagtaagttgttttcttaagtgacacaagtgcaataactttccctgaaagtctataaaatacatctttaaaatgactttttttcaaatacttctaaagcaaataattgtcttacttcattctctcaaatttgcattttattagagacataattttgattcaggaatatggattataagggtattgagaagaaatagaagccatcatatatttgcattacttctatcttaaatatagtaagatttttctttcattcacattttgaatactagacaattattaattgtgtttatgtattagtcttttttctaagaattactttttatattttgtaaattataaagttgttgccaattaataatattcaaatacattttattcattctatgcactaaaatattgatttatttttgaaaattaaaaaagagtaataaatgttttcattttatcatttcacactttttaaagccagtttatacacactgaacattcctttagcagttcccccacgtctttcttgtgcaaacattcagtgttttaaaaaccaatctaaagaactagaaaaccaaatgccctcagttccacttatttgaccaaaggggcttttaacttaaccaagaaaaaagaaaaaaaaaattctctaggtagaggtgtgctgtttgtaaaaaacgtttcatctcactctctttttagttccctttttttccctaagtgtatgtgttatttctttagaacactcaagaaaataaagagattgtacagaccataatgtctgtacaatgtctctaaaatgcttttccagtagaaatggggaactaaactccctaccaacagaatttagaagtgaatcatatcaaaaaacgaacatttctgagcaaatacaagtgtcactgttttttccttcaatgactgcttctttaaaattttcctctttatcttacatatttttaatatttatgttattatacaagaaatggtatctcctggtaatataaaaaagtgaccccaggtttagcattattttctttcaataagcctattcttaattgtgatcttgatggcttatcatggagaaggagggacttttagaattaaaaaatgtaataatgcaattatcttgggcttataatgaaatgaactgctttccttttgtttaagcctagattgataaaattatgtagaattttagtaggatacaggttttctaggccattatagatcccttcaaacttattaaagtgaaaaaagccagggatataccattgttattcatttttgctgggatttttctctaccgttgaatcactagtttaaccctgacattttggaattttatgaaggacactttgagatatgtgaaaggggtcactcaaaagtaatagcatatgttataatcatttaaaaaacaaacagtaactattcacaaagtctagaaaattgcgaacaagtctcagtctaatacatctttccataatacagacacattttcctttctatattcttctcagagagaatcctttcttatcccttcacaagacaggacaaatgcaccacaatttaacaaccaaaggaaacagaagtagatgcaggaggcaggaaaaagtaaataattagagaaaaaataatgaaggaatatagcgtgctgcggtgtttcgtcatttctgagtgatgtagttcatgtatttcttcatctgcccccaaactttttctttagtttgagggatggtgaagaggagttattacaaaagttaaaccaaaaattttagaagttatttttttctctttcactttttttttttttcagttcaactaatattgtctaggctcccagaccattgtggcccaaatcagttctacatacaacccacacaaatcattcttatcctttcttatccagttttcttacccagttttctgaaactctctcggtaaaaatgctaagtaaattccaacattaagttatgaaaatgatttaggcttgtatttgcccatttcaaggccaatctattctatttttatttcttagtattttacacattattgtaattatgatattgaattacatttactaattgtatatcaattataattactttaaatttatttttatttttcagtgtaggatatttctcactgccagaaatacaggaattagagattcttctcttgcttttcctcatcatctatttctgctatcacagtgattattaactaatcattcccatcatacctcttaaggctctatgaaactcatcttttgttttccattaccttagcatatattttattaaaaaataaaaagaagttgtgctacaatgatgccaaaataacccaatatttaaatttttattggttagtttggtgtaacgtgttcatttcttgctttgaatttcacagggtcttatcaatataacgtcccagagtcattacctgtagcctcagttgtggccagaattaaagctgctgatgcagatattggagctaatgctgaaatggagtacaagattgtggatggtgatggtttgggcatttttaagatttctgttgacaaagaaacccaggaaggaatcattactatacagaaggtaatgttttctttatttatcttttatcacagattactgagaagtcctttctgtttgatgggagaatgtactagacaaaccgaatggccatatgggaccattactattttaattttagtaagataagctatgcatttaatttttggtgtcagactcttagggaaccttgagttacatttgtaataacacccatcaattctattctttaagaaactcgcagccattatctatagcactataaaaataaagcaaactggcaatgtgctgttttaaagacctatttggagagatgaatatgtttctgccttgactattccactaatgaaaccctaaattcaaccaaaagcctgtgtatgcaaacaacagatgctattattttctccataaatgaaaataatatgatttcaagtggaaaccaaaatgttgaaaacttgctacattaccaattattgccatttaaaatttatagtaattggaagacttgcatatttcgtacaagaaaagcatgaaaagttgtaaaacctatcatactttctacagagcgagtgtgaaagagacagaaagtcagtacagcccaaactaaagattattttccataatatatttaaattagctctcaacacagttatgggagaaaatggactctttactctcttttcaatttagagatatgactttttacagatatttaatcaaaaataataactcaaaagctattatttcaaaacatagtcttagtttatcaactatttgaaacattaaaaatatatcaatatcttgacccctaagatatgaaattttttgtcagtatgaaaatccagtgtataactttgtaattaatacttttcaataattagcacatatcaataaaaaaagtgatattttatttgttataggaaaacatatgtttgatttcaggccaatgagaaaaacatttctgcaattatttccagtggacagctgctgttttagctaagctggtgacaatctgtgtataaaagttttaataactagagtaggccaactgttggtaaaatgttttgttttgttgcctaaattaaaaggaattcagtaaggtacaatgctgctcaaagatttcaaagagtcatctgaaatcaatctgttcacattcaagaatttttaatgcaaattgaaagtttttattgaacaaatacctatattttatatattataatgaagacagcatgaatctttgaaaattctaaatttaatataaaatatttgatttagtaagggaaaagtaaaacttgttttctaattttataatatcatttctggaaattttagaacattgctagaaaaagagacaaaaaaacctagattaaaaattatgtcatctaagagcataaaactcattaaaaaattgcaaggagaaatttgattctaacttataacaatagaaaaacatcacaaataatcattattattcttataggtatcaatatctgtcagacttttctttttgagtaacttaaaggctttattttattttctcaacaatctcatgaagctattattaggaccctgaaaatatagaaacattataaaatattgaacaatggaagaaatggtaaataatttatattatcatattaaggaattttcatccatcattgtagtaatgtggtgatgttgtttttgcaaatgaatatggaaaatttttattcaaaaattattaaaaggcagtatccaaacttttacagtctttcacattttatgaaaattgtatttatacagaataacagattataagaaaaatgttaaaatgttaatagtatcatttctaaatcttaccttcactgctttttcaataatatgtaacattcagtagttattgttataattgaaatgttgttaaatatataaaagagttattcaaaggccaaatggaaataaatatcattaaaaaaatctcattaaaaacactgtataatctactttgactgttattagagatcaaaattattttacaaatgcagaaataagtcacagagatggttttcagtgggttcaaatttcgtgtattgttgaagttcttaagtttgtgtattgttgaaggtattaaaaaatgtaatattctatttaataaattatgatttaaaatgattccaaatttttaaacatttagattaatagaatttttggttttgatacagagattccttacttctgcccagaaatctgaatgatgctttgaatctaataaaaatcaatcattagttattattaaatatttattcatcaatcattatatgagaagttagctaaatattttaacaattttttcactgaatatgaggtcaaaactccattatttttagttgagattgttagcaactaaaattaaattttattttcctaaatgacttctaatacataaatacttgtctaattctttgttttgttatataacatcaaagattatttaggaaaaattaagcacacacaatgtacaggagaatcttaagaatcaatggtggtgaaaaatttcataatattacttctgtgtcataagtagccaaggtaaattttaatatgtaacgaaagaattcttgttcatcctgaattactatggagaaccaaacagactatctagctatcaaaggtcaaaaaaataacatttaggttaaatccagggattttaaatacaccagtagacagttcagatgttgaatgctaacatgattttccatatcattttgagcctaaacacactgtttatatgaacaataatttagactaagaagttagtcatagtttattactcttaaaggggattgcgcaaacttgctttcagttttctaatgtgcaaagtagatctgatttttaaattttatcttaatgtggagaatatatataccatattgaggcaaaaccattagattctaaaagtaaaatgatgtatagcaacagatggcatgaacctaagcagtatggtctgcaatttttatgttcattaattcatcatgataggatgcatgggtgttaagacgagatatctgaaattttgctgtttgaaatagttaaagatgtttaaaaaatacctatggtgcttttatacagtgcagataatatcaacatggaaataaatgaaaacaaaatctcagttttcctcatgctaaaaatctttaggcttagcaaacattacttttttctttcttcctaccctcctccttctccacgtagttctgagtagatactagatagtgggaaaattaactagtatacaggagcttaatttttatttccaaagctccctccacctccaaactaatttttaaaaattttacaaatttttattatctgttaatatgttccagtgtccagacaatcctactttctcatccgtattggaataaacaaacataaacaaataatttatgtaagagttgactaaaaatagtggaaatgatacatttgcgttttactgcagtttaagcttactaattacgaaggttttcttttcacttgcaaaaattgcttatagtgttacacagttgatccttaaaaaccatgagttttaactgagtgagtccacttatatatggattattttctataaatatattactctttttggaaatttgtgacaatctgaaaatactcacagatgacttatgtagcctagagatcttgaacattttgagaaaaaattggtatgtattaaatgcctaaaatatatgaagatattagactgtttatgtgttaatagaataattgtgttatcagtaaggcttctggtcaacagtaggatattagtagttaagttttgagcgatccaaagttatacacagatttttggctgtgtcggtggtggttctcctaacccctatgtttttcaggggtcagttgtatattcatctcgtttttagatgaaaatttaccattaattcataattttcttattctcagcaattattttattaattcattgaaatatgtaattcacagtttatgtgtagcttctatgcctcttaccctgtacttggttccagaataatccagggtttgtcctgttatcctcaaacattgttcatattctaactctttctatgaacttcaaagaactattggatgcctagaattgagatctcttaaatttgctttcagttttctaatgtgcaaaatagatctgatttttaagttttatcttaatgtggagaatatatttaccattctgagacagaaccattagattctaaaagtgaaataatgtatagcaacagaaggcataaacctaagcagtatggtctgtcatttttgttttgttttgtttttgtttttgttttgttttgttttgagatggggtctcgctttgtcgcccaggctggagtgcagtggtgtcatctgggctcactgcaagctccgcctcccgggttcacgccattctcctgcctcatcctcctgagcagctgggaccacaggcgcccgccactactcctggctaatttttgtatttttagtagagacggggtttcaccgtgttagccaggatggtctcgatctcctgaacttgtgatccgcccgcctggtctgtaaaatttttatgatcattaactcatcaggataggatacatgtgtattaagatgagatatctgaaacgttgctgtttgaaataggtaaaattaaaaaaaaaaaaaaaaacttgtggtgcttcagactcatatttgccagatatgtatttcactgttcctcagtttcactcaacaatctagagcagtcactaaactacttgtaattcctggagagcaacgtaaagttttttccagttcttcaaacctccccctgcctgttgactcccctgcactctgctttcgtgcccccttaccatactcatcttttgagtctaaaaaatccctcctatttttcctttaaacaataaacagaagaagcacagcgcctgtaccagcaagatgcattttttttcaaggaagggagtgtgtgtgtgtgtgtgtgtgtgtgtgtgtgtgtgtgtgtgtattcaatcatgggaactggtctaatcatggaatgtagatgtcccagttccataaatattctgatttttttcatagacttagctgtggccacaaggattgaataaatatccaaggctctgtagaagtgtccaggagagctcaggccccatctgtcagccaactggtcagtcctaccagggctttcaaagatttgaacatgccctggggaagaagttgaatagtggattcataacaatgtttttctcaggtagacaagagaaagtggcacagaggtaatcacctgtgcagagacttcacttatgagataacctgctaaatacagaaagaaccggggcaatttctttggaggataatgaggaagggaatgtgggcaacagatgaggtaatgtaaatgagagggctcttaatgctccttcacaaaactgctgttggtaaataggaatatatatgtacagtgctttgcaaatagagtggattacacataatacatattgtaagacattttaagtgcagctcaataaaatatgagtagaaaattaaaatatttgcttatttctcttgaacacttattcatggaagtgcctgtgataactttaattcatttcaagtctttcacttcttttcaaaggactgtattacaatgaatatcaatatttattcaaattgttattactttcctggttataaatacatttccttcctcccttccttcctttcttcctcccttccttccttctttccttcctctctctctcccttccttccctctctccttcccttccccccttccctttccttcccttcccttcgcttcccttcccttccttctttcctgtctttctctctctctcttcctttcctttcctttcttttccttctctttctttctttttcttctttctctctctctctttctttctttctttcttcctctttcttttctgtctctcttttcttattctttcttagccttgaggtcattttaagtttttttccttgcctcttcctgtcatgatagctcttggctgtttattttccctttgacattatcctaagcttagtgatcgttgcttcacctctaagttatttttatgtcccccacacctagctcatagcctgcgtctagcttcttcatttttaaatacatctttttaaaaaattgctgtttaaaactcaaaactatatatttttattattccagctagtcttaaaagaatctaccttacactcagggaataagacagaataataccagcaattcaaaggaagcagtgaaataattatgatagaatgatgatattatatacttagaaattataaaataatttattacaattttgtcaaattaatgagaactttcattaatgagagctacaaaacaagttaaaaatcaatactttccctatatgtacttcatgagaacattggtgtgagtttctgggcttaatctaaccatggaagagcaacctgtgagtacctatgtaaggaatatccatcactctcattcacatccctgaaaccttccatcttaaaagaacgcgatctgctggcccaacaaaggcaggctttaccgccaaatccaagtgtctttccatcatgaggtcaaaagtatctctatactcaatttcagaagaaaatatttgcttaccattttgtaactagagtttatttggagttgttttcccagaatcaaggaagtcttgttcttaagatttcctcagtctgaactaacagtttactgtttgtggccctaacaaaacaggattttgattttcagttctacttaccaagatttcaataaacatggaggctacattataccctagacaaaacttttccagggagctttcacagcaacaggaatctgcagaacaataaatgagtcccctaatttccatattctttccctaccagaaagtagtggcattgtctgtgaaatttagaatggatttttgaatccgagttggaagactaaaagccagaaattctgaagaaaaaaaaaaaaagataaatttggcctccttttattaccccagagtatttttaaaattataccgagataaacaatggaatgctatggacagtccaccaaaacgaacagttttttggttggtctcccagtcccttctccgcataagaaaacatttacaaccagacattgctcagatgttgacaagatttttgttaaagtcataaatgtatttgttctggtggttctgaatgtctacatattacttcacatttggacaataaagctttaatgtccatctggatagagtcatttctattgtaattagattattttctacctgtggactgtgcttgataatcatctgaatttattttctctctatactataataaaactttggtccatatccttttcataaataatgtactattatatgtataataagatgtattccagtttgtgaaaattatcattgtattttgctacatttgaatgtattatacttggcatagaattcttttagaatcaggaagagaaaagcagaaaaaaatcctttttaaaatatatatttgaaaaaagaataaatagagaaaatgaaaaaatgctgttggttattctattactgttccaatatcttatacagaaaatgtttattaatatgacaaaatatgcagaatccacaaggctaaagattgctgtaaataatggcatagagtttttatgatttaatcactcttatactttaagaataaacctgattatatagtttaaatataaaaatgatgatgaaattttcatcttaaacagttaaagcaatgcaaatgctattccttgaccatttatgaatgtttctatgataacctttataaccagttaaataggatttcaaactttacaaagagtaaacataaagattatcacatttgagtgaatatagtttttgtttcacctagaattctttctttttacatttgctatcataacttaaaattaggtactttagtcttttttaatttttttctttaatatatggaagtctttcctctaatgtacctcagttttcaatataagtcttcagttgtgattaaatatggaatttttttctataaaatgcattactatggagttactatagagtaaaaaaaatgagcattttcaaaattaattccctatgaaagataactatgcatccggtatctgacatgtgatttatttggtggtccactttgtcacactatgaagacatttaggcttttaaaggctaattttgctgtgctagattcaaaatatgctcatatccataccctatgaaaggctgaatgaagtcaaaataatacagcattatgtggaggtgttaataatgctgtctacctgccattcactgccctaagttagatagcacagtggccttccagccttcaactcaagctgcacagatgtggactacctggggtttactgtcttgtactgaaatgtgtcttttgcctattacttgtaatattgaggtctaatttctacaatcaaatatgtatttcatttagtatttcataaatgttgctgatatgtggtgagagagaatcaaaccaaggttaatgccaatttatttttcttcctctcattaatttttttctttcaaacattttattcaattaatcctgctgctcaggatgcatatttcttaaaattgagcaatgacattgctctcatttgactgtgaaaaggcataaattttggattattttagttttaagggccgagataatttggtgagcttctgaacttcagattatattttccacttaattcaatcattgttactatgtatataagtatatactagcatactttaatcattatgtgtatgtgtttgtgtatataggcttattatctgcttattaaggtataaatttacctgtgcttgagtagtcaagagtagagatgaacatagagttttataaaaagataagaaattaacattctttgaagaaaatgatactaatttacatgtcgacatgtttgacctgatcaaaaggcactgactttgttcacttaggattatttcagcttttgttgattttgttcacttaagagtatttcagcttctgtttgattttttaaaattttgatagtgattatagcagtattctcagaatatgtgtatatcaaagatgttttccagtgagtccattatggaatttattttgctgagtacaagtcacagatcatgtaaaattgtccttcctttcccccctgccctcccatggcgtgttgattcctaggtcaatttcggtgggtaggattccaagaaagagatatttaagaaatagataggagagaatttaataattgtataaggaaggttaaaaggagaatttaaagacatagccagtatttctagtttgtgtaactagctgaatacttgcattgttctttgagaatggaatggagatgtgtaggatggcttggaacaagtgatgtttggtgcactgtaatagcaaggtaaatatgtctaagaagtcatgaatataggtctgtagttcaaggaaaagctctatagtacattcttatgtctaggagttatatgcacatgcatggcaatcaaagagaccattgataaaatccatggagggcacaaatgaaatgatgaaaagaaggctttagacatttcttggtgaaactgaacaatttaagttagcatggcaaagaaagactcagagaaggcaaactgtttttttcttccagaattaagatattttaagaggggttaaaaataacttatcaaaaagactaacaaacaaagttttatatttagatgaatagaagaaattgcatatgttatcaatagaagagagaattgatggatcgtgacatctatgataagtagtaatgatgggacataacagataaggcaaagattagaatagtcaaggaactggagctcttgctgagttcaaagaaattcccatgtcgagatctgacttcttcccgactgtttaatttggccatttcaagtttattttggttcattttatctggatatgctgccatcacctgacaaaaactggtcaccaactctcattctctttctatctgtggttgtatcaactaccttatttcttaataaatcatccccaaacctggtgctttaatttccttagctcatgattttgtgggtcagtaatttggcctgggctcagtaggatatttttatgctggtcttaagtgggctcacacatgcatcagctattggtcagcatggtggctctgcctctatggaggtggctggctgtctgcctggaaaacaaggggcctggacctctgcctcccatcatcccatgggctacctgggctggttccaagaatggtaagaacagaggttgtatggtcttttgaggctgtttgacagaattgacatgtcatcatttctgccacattgtattgacccaagcaagacacaggacaacctagattcaggtagtgaagggaaaaaagcatccctgagaagaaagaagcaataaagtattgtggacacagggaaagtgggaaaaatatgttgagttccagcgctgctccagagagactaactaaccttcaggttatacttcatgaaatggccaaggaaatactgaatctcagttctgcccacttccctcatcatcctttctcctctattagcctatctcataaaatcattttattgatcaaggtcagttaagatttgccactgtttgatgaagcgttccaggaaaacatatgctaagttgtcttcaggtcataatgtggattctgcttcccagacaatgtatgaaaccctctagaagttattgggtacagctatagtgcatgctggaaaatgttgacctcagcgtagtaagggaattggcctgagctgtaaggtaaaccaggttttagatgctgggcagaaatgcagtcctttccaaggcttgttttctactttatgcttataaaatcaaaacagactacctaagttcagagtaggaggctgtggtagacacaataatgcctcctcctcaaaaagatattcacagaatatgtgaacgttttaccttatgtggtaaagtgaattttggaaacgtgattaagttacggagcttaatgggaacattatcctggatcacataattgggtgcagtataatcacaaggctccttaaagaggaaagaaggatgagtcagtgttataaaaaagagatacagtaacggaacccaagcttggagtgatgcactttgaagatggaggaggaggctatgagccaagaatacatgcagcttttggacactggaacaattcttccccgaagcctccagaaagaatgaagctctgccaacaccttgattttagacttctgacctccaaaactataaagcaacaaatttcttttttaagccactaagattttggtaatttgttactgtagcagtatgaaattaattaatgcagaagtcaaaatggaacatttctatgggggcgaaagctgatccagacaggagaacagaagagagaaaggaagacactcgttaactaagtatgaataagaatctggataggcagagcctattttaaactgtgctaagtttaaaataatacgtgatggctgtggttactttgatgataatattcctcaatattaacttgtgttactagatgatgaaaataatatctcctgatatgtatatcattattgtattcctgatcatatctttgtataatttatggttttagactgcaatcatttctgcaattattcattgtattttgtttcaacctacctttggagcactggcactttctatctactggtaataatccatttgcaagctgcaaatgtttgttcatgttctgtcctaatatctgtgttcaagtataattaaaataataataataataataatgactgtcataaaagtataaaatggacctggagacaaccagtaatctcttttgcttattctaaatttgcttacacttattttactgtttttcaggtaatttgtttagccttagatattttttctttgtaaatcagtaaatctctattttattcaaaaataatcatatctattgtagatttgtaagattaataaagttaggatctttttataagaatctcaagtctagtacagttagaaagataagaaagtatcagtctggctgcagagaatacacagagctggcaagacctccagagctcttctccccccataacccatagacctctatgaatgcatcaacagtgtgcacctaggtagaacatagtatttattgtttatatattatctttctctcaccttcttctgtagaaaatataatttcttgctaaaattcatgagtcacaaaaatttcaaaatagagccctcatctacctactaagatcacttgctgctgtgaaagcaaaaattgcacaggacagtttaacaggtaaggaagattttattcaaggctgttgcaataggagagagaaacgagactcagtccaaactcaccttggctaaagcaaagggctgcagagtttttatgagctaggatggagggtggggatcataggccagttgtgtttgatgattggctttaaccaataggaaagtaaatgttcttgtatcatcatgacaggggatagttttacaacctggaaaaaggctcctgctgaagttaggctcttatccttctacagaaactgggaggtattggttctgtcttccttgatggtaaaatttcatagagatggctttggggcccttgaggaagacattccttggtaataaaagtgtcaagaggatttttaaaagatttacatattaaaagggcagaaaaaagatttacaatgacgaattttctaaagagaggtcaggggcctaaaattagaaagaaacctgtttaaatttactcaagctaaaagaaacataaggtcttcttggtcataacccagggaaataagaaaatagaaacgacagaatgcagttgttcataataaaggggatgtattttgctttggaaagttcttggggagtcattatatttaaatgtacagaattattcctgcttttaaacctcatccaaggttgtagatcaggtttaaggttctgggtagtatgtttatttagagatttagagtaatttttttttttttttttttgagacgatgtcttgctctgtcgcccgggctggagtgcagtggtacaatctcggctcactgcaacctctgcctgctgcgttcaagcaattctcctgcctcagcctctccagtagctgggattacaggcacgtgccaccatggcaggctaacttttgtatttttagtagagatgggatttcaccatgttgaccaggctggtcttgaactcctgacatgatctgcccgctttggcctcccaaagtgctggaattacaggcataagccaccatgcccgacctaacataaaattattgtaagggaaaagttataaatgagggttattttcccataggtatggtctcactcaagcccatttacttaggaaaaaagatttacatttatttgttcaagaagtagggaaaagctacagatattgaaagctacaaaatatactttcatttgaaaaacagctagaatctccagagaaagaaatactcttaatgaagacagtcatagaacttttgaacaaaatcaaaattaaacgtaagacattaagtatatagacatgcacatatacacatacactatccagccctgatagtgtcatgctaccattaaagagaacagaatggagaaatttagaagaatttaacttggatcaattcctgaaacattaacaacattgttggctaaaggtgcgagatatataaggaggtcattgaacttaacgagtatgtatttggctataaaccagaagcaaagctatattaatgaagaaaaatgaagtgcaatgattttattaaatgaattcagtaattaacttgttttaatattgaaaaggctacaaatggcaagggaaattttgagactccactattcgtgatagtcatattttttaatccaacaacagaatttgccaaagacaacaacctaggtgccagagcagaacaaagatgagaaacacgtactctttactttccatttgcttataatctagcaggaaataatgcttctaataacagcataatagtaatacagcaagtatttatacagtgattattttgtgtcagtcactgttctaggtgctatttatttctcaataatttacaaaaacctcatgaggttgatgaggtcagcaagggcttatacgtgataacatcatacagttgatggatatatatgaccatgagttcatgtagtatctgtgctctttaaacatgggctttttggacttttactagaactctttgctatttagttttcacatgtattaataatattgtcttagtccgtttgggctactataacagaaatatatgctggatgtttaaacagccaatatttatttctcacagctgtggaggctgagaagtccaaagtcaagatttggcatctgacgagggccctctttctggttcatacacagccatatcctgtgtcctctcatggcagaaggggtgagggagctctctgaggtctcatttataagggcccactaataccactcatgagggatccacactcaaaagctaattaaatcccacaggtcccacctcctaatggcatcaccttgggggttaggatttgaacatatgaatttttgtggtggttggggggcggacacaaatataaaatgcaaaagaaacactaatcttacattttttaaaatgcatgttaaagatatgtgtgtacaactctttgtagttagctcttaatgtaaaaaagttttattacatgggtaaggcgtttatggaaatgcttattaagaaggtgatagtctctagaagatttctctgagaggaatgataaagttgtgtgagaaagaaatgcaatttttgaatcatctgagaaagaaggagcagcaggtgatatatactagaagagaaaaagtgtgctggatgctgatcactgaaggccatgaatgttagccttaccatattgggctccttagatcagagattggcaaacaactgcctgcctgttttagcctggcccttgaggtaaagatggttttacatttttaaatgattggaaaaactcaaaacaagaaaaatgtgttatgatacatgaaaaccatacagaatttaaaatctgagttacctatcaaaaattattatttgcaaacaatcatatttattcattttcatgtggcagagaatgtactccctgccaagtctagtagtcactaatatttatacttcacaaaaatgtttgcagacccttgccttacacagaattctttttatttaatcctaatttaattatccttgatgacaataaatttaaagactatttttgtactttggaaactaatacaccaaaaaagctgcttctctcttttagtgtctctaacacagatgtcacttgatgtatgaaaaagtatctgctagtctgtatgtcccctatttgattccagacttgaagtggtgaagccacagagtcattctgggaaccctagagatgctaaaagagaagcagcgctttttttttttaaccctggttaaatttccaattatgtaagtatgcacttatatgtatgatatgtttggctgtgtccccacccaaatctcatcttgaattgtagctcccatgatttccatgtgttgtgggaaggaaccagtgggagataattgaatcatggaggtggttcccccccatactgctcttgtggtagtgaatatgtctcatgagatctgatggttttataagggggagtttcactgcacaagctcttctcttgtctgccaccacgtgagatgtgcctttcaccttctgtcatggttgtgagacctccccagccacgtggaactgtgagtccattaaacctctttcttttgtaaattgcccaatcttgggtatgtctttatcagcagtgagaaaacgaactagtacaatgtacttccaaacatcgagataatttatttagaaattacttttatttttttctatttccttatttggtgtcttttcttaattgttatttttcaagtataatcttaataattaattctaatagttatggactatattacatatctagaaatcaacaatgagaagtcatataaaaagtaaattttactgtaaaaatttaatttttttattcaaatgcttaacagtcttatcacatctttgaaaactagatcctggcatattttgatatactctgaaaataattttgtgaagcaattccttttgtctgtaatcttgattcatagactttcatatgaattcttttattgctttattttcataatagcttttaggcaaccaatcatcatgcataatagtgtgttttttcatgactttttagcatccagatgtctatacctcatgttgctccttttagatacatttaaaaaaacaagttgctgtaaaaaattgcattcatttctgcagtacattttaaattattctttcataagggagacaaacttttacttgaatacagaaatacttggtatgccttttgctaatgtgaaaacctgaataaataacttaaaggttgtggttttgcattgatttgaaaggagctgacaaatcggatttctaagtatattcttttacatatagacacatcatatttgaaaataagatttctcttatagttagtaatttttataaagaatataagaacaaactgaggttattatctaaactgcgagtatgttttggtttctcagtagatgcttttaggtaaatgagaatgcttcaagtgtccccaacataaaggttggaatttatagataggcccaagaaaattttatgagtaggtcaggtttcttaagagaggatttgcttcagaatcacttgacgagccttctaaaaatatatctgcctgtacctcgtcctgcacctgctgaatcagaatccattggaaggggccacacatattttagaagggtctctggtgggttctcattctcacctttttttgaccaccgttggacaagaccgactcttagataataaacaaacaaaaaatgttagcctcataaaaatattactgagtttgttaatacaatgttgtcatggcagtattttctatgtgtcccaacatttttatgtaaaacctgagataaaaattaaaacttttttgttctgcagcaattctagaaagtgtttctgtgctcaagaaaaacaatatacttgactgttatttcttcccttatctctcattttaaccagcaggattctttgggtcagatgtatagttcaattttcagcctcttgtacactgaatatctgtgttctaatttttttgttgttgtgttgattcaagaaaaggaggctcaagaatttattgagactcccctatgtataaaaagcattttaggtactgggaataatagtgatgaacaaaatgatcagggcttcaaatctagtggctaagagagatattaaataagcattttagtaagtcctgtctggtctagatattgtaagcctattttgtatattgatttatatatatatatgtgtatattttccttttgcttactcggagataagctgtgggatctctttaatatttgtgtgcaaacatatatatacacatatgtaatgtgtatacatatatttatatatataatgtgtatatgtgtgtatatatgtgttatattttatgtagcaaagtgaatatgcactgtacacagtatgggatatattatatacagtatagtatgtgtatatacatcctattgtatacttatataactattgttttatttattttggttattacctcctttgtgggataagtcggaataaatgcgtgcctgcatacatatacacacgtatgcccaaacatacagtgaatgaatctgaattacaattcttagtattacatattagctcacatttcataatgccttattcttatatactgacaactaagtgaagtatgtattatatttttcagtattcctgtaaagttttttttttcactgtttttaattctttttgttttacatcattaaatgtaaaaagaatttggggacagttttgcaagtggtaagactgaaattgaaagtcataaaaagctgttactttctgtatccattgaagaaaaagaagcatgttattgtcacaaacaacgtctacatgttgtgtatatgatttttatttttcaaagatggtgctctgctactgcaactagtttaattgtccttacaacctttttcagctctcatgcggtttgagttggtcactaatttttgggaaaattgtagcatgtaaatcctcttggaaaattagatacaatgtaaagattctgagatataactgttaacctcctaaaatagagatctagtatattttgatggaggaatagtgaaggcagacatgatgggtgcttcatggagaagaactggccatgtttgcagattgaacaacctcaggatggcacacttgcccctgcagccacactttgagtgccctgaaagctcagaatcctaattaagtcccccaaatcactgaccttttaaatgagaaattcaatagaaagtaatgcttttcttaatttttaaagtgcaccctgggtagtacagttaagttacatggttgaagaatattacattgacagtccctgttggaaaaaaaataaatttgaccagtttttctttcaaatcgtattccaaagactggcatctgtctgtctgtgcagcatatagcagcagagtggatgaagttgattcaaaagcactaaccattgtttgtgagccaggaaagcaacaagaaatctgattggcattgttatttattatttttggatgctgatggtgcatttacatgacagagtccttcctaagcttattgacattcataaatgaaaaggctctgctttgctgactgtttaaccggtaatttaattttcctaacgactttctttacaggagctggattttgaagccaaaacaagttacacgctacggatagaagctgcaaataaagatgccgaccctcgctttctgagcttgggtccgttcagtgacacgacaactgtgaagataattgtggaagatgtagatgagccccctgtgttctcttcacccttgtaccctatggaggtgtcggaagctacccaggttgggaatatcattggcactgtagcagctcatgacccagattcttccaatagccctgtgaggtaaaaactcattgttgtccttttctatggttttacaaacaatgcattcttgttcacaactcttattttacgctctgatgttcctttgttcataacaaataaaaaccagatatatatatatatcgagttataacagcagaggtaaaacagcattagaaacatacattttactaactcaaaaatatcatctgattatcaaggccattatcgttgagccatatttttaggcctccattactatccacaagccatagctgatgtttctattcaaccaattatcctgaatctcttttaaagcaaaacatgttcaaaaatgaagcaatgcatgtttaagttgtaggatacatgcatatgttagaaaaataattgtatcaacaattcaaattagggactaatttctaaacaaatcattttattgatattggtctacttgaacagtatatatttgttcagtttaatatttccacttaatttttttaaaaaaactagctacatataaagactattaaaaatatcttttcagtagtcttgtatctaggctagatattgttatagccaagtaatatctttaagactgacacaatggtgatatgtaagcatttcaaaatatgtcaacattacattttgcactttttagcaaatttatagtatgagatctacatgtttttgtgtgtatgcatgtgtttatgtgtttgtgtgagacttatttttttgaggtaacattataaatagaatatacttgaaataaaatggctgttgtattatatgtcttatttgggtttgtaagtaaaatacttcacttttcaacataaaggtttgattttgattacaaagactataacgtaaaaataaataaaacaacaatgattgttttatgttcagatatgttcaattagaaactatccacagacttttagatttaaataatatttaacaatggtaagtgcttttgaactaacttttgagataagtctggacgttggctctaaattgtcatgaaaattacttaatatttattgattttaaaaagccgataatgttgtttctttctaaagtaataaagtgattatgtacatttatacacatacacacatattttaaagtagtatatatacatacatatatgtatatgtgtatatatatgtatatatatacatacacacatatatatagaactagtaaaggattggtatagaaaaatagttatttaaaaagtgaaatcatatgtattatgtgcttatctaggcagcaaattcagaatgtattgatgattatactgtttttaatgtggtgataatagaccatttccgagagtataatctgtgcacaagaatatttatgaatcacaaatatagcagatagaataagccttcccctcttctctgtaattgccctgccttcatggtcaagaaaactttctgactgcagttcagccccacataccaagttatattaattggggcaaacatgagtttgagttttgttatagcattccatctcttagtgaaaccttaaatctcttgccctcatgaacaatcaaccacagtacaattactggcatagattagctacttaggacaatttggtttctgcttgaatcatttaatttaatggaaagaaagagagacatgctttcataaagttggagatatggagagtgaccgaaagacattactatatatcataatttactactaaaatgaatgatggagccaggtggggtgacaaatgcctgtagttctagcaacttgggaggctgaaacaggaggatcacttgagaccaggagttctagactgcagtgagctacaattgcacttgtaaataaccactgcactccagcctagacaacatagtgagacccctgtctctaaaataaataagtgaataagtaaaatgaaaggatttaagaatattttcattgattgcattgatatttttatcctgtttaaattattctattacccactcccttgttgtcattctgttgaagcctttcatagaaaatatttcactttttataatattttcattggaaaaaagtcaatattattatataataattttaggaagaagaaggaatagttggcccaaatgggaggtgacttgagaaagagcaagtagtgactagagagagatgaagtgagctccacttctgttctctgaagcacagaggtcaaaggcagaacttctgattttggaagtaaaaatctctgtggtctttatcagtgaaagagtacctacccagcaccatattttttaccccactttcatttccttaaaagtaatgacggtgacctgaaagttcaggtttctattagcttacatcgttatctcacaaatagagaaatagatagactttgtccccagtgaattaaaattttattttgtatatatgaatatttcttttgcatttgtagaattaatttcttgagtcatgtttaatacttacatacttgaaagtttttacacgattttcataaggtcagcacaattatttatacctttttattctgcatttgtctctcacatacttctcttcctctatccatttatataatatcccttaagaggccagtctccttattttataatttgttgcatatgcattactctcacgcattctctggaagactggttcccttcccagcactgctgtttgtggaatggcctcggagatgtcaccttgtcttctgtgtttttgtattagccagcaaaaaggaaaagtagctgatgctttatcccaagcttttctgatgattgaataagagcgagaaagtaaatgaagcttttaaactgtgaatcatgacttgaatattaccatgtattatcattatgtattgctattattataggttattgtgtttccatgccattttaattctgagattaatgaagtcagtaaaagagacatagcattttatatgcaaccatattgacaatctatattgcaggttgtcttgtactcatactcacgcgtattccaatagatataacatattgtatggctttttgatgaatataagcatgtatttgcattaggcactccagtaactatcaaaatgtaaatcctgtctcatatgtttaacataataaaacatatgttaatggatgaataaatagcagtcttctgaggtactaggaaaagtgaatctccacattgagatgggacatgaggagtcttaacaattgtgacctttgtgctttacacctttagcaatattgtagttctttgaggaatggaaaagcattatttgttttgttgtaattgtttaaaattagaccagtagggtttgacttgtaaaacagtgtggccaatgggatgattagttttgaatttattgacattctctgttgtataatactgaaatctagcatatgtcatttatgtttgtagtattttctgatatatgaggcaataaattagaattctagaaaaatatacatttagttgcccccagcaaggcgaagttgatattgtcttcctacatgatccctgccttgcacagcattttaaaatttctacctactttactgaagtaccacccaaaggctatgcataactcttctctatgaatctgctttttccttagagaaagactggggcacctatatgactattggaacctggtcattcttgacgtttacaagtgtagtcatcatagatggaaagattaaaaaaacccaaaccccagtaactggccagaacataacacgattgtgaatgttaggtcttttttatactttacccaatatccagatagcttatctagaccaccatttcatgtacactgtactgtccttttgtggcagggagtggtatgtggaaataaaaccatacgtaaactaaaattgcagtcaaagccaagggtagaagttagttgacacttgagattacttagagggaaaaaaaacgattttttttttaaagaaaaatgggtaattgagggcaagcacgtttccggcttgttatttgataagtagctgtttatcatatcatgtaaattttggccctaagtactcaatatcgggctttatctattgaacttggaaggacagattgtggtctgctgattctggtcacgtttctgagtgatagaaacttcacttctgtgtttctcatccaagatggtaaaagatgtaagaacagcctagagtctagaggatttgactcatttctcatgtcagcattggcagactgatcaatgactgaacaggcattcattaaaaacctgtgttatgcaagcactggggaaaatgctaatgagaaaacaaagataaataaaacatttcctctgacctcaaggaacttacaatctggatgaagtaataagagctcataaaagttaaacaatatggggaaaaatatgccagcactgtaatatggcaaattgtaagataaataatcagcactccaagttcactggctgtgagatttcatttgaaggagtggtagtgtaagtagggcttcaagagatggcaagatttgggcaagccaagaaaacatcatgcaaagtacatttatgttttatttggttatatcctaaaagcctagtactaaattatgaaatcagcaagttcatttctgtaggcatcacagcaagcccaaagttcctatactaaaaatggccaatgaaatagaacatgatattattacaaataagatcagatatgaagacaggaaaacaaaaagtaatacgcatcattttaagcatttctaataatctaaatatagaaatatgtttatatttatgttaaaggatacttggataatatttacccgtgggctttttcagcattcctagtattgtatatcctcacataaaaagtgataatattatgttggaaattactttatgtgatggattagtgtgaacatatttggggtgtttgaaaaattcagtgtgtattttttaagtagcttgtactcattcatatatgtgcacatatgaaatctaaattatttgtgaatatctattttattctaagaaaattagcaaaccaaccagtaacataacatacagaaaaataatactagcaataaaactgattaacttaaaaagtagcagatattatatctctgagaagactataagctgtactctatttcaaaatgctgctcattttagcataactaccactaaaaatgaaaaaaagaaagtatatgttcatgtatggtgaaaacatagcgtgttttcattagagtagtgtacttactatccagagataatttttgtaggttaaattttgcaggaaatgcctaatttattttagcctttcctttttctttcctttttcttttcttttcttttcttttcttttcttttcttttcttttcttttcttttctttcttttctttccttttcttttcttttgcctggctggagtgcagtggtgtgatctcggttcactgcaatttctgcctcccaagttcaagcaattcttctgcccctgcctcccgagtagctggcattacaggcatccgccaccacacctggctaatttttgtattgttagtagagacagggtctcaccatgttggccaggcttgcctcgaactcctgacctcaggtgatccatctgcctcagcctcccaaagtgctgggattacaggtatgagccaccacccccggcccattttttcatgttttattctattgctctagaattacaaagctctgctgtcagcaaagactttcttagttacctttttggaagactccaggtaaaataaattcactgaaaattacatttgttctgatttgtttcttacagtatttttcatatctaaaatacttattgagggcccagcacggtggctcacgtctgtaatcccagcattttgggaggccgagatgggtggatcattttaggccaggaattcgagaccagcctggcccatgtggtgaagccctgtctttaccaaaaatacaaaaattagccaggtgtggtggtgcatgcctgtaatcccagctactcgggaggctgaggctgaagaatctcttgaacccaggaggtggagggtgcagtgagctgagatcacgccactgcactccagcctcagtgacagagtgagaccctgccacactatatataatatatatatatataaaattaaatacttattgaaaagtcacattaataaaggaatacaaaaattcaatgttcttggtgtaaatcatagagaattattcatggggttaaaaagttagggaatattactttttatcatgtactatcctcttaacattctttaattataatcaacagtaattggccacagttcattttttaaaaaagaagtttattgaaataattgggtatagctcaaagaaagaaaggaaaaaactgaatggccaatcttcagaaaagagaggagtagggttcctctgtaaatacatgtagcgagggtagcaggctcttcagaacgtggcaactgtgatgaatcagctgcaactcttcttgcagctgtctgtttaagattcacattccctgcagaggttttattattattattattattattattcatatcttgatatatgtggccgtctcttctccaaaacattctggacatcttgagtgccatcaagattgcatatgagatttgaaaaagtataaaaccctaaaggaaaattgtgttgacataatcagaagaggggtgaggatacaggcaaggtgtctgctatcattaagctcagaaatcaatagttcatttttattcttttttttttttttttgagacaggtcctcagtctatcgcccaggctggagtgcaatggcacaatcatggctcactgcaacttccgccttctgggctcaggtgatcctcccatttcagcctccccagcaactaggactacaggcagatagcaccacgcccagctaattgtttgtagagatggggctttgccatgttgcctaggctggtctctaagtcctgaactcaagcaatccacccaccttggcctcccaaaatgctgggattacaggcatgagccacagtgcccgggcctcaataatttattttgaagtttacttatcattaaattcctaagagacaagcactattattcctatattagaagtaaatatgtccccagccacacagttagcaaatatggttccaggaatttagtgaggtctatatcaaacctgtacgatccttacagcaatacacacacacacacacaaatgcacatatcgacaaactttatagtagattaaaatttctattcaaattattcatctatttcaattgatgaaattttcccatgtttttgtattacattatcttttgccactttgggagtactgatgatatatttgtgttaatctagctcactcacctgcactttctgtttgtgaacactgatatgtaaattaatagctggtgataagaatgctacctgtgaatataaagaagaacattttaattgatctctttagctcatcaaatagctgcagtgataatcaccggtattcattaaggaattcattttgtaacagatgttcagaacactgaagacacacagatgtatgagatatggtcttttgcagaaaccctcttgttatgtagctgtagaagagatcttacatgaaaactcattttaaaaaattcagtgttagatctgaaaatgagaattcatcttgtaaaactttctcattgaacaaatgaagaaacagaaaagcacagatgaaaagccccaattagaacagtaggttagtgacagggtaatggccagaaatactgtcctttaatcctcagtctatggtccctggtggtgtagcacaaggagcatttggtaagatccacagatcacacaccatgcaggttttcttaaaaaagcatgacttctgatgtaattggaaaggcatgctgctttaatgctgctagtttgtcttcaaggaatagcaggactaaaataattggaaaggaggaaaaacaggaatacagaatgaccaacatgagaaaaggcacagaattggagatgtgtgtggtatatttgttcaccacttaatacatcagtttgactggttatgagtttagataggaaagcagaggggtgaaaaaaaacaaatagaagctgaattatagagatgtaggtggctgaaactacaatttgtatgcaacatagtatgctggaaaactggctcaaatagtcatgattctaaatcttggatccaacccccaactgtgaaattttagagtccagtatcgaaataacctcaataataatatatgcttgcgttagttagaaattgtgcttggctagtagcagcaaagcttaacactaatgacatactaatgagaagtctggagctatgctttcaaggactgacaccttggcagtataatgccatcaagagccttcacttcattttttaagcacttgtcaccgcttatttacaatgtggcttctggatctcttccattgtgtttgtgccccaggtgagagaaagggggagggcagaaatcaaataccaggtaaattaacagctatcactcatgctttaaggagtttttcaattaggctataggctaaaagtgtattttgtacctcatttttcaaaacttagatataaagacatcacatctacaagggaggctagcaaatatagtttttcagagggacatatggctgcgtctaataaaagcatggttctcttaacaagaagtaagagaaatataattattaggcatgcaaatggaagtttctgccacatatgatcttacatatttgtttgagaattaaggaaaaaaggtaaactatattttaaatattatatcctgcaaagagaaaagttcagaaggtagggtaatttggggaaaaggttgatgaatttgctcatagatatattgagattgaattaatgatggtaaagccatctataaagcagtgttcaaaaatttcaggaactagttttaggctggatattgagatacagagctgtcagcataataagtggatggggcagaagcttaactgctgttgctgcaaaaatatggaagtgatctctctaattgtccgctccaatatacactaaaggaagccaagtattttaggctgtaatttgcagaagctagagagattgttgtaagttcacacaccgctaatggcatcagaagttgcactgtagttagtggtggttcatgactaggaaatcacccatcctcacacttctagttcagcctccaattaactcaggcaactgcatttctcagtccctaggccagtcaatccacaacatcaaatagtgtttcctttcagacttcttttagggcctttcttctcttggctcaatcagccatcctacattactaaggcagagatacattacacttctcattctaaaaagtatctgtattttctttatttttctcacctaaggattttttttttctcaagtgactttatacattagctaatgctttatacaacaactgaagtttttttgcatgtccagaggggctggtagaaaataggaaacccctttaattctaggtgaccccaagtccttgccattaagaaatgtaaaaaccaccaggactgttctggatgttcagtctaatccttgtctttgacaaagtgtcccatctcatctcaagtcaatacctttctgcaaacatgccctgacctccttcataacaacttcttagtttcttcctcaatatttattattttcgttgcaataaaaaaagtttatgtaatgtatttcctgaaatagtatgtcacttgcaggtgctcaagagtaattgccaaatgcataaatgaataaatggaagacataaggaaatgataacatcataaattaccatatatatatatatatatatatatatatatatatatatatatatatatatgctatttagtgagatctaagtggggattatagttattaacaaatacacacaatttagaaggggtctgggcgtggtgtgtggttcaagcctgtaatcctaacactttgagaggctgaggcaggagaattgcttgagcccaggagtttgggaccagccctggcagcaatagtgagaccgtatctctacaaaaaatacaaaaattagcttggcacagtggcccatgtgtgtagaccttgctccttgggaggctgagatgggaggatcacttgagcctgagaggttgaggctgtagtgagccatggttgcaccactgtactccagcctgggctacagagtagactttgtttaaataaataaataaatatatctacaaggggaagctgcagagtgtataatttagaaatggtaaatatttgaatgatagaaacttttgttgcccatgttttttcaaaacagatagagtcctaggttataactagatccctaaattatttgtagttttctatgaggcaaatactggttggagaccagtttagcatattaaataaattctcaactttaatttttttttattctaacgctaggatctttgagactattgataatagaagcaagtgttttagtcattgactttagccctgtggggaattacatgaattcatttagaccgatgtctgtcaagttcaaggccttttagcttttaagaatctagacatttgtcttttcatgaatattcaaacattatctcagttattaacttagagatttgacaaagagagcaattcaggttttaatattggcttaattgatgcatgaatgtatgggttataatctcattaagttataatcctcttatcaaacattaatatcagttttcctattgccattagatatgacttacatagaagtgtattttatatatgtatattggttcatacatatacgtatgtatgtagtatatgtgtacacatatatatatatacacacacatatatatacacacacacacacacatagatacacacataaccctgttctaagtaagcatattccaccctgtatctcacggtaaatgcagctatgaaacctggatagagtggagccatcaggcctctaaaaagtaaatattagcaggtagtttagtgaagatgagtatacagagtatctccaaacctgtgatgagtttaccattattttctctctactgtcccctgtcctggagtaataattagaaaaacattagtagaataaatccaaagcaaggtgaagaaataaaacaataaagataagaacataaatcaatgcatttcaaaacaaattttacagaaatcaatagaattaaaagcttgtttttttgaacagacctaaatattgataaacgtctaccaacactgacaaaggaaaaaaaaaaagcagaaaaaatgataaatattaagaacaaaagaggagatgttacacaccccgcaaacataaaaagcagaataagaaaacactataaacaaatctactgacataagttttataatttcaatgaaattaggcaatttagaataaacggatcaatttttcaaaaagtgtaactctcaaaactcactcaatatgaaatagataacctaaataatcccataactattaaattataattttagttaaaaactttctgaaaatggaaatatccaagcacagatagcttcactgacaaatttttaccaaacgcttaaagaagaattaccaagtgtacacagtattgttcaggaaatatgagaagagggaatgcatcccaacttttttacaagtacagccttattcttactaccaaaaccaggtagacacagcaagtaaagaaaactttgatcaagactttcatgcaaatattttccacagaacatttagataactcaatcaagcaatatagaaaagaataattcaccatgataaagtagggtttatcccagaagcataagattggtttaatattcaaaagttcatcaatataattcatcatattaagaaattaaagaagaaaaaacacactgtcagatcaattgaaaaaaaaaatgggggaagctggctctcccgccgtaaggacactcaggcagtgttgtggagaggagtccatttggcagcaccaactcaccatccatgccatgcacatgccatcaatgtgaataagacacttcgaaactggatcttccaatcccagtcaaatcatcaaatgactgtagacccagccaacatttgactacaacctcctgtgagattaagagctaaaactgccctacaaacacactttcaaattcctgacacaaacaaaataagatatattattattatggtttgatgtcactaaatttgatgtattgcaatgtaatatccatatacacaggagtaataataatgagggctcatagtacataaattggtaagagatgtgaggaaataaaggcaaattgattttaagaaaatgttgctagcatcaataaactgtaggtccctattaggatgaagaattgctggagtgggaggtggtggatagagagtaagatgcttgaagtagagtttcccacagtaatgcatatattagagctgacaagtcaagggtatgttcataagaatccatgacgcctggagtaaaggagcaaatcaagaatcaagaagatgaagaacatgaaaggcctttatgtttaatgggtcatgagggtagctgaagcagttgctgatcatcatgcctaaagtgggtgtgtgtttttttcctgtttgttctttcgttcatttgttcgtttaattgtttgtttttgaatgagagccatctcacccaaccagaaagactgcgaggggaacctgaagatgatcatcatgaggggagggtaaattttgtgtataaaacaaataatagcatggactaaaaatacaagtggagtagtaatttttcactgctgaaaaaatgtttggattacagatatttcaagaaaaggcttttacatgcaaaaatagccatgcaatctcaggggttccactttgaaacatgtctttagaatcctggtcaagaccactgagtaagatttaaaaaaaaaaaaagaaagagggttaataacaggttggtgccgtcagaacaaaagatattactaagtatatgcaaatgggcaagatgtttacatgtttcattttagaagggtccataatcgtgaccagggttaccaaatatattgtaaatggtttacaggagtcataataataataatgaatttagccagtgatggtggctcacgcctataatcccagcatattaggagtctgagacggaagggtcacttgagcccaggaattcaagaccagcctgaggaatatagcaagaccctgcatctataataataataataataataataataataataataataaaatagccaaatatggtggtgcatgcctctagtcctagctactcaggaggctgaggtgtgagaatcccttaagcccaggagtttgaggttacagtgatccactccaccccagcctgggtgacagcaagaccctgtatcaaaaataaataaataataatagtaataataatgaacttgaagttctaatgacatattcaaagccattgtgaagattactgtggtgttcatttagtactgtctgacagaaaagcaaacatattagtgagacacaggttataaaccatctaatatgtggggagagttttaaaccaggcatgcatttatgtgattaatatgacagatcagagagtcagtaggatttagtaatgagctacacaaataatgaaatagtttcagcaaattataatcaaacgtacatgttgaaggcttttcttttcttcaatgttcaattaggtactcaattgacagaaacacagacttggagagatacttcaatattgatgccaacagtggggtcatcacaactgccaagtctttggatcgagagacaaatgctattcacaatatcacagtccttgcaatggagagccgtaagttgtgaggcttaaaactaaattaagatggaggacagtgagtggagaatcgattgtcatgaggttgtaaattcaagttaattaaagtagttccttctttgaattgtacaaaaacttgagaataccaaatttctaagctgtgaaatatacttatcttcactgtctttctatgataatatttacaaaatttatgaaaaccaaggactaaaaaacaatgggcctatattaccttcacaggatttctttttttctgatcataattcatatattgtgtttatgctgttatggagttagtgaaataacttacagtaattagtaaattgatctataacaaagacatctggatttgaatattctgatactgaactaagtttagtccctcataaaagataaaataataaataaaataaaataaaaactattgaaaaatgaatgcatatttgcatgcatatatgtatatgatatattgtgtattttaatgtgtatgcatttataatacatgtgttgataatacaaatgtatagtcatgcaaatatgagctctaacatcaaagaacattgaaattcatggtttaccatttattcttctttcaacaattttctcatcagggactaaaaaactacaagtacacatgtagaccataaatatacatttatatatatgcatgtatatccaaatacacacacatataatcatgtatatgtatatatttggatatacataagtatgtatacatacacatatacgtatatacatatatgtatgtgtgtatatatatacacacacatacaaatacatacatatgaatgtgtgtgtgtatttggatcatattttcgtattttctatagctccttttaagtaatacagcattatgattctagatttcattctcagcttcgtcattttattattagaattgtgctttagatgggcaaagagtaaatgataagacactgtcttatttattagagaatccatctcaagtaggaagaggctatgtggccatcactatacttgacatcaatgataacgcccctgaatttgccatggactatgagaccaccgtctgtgaaaatgcccagccggggcaggtaagagtcttcagaacactttgcttctaatttgtggtttcttaaaaaatatccagcagcagttgcctttgaaattcttccagctttaagataaaatataatcagcttgtttcagcaaaactaacactttgatgtgtagcatgaactaatattaaaggaaccttcaaattccagtttaattggggtgatgaaaattcctcaggaaggaaaggtaaacattgtaaaagctctgttaaatggctaagaacttagactcctttcggagaaagacagcatagtacgctgattgggctgtttcctaccttacccaaccgggtttaagtgtcttacaattctaagaattaagtgcagttcaatctcagtttggtttgttcatctattgttcagtgtcttgtgatgtttcctgggatgtctaatcaattggaacagcttatttctgaagttcacaaaagtgaattcaaacatgaactaagaaaatgacatgatttgtttttcagagcccttttttagattgggttcataataatacatcggatcctttctccctagctcattcagggagatggtatttattataaagtgtaaaattgctttgtcctgccacagaaaactaagcatagcacaccaatgtgctttcatcttttactttctcttttcctaggttatccagaaaatcagtgctgtggataaagatgagccatccaatggacaccagttttacttcagcttaacaacggatgcaacaaataaccacaacttttcattgaaagataacaaaggtaatgtattaatattgttaccgatagaggcagcaggtacagatactctaagcaagtatttttctccccaggaatgctgattatggattttttttaaagcaaggacaataattaaagggcaatgagcacctcaagtaatttttatctatggatttactatcatgaaggaaaagctgctatttaaattatcttaggcctaaagccaaataggagggaaagttagatttttctcattcttttcttataagcactcgttttcttatttgtataccaagttcattatccaaataatctagtaagttgatggtcaactaaataccctaataagtactatgctcatagatgcaacttgagacataagaaaaagaactggacattacacattttaatctaaatcaactttgacttaatgttttcgataataccccttactcttttatttttacataaatgcaaatgtaattcatgcaaataataataaaataatgacataattatgatgctaagaaatataatgttaaaaataacaaaactccctctcgtgtcaaattgtatttctctgcttcaaaggtaaacactcttagcagtttcctaaatatcattatagtaaaaaaaacttacaaatacctacaagtagattttagttttgcttaataatatatattgacagttataagaacttaaagcacgagaacctgctatcattgtctaattttgaatcgtatgttcgaatgagtttttattcaagatatttattttagtggaaggagagcatttgaaactgatgtagagggtgaatagtaccccccaacagcatggaaaatatctatttttaaaaatttatgttgtttatgtaaatctggttttaggaaaaaagtacagaattggatttgctagtcattactggcttgtttaaaacagacttactaccaaaaggtggataagaagttttgcatgaagccatcaccttatttagtgcaacctaggcctcaaaaaatttcaatctcaaaaaaattcaatctgaaaatgataatttttcctgatcttatttcctactcaatgagaatactattgtgtccctttagtaatatagaaggtagagcattctctacatgggtaactccagactcactgacttaatcatagttaagaaggataattctcagcatttaggttcatctggtacaagtgcagagaagggaatttatgaacttcacaaggagaatgtgagtatatcccccatgtgtcaccatccaataccaccatgattgctgtacagcacgtgcactaaaatgtcagcatttataggacatccacattgccacacaattgaaaaattgtctaccttaagcccagagctcccttgactgtaccttgaaggaaaacatatgaatacagagagagtcagttcttaagaagtcttccatatgatcacttttctgaatatagagtcatattctcactttttgggcatttcagcttgtgttcctcaattcaccgtgtgtgtgtgtgtgtgtgtgtgtgtgtgtgtgtcattttggtatcagtcatgttagattacaaatcaacaactttctaaaactttttgtatcaagtcataaatgcctctgacatcggagttggtaggaggcagaggcataggcctgcgtgctattgtgaaatgtacaggaacttactcaaaacagtatccttcaacaactccagcttaattttttagtgagtaccttctcaaattcatacattctaaaataaaagatttttttacataaaaatctaccagatggaatctgaaaatcaaactgttttattactgtctcttctataattgcatgtaatacattttctgcagtctaatatgagcttgctgttttgtgctgtttgagacagatttcatcttgctgtttcactagagtaccgttaattttttcatgctatcattgaataaatctttttgacagtttggaagagagaaaaatagataaaagcacactgcatgaaactctgatcctgatttttcttcttttcctttatatttttattaacagctattaatttaaaaaaatctcataaatactcttattatttaattaagacaagttagttggaaaactgctaacacacacaaaacatatttttgatatataaatcacacgttatatagacttattgatcacttgtttaaagttcataattactataattgcttagatgaattcaaatattaaatataaggtaaacataaatagcctgttttatcactgacaaaatgtttatacacatagagtagctataaatacctatatataattttcaaaattttacgataaaattcttctgaatatccctgtatattcaatttaaataaagctaaagtagctgattttaccctttttaaatattggtcttgcaacttgtctaagaaaggatagactgaaaattttatctgtgctatatgatgatactgcaaaatatttaacctgttaatatgtaccatcctttctataagtttatggtgtcaaatttaagataagtaaaagatgtagtttttataaagttgcaattaatgtaataagtgatgcataaacattttcatattttgttttactttataactatttcttttgttatactgcatagaataacataaatgtcttataatgtattaaactggaaatgtccctctgtcctagagaattgaaagaaaattgttgaaataaatctgcaactccagagatttccctaattaaggcatcaaagtaaatagagtgacttaaataaagtttgggaagactgattccatcagaaatctggtgttatacatttgctttcgttatcctagacaacacagcctcaatactgaccaggagaaacggcttccggagacaggaacaatcagtttactatctgccaattttcattgtggacagtggatctccctcacttagcagcaccagcaccctcaccatccgcgtgtgtgactgtgatgctgacggcgtagcccagacctgcaatgcagaggcctatgtcctacctgctggcctcagtacaggagccctgatagccatactcgcctgtgtcttgacattattgggtaggtactgtttccagggcttgctctgaaagagctgtcacaataaccacatgtcacgacttgcctattatcttctccatttggtgaacatatgcagatattctactggatggtgtttgttttgttttgtttttctttgagacggggtctcactctgttgcccaggctggagtgcagtagaatgatctgggctcactgcagcctctgcctcccaggttcaagcaattctcccacctcagcctcccgagtagctgggattacaggggtgcaccaccacacccagctaacttttgtatctttagtagagactgagtttcaccatgttgggcaggctggtcttgaactcctgacctcaggtgatccacccaccttggcctcccaaagtgctgggattacaggagtgagccacagctcctggcctggatggtgttttgctcactaagtaatacaattgttggccacactttccagtggtatatttgaagtataactcagacaaaaagttgtatcaatttcattttcaaagcaacagtgaagataaatggcttatgctttaaattaatgctttttaggattaaaaataatctatcttatcccagttctttgctttagagcactctacagaggagatacactagactggagaatacattttctatattgttttgacaatatgcttattttagaaattatggctttatattctactttttaaagaaattatttgattgctttcttaaattatttgcaaatttgaaatgattacaatttcagcaatgcaaatcttatatttttaaagtattaaatactaacacatttaattgtacatttccatgattagtttattactcggttaaattaaatttataactcatatttgcagtaactcagattttgcagcatccttttaaaaattgggagatgtccaatgtggacactgggtaatgggtttattccaaagaaacatttttcttcacattgtaacttgtaacacgaacacaacaagaacagagtaaacattcaatataccgttccatatggtgaatgttcaataaattttaagtgttactgatggaaaattataagctaagacctagttactaatacattataaatgctgtcgtgaaaatggaggttattgtcttaagtaacttaagctaaacaagtaaatctaaaagaaaataaactatattttgcatagaactttacacagatgcagaaactttgagaatttcattagaaatgggaagtaattacctgctaaatctaattagaatataagggattaaagtttgaaaaaggtagaaccactgcaaacaaatttttattggtctagaagcttctaaaacaaacttgtccaacctgtggcctgcaagccgcaagcagctgaagatggctttgaatgtggcccgacacaaattcttaaatgttcttaaaacattatgaaatgttttgcggttttttgtttgtttgttttttgttttgttttgttttttttttttgctcaccagatattgttagtctattttatgtgtggcctaagacaagtattcttcttccaatgtggtgcagggaggccaaaaaatttagattttggaatctaaaacttaataaaaaagatgtaaattgcatatttattttatagtagcagaataacctacattagaagatttaaaaattacatttgtgggccaggagcagtggctcacgcctgtaatcccagcactttgggaggctgaggcgggcggatcatgaggtcaggagatcaagaccatcctggctaacatggtgaaaccctgtctctactaaaaatacaaaaaaaaattagccgggagtggtggcgggcgcctgtagtcccagctacttgggaggctgaggcaggagaatggcgtgaacccaggaggcggagctggcagtgagccgagatcatgccactgcactccagcctggatgacagagcgagactccatctaaaaaaaaaaaaaaaaaaaaaaaaatccattcatgtttagaatgtctttagcttgaaggcacagaatgagaaggaataatgagaggataagtagatgatgtgtggaagactttttaagtttggtcagtgtatcataaacaacttagattatgccgtaaaggaataagattgtattccccaaattttaattatcctcaataatgaattgttttttgattattttaaggctgtctgatgaagcttgcttcactttagtaaacactttcaactttgactttgggattttttgcgatttaggttgcttgatgattctaattaagaattatcagctaattattactgaaagtaactgaaatagagttttattatatttcattcttagatatactgtatatgagtatacatatacagtatgtgcatgtatgcttgtgtgtgtgtctgtgcataaaagtttgggggatttgtcaaaatttaagtatggctactctttctgctaaatttgaacatattgcttaagtagacaccaaatttggaatgcctcttccacttctaaggatcaatttttttgtgccctatattttattcatttttttaagagttaccgcaagtcttcaaaaccgtaagtaaaacaaagtctgttgtactgaaatacaatttggaacaaggggcttctgcttgcagcttccatttctatagtgaccacacaataatcagtatcatcaaatgctaccattttagctcagaaatgtggtctctttgtgtcttatttcccaagtttttaaaagcagataatcaggaatttttatactgttttagttttgtcgccactattatagactctggattttcacacagtaagtgctgaagccaatgagattaagtattcacagggggtgcatgtggggcccacagcctggcatgaaaattgatttctagtacacaaataattcattctttatgacacctcagaaagtggtgtgaatctcgtttctaggcattaggtatcaggatttgtaactcaaaccttttaagacttctgaacaaatattactggcaaaaagcaaggtgaggaggtggagatggggaataagaacttgaaaatcaagttcaattaagaatgaaactatagaagtacctggactttagactcttaaaaaaaaaaaaggtacttgactacatgttaagtttgtgttccagtgatgtgactaattaaagctacatgtaacatgacggatggggatgcactgacattaccagaagtttaatgctggaaggcatcccacgtatcaatgctaacccaaaccttacagagggaaaacttgaggtgtagggtaagttcgagggtttgtaggagtacatataacaagttagaggatatgacggggtaagattctaggtctccttattctcaatcactgatttttatttaaactgcacaagaagtacatcgtgaaaatataaatatgtttacgactatatattgctgaaataattcatgttatctgaagttgtatttgtcagtctttatctctatctgtattctcctaactttatggatgaactgctttctgatttctcattcttgctctctctctaatttatttacacctgaattctttaaatgaaaaaaaaatccaaaaattagaacatgggtttcctttatttacagtgagtacagtttgaatgagataagctattgctatactcacatttcatcataaaataatcaattagatacctcaattatttttcatgcagaaaaatttcatcaacatatggcaagatactctggtattctaaattttttttttttttttttttagacagggtcttgctctttcacccaggctggagtgcagtggcgcaatctcgactcactgcaagctccacctcctgggttcacgccattctcctgcctcagcctcccgagtagctgggactacaggtgcctgccaccacgcccggctaattgtttgtatttttattagagatggggtttcactgtgttagccaggatggtctcgatctcctgacctcgtgatccacccgccttggcctctcaaagtgctgggattacaggcgtgagccaccgtgcccggcctgtattctaaattttgaatagaaattacaacccataactaacatcaataccaatttaattatgcatttttatcatagttaaattcacacttacagacatacacaattattcttccaccaggctaaaaacactttaaagaaaaaaaattctatgaatgactaagacattcgattatttattcagtagatttttttaataaaggagaagaatttcaactgttttgtttaaaaatatggtttcaatattaaatattgcactcctattcttaaaatattacagctaaattctttctgttcctcggcatacacaaaaataaaacctgtttcttgcacaataaggctgccactgaatttactatattaagttttgggtgtttctgtacttggacttccagggcccagtaattgaagtcttctagcattccttccagctctttgctcttctgacacaattgggattagttagaccagcccagcttcataaactcagatttaataaggtgtttgtagaaacttgctgtttactgcatgggattcggtctcctccagtatgtctatgatggtcagcttgacagttagctgtcatgcatcttttcacttttcttccctgatctcccaagtactaaactatatttggccaccagtaactgtggctattcatgatttttttccaacagaaaaatgctttcttgtttttgcaaatgatagtgaacatcactgaaggaaaaatacgttaaattgtggagaaaaaaagtggcagcactatgtaaaaaaatggatccccatcataatctataatgatagaacataattggcatagcagccctagagataataatgtgcagactactgttggctaatttatagtagcagatgtgttcctctttcaaagaagcatgagcataataaaaaatgaattgcatttcataagctcgtactatgtgctagacatcagcctaagtgctttacaagctttatctaatttaatgctcataagagatttcctaggcaagtattactatgcccacattttatataagaaaactacaacttagaggaaatacacaaaaagttacagaatgaacaagtgtcagagtccggacccaaacacagggaagcctgcctcctaaatgttctttataaggtatttttccatatatgtttccccacgtgaaagacctctctgtttctaggaaatgcttacaggtttgtggatattacagcctgggcactgccaaattaggtgcaggagtatctttgctgtgtttcacatagtggttttattatttattcggttaactctgagtgtctattttatagtatcttccaattccttccagtctttagaaaacatgtttagaagagtgtgtgttaaatttgaggttatatttcagtacaaccaaaatctaatacacaaattgtctttgtgcataaaccattcattgtacttaggaaactttttttctatattaactgagactaaggtgaaatcattctccctcacatttaaaggaaatgaattttgtgatacttgttttgggaaaagaaaagatccattttagttaaacttttccctttcttgagacttggaaagaattagcccctttaagcatatatgatctattacaggaggtctaccaatgtatgttccttgttctattggagagttgaaactagaaatctccagagaaacatcaatcctgagcaattttcctacattcttgcctcttttcctgattgaatacccacttatatgtttttctgagtggaatcagccaggcttccgtcttctcgcttgcatcctccatggtcaattagtccgcacatactgttaactttagtttttgggccttgaatcaatttgtttctgtctcttattgttgcacctgatttttgtccagggtctttttttttttcctcctgaattgtggcaactctaccattctctatcagaaccaatccgtcagtatttcagagtaagcttttaaaaactaaatgggattttgaaacaccgcagcttaaaatcgtattttcatgaaatcccattgtctacagactaaaatcacagactctccagtaccagacagctctcatccagtttgactttatttttctctacttacttggtgtactttagtcaaattgcatctgttgctttttctaagactcattctgctttgtctttctgcctggaatgcctcttcccataatctacaagtgggtcaatttttttttttttttttttttttttgtattgaagacgcacttctttggcttctgagtccaggctggatgctgttcctaaggaccccataataccttgcatctagcagtctttgagcatctgacatggtcgacttgtctgtttaattggtttatctccttgtccatctcttccagtagactgcttttagaggcaaggactgaacattattttgtcattatttatatcagctaatcagatgctgatctgacacataacagaacattctatacatgcatgctgaatgaagcgtgaatgatttgaatgtactgaattgtggaaaagaataattgatttgacttatttttattacccataggattatctccattagaccctattttttctatttcccaagacgctatatttttaggacatttttctgagatttggtctatctccttaactctacagaaaaattgatgtgtcacagattaaaagaatttaaatgatgtttgcaggttagtagccatggaactatataagggcttaagaaaaaacagtagaatatatgactaaaggtagatggagaaaatattgcagaagagatgtcagagatattttatttatcagtttaaaattcagttaaatgttatagttgatatctcagtcactcacttggatcataccaattatgaatctttagttatcctttgcaaaaataaaagtagtagagttggtccataagtgcaagataaaattttagccttgtattactggggatctgcatgagcctcagattccatagcacgtaaatccactcatccttcagatctttacttaaatgccacttctgatgacatccttttctgatcacaaccagacagtggtggtactcctgcatttttcctatcactttcctttttaagacataaattattttacgtctctgcttgaaacatttcagatgcacttacatggaatctaaatgtttctcatggtccacaaagcaaggcatgtttggccacctgcttacctctctaaggtatcaggctgtctgatccttctctcaaccagtaggaggacccacaatgcgtttcttcccattattttcaagtgtgctaccctgctcctgaaacagtcttcctgcatttcttcacctgtcaagtttagattatttttaatgcctcagcttcagtgttatctcctcaggaggagtgtcctaagcaccattattctccatcatagtatttgtttcttttgtagtacttatttgtaactatatgtgtttgttttctttgctcaaatataaaaccttttgaatgtagtgatcttcgtctctctgtcttcttaaccagtatattattggggcctgtcaaaggcacatatagagacaatatttttaatccataaatattatttattgcactctactgaaaattttgcaaccttttccacatattttaatcccttcaagaataggtccagtatcctccataattcattattctaccgtcagttagatagaatagagtagatatcagataaattaactacattacaggaggtcatcaaaatcacaagtgagagcatggtaaagtttacattttatctgtgtatgaatcacatgactcaaattttagcaacacccaaaaagttcggaactgaatcatatgaatttattgtagaaattccacaatgtatgacctattattgaataaagacagttatcgcctactgtgggtagcactacttaagccctttacaaatagacactcacttaatcttcataaagttactatgaagtggtttataagaggtaaagactattattttcatattggagagcaggtaactgaggcaaggagaagtaaaggatctcacctacctccatacatccaggaaatggaataacaggtatgcaacgcagatgaggtccttaaataggcaggagccatgggctgagggacgggacttgaggcatattcttggttacagtgagtaggaagaattgtttgagtggagcatgcggtgatggagagttgaagcaaagaggaaatgaagaaggtggagtcacagatgacttggagtttctgatttgggtattttcctacttgagaaaagagcacacaataggaaacaaatcagaggaacgttaatgagattaaacttagaaattttgaatggtgtatgagtgagagccattggacagaaagttgttatcagtaaaggaagtggtcataacaaatcataacaatgataattaccattttgaacatttattatattctgatgagtatatatatttgcattatcaaaaataggagtagtcattttaaaatatggtctggttatccaaagagatagatgagagatttagatgtcagagacatcagctcttgccatacaagaggcagttgaacctggggtttcactgggctcgcctaggaagaatgtggggtgaaaagccaagaaaccgagtatggaacttgaggaagatttactgtaagtacttcttagaaaagagtggctacaaaaaaacatggtttgaaagaagaaaataaaattgtttattttcttttaaactggctgcaagcagttgcattgtttactattgagtaagttcaagatagcagacccacacaatttcccatgaagttctgtgtcagataggacacacatgccatgtaaaaaaaagggccacaaagtgctcattggatttggcaaaatgtgagtcattggtagccttggtccctgggaaatagcagggaaaactcagattgctctggtttgagagcagtcaggatataagaaagtggaaatgtggagtaggctattcttacataaaataaaagttaataatattgagggtatatgaagataaattgttggctggaaaatttcaggaaagtgtttccacttaatgtcctccctttttgagctctgatggaatagtgtgcctggagatagtggagagagtttcaagatgaccctgaaaagagtggggatagcatgtttcttcatcatggttatttctgatccatctgaagccaacaaaattcaagctcagttcaatattaaaaggaaattaagctgggagcaatgactcatgactgtaatcccagcagtttgggaggatgaggccagaggatcacttgaagccagagtttgagaccagcctgatcaacaaatgagacctctttctctacaaaaaataaaacaattagctaggcatggtggcatgcacccaaagtcccagctactcgggaagctgaggcaggaggattgcttgagcctaggagtttgaggctgcagtgagccatgatcactccggcctgggtgacagagtgagaaaaataaaataaaaaaagattaaaattaattttaaaaaattaaaatgtctataaaaatttaaaaaaatttaaaaaacagaattaaacaatttttgaaattaaaaaagaaaaaaattactaaaacttaattagtgcccagtagaaaaagaagacagattttttaataaacttcatgtaaatcaacaggatcaataaatggtgaagaattaaaaaataggaagtttttggaaggctaagttatacttgcatatcaatgtggatgattgtttaaaataaattattgaaattgcatccagattgtgctggcagattttttattttgattagattatttttcaactataccttgtaggtacactaatcattaaactgattatagctgtcctattgttcaacatgtcatttgacaataaatctgagaatacctctaagaccatatgcaattagagtattctggtgtttgagtcttttgtttagatcagttgtccaaaataaagttattgtgaaccatcagtgtgaaatgcatatgtaatttgaaattttcacgtagctttattagaaaaagtaaaaagaaactgttgaaataaatgctaataatatatttcaaacacactatacaaaactattatcattttaatatgtgatccatgaagattattgagacaatattttacttttttaaaaagagaaacttaagtcttgaacatcatatgtttattttacacttagagcatatctcaatgaagaatagccatattccaagtgctcaatagccacatgcagctagtggcaactatggtagacaacgaaaatttaaacgactattttatggctaattagaaatgatgattgttcataagagaccatatagatgatggtgtttttggtaaagacttacttatccctcaagtcacatttcaaatgtcatctcttatgttggactttctctgagaatcctgggcagaaataatccctttcccatacatattttcctagcatattttatattgctttatatttaattcattctataatatttaactctttattttttattcaaattgttgggcttgttgatggcaagtccagcaagtctacatatttctagtcacatttccttgcctataacttattaatccatttatcaaatatttattgagcacatacttactatcatgtattattctttgtgcttagggtaaatctgtagaaagcaaagtcactgcccttcatatggcttacagttttagcaatcagtactcattaaaaatattattgaattaaatggaatttaggctttaaacctgtggtagtagccactaaacaatggattaaacttaagaaagtgatatttaacagatacaaacataaatttatccaatttggttttaaaaaactttctttacagagttttaggctaggaaaaaacctagtgggatgtaatttacattactgagtgattttaaaaggataccagattcaacattttaaatatgttaaaaaaaattagtggagttactttctctttaatataagtagccttagaaagccaaatacctcatgttctcatttataggtgggagctaaacaatgcgtacacatggatatagcatggtggaataatagacgttggaaactacaaaaggtgggagagttgacggggagtaagggttgaaaaactacctgttgagtacagtgttcactgtttgggtaatgtacaccaaaagtccagacttcaccactgcaagataaacgcatgtaaaaaaatctgcacttctactccctaaatacataaaaatttaaaaaattcaaatatgcatattttatatgtatatacttatatatgcatatataaatgtatatatatttataatttcatacatgtatatatagatatgtggccttatttagcaatggtaccattttgtgatgatcagatgacatcggcagaattctgctatttctgggtgccaaaactgaatattgagcattctgacatttgcaagcacagaacatccagagtaggggactcaggatgacaacgaggttttgaactccagaccagctgaacactacacatgcatgtggagcaagcttgttcaacctgaggcccgcgggccacatgtggcccaggatggctttgaatttggactaacacaaatttgtacactttcttaatatattatgaaatatttttgcaatttttttaggtcatcagctatcattagtgttagtgtattttatgtgtggcccaagacaattcttccagtgtgggcaggggaagccaaaagattggacacccctgctgtagagcaaatataggtgacttctgaagtgtctgccatctttaagaggatatgacagttcataatagaatacattcattggaaagaagggatacttattgtagagaccagtaatttcatggttatcatcaagtggggagattggttaggaccacaggacttgatgatactccaatagaaatcatgttccagttacttgatgatagtccagtagaaatcattttccaatttactgtgcagatggacatctgccaaagatcacagtaaagctgagaataaaggtgcccactaatttgtagtatggtgtgtgttttacacatcaatatttttctccatattcccttccttttatttatcttggttttgggagaatgattctatccaattgctggacaacttaaactaatttaaaactgacaaaaaggccgggcgtggtggctcacacctgtaatgctaacgctttggaagaccaaggcaggaggatcacttgagcttaaggagctcaagaccagcctgggcaaactggcaaaactccattgagctcaaggagttcgagaccagcctgggcaatatggtgaaaccctgtctgtacaaaaaatagccatgtgtggtggtgcatggctgtagtctcagctacttgggagtgctgaggcaggaatattgcttgagctcaagaggtcgaggatacagtgagctgagatcctaccgctgcacttcagcctgggtgacaaagtgagactctgtctccaaaaaataaaaataaaactgacaacacatcagttcaaaagagtgtaaagaattacatgaaatttgtaaaatagttcgcagtagggtgttgtagttttatataattttattcttgtaattctcttttctgcatatttctctgcgcctgtgcatgtctgtatattcttacagtgaattgcagtaagattcatactgtatttatctgtgaatatacagtcaacagtgttggaactgcttatttgtaggaaccctctcttgatatgcttttgccaatatccagcactatttcctacctgctagaatgctcagaaaatgttgaattgaatgttgtaagactgaattccaaaatcagaaatttaggcctgcatcatacttttactgctgtaataacactctaacttcttttgtgacatcttctcccctatcttcctctccttggtccagtaagaatgatttttatttatttttttgaaacaatctgattatatcatgcaggccttaaaatatgtttgttcttggacctgtagggcctgactcgtgcctacagctccaaccttacctcacctctttctttgccctccagccacgttggcctcaaatatttgctcactgtcgtcactgtaccaagtatgttcttccatatcacatcttcctgtccctaccctcagcctccagttatcatcagttaagtctttctcatctgtatctatttcccctagtacacttctttataagatcatgtgtccctcttttggagtaattattacaattctacttttacatttatttattttaatgtttggatcaatatctgttggtcccacggaatcgtaaggtccatgagtaaatgttatatgtctgcttctatgtgcaacattacactacaatacctaatgcatataataaattgttaacatatttttgttaaacagatatgtaaattcctgaacaaccagaacaatctaagtgtcacacatggctaaatttcagctagacctaaatcttttcttctatttccactcagaagtagaggtcatatgacacaaaagagaaatgataaaacctcttaaaatatataatcttctgcttacttaggcagagtattcttcttaatacagtgattagcaccagagtctatgaagaacagttaattcttgttctatgtaaacattaaattctattttttatatgcgcttacatggttagaaattaatattttctgagatcattcaaatgttaaaattatctaaccttccaaaataccatgtttttctttgccttggacaagattgggaaataaagcaaactgcataacacattaatatccttgatgtgtattgtaccttagggctggtatacccacaggcactgtagagttttactttgattgaagacctgagaatcagaagtcaagtttatcagtagcatgaaatacatttacaatagaatataagaaataattgatatatactatatatagcaatatatttatgacaaaatttattataattaaagaatttataattttgaaatgttttgtctacttagacattgatttaaattaagagaccgactaattattatataactcttaccctctttatacccttactgactctcatactcattcatttcttacacccttttgttctcaactggacatttctcctccttaattatgctgttcaacatgtgtaacaggtgtcttatttctacctgcctccatctgtgcatcccatcactattttctctcaacgtccctcttcattccatgctttacttaatttgatttctcactaagaagtcctactgggttctactttctttctactacaattgctttcattttggggaaactatgtgaaaaatttcagaaactaaagttgtatatgaatataaaataattgtttattcatccatgtattttaaaaattgttgtctttcttgagcaagcaaattgccttttgagctttcatacttgtcaactttagcctttgttttttaatcaccttgtttgaaagtactaagcatacagtgttataaacagtgcgggggctttgaagacagactgagatggagtatgcctcacccctcactattgcatttaattatatttagacaggttattttatgtgtctaagacaaccatcaaatgggaaaacacctaccccagagaactgttgtgagtgttaaataatatgtcctgtgtgcagaccttcatttctcactgtaccacctttcctatttcccatttaatctttggtacatatgcctagccatatatggtacactttctactttgcttgttaccttaaaaacaaactgctctgttgcatactgataagtaactgggattctgctaactctacttacgttatttccaatgttctttatctcttcagtccacactgtgaagattgatgttgactattattatcatatattgctaatttcaattagtttgaaagttacttgttccaacatcacacagctaatatgtaggaaggttggacaaggcctttctgacaccaaagctgcagctgctgttgtagcattctgtcatgtaccttgagaactacaaggcattagaatggtgaaagtgctaattctcagtagacaagaaaggacaatccacttaacagggaaggaaggtgaataccagactacttatgggaacagaaagatatacaagcagtaacttttgaacttaggttggtgcaaaagtaattgtgatttttgctattaccttaattgcaaaaaccacagttacttttgcatcaacctagtacatatatgcccttttggtgaagctggttgaaaacattcaaatgaagtaaacaggagcaaaaagaaagagagcagggatatctgtgccaatgcagcatgagaaggtggccagaaaagctcagaaatgtatcagtttctgaactgtaggccatccataaagtgtaaagcttatgagaagagcagtgcagtagggtccagtgggaaagaaaaggaaaaagtgccacaaaaaaacaattgttgtcacaactatttccacagatcaccaatacagtttttcatcagtcacattcctgttgatgataacacagatagccaacagacatttaagaaagcatgtatttttattgaagatgaattcattttatttaaaactaaataagtgctcagctttttggtttttgaaagtacactgaggtgggggatggagtatgccttacccctggttactgcatttaagtacactgcagttaaggacgttgatgtccttcatggttttatatttttattttcaaaagtgttcctaatgccaaagtaaaaagtttacaagatactttaaaaatatttcacgcctgcttttaaaaatatgatgacaataatgtgccctaaacgataatccatataatgtacgttatgggctattcagactttccagaaaaaaatcgtaagctgatgcaatataaattgttaaaaggtatttgtagatgaataaaggtaattcattactttacatatttttaaattccaaaattcaacaatactctttttatttcattgtagtttagttgaagttgcaatgaaatcaaatgtattcccaattcaaggagcatgcagtcactcagaggccagagcactttccttatttgtgtatactagtgaaaaatgcacagaatacattgtttaagtcccccaaataaccagtgtagttgttcttatttgctttacagtgcaacctcctgctttaagatgtgatttttagttttgatataggaagataaattcctaacattaaaggggtgattcatttcttaaatttatctttgacagttgctgaaaatctcacagcttgtattctgtctgtaggtataatggataaagaccaagttcagtattttatacatgaaagtgggactcaatttattatagagaagcttttaatctttgtaaatggcctgacatgctggattttatttaacagttgactttcatagagaaggagtaggcatttcttcaaagaacctgaccgagtgctataaaccatttctttgtgaaattgcagttgttaaattagacacaaaacatttatgaatttcaatttgcctttccagcaattaaggagttcaaaaaaatccctttgtgtttcctggctttgaaatgattatatttatcatgaactggcccttcaatttcttctatcaaatacattggaggttacgttaaagaggaagacatcagttctgaacaggtgtggaaaagggttccttgatgtataaaagtgttctaatttaaagccactttagcaattttagcacatctaccgctgtgaatccttgtggaagtaggtggccaattcatttctctttaaagggaagaaaacctgtaactcagcgtcctaggcctaattttaccatgacgtggggcaatgggtgagtttactgaaactttctcttcctgtcttattgtttcagtgttgatcctccttatcgtcactatgagaagacggaaaaaagagccccttatttttgacgaagaaagagacatcagagaaaatattgtgagatacgatgacgagggcgggggagaggaggacacggaagcgtttgacatggctgcactgagaaacctcaacgtcatccgagacaccaagacccggagggatgtgactccagaaattcaattcctgagtcgaccagcttttaaaagcatcccagataatgtcatctttagggaatttatttgggaaagattaaaagaagccgatgttgatcctggtgctcctccttatgactccctgcagacatatgcttttgaaggaaatggctcagttgctgaatcactcagctctttagattccatcagctcaaactctgatcagaactatgactacctaagtgactggggacctcgctttaaacgactcgcggacatgtatgggactggccaagagagtttgtactcatagccttggaaccttaattcgaaatgtactgaagaaaaagtaacagcaaaaaataaaataaaatgaaataaaataataaaccactacatacagaaaacaagaactccccttgctggagacagatggttgtaaatatttctccatttttaattgtttagatttctgccttggtgaggcatatcttcattagacttatctaaaggactgcactgaccacagactctgagcatttgaaggttttttgataaaaataaatgctcagtggtttgtgaatagatagcaactctcatatacctgcaaaggcaccaaacctctatgagaaagtagtgccctgtgttgtcagtgagtcaaagatgccctgtacataccttcatggtactgtcattgagaggaatagaacatgatgagctattgaaaaaccctggaacttgttgcatatcaaaacttgggacaaatttaatttacagagatgcttatagcttactatattatagaatccaacagaattatgttgctcttgattaacagaaatattttatttaggaatatataaattcccagaaattccttcctaactgaaaaccctaccacaaaagccagtaaaatttagtttaaggcaatataaaccattgtttatccaataaattatgaagtgttccaaataagaaaaaggtaaataatttgatagttttgagatgcttgtgtaggtatgataaaaaaaaaagttgctgtctgttcattgatttttattatctcttctgatttgtacaggagaatatcttttcttttttatttgacacatggtgttgtatttattttggagctccaatctccactaaattcaggtccatcatactgcctcatagtattaaactcatcagaacatgctgatttttctccagcccgagctacatgaaggaaatgaagcatggaaatggagaactaatagtaaagcaattgagccctgttgcaggtcacatctcaaagaggagcacagctacaaggacatataaattgttcttctgagccattagaatgtcaaaacattggaataaaatatttgtattttagaaagacttcagagagaattgagattttctttgatgcaagaattatttttcaagatcatgagttctacatgctccaaagactttcaagaacacaacctttcttgctgcaaacctattgagtaaaatattgagtttttaaaagtcttaatataatgttataaaaattaaaatccatctttaaattctgatgcaaatatgtccctcaagaattaaccaagcaatgtatgatttctgtgtggtttagatgtgccaaaggaaggaaggcaattgcaagtcatcatgtgtttaagtttgagttgagcttgttagagtatgactttcatgaccaaaatgatgtttctacctattatttttcctagattaatactagtttaatgtgcatatacattcaagtaagaatggatttattttttccttcctttctccttttaaaaataattcattgttgggttcctaatacatttacagatagtaaacactgtgtagagaatcatgttctaaaagtgctttttgaaaggtagacagtggaattagaatattaatatgttgattacacaaagaagaactatgtaggattctgtaaacttgcagcccaactttagaaatgaagtatgtaaaagtggccttcaacttcataagtataaataatccaataaatttgattacctgcaaacagttctttaatttgaatagagttttgtagacattgttttatgactatatagatatgcttcttgctgtattaatatgcatatatattttaaaaaattataacagtgaaagatactgttcataacttttaatcacacatgcaagtttttcaaactaaaaaataacaaacaaacaaaaaaacacgcgtatttacccagttcaataaaatcagagtgtggtgcaggaattacagagttgttaagtcagcaaggtgctgagaaaacagtttgtaataatccccttgttgtctgcaagaagatgaaatag

SEQ ID NO: 15846 - DNA, 40951 bp, Human
  misc_feature (1)...(40951): n = A,T,C or G
ggggatcagaagcaattaataccctttgtcatctgaaatacagtccaacttcatatttatcctgtttgccttgtcatcagcattgcaacaatgctcatgaatccttaggctcggatgaatccagctttttgacccagtttgcatggccgcatgtagttttaccactttgcctctttcttctgtgcatgtacattacacacagagggagacagagaagggtggcatctaaaacagagaaaaacatctcagaagggagaggtgtggtggcttcttttaagcaattcttcctcagtccgctgggctcaatgcagcttccctaagactctgtcacccagtgaatacatggggagcatctgatgtgtgttacccggtgtccacggggagtgttagcagggcccaggaagcaagtccaagtacaaccttcctgtcacacatcacctcaataacacactgggaccttctcatcgacctcagcctcctcataacccctttgctggccagggtgaggtcagaaaggtccgtgatggctgtgtgccccacacccactcagctagcctgggctttcctgggtttggtgctttctttataaagctgccttctataatggagctattttgaggatgcatggctttttccaagccatattatctctgcgccctccatccgagcactttcatatgcagatgaagccctcccctgactgcctttgtgacactgggctccagctggactgaaggtctcttactgcctcccaagagctgtttcaggcctcattgcccctgtttgaactgctcatattgtccaaagtcttcctacttcctcccactacctccacctgccagtttctgtttcctggtctggctgatttctatttatcctggaaggctgattacttaccacctccctcaggaagccatcctggctgcttctgcttccttcctactactgctgaggtagggcccatctggtatgtgtttcattccactctaagacccttgaggggaaggtttgtgactctgtattcgacgacacagcagggaacttgcatgaatcgcaagtgtggcgtgcatacgtggatgtctgttcggctaagcccagttcttcagtttctgacatgactgcttgtcaacaggagtgtgtgttgttttttgctcacaccaagaatgctgatcaggaaaagaacttttctgtggcaaactgataagaatctctgggtgattatagatgcctgggctgctctgttttcttttgttttactcagatgggcagattcagaaattggtatttgtcttagaatcataccgttttgaaccagaagggaaccagaggctgaggaagcttaaacagctcctgcagtccttcaggcaacaggtagtgagggcagagcccaggaagcccctacaacaccttgctttccccgctttttaaaattctctgtgtgtttaacaagttaaaaggtaagcaggccgggcgtggtggctcaggcttgtaatcccagcactttgggaggccgaggcgggtggatcacctgaggtcaggagttcaaggccagcctggccaacatggtgaaaccccgtctctactaaaaatacaaaaattaggtggtgcgtggctatagtcccagctacttgggaggctgaggcaggagaatcgcctgaaaccagaaagcagaggttgcagtgaggtgaggttgcgccattgcactccagcctgggcaatagagcaagactctgtctaaaaaaaaaacaaaaaaacaaaaaaaaaccctgtaatcccagctactcaggaggctaaagtaggagaatcccttgagcctgggaggtagaggttgcggtgaactgagatcacgccattgcactccagcctgggcaacaagagcgaaactccattcaaaaaaaaaaaaaaaaaaaaagtaatttggtgattccctttttgttttacctagttttatccagaaagagctgtgtggactctctgcctgacctcagtgttcttttcaggtggctttgcagatcgctcctccatgtaccagtgagaagcattatgagcatctgggacggtgctgtaacaaatgtgaaccaggtacacctgcttctgagccaccttgcattgcccctcaaaagtgggtgaggctttcattattttttctgtctgccagatgaaaaaaagaaattggatagacgcgttatggtagtggcaggtggtaatgtctgtcactctgaagacaaaaatctttctctcaatagagatttgaagggattttaaaatcccttagaaaaaaacaaaaacaactttaaaaactgttgcttaatttgggctgaaacacaattttccaaaacactatttctcaagatggcaagaagtttttaaaaactaatattttagcactttatgactcaaactctcaaatgtgaaatgcagctcttacttaaaattgttttcacagaaattttattttggaataaccacactggaattgttgctgctaaaaattgcctaaacccttgtcgtacctttttccatatacctgttgaggagcagaaggtggactggctaccacctgccccaagttgttctgccagaagtgtggctgagtatttctgcagccccagtgaaagccacagtccacggggcccgcactctctcatcattctggggaggggaaggtgggttaccttataacaagatattttggatatttcagctacannnnnnnnnnnnnnnnnnnnnnnnnnnnnnnnnnnnnnnnnnnnnnnnnnnnnnnnnntgtgttggataggcgggtggggcgcagcgtgcacttggtcaaacgaagctaaccatgagccggtagtaagtgtagaagaagttaacaaaaagaagttaacaagaagttgcctatccagatggaaggcagaggggagaggggatgggtgatgaagttcctcttgcctacccctcttattccctgagtgggttccagggaatctttcaagttctgcggcccagtttaaaatcatcattctattccttttttttttttttctttttttctttttgagatggggtcttgctctgttgcccaggctggagtgcagtggcatgatttcaggtcactgcaacctccatctcccagaggttgaggcagcaattctcctgcctcagcctcccaagtagctgggactacagtcacctgccaccacgcctggctgatttttgtatctttagtagagacgagatttcaccatttggccaggctagtctcaaatttctggcctcaggtgatccgcccgtctccgcctcccaaactgctgggattacaggtgtgagccaccgtgcctggcccatcattctattccttagcagactttttgggtgcagagggtggttggctttttacttagaagaattaagagactgctgtgaccacaggctcagcggacccaggtggggttatttcagccagctgcgtggcctgaggagcccagggtgctgcagtcactgcattgtggcctcttctcctgtgtcatattgtctttggggggtgtcctgggatcatgggcaccaatgattattggtcccatagatgggtgcaatttttgttgctgttttgctttgtgttgctgtttttgtttggttttttgatggttgcatttttctccctcatttttttaaggaaagtacatgtcttctaaatgcactactacctctgacagtgtatgtctgccctgtggcccggatgaatacttggatagctggaatgaagaagataaatgcttgctgcataaagtttgtgatacaggtgagcccgtcctgtcagtgtgtcagtgggaagtgtagaaacctcagacctctttttctatagaaacatttttagaggcagccaatgatgtttcgtttcaggaacatgaaaggaagttgtgactacacatcccaagaaagatgcgttttagatccccaaggcctctgttaaaattcttcatttagaacatttgttctggaatatatttatgttgccatttaatcatgggacacatcatagacttgacataatgtttccataatgttcccacctatttttgtgtggtttaatcctccctgaaatcctgtaggtagccatacttatcccttttattttatttgtttatttatttatttatttttttaatttatttgagacggagtctcgctctgtcgcccaggctggagtgcagtggcgcgatctcagctcactgcaagctctgcctcccaggttcatgccattctcctgcctcagcctcctgagtagctgggactacaggcaccccccaccacgcccagctaattttttgtacttttagtagagacggggtttcaccatgttagccaggatggtctcgatctcctgaccttgtgatctgcccgcctcggccttccaaagtgctgggattacaggtgtgagccaccgtgcccggcctatcccctttaaagattgagaaacggagattcagagaggttgaataacttctccaaggttaacacgtgtgaagcaggactcaaaaccagctctactcttcacctttttcctaaactataaatattttattaacacagtctgatctccttaccagactgtcttaagtttcttgcctggaatgttttttaaagtatagtttatttgaaggaatcaggagcaaaatatgtctcttaattctcttaagaaacagaggttcctttctctcccttctttcctttttccattgagctcattttttgaagaaaccgtgatgttagtcctgtggagattgcacaggccacattttgttggttgcattcccttggtatcatttaatgtatttttctgtcccttatatttcttttttctttcttttttttttttttttttttgagatggagtcttgctctgtcacccaggctggagtgcagtggcacaatctcagctcactgcaaccactccctcccgggtttaagctattctgctgcctcagcctccccagtagctgggattacaggcacgtgccaccatgcctggctaatttttgtatttttagtagggctgaggtttcaccgtgttggccaggttggtctcaaactcctgacctcaagtgatgcacccgcctcagcctcccaaagtgctgggattacaggcgtgagccacaatgcccggcctgaccccttcttataaattggttgttagatcaatttcttataaattggttgttagctctagaaggccaatcagattctgctttgttttttgttttgtttgtggcaaacttcatatataatatagttcatacatagaatattagaaccatgtaatagctgagcattcctctttctaacattagcagctgctgatggtcatggtttagatgtgtttcctttaagggctgcagaaaggtgatgttctgattctctcatttctttttcatttattagctggcatgctttatgaagataaacttccctcatcaactatttattgataaagttactgcatttatcctgtagtgcagtacatatagaaaagatagaataaatgcttttaaccttatttatcactttgcaaaacaatatcttaatcatccagcattctcccaaggacttatattatggagctatttgaggtgttttagtttcagtctattgcagttattgttgctgttgtttgtttgtttgtttttgagtcttgctctgtcgcccaagctggagtgcagtggcacaattttggctcactgcaaccttggcctcccgggttcaaacgattctcctgccttggcctcccaagtagctgggattacaggcacgtgccaccatgccctgctaacttttatatttttagtagagagggcgtttcaccgtgtgtccaggctggtcctgaactcctgacctcaagggatccccccgcctcggcctcccaaggcgctgggattacagcatgagccatggtcccttgcctgcaataactggttgtaatggtgctcagattgtcacatttctatgaggtggcccaaggtgttttgatacagcccaggcatctattgcttccatgcttagcttgcacaatccttgtcttaaactacaatcagacatttctctaaggtttcatgattgtttttagaggaacattttatttagtgacctcagtctggactctagagaagactcactactggattgatccttgtgtatagaagttttttccccaatggacagaattagagaataagtgtttcttttaacaccataatttttctaatgtgctggagacagctggcagattttggctagggaaggtaacatggaaactccactgagcagaagcatctgatcaagccttttttatttcccactgcttagtaatgaccttgactcattgctgtctcttggaaataaagattcattctgtctactgccaaagttgattaaagccaaaaatctggtacattacatacaatattttaaattatgtcaaaattagtcatcaccacccaggcttacattcggatgggatcctaggagtagttggaattttccagagaagtggcatgtgtctgtggacgttcccatgtgttgtggacatgtttttgcattttggccttgatgttgcagagctgactggggccttggaagagtgggcactgcaggaaatggggacttctccagggtcaccaagcttgggtctataaagattggaaataggaaatgtcccctccctactggctgtaacttgagaccataagagacagcgggtttctggtttgttggcttgtttttcccttggaattcctataagtattcaggaatataaggtgcaggggctgtttggacaatccaggtgagaaggagccctagaagggtacaaggtctgttttaaataatgttattgttttgtatcatgttggggggtatggggtcatgtacttatgtgcagttgactgtggttatgcacagtagttatgttctataaagtcaccgtgaacactgaattagcaaatcctgagccattactcctagtggattacagggtgaggttcctgcaagcctccagtcacactgtcacggactgatcaccacgtaaacttgtttcatgtgtgtttctgttaaagacaccttatttgatacatgttgttgattcattaacattgcactcatggccaacagcactgtaattcatgcctgagtgaagcttctctaacacacttattttctctgtaaggcacaccacagttttcttgcacttagaacgctagacagctcttcagcacgacagttgggggctgttgtaagcagggaaatcaccaacaaaaagctcgtttaccttctgtgagctgaaacaagaaggcagagcatcgattacccaacctcagccagaaacctgagtgtggagcaactcaaaatgtacacggttctgtccctgaaggactgcagaagtaccaagaggattgattttggggtgcaaataaattttattgagcaggtgaattcacaaatatgaatctgcaaataatgaggactattgattgatcaataatttgattcatatttgtgtgtgtatgtagtttataacagatacgtgtgtgtgtgtgtgtgtgtagtttacaacagatcaattcccacgtacctgcattccagaaaaactggaaggggccaggagatttggaacaagaaggccatgtgttgtgaaaacagaaacaagcatgttaccctgagtgcttgaggagagtttgactccaagcatgtcactgggcctgcctctgtaccctctccatgcatgtaactccacaacaacccgttttcaccctgggatgcctcaggatcctacaatgaatcctaaacctccagaaaccctgttctctaaggtccagtcttgcgttagtcttatacatatggcatttgaatttacaaaaaacgaggaagctcaactctgtgacccttctgcattcgccaaaacattcaatgatcatcaattcccaagtccttatctttctactaacatgaaaattgacttttaaaaaaagcccacaaaactcttaattatgagagagagaagaacccccccgtgacgttttcgtgccagtgcaggaagtgcgaggaggaacttgggacttctcgagcagtgtcctggtgattcacgctgcaggcctgccaggcgggctgctgctctgggctggatgttggatagcgcagtcgtgggcggtgtgtttgggctgcctgcccctccctggccactgacctgtctcttgtctcccgcaggcaaggccctggtggccgtggtcgccggcaacagcacgaccccccggcgctgcgcgtgcacggctgggtaccactggagccaggactgcgagtgctgccgccgcaacaccgagtgcgcgccgggcctgggcgcccagcacccgtgtacgggttggatgtgtgcgtctgtcggctcttgctgagccatgcaaagccagctttgagacagtcttgataatagcagcaagaaagctccagggtgctaggcagcattggaggaacctgagggatggggaaaggtgggggctgattttccacgagatacaggcccaggcaagacctgagaatgaatcctcggcttaggttcttcaaagggactgcgggcaatttgcctacatgctctggccatggccaggggttgctggggctcctccatccgtggaaacctgggatccccacttaggagccagcaggatagtgcaggggtgattggacgtttttgaaaagtgtgcacccattagaattttggaaaaaccatgcatcccccaccccagcacgtttttaagttgacatctaaaaagttttgttacaagtttgaagaactgataaggacttagttaccagggaattataactgcgataacactgaagaaacgaatccaggggaatgtaaacaccatggccatttgtgcccactatgattcatttttaaatgtgctaattgtatttaactattggacagtttacatagttactttctctccttttgtttcctatccattccaccttccccatagaattttatcctgatatattttttatgcttggagggtttttactaatcaccttttcacattcgaatatgcacatattgaaaaatatgcacctatttgaaatctttatttattttatttattttttttttgagatggagttttgctcttgttgcccaggctggagtgcaatggcacaatctcggctcaccgcaacctctgcctcccaggttcaagcgattctcctgcctcagcctcttgaataactgggattacagggatgcaccaccacgcctggctaattttgtatttttagtagagatggggtttctctatgttggtcaggctggtctcgaactcccgacttcaggtgatctgcccacctcggcctcccaaagtgctgggctgggattataggcatgagccaccacacctggtcaaaatcttaatttttaaatatttactttgactgagggttaaaaacatttcttctggaccaagttgtcactgcatttattattacacaattggtcacaaatgaatatatcctattttgctatattataatcataaaagtaaaaacttctgacctccataatgagtgggattgtttttccaattcatatatttgtggctaaatattacttcttgctaaaatgcaacagcattcaacatcaattctgtttctactttttgtttttatgtatgtaagtgctgagaaatttgttcacataaataactgaatggcaaaggaaacactttggttataggtgtgtccctcaatttctttcagtaccttctgatttatgtggccaagctcacctactgatgtgatatcagaagttatttttaacgctctatcagttgagaattcaattgtgtccttcaattttgttgaaagtaaagaaatagaattccttttgagttgaaaaagtatttcttagagtaatttgctttcctgacttctaggaagtataacaaaagcgtttttttccacgacttaacaaatgattatttatgcctattactcattcccttagaggcacctggttttaacccaaaatacttggacagggttgggagaattaaaatattatccatttcaattcatatcaaggaaaatgtccatcacagagtctaactgacacattcggtctttattatcaaatgcattgactaaaccagatgtgctttctcttacaaaaagtctgacttgattttttaatggttaaaatggatctccctatcacagccaactccctctgaattctgattctaaaatagaagaggcccagagcctttcctttaggttttcaccagcatgtcacatcagggattctattagactttctctctgccttgtacctttggaaatgggttcatttttggacaaaataggttgaggatagaggggaaacggtagatgaatggaaatttcactcctgtcccaccctgcataatttcaattcagaacaagtcagcctgatcgcagctgccccatttctatcatcctgcttttgcccttaatagagcgggaaaggtgggaactgtgctgggaggcgcaggaactctgccatccccaatgtccacttgtcacctcgttcagcatctcagaggtttggcagcatagcagcaaactatggggtgggtaaaaagtatatcttttgtgaaatgggaaaagtgtgattaagaaagggagcaaggaaaggagcctgcaggatgcttctggcaggtcagtgttactaagagtcatatggaagtcaagctatggaaattaacacccttaaccctttgtatgcctgttagcccccgtctcttcgattttgagggcttctcacaactctagattgtgcttctcttttaaaaagctgttcaaattaatgtgagttattagatgtcaactgggctcttcttaataaagattcaaggcaaatcaaattgctaggtgaaggagcgggtaccctacctagccagccaaattgcagaaatcaacagtatacttcatacttgactctggacaaagaaaatttatttcctttttttagtgttttattcacgaaagtaaatcacagaagtgctactaatttcaggagtaatttgtggtttgggcaccagccagttgcctgattatgatatcacatagtagccaatgttcttcttgggacttaccgaagaatcatcatgtgtggattgcagtagagggaataggcataggaaacctgagacatttattttgacagtgtagtttttgaagaatatgagagtcaagtcagttcactaaccaggatcagctcctactttcaacactgtccattaaggaaggggtctaagatccattgtgccactgtgtttatcagtaaagttttattggaacacaccctcgtgcattgcttttaatgtattgttggactgctttcatgctatgagtagctgcagcagagaccataggcctgcaaagcctaagatatttactctatgaccctttatagaaaatgtttgataccaacccttggttgcagggaaagagacctgtagggttcttcctcgtcttctttttttaactgagaaaactttgttgacactctgatatttggactgaggagattaagctcatcagaagaggtcaggacagtgaccttcaaagcagtaatgtgtctgccattccctgcagacagaggctgggctagctggcaggtgcatgggggaaaacaagagacagatagcaggagcagtcaacatcggctcccagactaggaaacaaagtgtcggtgaccaggggagtggctcagaacaacaaagggtcatgaccagagctagcctgacctggacatcacataccagtgttagtggcctgacatcaagtcagttacctttctgagcgtggttccataactcactgctggggtcagaactgctctgtgggcccaagcctgtgggagctgaagaagttagacacaggggtgggcacaggggtgggaggtgagggcagagaggggcagcgcctcacctccagtcctctggagtcccagcctggatgatctctaagtgacctcgtttgttttttgtttgttctgtctgggttgttttttttttttttctcacagtgcagctcaacaaggacacagtgtgcaaaccttgccttgcaggctacttctctgatgccttttcctccacggacaaatgcagaccctggaccaagtaagtaacaacaaaggagtcagaagagatggttggtttttaaacaactcaacctccactgtctcgtctgggttgaaaacggacggattctgttgggttaggcttcctcttgaagccacgttcaaaatggaaaaagtctgtcaattcagcctggggaaaataaaccagtcaaactaattcttcagccctatgtgtgacaggaacttcgtgtgactttttagatttggtaatctgtgacttacggttgcagctttttctaaccttgtttggttgaaaatgatttataacatttattcagtggtcacgcctacttctcccgatttcccaacatcactgatttattcatccagttatttgtgtgtgtgtgtacatatagaagcctcctgtttatataaatgtttgcatgctgtcaacatcgtggggttttttttcacatattatatcctgaagctttttctatattagttcaccagttcatgattttcttggcttttcacagctgcatagtatttcattgtagagatgtactgtaagttatgtaataagttctttattgatagtcatttaggttgttcccagtcttttacagtaatacataattttttaatgaagaatctcatatatatatgatttctcacgtatgtgagtaaatctatagtggaattcatgggtcctttcattgcatgtttgttgttgcataccaataatcaacataatgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattttatgttcaagaggattttctgtgtttttcaaaaagagcaatcagcaaaagtatgtcacttaaccatgtaattgaagctattggaatatgcattttttttttcttgagacatgatctcgctctgttgcccaggccaaagtgcagtggtacaaacacggctcactgcagcttcaacctcctgggctcaagcaatcctcctgcctttgccctccacagtagctgagaccacaggcacgtacaccgcacccagctgatttttaaattttttgtagagacagggtttcaccatgttgcccaggctagtctctaattcctgggctcaagcaatcttcttgcctcagcctcccaaagtgctaggatgacaggcctgagccacccaggcacggccagaatattctttcctgaacactctgctctgctcctttgctgaccgcaatctcagagtagctgtcagagaacacaggcagcgtttgcttttgtatatttgtttgtcccaccttgtgctgttctcctccctgtggaaggcacaggggattcaaatgtccaagaaggcgtgggttcctctcctgaaggagctggcaatctgggagagttttgcatttgttcactttttaaaaaacaagcatataaaaccaaagcactgaactaccttttcccccacagctgtaccttccttggaaagagagtagaacatcatgggacagagaaatccgatgtggtttgcagttcttctctgccagctagaaaaccaccaaatggtatgtttaaaaagagcctgttggttgatagatgtgccccagggtggtcagctggtttagatccctcccagatggcacatggatttgcgggcgtcctctccccctttatttcatcccgtgcatggtcagctgaatatttcattctcatcagtattttaattccaggtatgttgtttccttgataattttctacactggattgggggtaactaataatgttttgatatacataaaaagaaaatagagctgcaaacataaattaaaatgctcagacatggtgggatgatggtggtcacaagtgagggtgtctatgaggagattttagtcatcttcccaaattgttaggatctagctatcattatctatggaacatgttgtagattagattaaattaatcttttttttttttctttttgagacagagtgtcactctgccacccaggctggagtgcagtggcgtgatatcagctcactgcaacctccaactcccgggttcaagcgattctcctgcctcagcctcctgagtagctgggattacaggcgcacagcaccatgcccagctagtttttgtgtttttagtagagacagggtttcaccgtgttggccaggctggtctcaaactcctggccccaggtgatctgcccgccttggtctcccaaagtgctaggattacaggagtgagccactgtgcccagccacattaaattaatcttaagtagagtttcagattgccagaaagttgatggtggaggctggttacttggtgagcaggacagtgtggaggtgtgggtccagatatcggaagagattgcttcagtggcaaggagacctttcagatgaggaaagagaacaataggccacagaataaccgggttaacaagctttgaccaagaaatcaggggtttggccttgatgttttgggaaacaggaagacattaaagcattctggatgtggagttacacaatcagagcaaacttttttaaagaccatttggcagataacattaaatataactgaaggaataaaaagttattttaaaaaagaggagaggaaaagtaggagtccaggaaaccaggtcatgtaaatcaagagttttgaacaaggattctagcaatgaagtgatcagggagggatgaagagaacagttgggtccacgtggtgtcggggatgaaaactacagaaatatttcacaggatggctgtggttctgttctcatgaccagcaaacccctggtgccctgttgctattaggaaagagatagaagaagctccttttgtctgcaggggtcatttttctggggatactgaagggttctggaggttagccaaaatgagactgggtgatgtggtgagcatgatgagagctgttctaaggtagaaacaccgtaatggccctggctgctctcccgtagagtgaaaccggactgagcagggctggctgagattgtggatctcaccctttggaatgtgagtgctcgcggacaaagggcagccaagggtggggactgtcacttctgctatcccagaccaacatttttgattctgaggtttgatttaccgggatttgtttttcaactgcgtaaaattaaagaatctttactaccatatttctcattttcttccaatacagaaccccatgtttacttgcccggtttaataattctgcttctcttcgcgtctgtggccctggtggctgccatcatctttggcgtttgctataggaaaaaagggaaagcactcacaggtattgtgtctatggtggtttttgcaaaccaatcttaaaagatagatttctaggtaaatgctttggaagttgagtagattgtctacttgctgcctatggtgatctgcttaaactaaagcaaaacacgttttatcattctctggcaaaaagaaacaaaactccaaaaacttgaaaaagccaatatcctgcctagttgtatataagggaacaggaatacgctggcgttcaggaaacggatgacttgtaagctctgtatttgagttgtgtagactctgcagcatcacatatatgggagcttgcatttatcctagaatacatcaatttttaatgcatgcttttaaaatatacataaaatatttagatgaccggtaggggggaatttctgactggagtgttactttgaaataagaaccttcggnnnnnnnnnnnnnnnnnnnnggtgtggtggctcacacttgtaatcccagcactttgagaggccgaggcaggtggatcacctgaggtcaggagtttgagagcagcctggccaacatggtgaaaccccatctgtactaaaaatacaaaattagccagacatggtggcacatgcctgtaattccagctacttgagaggctgaggtaggaggatcacctgaacctaggaggcagaggttgcagtgagccaagatcatgccattgcactccagcctggacaacaagagcaaaacctcctctcaaaaaaaaaaaaaaaaaaaaaaagaaccttcgattatgaaaataagttatattgaataaaatttgggtgcttattcttagaatagacggtcaagtcttatcctgtttcttgggaataattttcccacacaaatttgttagtgtctttaaacatcacgtcatgtttaacttgtagactacaaagctaaaaatgtgtaatttttacgaaaggattcaaggcatcattagatttcctaagaatatctcttaaatctttcctttaatattcaagtcattctcttttgacttgaatattaaaaacctgctgtttcaccatccttttccattttcagttgctctcttatttatttatttatttacttatttattttttagacagagtctcgctatgttgcctaggctggagtgtagtggcacgatctcgactcactgcagcctccgcctcccaggttcaagtgattctcctgcctcagcctcccaagtagctgggattacaggcatttgccaccacgcccagctaatttttgtatttttagtagaaatggggtttgaccatgttggccaggctggtctcgatctcctggcctcaggtgatccactggcctctgccttccaaagtgctgggattacaggcgtgagccaccacgcctggcccagttggttgcttatttatagggcccacctttgccttgctgtgatttgatcagttttcccacgtcacactcttggacttcaagagaccctgcatatctagctacttctctaaccattacattgccaaatgaaacactagacaatcagaagattaattaaagaggaaagatggggattgcagatgccagtgttaagcagtgagcaatgtttgagtgatgaccctttttttttttttttttttttttgagacagagtctcgctctgtcgcccaagctggagtgcagtggtgtgatctcagctcactgcaacctccgcctcctgggttgcagcgattctcctccctcagcctcctgagtacctgggattacgggcatttgccaccatgcctggctaatttttgtatttttagtagagatggggtttcaccacgttggtcaggctggtctcgaactcctgacctcatgatccacccaccttggcctcccaaagtgctgggattacatgcatgagccaccgcacccagccaagtggtgaccatttcttaaagagtctgttcattgttgaatgcctttatttagtgcagcttcacctccttaacaacatcattactagggatttggataatgcatgttcagatgatgaaggtcgcttgtaggcacgtttatgtgagataaacagacttcctgatgttttgttctttaggtttttctttttgatactattttactgccatatgggcctaccatttagtgaactggatgtcatgactgttagctctttatcctttcatccatacatgtttattgatcatcagggactggactgacactggggtctcaatatcgagcaacacagacacagccagtgccctcctggaggaagcatcttagtgggcagggtaggcgttaagcccacagagggaagctgagtatgcaagagaaggtgctgagcaccaagtggcagatgacagaaggtcagcccatccctggggccagccagggtctcccagaggaggaaatgggtgagttaagatctgaaagacaagtcagaattcactagacaaggggcatcaggagaaccacaggcattctatcgtgagagagctgcatgatgaggggagcacagtgcattagcgggctggaaggagctaatggcaccgtagcagaaagccagggaccaagtggaagatgaggctggagaggagggcatggcgagaccatgtagcggctgctgaaggagtttgctccttgtccttagcaaaggggaccaagggcggccctctggctttagagtagcaaacaaatgtgtggtacagtgagagtagatgcaggcgcaccagttaggaagctgtttgcagttgtccagaggagaggtgatcatggcaggtctgcatgtttatcagctccgtggacaggtattattttttagtgccatttgtgattgtctagactgattcctccaaggaaacagctgcaactgtccttttctcttttggtggggggtagggagggtgtggtttaccttgatatgtaattgcaaaataagagaaaagaagcaagaataatgatgataatagcaatagctgacacatattaaatatttaatatgtgctgacatgactatatatattttgcgtgtactacgtacatcttcacaacagcaccatgaggtgggcactattatttcccctattttgtgatgagactgcttagcaccctccctggcacgcttaagtgctcattagctgttacactgaactgtgatgatcttcccatggagaacctgacaactcctaactttagtcggttttgttttttattgttgttgctttttgagacagggtctcactttgtcacccaggcaggactgcagtggcacaagcgtggctcactgcagcctcgacctccctcccgggctcaaacaatcctcccacctcagccccccaagtagctgggaccacaggcatgcaccaccatgcccggctaatttttgtatttttttatagaggtggggtttcaccatgttgcccaagctggtctcaaactcctgagctgaagcggtccgcccacctcagcctcccaaagtgctgggattacaggtgtgagccaccgggtccagccctaactttagtctttatagtgaacccaacattaaatgttcattagaagtgggataaaattgtatctttgcataatataaattcatagatttcttaaaattcataaaatttaaccttttaggtttcatcacttctgtaagagtgggtggagatgtacttttttgaacatattcttctttcttctgagaagcagccagatatagtggaaaaggtcttggggcccgctggtctcagtgggtctgacacctagcttgctgtgtttgcctcacttttatagtacattcaacctagttcactggaaaaaccagtctcctagacatgttttctttgttcttctatgatgtctaacttagtccctcatagccaaagaaaacttgttaagagaatgagaatgtctatagtcatagcagcacctctgacagcccccaaatgtgcccagaggaagtcactgaaacgttagaggatcatgttttgctttgcatagaacaggaagttctgtttttgatgggagtaagatggcttcatagcctttattttttattttttatttttttattttattttttggtttttttgagacagagtttcgctctgttgcctaggttggagtgcagtggcacaatctcagctcactgcagcctccgcctgccaggttcaagcaattctcctgcttcagcctcccaagtagctgggattacaggacattgccaccatgcccggctaatttttgtatttttagtagagatgtggtttcaccatgttggccaggctagtcatgaactcctgacctcaagtgatccacctgccttggcctcccaaagtgctggcattacaggtgtgagccaccgcgcctggcccttcatagcctttaaatcagttgatttacttttaaatgctttcactcccaggagtgctcactgaaagacttgcggtggactctgttgaaagataatattgaactgacctagtggtcataatactgagcctgatagagaaataaaaatctagaatgattgcacttatatgtgtagtgttccccaaaagtcaaatatacagagatatagaataaaacaatggttagcagggacagggggaaagaaaatggggagatgtgggtcggaggatacaaagtagcagatgtgcaggatgaagaaagttgtccaggaatctaatgtacagatggggactgtagttaatcatgttgtatcatattcaagatttttgctaaatttgtagattttagcggatcttgccacacacacataaaaatgggtaactaagtgagatgatgggtatgttaatttgcttcactatagtaaccattttactatctatatttgtcctataacatgttgtataccttaaatatacataataacctttatttaaaagaaaagaagtgggaaataataacttgaagtccttatccttgctttgtgttttctagctaatttgtggcactggatcaatgaggcttgtggccgcctaagtggagataaggtagagtgaacagttgttggtgcctctgttaagtacattcaacagttaggctggtagagccatcctagtcacatattgagcacccccccccacccccactttttttgagacggagtctcgctctgtgcctcaggctggagtgcaggggtgcaatctcagctcactgcaacctccacctcccagggtcaagtgattctcctgcctcagcctcctgagcagctgggattacaggagcccactaccaagcctggctaattttttgtgtttttaatagagacagggtttcaccgtgttggccacgctagtctcgaactcctggcctcaagtgatccacctgcctcagcctcccaaagtgctgggattataggcaggagccaccgcgcccggcctcagctcctttgcttacagggcatttccaggttcagtgatcaaacctcaaattccaggatggatccctgcagagcagctcaaagcccaagtccaggctcattctagatgcctgttttctttgtctttgtttccacttctgtcatctctgtgttcatgtcattttttttagtaccaatcttgattgtctggtacagattcctaagaaggatgaactgcaactttccttgactctgtagttattctggtaacattttatgttgacacagttcaaaattataggaaagtagtgagaaaaggacaaagaccttccatataccctagacataggcccaccagttgtttctattttctctcattgctttgtgatttgcttactctctgtatgtgtgtatatgaacacaggtatgttttcttcttgaatcattttacagtgaatggcagactgtgtgtcccatatccttaaatatttcagtgtgtatttaagaacaaagacattctcatatataaccatagtacatgtatcggaatcaagaaatttaacaatggtacaatactattattcaacccacatttgatattaaattttcattaattatttcattatgtcctttagatctttctttcttttcttcttcttacttttttttttttttttttttttttgagacagaatctcactctctcatccaggcttgagtgcaatggcgcaatctcggctcactgcaacctctgcctcccaggttcaagcgattcttctgcctcagccttcctgagtatctgggattacaggtgcccgccaccacacccaactaatttttgtatttttagtagagacagggtttcaccgtgttgcccaggctggtcttgaactcctgaactcaggtgatccacccaccttggtctcccaaaatcctgggattgcaggcatgagccaccacgcctggttagatctactttctttgatataaaatgtatacatttgaaagcataagctcaaactgatttctctaattgccaggccaactcaacatgattcattctggtctttccctttcccatatttgaatctttctttccccagctgtatgaaacctggctcctattattctcagtatatttcctcatttgctcaattctagaatacatagaacgtagtttcagaattactagagcataccacagtgatacacagagctgcttactcgagttcaatatttgtttacagttgttttggggttttgtatttagattgagaatatgtagtcagaatactgtgttcaaaagtcatttgggttagctcctctccttgctcagatgtgaacatgcttttcatctgagatgcagctacattcatttgtttctagttgtattccattctagagttctcctgcactcggtaatttgaaataacacaaagttccatagtcagttttccatctgtacttgttatggtggaaataatcagtgtaaacactgttttcagcaatgtttagctaaacttgtcctaataactctaggtattaatgcctctgccttctgaatgtaaatcggcaggagtcctcaggtgacagttgtgtcagtacacacacggcaaactttggtcagcagggagcatgtgaaggtgtcttactgctgactctggaggagaagacatttccagaagatatgtgctacccagatcaaggtggtgtctgtcagggcacgtgtgtaggaggtggtccctacgcacaaggcgaagatgccaggatgctctcattggtcagcaagaccgagatagaggaagacagcttcagacagatgcccacagaagatgaatacatggacaggccctcccagcccacagaccagttactgttcctcactgagcctggaagcaaatccacacctcctttctctgaacccctggaggtgggggagaatgacagtttaagccagtgcttcacggggacacagagcacagtgggttcagaaagctgcaactgcactgagcccctgtgcaggactgattggactcccatgtcctctgaaaactacttgcaaaaagaggtggacagtggccattgcccgcactgggcagccagccccagccccaactgggcagatgtctgcacaggctgccggaaccctcctggggaggactgtgaacccctcgtgggttccccaaaacgtggacccttgccccagtgcgcctatggcatgggccttccccctgaagaagaagccagcaggacggaggccagagaccagcccgaggatggggctgatgggaggctcccaagctcagcgagggcaggtgccgggtctggaagctcccctggtggccagtcccctgcatctggtaagtgacttcccagtctctcacttctgagcagaagggccagttcttggtacagggtttgggggcaggtattaccatttaggaaggaggaagctaatgggaaaacctcagcttgtgctttttctcttaataagcatttttacaggatggctttggattcagtccacgtgtttggttatacactgcgcccagcgctgtgtggcttcatcgtttaccactggggcagtttctgcatccatgcatatcccatacccttttgcattcaggcttttcatgataggattagacctcaagccccagcactgaccccggaaagacaaagtcaacatcggcgtcaggactggctgagccaaggcattccctcagatttctgctttttggtttttgttttcaaagcaccttaggcctcttaaatctcccccaagaaagcacttataagttttaggaggacacacaaaattgtttagttaatccttaattaattaatatttattgtgaataatgtgttgattctataccaaatgaatgatacagtaaaactgtcttttaaaaagtttcatgagaaaggccccttttataaccacaacgtatcatatatttatggaaccaggcagataattttaacaatttaacatcattataaagatgtatcactgcaacactgcctgagcatgaacaacccaccgattataatattataactttttcccatgagggtaaaacaccatctgttttattacatagttacaaaggactttgcagctgatagtgagggctctggctctgagaattaactgtcatttgaagggtcagggatctctttgagaatcttccgaaagctacagacactccctccagaaaaacgaatatatggatatatactatttaaggggcttcacagaatcctccaactcatatttttaaaaggcccattcataggccgcccctctccagagatgctttttcttctctgcttctttatttagactgcaagtggtgctagcagccggtcttcgaattgttttataaatctgaggtagctagatctgtgccttaaacacagagactgttttgcctcgtggtaatgatggttcctggctttaatctgttcctcaagcttgtggttttgctgcagctacatagatttactgatgtataaattcagtaatagcagttctcagtcaaacagaaaggaggagatatgtttggggatatttttcaaagaactggtatgttttcttctcagaagatctcagaattgttcttattttttaagattgtaaggaatctccatgactgggctttgctgttcgtttgcattgttctatttcttttcttttcttttcttttctttttttttttgagaccaagtctcactctgtcgcccaggctggagtgcagtggcgcgatctcggctcattgcaacctccacctctcgggttcaagcagttctcctgcctcagcctcccgagtggctgggactataggcgcatgccaccacaccatgctaatttttgtgttttcagtaaagatggggtttttccatgttggccaggctggtctcaaacgcctgacctcaggtgatccacctgcctcagtctcccaaagtgctgggattgcaggcgtgagccactgcacctggcctgttctatttcttttctctcagtttattgtcttccccttggttgtggagacagacaggaccctgggctgtggggagcgagaaagctgacgttctgtctctggcagcagccaggtcctggccacactgtcaggggcagaccggtttttcagtgggtgacaccaggaagatgatgttgcctctgtgtgaaaatcagcagcagttcttggaagaacagtgttggccagatttaaagagagagagagagacacatggatcttttaatgccataaaacaaaaagcccgatctttgctctcctgtaagagtcaaaaccgtagcctagtctgtttttcatcatcttttatttctctagcactaaaccatctagggatggagaaaaggaataaaaagtgtgtcatcaactaagtggtgttaatttgcaaaaagtttacactgctttttctgtcttcgtctggtgcttagccatgcaaaacatccgtagagagtctgcccgtggtcgacgccagcaagcgggccaaattaattttcgcctgaggagaggcagcagccagattgattttggaggctgtgctattctctccacaattacttctccatgaacaggccttatggtttctggtcaaaatagtactttctcattcttgctttttcatgtagttttttaaaaagtcacaatttacgttctataaaatgcgtgaaagaggctggagcttcggtgagcagtcctacagaggccttatcccatggtcccctcaaagcccctgtgctctcaggactgtgctgatgtgacatttgtttaagggttttttggatttttatatgagaggattttttgtttgtttttacttacaatcacatcaaatagtttctggagaaatgacagtgactggggacttttcctttagggaagagtatctcctgtcccagcatctttgtgaggagaatgatgatttttcagacagctccacaagtgtagacaactttaaaaatcatgatacccagtgctgttaaggctatgttagccatgttataagtcctaagaagcaaggagaatgattagcaaagatcagtgaagggggaagcatacttctggttatgtcttaaataaccatgccttaatttaggtctgaagttacgcctaatcctgatgacgtgatggttgccttggttacaagccctctcacctggagattggcgcattctcactgtgcccctagagagttatttcatgcgaaagaaaccataactgcttatgattaatgtgtctgttgttggctggtggcttggttttggctcctgaagccactcgttagtctatcacttctgagctggagaaagttggggtggtctttttttttttttatcttttaaaaatcattttgctttttaattatttcaacttttatcttagattcagggtacatgtgcaggtttgtacctgggtatattgtatgatgctgagttttggggtatgactgatctcgtcatccaggcagtgagcacagtatcttcaatccttgtttctctccctctctcccctgcctagttagaagtgcccagtgtctattgttgccttctttatgtccatgaatacccagtgtttagcttccacttataagtgagaacacgcagtgtttggttttctgtttctgtactaatttacataggataatggcctccaactgcatccatgttgctgcagaggacatgatttccttctttttctatggctgcaaacaattcttgatgaacacagaatacctatttgtttttcaattaatttattgaaggtccaatttattgaaggtccactgagccacagagccttgaaaaagcctgaaaaacaagtagggattaatgccagggagtggaccgtgtgaaaaggtatcaatcatttgagaaatccaggccttccacagtctgccccatccctgacctgcggcctgttgtttgtaatgaatcttggggtctttctcaccagcctggataatctcacaccctatcaacaccccagctctaggcagccacaaccagttagtgggaatcctggctgggtgcagtggctcacgcctataatcccagcactttgggaggctgaggtgggcggatcactttaggtcaggagttcaagaccatcctgaccaacatggggaaaccccatctctactaaaaataaaaaaaattagctgggcatggtggcatgcgcctggaatcccagctacttgagaagctgaggcaggagaattgcttgagtcagggaggtggaggtgatctgagatcttgccactgcactccagcctgggcggcagagcaagactctgtctcaaaaaaaaaaagaaagaaaagaaaaaagggaattctcatagcctaatctttctagtatctcaatatgttaagtgaatggatgcttatacactcattcattcatccattcaggaataaatagatgaacatgagaccactgtatcctgtttgttcccccaagtcactctcagcctcctagttctttggtctgctctagggagctggagaaggagggggatggaagggccggcactggctgccctgggctcacctagtgtacctgggcagaggaggcagaagtgacagnnnnnnnnnnnnnnnnnnnntgggagccggaacacgggacagggaagacctgcctgacccctcatcctcctctgtcctcagtctccgtccctggtcccactctctcttgaaatgactgtggttgatcatccatttccattctgaggagtacagaagattttcctatccaaacttacctcccctcctttcttcccctccagcagcggacagccttctatctctttcttcacactcttgttagaatgccgttcaccaccttgcatttcactttcagctaaatctcgtaagggcagatactggttcattggccctgaatcttgaagttaatatagatatttcataatttggttatctggtgataatattcagctttcattgctgtaaaacatcaatgcactatttcaaaatatacaaaaaatgtggtcactgtgtgtactctgcttcatttcgtcctgtctcccttctttctgcactgatagggctcattttggaaggctttggtctgtaagactttctaagtaattttcaagcatgattcagaatggaactattaaatactgtttcccttcccttaccatcacatacccagtttcttctaaatgcctgaaacagaacttacatttccataaaaaggaaaatcacatgagaagcatatgggttaaatataaaataagttttttaaaaaattccaaaagaacccaatgtagcctgggtagtttgagtgtatttgtgtatatttttagttctcttccttggaagaaaatctacattacaatttggtggtattatttggcatagttcttgtgatttaatattcatgtgttaggcattttaaacaacataataagcttttgagaagaaaggtatgcattgtcttgcttaaaaatgtaaattctgtcagggattgtgttcttagaactaagtttgttctttctgcctgagaaatgcagattccacggagcctgctatgtcaagcatggacaaagtagaagcatcattctgattatgatgggaaacatcactgattcattgtttctgttgacttacttgctatttttaacactctcaagttacctgaacatttttctggttaagtcacattaaatattaatgttaagtcaactaatccattctttttttttaagttttttttgagacagggtttggctctattacccaggctggagagcagtggcacgatcttggctcattgcagcctccgtcccccaggctcaatccatcctcccatctcagcctcccgagtagctgggacaacaggcctgtaccaccacaccctgctaatttttgtgtgtgtgtttttttttttttagagactgagtttcgtcatgctgcccaggctagtctcgaactcctgagctcaaacggatccacacacctaggcctcccaaggtgtatagtcccagccactcaggaggctgaggtgggaggacagccaagcccaggaggtcaggactgcagtgagctgtgttcacgccactgcactccagcctgagcgattaagcaagaccctttctcaaagaaacaaaaacaaatgtctgattatgaagcttgtaccctaacccactgcactgtctgggattacaggtgtgaccctctgcaccctgccaactaatccatcttaactgttggaaacacttcccaaattcccatatttaataaaaatccccatgtcattctggctttcaaatcatacttttgggtagccttcaaatttcatcagtcatattgtgttcagggacctgtaagattggttcgatagcctgaaggttacagttttgtcagtgatattatagacgttagtcactgggtgctgagtgttttgtgtgtattatcttcttattcctcacagaaattctatgggacaagttcctcgcccaggatcatacagctagtaagcgacaaagccatggttcaagtatctgattgcaggccagggcacagtggctcccacctgtaaccccagcactttgggaagccaaggtgggaggatctcttgaacccaggagttcaggaccagcctgggcaacatagacctcttctctacaaaaatttaaaaaaaattagccagatgtggtagcatgtacctgtagtcccagccactcgggaggctgaggtgggatgatcacctgagcccagaaggtcagggctgcagtgcaaccttaaaccaccgcactgtctcctcttaagtcagtgcaagtgatgctgatttcatttatttactgtgtcttggagaatcctcagtgtgtcacagaatagggacaagcacagtcctggcatcattggctactctggctgagggagaggcagtagccaggcctggcctggcccagagggttccacaggagggacagtaggatgcacagtgcgtgatggtcccctggttatggtgagacccctctcttctgccagttgtcttgggatgttactattttcactatcactttctcttgtggggagagccttttcttccacatgcttcaaactttatcttttttttttttttttggcaagcaaaataaatgtcaaataaaggtcagaggcagcctcgaaggggaacactgtcagaaagggatcccgaggagaggaggcaagaggggagggacaaggcctggtttggcttaatggactaacaatgcctataaaaaacctctggtcttcatgtttttaatgtagactattttttagagcagttttagcttcataggaaaattgaggggcaggtacagagatttcctatatacctcctgccccccacacatgcacagcctcccccactagagtggtacatttgctgcacttgacgagcgcatattgacacattggggtccactctttgtgttgtacgttctatgggtttggaccaatgtatcctggcatgcatccaccatgatagtctcctacagggtagtttcactgccctacaaatcctctgtgctctactcaccccttcctctctctgaacttctggcaactactgatctttctactgtctccatagtttttcctggtccagaatgccatagagttggaatcatacattctatagccttttcagattggctttgtttacttagcattatgaatctaagtttcctccatgtcttttcatggcttgatagctcttttctttttttattttttcagacggagtctcattctgtcacccaggctggagtgcagtggcgtgatcttggctcactgcaggccccgcctccgggttcatgccattctcctgcctcagcctcccgagtagctgggactacaggcgcctgccaccatgcccagcaaattttttgtatttttttagtagagacggggtttcactgtgttagccaagatggtctccatctcctgaccttgagagtcgcccgcctcggcctcccaaagtgctgggattataggcgtgagccaccgtgcctggccagctcttttctttttaacactaaataatattccattgtgtggaggacatgggggatttgtttatcccttcatttactgaaggactcttggctgcttccaagttttggcaattatgactacagctgctgtaaacatctgtgtgcagatttttgtgtggacataagttttcaacttctttgggtaaataccaaagagtatgattgctggatcatatgataaccgtatgttcagttttgtaagaagtcatcaaactgtcttccaaagcagctgtacccttttgcattcccactagccaagaataagagttcctgccacccacccccatgctcgccagcatttggtgttgtcagtgttctggatctgagccattctaataggtgtgtagtggtgtctcactgttgcataaattctcacttccctaatgacatatgatgtggagcatcttttcatatgcctgtttgccatctggatatctttggtgaggtgtctgttaaggccttgggtccattttttaatcgggttatttgttttcttattgttgagttttaagagttccttgtttattttgggaaatagtcctttgtcagatgtggcttttgcagatattttcttccagtctgcggcttgtttcttcattctcttaagcctcggatctttttaggccatcttgggtaagcctcatctgaaccatccctccccttttcatactcccttactagccaccagcaagggagaggtccctgctaactgcagaggtccccgttgagtttctaggcattcagtgggaagagttaccctcctgggatacgtatcaactgcagaaaccatgagaaccatgttgaaaaggagacccacagcacccacctgattatacagctgccaacatggtgacctattgatgtcaccatcgcagatcagatgtgagctctctgatgtgaacaactaatctgttctgcaatacagaaagcaaatgttaaggaattcttacttttagcaaggacagttcaggactgaggtatctattagataaggatattaccaactaattctaagccttgatctactctcatgctacattcaactcacagcagacttgcgtgatgagaaatgagactgtggggtttaatgtagaattatatagatgagtgttgtaaccgaagacaatcatatgattgaggacttcggcagagcaaacagaagttggttagatttccagagaaagtgccctttcagtctttaagacgcattgagatcctctaacaagacagggatggaaagataatactactcttcagtgtatttcatgaatctctgtgtccttgggagttccgtgagcacggatattactttctgggaggaggaatgccaccattgcacctgtgactgactctttgctatttccctagcattttcaaatctatcatcttgtttgacccttatgctatcctgctgaatattcatgtgctcatttgttcatttatttaacaaatgtgtattattaatatttgcttgctctacgcagttgcacactgccaggccagcacagcttgatacagattgggagagttaggtggtttgttccaaattctcaccactagtgagagccaagtctcaggacaagacccaagagcttctagactcctattctctgccccacatttctgcccctcctgaattcaggcagccattaatgcctccatccctctagctaccacttattcacctctgctcttcagagactgaaacaccacaatgacattgatgtcattagattgctttccggtgaatctggattatgacgtgccatggaaaaagaaggctgtttggcagttttcatccttgaacagtgtcagtcggtaaaggggaaaaaaaccaatcacagaaacctggcgtgctcacgtgcagagcacctgcaagctggtgtttgtgatgcagccaacctggcctggagagagggcttagtcaattctgtatggagagtgttgcttctgttactgttattattgtagtaggtactcaatctatctccactcaacccacagattaacccacacccgcccaggaagctgactgaagcccatagcacactgattattcacaactcttgggtcactctggaatacccagacccttctgctgccacctgctgaatggccatgttttctaaagtccatgggtgctcccagttctgtgagtgtgagctgatcttgtcattcaaaacattaactattacgttaactggcaagaaaaaatgagtttgataatcatgattatttctatgaaaactactgaatactttgggatgattcggggaatgaattgctaaaacctttttggtattgaagttgaggtgaatgacacaaccgtgaaaggtggaaggaagaaaactctagaaggctcctgcacttagactgctttttggcaagtgacttttggttctctttccacgttaaagaacccaaaactagaaattgtaggtaaagcattcaagatacaattggtacaatcagtagacccattcgcaaaggacaggcccgttttccatcagaaagttggtgttttgcagcaaggggtgggtggcttgaacatgagggaaacatatcacaggatcagtattttagaagcataagtggagagcttctacaactcagttttactgaatatttagtagagaaaatctgattagcaaacacttctgtaatattgaaaaatgtccaacttataagatgtcacttccgaaaacggtagtgctagattagagcctcagtggggaaagttcccagagtaatgctcctaagagttgcccgcgccttcaggactggtgacataactgacatagcccagtggaaaatgaaaaattttccccttttgcaaaaattaataagaatttcatgatgacagcaaagcatttaacccagcgtggagctcttcagagcataagaccttgtgcggctgcacaggcccatggcgaccactctgctgccacttaagaattgccacgtattgtgtgattggcacatcagtataacttttttaaaaaaggtttagtctctatcagtttactatatctcacaagagtcaccatgcatggatagacttgaccaatggttgtttttgtcattaattttaggtttgttaaagaaacacttgaagaataaacttgttttagaatctcctaaatctttctaggtaactgtcctttacatcttaacggtcaggaatttttttttttttttttttttgagagagtctcactctgtcgcccaggctggagtgcagtggcatgatctcggctcactgcaagctccgcctcctgggttcacgccattctcctgcctcagcctcccgagtagctgggactacaggcgcctgccaccacacccagctaattttttttatttttagtagagaccaggtttcaccgtgttaaccaggatggtctcgatctcctgacctcgtgatccacccgcctcggcctcccaaagtactgggattacaggcgtgagccactgcgcccagccaatggtcaggaatttaaaggcctagtttttgcccttccacaagcctcacggccttccaaaaataatattctttttttttttttttgagatgggggtcactctgtcacccaggctggagtgcagtggcatgatcacagatcactggagcctcagcatctctgggctcaggtgatcctcccacctcagcctcccaagtagctgtgactacaagcgtgtgccaccacacccaactaacttttttgtatttttcatagaggcagggtttcaccatgttgcccaggctggtctccaactcctgggcttaagcattcacccacttcggcctcccaaaatgccaggattacaggtgtcagccaccgcgcttagttccccaacaataatattcttggttcagtccatgaaacaaaggattctgaaatgtttagatattctacttaggcaaaagggtttgaggtccatctgaaaaaagaaaacaaaaatgaatataggtcctatagaatatttaggttatcagtatcaaagatactgtttgccatggagcaatggcatggaatgaaattctcaagatgaaagactttacacaaaccataggttttacctggattcagactcatcagaggttctcacaagaaagaagtaaacaacaatggattcatgatgatctgttgaaaaataaaatttaaaatggcagagaaataatatataccatgacataagcagataaatcagtgaggaggataaagaagagatgagaacgaattcaaaaccataaatccatcatacagtggctggagatatcctctgtgcagttttacgtgatactgaagagcaacagaaccagcaggcgatgatgtcgtagtgagaacacctcatgatggatggttttgcatttaatctcatctcttctttattctcttcatagacttatctgtttgtgtcatggtgtatattaaaactagaggaactaggtcaagaataatcatacgactaagcaactttaaattgcttattttattaaataaacatggtatgtttttaatcagaatagaattttcattgtatgtgctttttttaaaaaattgaatgtcccattccatgtactttttagttttcactttgactttttctattaaccaagtagtgatttctctaggaggacttaactgtgttgctacgcctacttctgttgctgctacggtagaagcctttttatcagcccctggtcagcagttgctgagttacttaaaaatgtcatcttacaagttcatctcttaaatatttttttacttaaaacatataccttatagttgacacactgattattttatagtataagtctgtatgtactggctgattatagtttcctgagtcccttttttttttttttttttttttttgagagagtcttgcactccacccaggctgggtgcagtggcgcgatcttgactcactgcaacctccgcctcctgggttcaagcacttctcctacctcagcctcctaagtagctgggattgcaggtgcccaccactatgctgagctactttttgtatttttagtagaaacggggtttcgccatattggccaggctggtcttgaactcctgaccccaggtgatctactcgcctcggcctcccaaagtgctgggattacaggcgtgagccaccgcgcccggcctcctgagccctttttacattaaccacaccaccttaatttccagtttcgatttcttcaatgtgaaatgagaaattacagatatttgagagcaaaatccttctggagttttattatttccttttcctattctttttcttcctttctcacttctctgtggccctgggaactgtctcattgtcatatttgtgttctagaatattttgagtgataatgtcggtgctgtgtgttttgttttggttttctgcggggggagtggaaccagcttgcttctgtgccgccattttgaaaccagaagtccttcctttttctttcttttttcttagtttccttgcctacaccaccacaccagttgaacagtttgtggtgattgtttcattttgtttgtatgtttgtttgtttgtttgtttgttaacttttatttgggtccttgcaaagcattcactttagttttcatagaaacatttcccattttttctcactaatatttcactgctttacctaatatgtaattaaatttcctgatgagtttatctggtgacaacagacttgagaagtaacttggtaagtggtgggagcagaagggcgtagatacagtggtgagcagaccctcactggagtacgctgcatgcctggcaatgtgtggagagggggtggagaaggtgctgggtaggtggtaaacaggaatgccaacgggcctccctcatgctaattgggggttcttagacaagtcctgccactgcccatcttgaaggacatcccacacaactgcccatgggagaaacagcatgaggcacagacctccttccaggactttggatttgttgctcatacttgaaatccttgtgtcttcatgggcttttccttgtgttttggtcttggcttctctagaggttacccagtgggtcaggggaaggctcctcaaaggaatttcctacatgcgtatcggtattttagtcaggccatccaaaacatgccttccaaattcgaggaaaatctcgtgtggagtggtaacaaaaacttcattttatttgtatgaattattactaagctgagtcacaatggagaagaaaaaggggtgaatcgtgaggagccattttgacattcctggcccctgatcaaatggaaggattctgtttgtgatgctgagtgttggggtgtttctagatctgcttggtttgtggcactttcctagaccaaagtctaggaaatttctgtctttaaaatggaagaatcgtaagagctagcaggttgcctaacatttgttggactttgtttgtttttcaaaaggcccgttgctgaaagactggccacatctagtcacccacaaagcaatgatgctagaaccccttagggacaaaacacccttcagagttcagaagggaaaagtgatttataggactttttttttctattttagttttgtgaatctgttttgtttccgggagtaattttaatgttaaggaagtggattaatctctactgaaagctgagcccacgtggccccatgatcctccagggctgagttgttagggaccatgaggaaccaaggcacccacggtgatggggcctcagatgtgagtccagagaggagagcagactgaggtctccttccttagctgtgcttgttctgtgttgaacacacacacacacacacacacacacacacaaatacacatacactctctctctcttttgtaacatctgaatcttgtctgtgattctgtaatcttggtgtgctctcttgccagtatcccagagtcccacctcacaagcaaatggtaaagcatgagtctgcccctaggcttgctcatttctcatctcttcctctcccctccttttctgttcctcctctcctcctcctcctcttcctctcctcctccttttcctcccctcctcctttcctgatcctcctctcctcctcctcctcttcccctccttttcctcccctcctcctctcctcctcctcttcctaccnnnnnnnnnnnnnnnnnnnnnnnnnnnnnnnnnnnnnnnnnnnnnnnnnnnnnnnnnnnnnnnnnccctctccctcccccttcccccctccctcctccactccttttcctcctctcttcctctccccgcctcttctctttacttcttttgtcttttttctcttccattcctcttttctctgccccgccttcctccgcctcagtgggcctggagggttacagtgtggttccctgtggccccgggctgtgggaatccggggagccgccctccactccccggaaccttcctctcggcagaccctgcctccgggcgctgactcaccctccccgtgttctcccttcctctccccgcaggaaatgtgactggaaacagtaactccacgttcatctccagcgggcaggtgatgaacttcaagggcgacatcatcgtggtctacgtcagccagacctcgcaggagggcgcggcggcggctgcggagcccatgggccgcccggtgcaggaggagaccctggcgcgccgagactccttcgcggggaacggcccgcgcttcccggacccgtgcggcggccccgaggggctgcgggagccggagaaggcctcgaggccggtgcaggagcaaggcggggccaaggcttgagcgccccccatggctgggagcccgaagctcggagccagggctcgcgagggcagcaccgcagcctctgccccagccccggccacccagggatcgatcggtacagtcgaggaagaccacccggcattctctgcccactttgccttccaggaaatgggcttttcaggaagtgaattgatgaggactgtccccatgcccacggatgctcagcagcccgccgcactggggcagatgtctcccctgccactcctcaaactcgcagcagtaatttgtggcactatgacagctatttttatgactatcctgttctgtgggggggggggtctgttttccccccatatttgttttccttttcataacttttcttgatatctttcctccctcttttttaatgtaaaggttttctcaaaaattctcctaaaggtgagggtctctttcttttctcttttccttttttttttcttttttgggcaacctggctctggcccaggctagagtgcagtggtgcgattatagcccggtgcagcctctaactcctgggctcaagcaatccaagtgatcctcccacctcaaccttcggagtagctgggatcacagctgcaggccacgcccagcttcctccccccgactccccccccagagacacggtcccaccatgttacccagcctggtctcaaactccccagctaaagcagtcctccagcctcggcctcccaaagtactgggattacaggcgtgagcccccacgctggcctgctttacgtattttcttttgtgcccctgctcacagtgttttagagatggctttcccagtgtgtgttcattgtaaacacttttgggaaagggctaaacatgtgaggcctggagatagttgctaagttgctaggaacatgtggtgggactttcatattctgaaaaatgttctatattctcatttttctaaaagaaagaaaaaaggaaacccgatttatttctcctgaatctttttaagtttgtgtcgttccttaagcagaactaagctcagtatgtgaccttacccgctaggtggttaatttatccatgctggcagaggcactcaggtacttggtaagcaaatttctaaaactccaagttgctgcagcttggcattcttcttattctagaggtctctctggaaaagatggagaaaatgaacaggacatggggctcctggaaagaaagggcccgggaagttcaaggaagaataaagttgaaattttaatttgcattttttttgtctagataagaatagcgtgaatagatcctcttttattcgtaaataatcgtgcatctgtgggttagccttgtagaagtggaaaacattccattttccaatgcatttaaatgtaaagccaaatctgcatgttgtgaatttaagaaaacttattatcctaaaggtgcctttctcttggcatcatcccgcttgtgagaagcctagaggacgctccaggtggaaggaaatcccctgggtggttttatcttttgttacccagtgagcactggttccccgcaaatactggggaaaagcaaaaatacacaagcaagttaaaattaattttgcacatctgggaggttataaaagaaagcactaatagtagtcactgcccagactttactggccacaaatgcccagctgaagagcatgactgtggatcactggtttttccctcctgctggaaatgctggggtggtagcggtcgattaggattttcagtggagaagcacaggacagttctgtaatttatgggactccttagccaacataaagaactgcaggaaataactgcacagccaggaggatccgttggtgggaatttaccgtcattcctgcccttttatttaacatcatccacagagagatgttatacaaatggaggaaaccattataccttttgatatggaatatattacagagttacagttcacaaagtagaatgctgagctgaaaacccgagtttctgctgtgactgtcatctcactgagcac

SEQ ID NO: 15847 - DNA, 37565 bp, Human
cggtctggtatttcagaccatttcatctagacaagtctaacattaagtgtagaaaagcctgggttaaaggctgttgaattctaaatggggttaggggaatggtgggtttagaggactcaagtaaacaaataaaagaggacacgagccgttcttggtggtgcagtccccctccctgaaaacacatagcccagcctgacctgagccaagtcttctggacaattctccactgactgcaaagcattccactcttcttccatcacctcttgaactagaaagctgttctgagaattccctggcccactgcttccagcctggcggtacctgtttaggagcctgtcccggctgtttctcattctctccaggcatctctgggaaaaaagagcaagattgggggggaaaaaaaaagcatttctatttttaaaaaacactcttacattagttgagaaaacattaaagaaagtttatagacacaaaatttcaatgataatactaactagtgttacttttgcatattcctctgtagagatacataaaattacaatgctttgtacacgtatttacaaagaaccatattttttattctagcttgccagtttccttaatggttgtgtgcataatatctcagcatccaatgtcctattacagaacatttatattccttccaaattcttgctactctagatatggctgggtaacggccttcctgcacagcagcgtttctgaactcagggaggttttgtcccccaaggaacatttggcaatgcttggagacatttctggttgtcacaattctagttataggactattagcatctagtgggtggaggcccgagacgtggcttaaacaaccctccacaacatataaatatctccctcaaaatgtccattgtcaaggctgagaaactctgctgtatctgctatctttcttgcgtcgggttactttcttggacattacttactaataaccacactgtgttcagaagaggccagaactgaggtggagccctcttctaagcctcattttactactctctagaatagaaatcatctctatctcacaagacgaacgtagacaaagtgcctctctcggtggccacctccgcagcaacagtaggtagtgttattgcagaggtgcaaacggtgatgtcctgaccacaatttaaattcaaaacaaaatcgaatccaaaaacaaggctttctaggacttgaccgacccgggctaatcccacactctacagtcagcaggcctgggtttgaccagaccaggcgcgctgcggcacctgctccacggagcagggctaaggcgaaggcagggaagacggcggtcaccgggacgatctagggtagaccactgcacaaaccccatacccacctgccggaaagcctctttccaaggcggcgagcccaccagtttgtacagggagcggcgcggagacctcaacgactccgccatctcctcttcgcgggagacaaagccacaagacccgttccctggaggcgcgcacagacccctgggaggtgtactttccgggtgcagaccgcgaatggatcgcagcgtattctgggaagtgttgttttatcgaccggccccacgtggagacagatttaggcatccaagcgaaatgcgtgaggccagcccgacctgcactgagggaggtaagtcttgagggaaagttctggatgcctgggtttacccagatggaggtgtccaataggcaattagatacacaagtctcaggctctccccaggtgctagatttccagcagcaccaccattatgttgacttctcgtcccgcccccttgggcttcagaaataatggtgattggctttcccttggtgacgcccctgcttggtgggctggcctcgccttcgccccccgacctggcacgagcctctcgagcttccgggccgtctgctcggtgattggccgaaacagtgagtggacggccgcggattggctgtgctcagcggcgggctgagcaactggagtgaggggagcagttgggccaagatggcggccgccgagggaccggtgggcgacggcgagctgtggcagacctggcttcctaaccacgtcgtgttcttgcggctccgggagggactgaaaaaccagagtccaaccgaagctgagaaaccagcttcttcgtcgttgccttcgtcgccgccgccgcagttgctgacgagaaacgtggtctttggcctcggcggagagcttttcctgtgggacggagaagacagctccttcttagtcgttcgccttcggggccccagcggcggcggcgaagagcccgccctgtcccagtaccaggtaatgccaggccgatcttggaagtgaccctcaccgggatcggaaccagtcttttttgttccttgctcctcttggctgtttttcatcttgtggcaggcgttccagcggattgactccgacgctgccatacgcggtcgcggggactcaggctctctcgatgcttacggcctggaggcctgggaggaaggaaagggtcattgaatattcaataaaaatactagtgacggatgagtgctctggagaaaaacaaagcgggctaaaggggttgagaacgagtgggcggagttgctatttttagtttcgtcgagagaaacctgtttcctgatgtgacgcttataataggttagatcgtaactttctcttgcgttgtgcacagcaagtcaggttgcaggtttcaaagcaccacgcttcatgcttgacatggaggaggaagtctctgttaattcttacccccgtaacgcccgctttagaaaataaagccatacccaaaatggggatttttgtttttgattagccgacagcatgtgaaaatgggtgtgatccagaaagtattacacacttgccgtggtcaaatattggtttatggaaatgtttatttgtaatacacagattctcttaaagatgaaaaagagcttggtactcattctaaggtatgacatctgttgtgtgcccggtccaattcttgttaccgagaagtgatttaattttaataagacgctagcaatgcttctgcagttttgaaaatagggcaggagtctacagtctacttatttacccaatttcagttaaaaagaattatgaaggccgggcgcggtggctcacgcctgcagtcccaacactgggaggcagaggcaggtggatcacctgaagtcaggaattcgagaccagcctggccaacatggtgaaaccccgtctctactaaaaatacaaaaattagccaggtgtagtggcgcgcccttgtaatcccagctactcaggtgcctgaggcaggagaatcgcttgaacctgggaggaggaggttgcagtgagctgagatcacgcccctgcactacagcctgggcaacagagcaagactgtgtctcaaaaaataataataattaccaaatgtgcagcacgcagtattctaataacattctatactgctgtgtagcatttgacataatcataacttaattatttataattattttgtgtcttttttttttttttgagatggagtttcgctcttgttgcccaggctggagtgcaatggcgccatctcggctcaccgcaacctccaccttccagtttcaagcgattcttctgcctcagccccccccgcgagtagctgggattacaggtatctgccaccacgcccgactaatttttgtgtttttagtagagacggggtttcgccatgttggccaggctggtcttgaactcctgacctcgtgatctgctggctttggcctcccaaagtgttgggattacaggcgtgagccactgcgcccggctgtttttgttttgttttgttttgaggcaggatctcgctctgttgcccaggctggagtgcagtggtgcaatctcagctaactgcaacctccacctcatggattcaagcgattctcctgcctcagcctcttgagtagttgggattacaggcccactccaccgtacccggctactttttgtatttttagtggagacggggtttcaccatgttaaccaggctgatctggaactcctggcctcaggtgatccacccgtcttggcctcccaaagtgctggcatttcagccgtgagccatggcactctgcctctgtcttcttttctagactgtaagctccaaggcaggggctgggtctgcccttgtcattttttaaaaacgtattttattttttatttttgaaatggggtctttctctgttgcccaggctggagtgcagtggtgtgatcacggctcattggagcctctactgtcaggggtcgagtgatcctcccacctcagcgcctggaagtagctgggactacaggcatgtgccaccacgcctggctatttacttatttttgtatgtccagcatacagaaatgctggagtgcccagaatttataagctttcagtaaatattggtgactatctcaataaccttcactcctccaaaatctcaaaaccttagagatggggaagaaagcagcttatcatgagttgtaactttggatgttaaaagcaagcatgagtaagctgggtgtggtagctgtagcctataatcagcactttaggaggccaaggtggaggcaggtggatcttgtgagcacgggaacaggtgttcagaccagcctgggcaacatgacgaaacccccatctctacaaaaaaaacctttttaattagctgggagtgatggtgcacacctgtagtcccagctcctctggaagctgaggtggggaggacacttgaacccccatagtaaagtctgcagtgggctgccactgcactccagcctgggtgacagcaagactctgtctcaaaaaaaaaaaaaaaaatttgtgagttaatggtacaagtgtgagtacttatccagagttttattatcctataattgtagtaaactaagtattactgtgatttcaagtaactgccacctatatttaaattaaaattaactatgttgactggtttgctctaattttcagagattgctttgcataaatccacccctgtttgaaatctatcaagtcttgttaagcccaacacaacatcatgtagcacttataggaataaaaggacttatggtattagaattacctaaaagatgggggaagaattctgaatttgaaggtggaaaatcaacagtgaattgtaggtaagttgtatactatttatctgtataatttattatatatacagaaaattgttcaagactagtggttcttaagcatgtttagtatactactcttaaaacattaaaacactcctcgtggtctgcagactggcttctgtgttatcaatgttcatagtatatgtgtaattgattgtactttattctgcctgaagtaccacgttgctgtctcatttgaggctaggccattctttcgattaggtagaagtaagattttgtaaaaccagttatctgtcagccagaagtttgccagaagtgtaagtattttatgtgtgtgtgtgtgtgtgtatgtgtgtatatatatatatacttttttttttttttttttttttgagatggagtcttgctctgtcacccaggctggagtgcagtggcacaatctcggctcactgcaagctccgcctcctggattcaagcgattcttctgcctcagcctcccgagtaactgggattacaggcaagcgctaccatgcccagctaatttttgtatttttagtagagacggggtttcaccatgttgaccaagctggtcttgaactcctgacctcaagtgatccacccaccttagcctcccaaagtgccggggttataggtgtgagccaccgcacctggcctatttttatataatttctttttcaacaaatccagaaaagtgaatctgaaagatctactgaaaagagtacagatgcttttcaacttacgattgggttatgtcccgataaacccagtgtaagttgaaaatggatttattgctgacaacacagcagaggatccccgatttaggatggttcaacgtaggatttttcaacattatgatgggtaaccccatcataagtcgtaaggagctcctcagtttatgttggcttatgtactggtaaacccattgtaaagttggggatcatctgtataaggtagaaactgcttttagctccgcaacttataagttgagtccccttaaactgtttaccttctaaatctgtttcctcattttaaaaataggattgataatatctgcccttgtaatttccttacagggttagtaaaaagatcaaatgagatactatatctgaaaacacttgtactgtataaatatgtatcaatcctaagtcaaaccatcctaaaatgtatatatacgtatgaaatatgctataatttggagccaggcacgatggctcacacctgtaatcccagcactttgggaggccgaggcaggtggatcacctgagctcaggagcttgagaccaccctgggcaacatggtgaaacctcatttctactaaaatacaaaaaataagtggggtgtggtggcacacgcctgtagtcccagctactcaggaggttaaggcacaagtattgattaaatccaggaggcggaggttgcagtgagcaaagatcacgccactgcactccagcttgggccacagagtgagacttcatctcaaataaataaacaaataaaatttaaataaataatttaaattattaaaataaataaattatttatttattttgagacagagtctggctctgtagcccaagctggagtgcagtggcgtgatctcagctcactgcaacctcctcagcccgggctggagtgcagtggcacaagctcagctcactgcagcctccacctcctgggttccagcgattcttctgcctcagcctcacgggtaacgggttacaggcatgtgccaccacacttgcctaattcttgtatttttagtggagacggggttttaccatgttggccaggctggtctcaaactcctgacctcaggtgatccacctgccttggcctcccaaagtgctaagataggcgtgagccattgcgcccagccagtgtgctataatttagaagatatttttatttcaattctttgatattgattgaatagatgccttgaatgtcctctcagcatgatttcagggaaataaatctgaaggaaagagaatcaaagagtgttaaaatagaaatttcttcagggcctggcgtggtggctcatgcctgtaatcccagcactttgcgaggccgaggtgggcagatcacctgaggtcgggagtttgagaccagcctgaccaacatggagaaaccccctctctactgaaaatacaaagttcgctgggcgaggtggcaggtgcctgtaatcccagctacttgaaagactgaggcaggagaatcacttgaacctgggaggcggaggttgcagtgagccgagattgtgccgttacactccagcctgggcaacaagagagaaactccatctgcaaaaaaaagaagttcctttagaagattttcatccaagttgtacaaaatgttttggaaaattattatctttattttagtaccactccagttgcggagagatttttcaccagttccacctctctgactctaaagcatgctgcatggtatccaagtgaaatcctggatccccacgtagtgctgttaacatcagacaacgtaatcaggtaaattttatttctctctcttgaagccttgcgagtgggaaagctctgtttctgtttgccaattaacagctcaacatagaacgaagtgagtcattgaatgagtcagtgcttttattggatggctgttgtaacccattctcaatcataagaattgcctaactgctctaacttaccactattccttctcaactagtcttcctgcctccaggtatctcctctcctaatctgacaccttagaataatctttccaaaactctttcatcattgtcacccttttggtaataatgtagcataaaggaaagagaatgtaagtgtaaatttagagatttgaattattgtcccacctccttttctgttatctttgagatcttgagctttttaggggttggggggctcagtttccaatcttttaaattgagcaggtttgattcaatagtttctaacgccccttccaagctttgcactctatgattaaatgccctaatgctacgtagatttctactctattatcagctaactttctggatcggccttatgtaaaaagttattggggggactcagcagaggtacagataccttcagttttatttttcgtaatcactgcttttaactgtgctctactaaatcttccttcactgctgaatgactcaccccttaatgatgtcttatacagatccccatagctttctcgttacttctagttatgaaaacagtgtgtccagtttaaaactcatcttggctggttgcagtggctcacacctgtaatcccagcactttgggaggccgaggtgggaggatcatttgagcccctgagttcgagaccaatgtgggcaatacagtgagatcctgtctctgcaaaaaaaattagctgggcataatggcatgtgccggtagtcccagctactcaggagactgaggtaggaagattgcagcctgggtgacagagtaaaaccctgtctaaagaaaataagaatgtcgaaagctatttgatctcaaatctttcacaactatgtcctggcccttttgtaggtcagacctgtgttttgtgggatcagaagtgattggagagtgtgcggtctgctctttcactcttcctgttatcccagcactttggaacatagggtgaagtgtaaggaatgggctgccccctccttcctccaaatctaactccttcagtgtggggtaggggagtgggacaggtgaggtagagatcttaccgaactggtagcctgtgagtgatggggaagtatgcctgatcttgtttgaatctcgttccatctgtcactagtgaactctgttgatgtggtagtctctgcatagatggtgtgtttgtgtgtgtgtatgtgggggggtggggtggtgttggagggcagtgttgaacttccagctccccccatcactgaggagctctggctcccattggctcctgtcagttctctatgccctgaatcttctctcaagatggggtacagtatactttatctgcagggtgtgtgttccaagaccccccagtgaatgcctgaaactgtagatagtactgaacgtgatacgtgtgtattgctatgttttttcgatcttataactgagacagctactaagtgactaaggggcattcagctaggaaatgcaccagtctcccttattacaggtacctccacatctggctgtttcctagagccttccctgcccacccatttggctttagagttcagggcagagaaagaggagagggaaaatcttcccattacaaacattatactgtactcctaaggaatctttgacatcctctcttcttagtcttccttttatatgctatgatggaaaaggagatggtgggaagatagcataggtacagttcttaagccccaaaggaagtatctggccccaaatattgaaggttcttttttaaaatatgtggtatttaacacttctgttttcctaagctttggagattttgggcagtttcagagcaaaaggaaattttcaccgaatgccctgttgcaccttctttttctttcactgttccccagtacaacattattgcctagtatttatgtgtattttgaagttagtaacgcttgtaggaacctaggaagactgtaataaatgtgtattcaaatggatcaagttatcattaaaaatttattaaatacttaatgtggcattttattgatattggaagaaaccaagttaaaaaattcttagtggcgtcagacaaaataagtgattataagggacactggatttctaaaatgacattactggccttttgaaaattccctttttcacaatagccttatatgctgtgaaatgtaggttactttaaattaaaataattttggttaaaaaaattcagtattatactttcccttgaaaatagagatgatacgatactgggtttgtttgtttggtttttttttttttttttgaaatggagtctcgctctgtcgcccaggctggagtgcagtggcgtgatcttggctcactccagcctccagctcaccgcaacctccacctcccaggttcaagtgattctcctgcctcagcctcccgagtagctgggattacaggtgtgtgccaccacacccaaataatttttgtatttttagtagagacggggtttcatcatgttggccaggctggtcacgaactcctgacctcaagtgatctgctcacctcggcctcccaaagtgctaggattacaggtgtgagccaccgtgcttggccaatattgggtttttatataacaaacacataagtagatttgcaggctaaatatcactcactctgtcagccagttggcatataaagaataagatacagttctttctctggtgggatttggtgtccaataggcagagatagatgtgtgtagttgaaggaaaactggcaagcttaggggcaatagtgagatgactggacaaggcgagtatagctaagggctcaggacggaagtgacagaggtgcgatgttatggaataggctgttaaagggtattggtaaggatagagaacatttcttcaggccccaatgaaactcccttatgtagttaaagaataaatgaactagactactttgcaacagcaagatttttgcaaagaaatagttgtgataagtgttagaaaattctcaagaactgactagatggagaggaaagtgcagttttgggaaatgaaaacagaattttaagtgctggttttcttctcttttggttgctagaatttactcactacgtgagccgcagacacccactaacgtgataatactttcagaagccgaagaggaaagtctagtactcaataaagggtaagtttttatttgagtcttgaaatggttttttaattagcttattgggattataaatgcaattttaacaggttgcaaggtttttcagaggtgactagcatgcttttggtaatgtgagaagtaagtgtatttttagtagaacagggattcgtcgtgttggccaggctggtctggaactcctaggctcaagtgatcctgctcgtctcagcctccccaaagtgctggaattacaggcctgagccaccattcatttctttatcacctttctatgtgataaagaaactaagataatatcttgcattgatgtttgctctctcaactatatgaaattgtgatttcattttaaccatatttgttaactttgtattgaactagaatcttcctgaataactacagtaaattttaaatataaaaacagcatggttttatgatttgccttcttgatatacatgtaatgtatatttgctgtagaaaattgagaaaaatagatcaaagtattaggaagaaaatgaaaatctttgtaatctcctatagctatagcctgtttcaatacagcacccaaagtttaatcacatcattctactttaatctaagtttaatcagatcagtttaatcagatcattctacttccctgctctccataccccattgatttcccagagtctttacctataaagggtccacaggtatgccacctgattgcctttccagcttcattcctccctctgtgccctggctctctgggctccaggcaccttggcctccttgccattccacagacattaagcacttctaccttagagcatttgctctccacctcaactgctccttccctagttaaccacagacttgctctcttacttccttcagatctttgctcaaatatcttatcagagtctttcctataccaagtagtctaaagtagcacctccatcaataccctcttaccctactttatttttcatgatattttctgagtttatgttccatctttatttcttctctttttgtggtatttctctctctagagggcaggacatttgtttaattcactgacatattcccagaccctagaaaagtacctggcacagagtaggtgctttgcgagtatttgtagaacttacggatcctgctgctcagagacaactgttgatgttttcatgtgttttcctgtttcctttttgcatttatgtgtgtgtatataataaatttttgctatttgtatatctgtgtatttaaactatttaagatgagagtagaaccaaataattttatggccagcttttttcacttaatttcatgagaattttttttttttttttttttttgagacggagtttcgctcttgtcgcccaggctggagtgcaatggcacaatctcggctcactgcaacctccgcctcccaggttcaagcaattctcctgccttagcctcccaagtagctgggactacaggcacctgccaccacgcccaactaatttttgtatttttagtagaaacggggtttcaccatgttggccaggctggtctcgaactcctgacctcaggtgatccacccacctcggcctcccaaattgctgggattacaggcatgagccactgcacccagctgagaatttttaaatgttaacattcttcataatcattttttgtcttttcagtccattgcctacaaattccatacatacccacctcctgttattagacattttgtgtttttgttttgttttgtttttctttttactttttgttgtttttgtttttaacaagttggtttttacatctctttccagaagggcgtataccgcatctctaggagagacagcagttgcatttgactttgggccattggcagcagtcccaaagactctatttggacaaaacggcaaagatgaagtagtggcatacccactgtacatcttatatgaaaatggagagactttcctgacatacatcagtctgttacacaggtaagttgaggtggtcacccacctgaaatgaaaactcagtttgggctccagtagatatcattgaggctggacttgggagccatgtttttgagtctgtggaaatgttgcagccttcacatgcttggcttgcatatttttgagaaagagttagtacaggtcatttggcctttcatttcttcatattatttgggtaagttctatagaattcttggataatcacttatgataggcctggatttgtgttcacaaattctagttatccgaacaagtgcttattgtttatcttatatgaacaagacaccacgtaggcgtggtaatctggtatcttatgtcccagttgtggggagaaagatacatacacatgaaaaaatactatccataccacagtattggtacacagacagtaagaaccccgaggaaggagagatcattctgactgggaggttaaggaaattttcgtagagaaggagtggtgtcatgtgtgacttaaaggtctcattcaggattaaatgaagtatcaaggaagagtgagaccatttctgtcaagggcagcataaagtagcgtctgaaaataagcaagtgcaagtgtcattcaagcttaatttattagacattctgggctagagctgaggattcatgtagggagcattaagtgataaagctggagtatctgtcccgagaaaatttgctggaattaaaaatacctcgttaaaagagtgagtgtgggttttttttctgtaggaatagggtagtaggaagccagtgatggtttctgaacagaaggacaaaacaattggttagggaggggactgggacagagacttttaaagaagcttttgcaaaattgagcttgtcatttatgagagtttgaacttgggtggtaatagaacagagggaaaaatgaaacacagtagataacaacaaaggaaggataaataagacttagttactgtttggataagggagtatgccatgaacagaaacaggtcagtaaaggctgctaattgggggagaagatttatttctaagtaaatcagtgtaagatagtattggaccaataaaatggaaatattccatggacagttggaaatacaggatgatgacagacaagaagaattaaaatagaggtatgagaatcatctttcatggtgagagagtctatacaggataagaatttgagggaaaactgcagaggcataaggctaagggctgagcattagagtttattcgcttgtaaatcgacttaacagatacttattcaggacccactctggcagaagatggaaatacaagattgaaggcaaggttcctgccatgtggttccttaactaccagaagggcatacaactaaaccagtaactatagtacagtgtcatgtgctcagggcatcaccgggttcttcaggagtgtgatggagtaaatgagtaggcctgctcatcttggaagactttaaggaaatgctattacaaaagcttgaacttgaaggattcactagacagaatcagaagtgggtacaggagagagaagagagtacgcaaaaccataaagattagaaagatgaaagagctcggtaggttacagaatggtgaggattcactgttgagtgcattctccttggcagaaatgttctctgcctttcacacatgatctcaggaggattttgtggtaactttagtaccttcccttaccctttctcctcttgctgctgagccctcatttgtccaaaccatgatctgcctagtaacgttagcccaaaacccaaaagttttcttcatccttacatttcatcagtcccaaatttctattgattttgtgatttaaatttttcgaaagtatacaccaagcttgtccaacccacgggctgcgcgcagcccaggacagccttgaatgcagcccaacgcaaatttgtaaactttcttagaacattatgatatttgtttgcgattttcttttcttttcttttttttttaaagctcatcacgtattgttagtgtattttctgtgtggcccaaaacaattgttccagtgtggcccagggaagccaaaagattggacacccctgattatacacccttctctgcattcctctgtccctgcttcagaactgcatcatctgcctacttcaccatctgcctggcttattttcttaaatagtttccccaaatcccattttggacccttccatgtcttcctccctaataccagactgatttgtaaagtgaggctccatcgcttgatttaaacctctagtgatatactgttacccggcagatagatttcaaatagtttaacatagcacacaagactgtgtacttcataagccagtcctggatgtctgtctagctattttgccgttgccttccaccttgtactttgcctcccatcatactaaataagttttcttgttcttagttctttgtctttcatgtttccaggactttgcataaactgatctctagcttggaatgctcaacaatccccttcccagaaatcattctttctcatttttctcatttattttttatagctttcttcattatctttgtatctttttgtcattcctttgtacaccataaatccttctgttgttgcacttatcacatggtatagtaattctggttaaatgtctgcctcatcaactaaaccatcattcactgggagtatcatctagcactcaataataagtatttgtcaaatcaaatttaatatggggatccaaagccttgaagagaagctacattttagaagaaaggatttggtagtctttgaatatagatggtagttaaaacgaggcatagtttaacaggctctcatttaagtgtgtattttgaaaaaagtcaaagcatacaacagaatcctggagaacaccaatatttaagagacagaaattagaaaaggacgttagaaaattgtgtttaaagaggtaggaagagagaactacaagaaagaattgttacagctgttgagtagcagtagtcgttaaccagtgataaatgcagcagaaggttaagtgcattttggatttagcaaatctcacaggtgacctttgccacagtagcttcagtggagtggtgaaagcataaaccatagtaaatttagggcaagggttttcaacctttgtactattgacattttggtctgaattattgtttgttttagaggtgctgtgctgtgcgggaatgtttagcggcttctgtctagcctctaaccactagatgctaatacctccccccacattgtgacaaccagttgtgacaagccaaaatgtcttcagacattgccactgtccgctagggcaaaattatctctggttgagaaacacagagtggtgggatctgagtgggaaagcgagaagatggagtattgggaatacactacatttataatgaaggtatgatagctggaggaaaacaaagtcaaagaatggttttatgggatgagcatgcatactgtcaacatttcccaaatatgtttttactccttctttagccctggaaatattggaaagctgttgggtccattgcccatgcatcctgcggctgaagataactatggttatgatgcgtgtgctgtactctgcttaccctgtgtccccaatatcttagtgatcgctactgaatcaggaatgctgtatcactgtgtcgtgctagaaggggaagaagaagatgaccacacggtaagtgcaggctgctgtggttgtttgtatcttcaacacctggcatagttcctgacccaatatgaatgcttaatatatgagaaggaattttaacttacttatggaacttctgatattttggaaattaaacagttaaaaaagtagctgaagcacacttagcagtctaagtggaaagaagttagaaggttgcccaacttacttggtccaccagtctgcatgttactttctggtctctatattgcaatcttcagggacagatacaaagagccttggaatcactgaattggcttttttcacaaacatcttcctaaaggaagagagacgttttgtcttcagaataacagtgcactgttaggatagaggtggaattaagaatttgaaagtactgtttgacccagcttttttttcaatttttttatttattttttattattattttttggagacagagtttcgctcttggtgcccaggctggagtgcaatggtgtgatctcggctcactgcaacctctgcctcctgagttcaagcgattctcttgcgtcagcctccccagtagctgggattacaggcacccaccaccacgcccggctgatttcttgtacttttagtagagacagggtttcagtatgttggccaggctggtctcgaactcctgacctcagatgatccacctgcctcggcctcccaaagtgctgggattacaggcaagaacagccgcacccggccctgacccagctttttgcctgtttttaattgtgtacattttcaaattaacatgcaagatcaaaattacaacacttttttttacagtcagaaaagtcctgggattccaggattgacctcattccttctctgtatgtgtttgaatgtgttgagttggagcttgctttgaaactggcatctggagaggatgacccttttgattctgacttttcttgtccagtcaaacttcatagaggtaagctcttcaataaatgtagtgcttttttcccatgatttttatactaagactatcatagactgttcctatgtaatgtatttgttctgtggttccagcctttaaaaagttgactgggttttttttagctttttagtcactatagtacactttttgtctaaggcagactgagcaaatttcccaagttttaaaatagtggtctttggtccagatcaccagattcctaatagtgaatttttcctggtcctttcaaaagtagaactaccatgttattcagtagttccactactgggtatgtcaaaaggaaaggaaataataggttgaagggatacctacactcccatgcccattgcagtgttattcacaacagctaagatgctgaatcaacctgtgtccatcgacagaccaaatggattttgttgttgttgttgttgttgttgagatggtgtctggctctgtcacccaggctggagtctaatggcgcaatctcgactcactgcaacctccatctcccaggttcaagcgattattttgcctcagcctcccaagtagctggattgcaggtacccaccaccatgcctggctaatttttatatttttatttcatttattcatttattttgagatggagtctcgctctgttgcccaggctgaagtgcagtggcaccatctcagctcactgcaacctccgcctcctgggttcaagcaattcttctgcctcagcctccctagtagctgggactacaggcatgtgccaccacgccctgctaatttttgtatttttagtagagacgggggtctcaccatattggccaggctggtatcgaactcctgaccttgtgatccgcccacctcgacctcacaaagtgctgggattccaggcgtgagccactacgcctggcaatttttgtatttttagtagaggtgggatttcaccatgttggccaggctggtctcaaactcctggcctcaagcagtccacctgcctcggccttccagaagtactgggataacagatgtgagccaccgcgcacctggccccaaatggatttttaaaatgtggcattgtatacacagtggaataccatttggcttttgtgtgtgtgtgtgtgatatgatctcactgtgtcatctaggctggagtacagtggcgtgatcttggctcactgctttgcctcccaggctcaagcaatcctctcacctcagcctctggagtagctgggactacaggtgtgcaccaccacgcctaatttttgtatttttggtagatacgggattttgccatgtcgtccaagctgaaagtcctgagctccagtgatccttctgcctcagcctctcaaagtgctggtccacaggtgtgaaccaccatgcccagccctatttggctttaaaaaagaatgaaatcgtgtcattcactgcaacataggaggatttcaatcttgtagcagtttgacctactctccttacagttcttgttagccagtttgcctagttctggtaataacggcctcaactctgtactaaagtataggcaaaacatttaagggggcagaattccttacataacaaaccagcaaagagtgtacattgggtttgtctaattaaggtattttgagatttatattgtctaagaattttatagatgaggaaacagaccaaatgaagtaaagtgacataaactaattggtttcctcatatagatacgtatatctttgggaaatcttaagtgtagacgtggacgttttgttcttgggttttgttttttgtattttgttttttgtttttttttttgagatggagttttgctcctgttgcccaagctggagtgcaatggcacgatcttggctcacttcaacctccgccccctgggttcaagcgattctcctgcctcagcctcccaaatagctgggattatagtcatgcgccaccaggcctggctaatttttgtatttttagtacagatggggtttcaccatgttggtcaggctggtctcgaactccttatctgtccaccttggcctcccacagtgctgggattttaggcataaaccaccatgcccagccttttcttggttcttctaatgagagtaacattttcatatgtgaaactaagaaatttttgacttgttcctaattgtgctgaacaaggcatattataatcactgaggcacaccagatttcttagtgacaaagtgaaatggctacagtatagcatagggtggtatctaacaaatttcctgttaagtaaatgttggctctttttagtaatcaatttgttttacaccccagtgttaagacttttctgttgatgttagcactacaggttttgaaaagccattttaacaatgttagatttaatgagatgatttgagccttaagtcttaaaacatacgcaaatgaaaagaaaattttcaatattttaattatgcaaacagatgattcccatagatgagggttttttaaactttttatagcagaatgctgttttctaagatgttttatggaacctcaatatataagacagaaaaataatatatcagctttagaatattaatttatgataaagtcactaaccacaaagtgagactgttagattaaaggaaaatttaatttaggggttttatgggttattgttgccattttatcagctttaatatataccttatctctgtattttgttttagtttaataacattattattttgtgtttttttttgagacggagtttcgctcttgttgcccaggctggagtgcagtggtacaactcggctcaccgcaacctccacctcccaggttcgagcgattcttctgcctcagcctcccgagtagctgggattgcaggcatgtgccgccacgcctggctaattttgtatttttagtagagacggggtttctccatgttggtcaggttggtcttgaactcctggcctgaggtgatccgcccaccttggcctcccaaagggctgggattacaggcgtgagccaccacacccggccaataagattattattaatattaataataaaaatattgagttacagagataaatatttatacataataataggtattcagtagtttatcttttagtctcaggattgtcttactgatactggggctcaaaggaggtacagaaatttttgtttcaaaatcagttaattaaaattgtataacaactactcatacttcttagttataaatgattgtcaaacaaaaagagcatccaaaactgaaaataacctttgaaactatctgtaagtcaacattatgaagacatacgaaacttcacttctcatttcacaccttactacactgatagaactgttccctgagccgttgtgttaaagtcttttgtgataactatgctgtagaagtgcatttgcttcaacaattttatttaagtcgatgtatgcaagcataagcataggttttctacagagctgctattttaaccaccattttcttttgaagaactaaataaatgcacagagaaaagcataaatgagttacttgccagcaagtatttatgttttggtgaacctcattgtgttcatatttagaaaataacatttggattgagttttttttttttttttttttttttgagacggagtttcactctcgcccacgctggattgcagtggcgcaatctcggctcactgcaacctccacctcccgggttcaagtgattctcctgcctcagcctcccgagtagctgggatcacaggtgcatgccaccacggccagctaatttttgtattttagtagagacgggttttcaccatgttgatcaggctggtctcgaactcctgaccttgtgatcctcccacctcggcctcccaaagtgctgggattacagacgtgagccaccacacccagccattttttatactttttaaaacataggcatacctcctcattttattgtggttcacagtgctttttttttttttttttaacaaatgaaagatgtggcaaccctgcatcaagcaagtctatcggcaccatttttcaaacagcacgtgctgtctctgtgtcagcattttttagcaataaaaaatggttaaggtatgtacatattttttgacgtaacactattgcgtacctactagtataaacataactttctgcatagtgtaaacataacgttcttatgtactgggagaccaaaagatttgtgtgactcactttatttctgtattcgctttattgcaatggtctggaaccaaacccacagtatctctgaggtatatctgtacttaaaatatatttgaaatttgaattcaaattttaaaatttcaaaacccctaacaatatgaaagtcttttataaaaccttccatcaacaaatgcgtttgtaggctaatgtggagtagccaacaaatttgaggtaaatttttttagttatccactggctacctttgtatcattaatcattccatttgcagatcccaagtgtccttcaagatatcactgtactcatgaagctggtgtacatagtgttgggctaacttggattcataaacttcacaaatttcttggatcaggtgagtttactaactctctgcacttttaatagatttcagaggaaaaatagatttaatagatttcagaaaagtagtttggaatagaaaaatgatagagaaaatcagtgaaaccgaaaggttctttgaaaagatcaaccacatttcacaagcctttagctagactaactataatcaagaataaaagcagggatattactattgaccttacagaaataaaagattataaaggaatattatgaacaaatgtatgccatttacataatctagatggaatggacaaattccaagaaaaaaaaaaaactaccaaaactgactcaatcagggtctgggataatttgctttaaaaaaaaaaaaaaaaaaaaggccgggtgcggtggctcacgcctgtagtcgcagcactttgggaggccgaggtgggtggatcacaaaatcaggagattgagaccatcctggctaacatggtgaaaccccatctctactaaaaatacaaaaataaattctccgggcgtggtggcgggcgcctgtagtcccagctactcgggagactgaggcaggagaatggtgtgaacctgggaggcggagcttgcagtgagccaagatcacgccactgcactccagcctgggcaacagagcgagactccgtctcaaaaaaaaaaaaaaaaggctgggtgcagtggctcatgcctttaatcccagcactttgggaggccaaggcgggcggatcatgaggtcaagagattgagaccatcctggccaaccaacatggtgaaaccctgtctctacttaaaatacaaaaattagctgggtgtggtggcacacacctgtagtcccagctactcggaaggctgaggtaggagagtcgcttgaaccagggatggaggttgcagtgagccgaggtcatgccactgcactccagcccaggcgacagagcgagactctgtctcaaaaaaaaaaaaaagttaggccaggcacagtggctcacgcctgtaatcccagcactttgggaggccaaggcttgtggatcacccgaggtcaggggagtttgcgaacagtctagtcaacatggcgaaaccccgtctctactaaaaatacaaaaattagccaggcatggtggtgtgcgcctataatccctgctactctggaggctgaggcaggagaatcgcttgaacccaggaggcggagttgcagtgagccgatatcgtgccacagcactccagcctgggtgacagagcaagactccgtctcaaaacaaacaaacaaaaactgacacaaagagattgattagtaatcaaaactatccaaaaagaaaagctgaggaccacatggattcacatttaaagaattaataccggtcaggtgcagtggcctacgcctataatcccagcactttggaggccgaggcacttgaggttaggacttcaagaccaacctggtcaaaatggtgaaaccctgtctctactaaaaaaaaaaatacaaaaattagccaggcatagtggcggatgcctgtaatcccagctactcgggaggctgagacaggagaatcgcttgaacctgggaggtagagactgctgtattcgagtcgagatcacaccactgcactccagcctgggtgacagagcaagactccatctcaaaaatgaaaataaaaaataaattaaaaaaaagaattaataccaattattcacagagtgagagcagttaaaaaaaatctagcagcctttcatgttaaaaatactcaacaaacttaatagaaaggaacttcctcaaactagtgaggaaacttttcatctacaaaaaacttggaaccaacacaatgcttaatggtaaaaagactgaatccgttattggctttctactgctactgttgtaaatcatcacagacttagtggcttaaaacatgacaaatttgttatcttatagttttgtaggttagaagtcctgcatggttctcactgggcttaagttggcacagcagttttcctttctgaaagctctagggtagaatgcatttcctaccctttttcagctcctgccacattccttggcttgtagtctcttcctctatcttcaaaggcagccagcaacagtgggctgggttgagtcctcatgttgtatcactctgtttcacttttaaagaaacttgtggtaacattaagtctgcccggataatccaaggtaatgtccctatttaaaaaaaaaaaattcttttaagagacagagggtctcactctgttgtctgggtgggagtgcagtggtgcagtcattggttgctgcagtctcgaactcctgggctcaagcagtgctcctgcctcagcccccaaagtatctgggactacaggagtgagccaccatgcccagctaatttttgtgttttttgtagagatggggttttaccgtgttgcccaggctggtctcaaactcgtgggctcaaatgatccacccacctcagcctcccaaagtgctaggattacaggtgtgatccaccgcacctggccatcaaaatttaaatcttttttcttcaagaatactattacaaaagggaaaacagcccacaaaatgagagaaaatatttgtgtgataatggactcgtatggagaacaatataaagaacccttagcatttgatacagttgggcaaatagcatatatataaaaagatgtacaacattattagtcattatggaaataagataccacaaaaccacaatgaggtatcacgtcatatccactagtatagctaaaatgaaaaagatggacattaacaagtgttgaggatgtgggaaaaaatggggacttttatacagtgcttatagaaatgtaaaatggtacagtctttggaaaacaatctggcagttcctcaaatgattattcatagagttaccatgtacctgatagtccagtcctgagtatatttccaagagaaatgaagacctgtatccacacaaatactggtacatgagtgttcacagcagcattattcatcatagcccagaagccacatacccaagtgtccataagctgatgaatggatagataaaatgtggtgtgtctatacaacagagtattattcaacaatgaaaaggaatgaagtactgatacatgctccaatatggatgaactgtgaacagatgctaagtgaaagaagccagttacaaacaactgtatggctgtttatatgagatgtccagaatagacaaatgtacagagacagaaagtagattagttgcctaggtctgggaagtttggtagaaactgaggagtgattgctaatggttatgtgggtttcttttggggaaatgaaaatattccaaattgttaatgataggtatacaattttttttttagacggagtttcactctttgttgcccaggctggggtgcaatggcatgatcttggctcaccacaacctccacctcctgggttcaagcgattcacctgcctcagcctctcgagtagctgggattacaggtgcccaccaccacgtccagctaatttttgtgtttttagtagagacggcgtctcgctatgttggccaggctggtcttgaactcctgacctcgggtgatccacccaccttggcctccgaaagtgctgggaattacaggcatgagccaccgcaccctgccaggtatacaattcttacactaaaaacttactgaattgtatactttaatgggtatactttaaatggatgacttgtatggtactgtgaattacgtttcaaaaagctgttacaggccaggcgtggtggttcacacctgtaatcccagcactttgggaggctgaggcaggtagatcacctgagttcaggagttcgagaccagtctggccaataccgtgaaaccctgtctactactaaaacctgggcgtggtggcgtccacctgtagtcccagctactcaggaggctgacgcaggagaatcacttaaacccagaagccggaggttgcattgagcagagattgggccactgcgctccagcctgggcaacagagggagactccatccaaaaaaaaataaagctgttataaattgagtatccctactctgaaaaatttgaaatccaaaacttttcttttttccatccttgaacctgagtgagctacaaaagtttttgagtgctgtcatgacaacagaaatgctcattggagcatttaggattttagattttcagataagagatgttcaactactaagtataatgcacatattccaaaatccaaaaaaaaaatgtgaaatccaaaacacttctgatcccaagcattttggataaaggatactcaacctttatgaaaataaaatcagtgtgggtaagcagcaccctagaagagaatgatttcactgttcttagtgaaacatttttgcattcagagacattacgaaggaaaatcctacttcttggggcggaaatctagaccccctgggaaagcgtatgcctatgtcagaaaagcatagtacttgagaagcaatgttttcagacaagaacctcactgcatttaacccaatatcattagcattttaatttggagacttgtctaagcatcatttcatttatgtaatgtcttccatggtagatgaagaagataaggatagtttacaggaactctctacagaacagaaatgctttgttgaacacatcctttgtacgaagccattgccctgcaggtaaggactctccctcccttgtatatcagaaaacaattgttcatttcagcagttcagatacgtttgtatccgttacactcacatccacagtattcactgctgagtcatttgaaagttgcagacgtgatacttctcccctaagagtgtcctgctcatcagaagctttctcctctccagggccactcgacatactgtttcctgactggaaggtccttccccagccccagccccagccccagcttgctgtcttctcttggctaactcctacccttctttctgatcttaatgtcacttcttcacagagaacacccttgactccccagtctaacttggggctctcctattctcttatccattgtagcacatattacactatttatatttgcatttttttaatgtctgtcgccactaccggaatgtatatgtttcatgagagcagagactgtgtctgcccttcactgcattgctgtgtttatttgatgtggttgcccatgtctcctctttgaaacacattctccttggcatccttgacgtctgtccctccaggttctccttcagtcccgccagcagcccttttctcaagtttccttcttgggcgggttcctctgcctctactcactgcttataagtaatgctcacaactctttccttgggtcttctctattctttctaggtcctttcctgagtaacttctgccgtaatcatggcttcagtgctgacagttcccgcatccatatcgccctagcccagaccactctgaactccagattcacatacccagctgcctactgggctcctccacttggatatcctataggaacataaaactccagatgtccccttaactcatcttctgtctttccaaatctgctctctctcctgtgtcccatttttctgaagggtgccatatcaccccagttatccccagtagaaacctggaaggtattctagatacctccctttattctgttcatcaattactagatatctcataagcactctgttagacatggagtatacacagacatgagacaaatagcatacactaagaaatagacataatctaggtttggcaatacagaggaccacagggaaaacgcttggtggggaatgagaaggatagcaaactgtaccagcttgaaaagtgaacagtgaaaccaggcactgtggcttacgcctataatcccagcattttgggagatcgaggtgggtggatcacacggtcaggagtgcaagaccagcctggccaagatggtgaaaccccatctctgctaaaaactacaaaaattagccaggcatggtggcagacacctgcaatcccagctactcgggaggctgaggcaggagaattgcttgaacccgggcagcacaggttgcagtgagctgagatcatgccactgcactccagtctgggtgacagagtgagactccatctcaaaaaaaaaaaaaaaaaaagaaaagtgaacaaggaaaatacataataaaatcccatgtaggctgggcatggtggcttacacctataatcccagcactttgtcaggtgaggcaggaggatcacttgaggccaggagtttgagaccagcctgggcaacatagtgagaccctttacaaaaaaatttaaaaattagctaggtgaggccaggcgtggtggctcacgcctgtaatcccagcactttgggaggctgaggcaggcgaattactaggtcaggagttcgagaccagcctggccaacgtggtgaaaccccgtctctactaaaatacaaaaaaaaaattagctgggtgtagtggcgggcacctgtaatcccagctactcaggaggctgaggcaggagaatcgtatgaccctgggaggtggaggctgcagtgagccaagatcatgtcactgcactccagcctgggcaacagagtgagactccgtctcaaacaaaaaaaaaaattagccactgtggtagcatgtacctgtggtcccagctactcaggaggctgagaaggaaggattgtttgagcccacgaggtcaaggctgcagtgagtcgtgatcgcactattgcactccagcctcggcaacagagtgagaccctatctcaaaaaaaccccaaaatcccatttatatcaatttcagaaacaggtaaaattaaacagtcttgcctaggagtgaatacatagataggaaaactataaagcaaagcaaagacatgatattatgaatgtcagagtagcggctacttctctggggagtgaaaggctatgaccagggaaggtcgcatgggaaccctgaggccccctgcagtgtcctgattcttgacctggatactggttacatagtgtatagcccagtagtgtgtagatttcacactgataataaaaagttaaagtttacaaccttccagatatcgtctccatgtcttgtccaaaaaggtaaatgggagctatggaaggggaactagtgttttcaactgctgtttaaagactgctggttctaaagggatggcgagaaagaataggttaaggggaactggacattatattgaaatgagagtattttaaatggaagagacatgagtttgcaagctgaggggaagtagataatagggagattttgaaacgacacagttgatggtacaattttcagaaggtgtgagaggaggcggcatccacattcgggggcagatgtgtgttgtaggcatgcaggtgggatgggcatgggagccgctaggagagcatgttggcagaatgacagttcccatctgaggtctcagtttccagtgtcttcactgaagtgggaaggaagactgagagagatacacgctgtgcgtgccaagtgatttcctgtgacattgacattgggcctcattgagagagactcggtagttctgttcattcaacagtttctaagcacttaatttgttagcactgggctaggcaaacaaagatagctggggcttatgtgcaagttggagagatcttcagtgtaacgtgtaacttttgagattacagtcagcagcacgctacagttagggattcctgagtgacttagtcacatgggctctagactttagtgtggagctgcattaaaggtttccaagccaccacttttgaggttatggtactgataggatgtcccaagcaacttcagcccaggcctgagaaggccgcggacctgtcatgtctttgctcttggttccattgcatttgctgctttgtaatttaactatgactgtgtttttccaggcagccagctccaattcgaggattttggattgtacctgacattctgggacccacgatgatctgcatcaccagtacctatgaatgcctcatatggccgttattgtacgtcccattttatattctccacacagctcttgttaattctgcaatatctaagttgggaaaatgcactcagtaaccaacttgaagctatacatgtgtggtttatactttggcttctgacttgagggttggaaggatggatatttctgttcctgccatcatctctataaggtttcattgtaggtatagtttctggcatcccctgcacctagctgagagtcaggagcttttcttcagagtgtggagaaaaaatactaaaattgaataccaaattccattatcgatatgagtaataattatcaagctgtgaccatacgccaagctcagaagtaagccacgtacccgcactgcctcctggaatcatcagggcagccctgtaaggaaggcactgtcatttccattttataaaagtggaaacggggatcgagaggttagtaaatgctgaagtcacaggtaacaaatagagctgggatacagatgcaggtctcattgactcagaagtccatactcatactctttaatttctccatctctgccagcctgagggacactgtagactatgtaaactggaataaagctgaactcaggctgggtgcagtggtggttcatgcctgtaatcccaatgctttgggaggcccagagttcgagatcagcctgggcaaaacagtgagacccccatctctacaaaaaacaaaaaaattagccaggcatggtggtacacatctgtagtcctagctgctcaggtgagaggattgcttaagcccaggagttttaggctgcagtgaaccatgatcatgccactgcactacagcctgggtaacagagcaagaccctgtgtcttttaaaaaaaaaaacaaaaaagctgaactcttagtctttgctcctttaaggaactcagataattaagctgtaatcactatgttccttttccaacagccctggaagatcattctgagttacataaatgtaggaatatgagtaccaaaaacaaaagtcactggagcttcaaacactagacaacacccccaccccttgtccgttcaaagcttgcacctctggatgctgacataaattcctaatactggcagtagtttactgtccttagaggatcttccatagtctttgaagcttgattaagttgtactatctggatgtaaaaataaatataaattttgtgttatttacactgaaggcactaaaagctagcaagaccaaacaaaaataataaaatcactggagaaaaaattacctgtaagttacctcagcatactttttaaacacccacagtacatttagtaaaataaaacctagtcacactagcttacttcagaataaatatgaatcccaaaggggaaaaataaacattaattgtctggatattttttttttttttttttgagacggagtttgctgtgttgcccaagctggagggcagtggcacgatctcagctcactgcaacctctgcctcccgggttcaagtgattctcctgcctcagcctccctagtagctgggattacaggcgcacaccacatgcccagctaatttttatatttttagtagagatgaggttttgccatgttggccaggctggtcctgaactcctgacctcaggtgatccacccacctcggcctcccaaagtgctgggattacaggcatgagccaccgtgccaggccaattatctggatactttcagatcatatttctgccaactccctgaaatacaagttgtctataaagttatgctatttcatgaactttcacttttttttttttttttttttgagacagagtcttgctctgtcacccaggctggagtgcagtggtgtgatctcagctcactgcaacctccgcctcctgggttcaggcgattctcatgcctcagccacccaagtagctgggattacagatgtgtgccaccacacccagctgatttttatatttttagtagagacagttttaccacgttggccaggcttgtcttgaacgcctgacctcaagtgatccacctgcctcggcctcccaaagtgctgggattacaggcgtgagccaccacgcccaaccaaacattcacgttagaattgttgccttcagagtaagtcacttgccatgctgccgaagtctgtgagatcttttaagctctttttgaagtttgagtatttgcacttgactgaatagtttttagaaatgaaattatatagaaccaatatggtatatacagcagtttcttggcttaatattggttttgatcaactctaaacctaacaaataagtaatttatgtttgtggctccggcttataaactggctttcaagtcctttgccaagaatccatgctaggtgtttgtgctgccttgatcttttagaaaagaactggaaatggcagtcagaaatgctttcacaaatcaggggcattggaataataagggtgtagcttcccaaagtgaccttttcaaggtggaaaacatgcattcttgcacttttacaaaagttacactttattttatattctgaaagttctggattaatgtggtttctgctttcctgtaatacagtaaatcactccatggtagaattcaatttacttacttattttgcagaagtacagtccatccagcgtctcctcccctgctttgtactcgagaagatgttgaagtggcagagtctcccctccgtgttctggctgaaaccccagattcctttgaaaagcatattagaagcattttgcaacgtagtgttgccaatccagcatttttgaagtatgcaaccttgggcatagcggttttatgaatgggttctcttctgtcttcagaattactgtgcatcctttctgtcctcatctgtttcatatactttttactgtgataaatttggaagaaactggatatatttgatcagctagtgaatggggagcaggagggaagtggcacctgagaatgataaacaggaagtgtttaaaaagaagttaggctaggccgggcgtggtggctcacacctgtaatctcagcactttgggagaccaagacgggtgaatcgcgaggtcaggagatcgagaccatcctggctaacacagcaaaaccccatctctactaaaaatacaaaaaaaaattagctgggtgtggtggcagatgcctgtaatcccagctacttgggaggctgaggcaggagaaccgcttgaacctgggaggcagaggttgcagtgagctgagatcccaccactgcactccagcctgggcgacagtgagactcgtctcaagttaggctgggcacggtggcttacagctgtaatcccagcactttgggaggcccaggcaggcggatcacctaaggtcaggagttcaaaaccagcccggccaacatggtgaaaccctgtctctactaaaaatgcaataattagccaggcgtggtggtgggcacctgtaatcccagctactcgagaggctgaggcagaagaattgctcgaacctgggaggtggaggttgcagtgagccgagatagcaccaatgcactccagcctgggtgacagagcgagactgcatctcaaataaataaattaaaaatataaaaagtttaaaaagcacctgtgacttgagtctatttattttcagttgttttactcagctaaggaaaataaaggtagaaactttgtttttaagagcttctgaaaaggacatagcccctcctcctgaagaatgccttcagctcctcagcagagccacccaggtgttcagagagcagtacattctcaaacaggacttggcaaaggaggagattcagcggaggtatgatgtcctgtgttcacaaaccatcgatccctggctggtagctgatgctgtatggtagcctagacctggcttctgaataaactctatttctttttgtttttaaagggtcaaattattatgtgaccaaaaaaagaaacaactagaagatctcagttattgtcgagaagagaggtaagtgtcaaaaataagaagaatacaataggtcagtaagactggaaccatattctcaccctaagatgctgagccacattaggtggtttcagcatcaaggggtggacctcaagagtctcttgtgtcttacatcattaggaaaagtctgcgggaaatggctgagcgtttagctgacaaatatgaggaagctaaagaaaaacaagaggatatcatgaacaggtcagtgggctgtataacatttagttacctagtcaggtactaacaacgatatttaagaaaatgggcattggcaggtgcttacatacctacggaactgaactgatccccctgcctctcctctgaagtatatgttggggaaaacatgaggctctcccctaacccttcctatggggcctacttcagaaacaccagattcatgaattatgagcttgtgattatgtttctcctaattagtagagaccttaaattgagatgtttgcttgccttttctaaaggatgaaaaaactacttcacagttttcactctgagctcccagttctctctgatagtgagcgagacatgaagaaagaattacagctgatacctgatcaacttcgacatttgggcaatgccatcaaacaggtaggaatagatccaaactagctaaatttggtaatttttcttaaagcacttattctacagaaaattttacaaaaatgtaaaaagaacagattcaaatagatactgtgaaaatgtgtggcaaaccactgccaaaatatctattattttaatacttaaggttactatgaaaaaggattatcaacagcaaaagatggagaaggtgttgagtcttccaaaacccaccattattctcagtgcctaccagcgaaagtgcattcagtccatcctgaaagaggagtaagtaaatacttccaatcagctattatcgtgagatagtttttcctttacagtatgccagaatcaacctgtcttaatagaaacctgaatcttggtatttgcatgtcaagtaattactgggatgagagccacatgatacatagggacttaagaaatgactatggtgggaggattgaaagggatgaccttctagtaacatgattttgttgtgtggccaaaggtattttacagtaattatgttcaaaaatatttccagtacttgcaccgtttgccaccttaaatgaatagtgaacactattgctatccacctgaaaccttcagctgttaattttagcaaagcagttcttagatgtttcaacattaccagtttaaattcttaagaatccatataaatggtttattataattccaaaagtgagtgactttacaattttacaggggtgaacatataagggaaatggtgaagcaaatcaatgatatccgcaatcatgtaaacttctgacaccaccaggagctgactcacacctgaactgaacaccattgaaggcttaaacccatattgtaaaacaggtagaattatctaatttataaaaaggtgttttgatgacctttggtgtggttcatctttttaaatatgttgttttataataattgagtaaatgcttttatttaaaatttggaatgtgctttataactcaagcctacagttgtgttcagcaaggactcaggattatttcacactgcacactgccagaacctccctgaaccctattgagttttctccatatttgagcaagttagttattcttgtgagctgtgttttaaagtagcagcaccagaaacatgactctgaagagggatagaaccctaggattcaaaggagaagaccacacagtgtacttggcagcagcttttttaatttgaacactttcttcttgaggacacaccttcagtacagttaacaaatggttacacctgaaatctgctgagagcagagctcaagatccacaattgcaaaggccactgctggctcacttcctcacaagctgtattacctttcagagctgagtgaggctgtgctctacgtcccaatacttgttactgagtggacatgaggtgcaagtttagcaccttaaagggagaaaaaaataggttagtatgcagaatgtgattttgtcctcacttcaccttaagtcatctttttacacttgccaatgtgagttctgaaaggtactactatatctgcttagaaatggctgagtgactgtcaattaaaagccacatgataaggtaggttacaggtaagaggtaaatcaggttagacatgcatgagaacatgtaggcacagactgaatataagcacaggaacactcgtgaaacccaactgagcttttcttttgcctagaagggctaaatcctgccttctacatcagttcccatttatgctgaaaacccagttgaaagaattgtttcctacctggacagtgacacagtagtttgtttcataccagaaacacattgctaaacaaaacttaagagtctcagtttgggtttttctacaataaagtgaattccaacagttggcatttgccacagtagagaccactaaccattccctaattgtgatgattttattacccagcaccatcttctggagaaaaatatctgtaaggtgctcagtctcagcagaacacttcactgcaagctctagttcagtcagttcagaaaggctgtgaattgcccaccctgatttacagcactaattttaataatctgaagacaaattcgcttggggcttatccaagggactagtcttaaacctacgtaatttaaattgattgcattttataattaataaaatcccctgtaactcaatagttatatgtttcctttatctaaaccatgtagcactctttataaagggactttaaaccaattaaaataatgtttcatgtgcggcaagcctttagtactatttccataattggtatttatttttaaattcataaccatgaatgcaagactacaataataacccaagagatgaggtatgtagtacttatcatttgtcctatggaagacagaagtacagaagatctttagggtaagtccatagtgacctcatttataacaaagacaattcactttaagttgatggtggcgttatgtgaacaaaacaatctacctagttcactaactcccagaaggctctttcaggtaccctgctgttatgcaaccagtctcaaaaatgatttgaaaaccatcttacttttgaacctcctggatgatgaatccatccactggatattcctgggacagtactctcagcaggtattgatgaacatgaatcaattctttgtgctttctgtagcacttcataaagttatggcaaagacctgtttcactgaggctttcttcacacaggaaaggaatctaatgcttgtaaaatgacaagacagatttccaattctaactaactggctttccataagcattgtcacttacttacattccaggtctgaattcaaaagaaaaatacaaagtatctgtcaacctagttaccatttttgtatttgacacatttgaaacaagtagtacgtaagccta

SEQ ID NO: 15848 - DNA, 89450 bp, Human
  misc_feature (1)...(89450): n = A,T,C or G
ctcccttagagtttcattccccagtgactcttgcagagacattcagctcacatcagtcattcatgtttagtgcaaattattttattagatttttttctctctatgacagtgaagagaaaaccaccgaggaataagaggttggctgaaggtaaggagaaggtgaggctgttttgtaataatgaacacccacagcagattcagctagctagagcccaggccataagaatagggtcctggagccttcctctggtgagaaatgaggacctaaagagagaaaatagggcacagaaaggagggactaacaaatgtcaagtgcttttcccttagcctctgtctggttccagttgcctacacataggctctcatttcctttaaatgtcacacaaatgccttttcgttttttggtgtcatctcacaaagtaaaatcctctaagatgaaaaagtgaggctcaaatcatctcaccaggtagctgaaggaaatctgagagcaaaaatggtttcttcaaaaagtagtagtttaaaaaaaagcatgcaatgaactagagaactgtacagggtgttaatggaaaaaaataagtactacaactggtttgagtaaatcagttcataaattaattttaacactatatactattgttacctatttattatcacttaccattttattacaatatcatttgtaattatcctttcatctaagaaatttaagatataataagactttctggtttggaaactttttttctgtttactattctgattttcctgaataactgtccataatagatgtttaggaatttaaattttttacaggaaaaaaatgctttctcatttacattaatatggtgagtactggtgagagaattgtttctcttgatggaaagagaatgcagagttatattagtatgaagttagaaataagacctaaatgctaactatagattacataagagtaaggttatctatgtcaagagatattgactataaattctagtagggctgggaatgtgtttcatttatatctaaagacaagtagtagttgctaacttgaggtttactggatcatcaatttacaacacaacgtgaaaaaaaccagggtccttatccctgaagattttcaaaatacatcctccatatcactgttggaacagtctccaacttcccatgtgctcatgtgcacaaaccatacacacacacacatcacacaccacttgaatgtccctaatcactcatctttatgcagattccctgataattatgtagtctgtatcagcacaacagtatcaaatcaagccttcaaaggtcttaaaatagagggtttatataacacttcatggttattttggttttctatcaaaagagacaatagggtccaagaaatacacaaaactttgcttctaaccaacagggacatttgctataaattttgtagaagacccttgcaatacattgtccaagaagtccgttaaaaatccatctctaaacaaaaaagtttccctttcactgtcatacactgaaattccaactattagttgctatttcaatttacacactgaaaacatacttccttagaaagggccatggaggctgcctgtggagactcactcatggcaccatgacaatgtggtaactactccagttagggagtctggaagtcagaggacatcaaaagggttggaagtgcctcattgtgaacaaacaaccagcttcatggttttgccttctcctaggcttgtccagtctgtatttcagtgaatgtgatcaaagaaagcagggaaagaacagtttttccttgaaaacccagaggagcaaatggtctttgatttctcatgaaaagtcttgggcctatctcttcatgttaattgtgatagtaaaacaataaaaaatgagatttaattttaacttgtgttggtcggtctagggcagtgagtgaaggtgacaggctggaaaaatattaatccaagttggttatttaacatctgctttatttggaggacactattgaagccacctgctcaggacaatgaaattcttcagttacattctggtttatcgccgatttctcttcgtggttttcactgtgttggttttactacctctgcccatcgtcctccacaccaaggtgagtgaacctggagaacagactggtggatttcctgacttatttaattgtcctttattaaaactgtttgctgtttaactgcctggctcagagctgaatgaatgttgacccttcatacctaaagtcaggatggttgtacatgatgttttggccattttctccctttttaataattaacattggttgattcttagtatgattaaacataattaaatagaatattcaatcagaattgttctctgcctatcaactagatgagaggaagaacaaaagaagcacaacctttgagattttgcagttcaagttgtcattctccagggagcatgcatggctagtgcaatgccttcccctgagaataggcagcaaagcaattgctggggacagaggtggaagaacaagggaaatcctaggtccagcacagactaatttacttctcagctctgtggctttgtcacagaacttcctggaaatttagttcccttgtaggaaaagaagacattgaaagcttagagtaatttcccttggtcaatcagaaaatctaataaagcatttaccatgttctgataattccaggttttgtttcattgtggtgtacttgtaagcatttttgtttgctttttaagagtagtcagggcattaagtccagaacaataagctcaagcatgtttaatttcttggtaaaatgatttgaatcagcaaacatttaatgagcaccttctctgtgccaggcacaaacgtcacttggtagtaagaggacaggctttggagccagattctctgcttcaggtcccagatttaccacttacaaactgtgtcacctgggcatgctacttaatgtctctgtgcttctgttttctcatatgaaagatgtgtatagtagcaggcttgttgtgagaatgaaatgaagaaacactcttcaaacacttatttggagcagtgcctggcacacagtaagtgtgcagtgccagtctccttgggtgtgttgactccacaggtggggcaattcccagcactccattatgcacagtccctcctcttaatgggcaagaaccctgctgatgctctcctctaacaagtactaatcgaggttacaccagtctgggttataatagaatcatattaactataatatggtggtccctccagcctctgccagaagcctttgccagtgatcctgggacctctgaagggaattcatgtgagctaataaagtccttttggacactgtcaaggcctatcctacctgcaaagctggagaagggactggcccctgctgtggcatctgtgggttgtctcccaccaggtgcaatcttctagctgcagcattcttggcttatctctccttgtgctgaggtctcacagagctacatggagggaagggaaaaactccccaccccttttggtccaaatttctaagccctcaaattcgtacagaatttgtaaataataataataactaaaagaccttgtcagctgtttttggctttgttggttttgtttttcaaattctgtgtgactaaccctttccctcccaccctgccactcccaccccggctccttgtgaggtctcctatatgaatctctggcagccccatcagatgacaaattccagcacagaaatagtgctctattctgaattctcaccccatctccttgccaagaacttcatctaagacacattatgatcttcactttgcaactctcctggtcccatgagtcctctagatttggctgaatcctatcatgaccatatcctgcttcatacctggagccctgctatattttaatatttttgagttagtctcagcatacattcttacttatggcagagaaagtaggaaattaaactagtcaagacaaatttaggtcattaccacatatcatctgtgctgctctttttacatataaatgcatgacaatttgattatcctccataattttctgagaaatgaatataaactctttgaaaaacaaaatgagtaaataaatcaaaagcaatcattttagtacatgattcattcactgggaagtgtattatttttaagaaatgcagccactgattattttttccaaggtgctatgacaaaagaacattaggtccatgcaggaaccaggtgtctggcaccaagttgcatctggtgagctggttcctctttcctttcctcctaatcaactcatttgttaaaactcaattaatgttaatggaggatttattcctagtataataacatgatattattttttggccactttaaacatatatttaatcattcaataaactgctaattaaactgaaagactattattttaacttgcttacaatgaaagcaaattatttttttaaagaatgtaggcctttggagggtataaaatttaaggagaagtttactttaacataaatgcaagtcaatttactgttaacttttaggttaccaaactgaagaagtctatgcttctaaagacacaatattagattaattaaaacattcaatggaaacaaaaatccaagtttctctttcaaaaccacaattataaaaaataattccatgtggggctataatctacaggatgtagagccaacaaacaatgaattattgactgatttctttccttcattttcctgcttgttattgagttgttcaatagactggccttaacttatgtcttaattccatctaaagtgaaaaaagtgccatgaatgaagaaagaccctaactggtttttcaatgtactattaacagggacggagaatagactgatttgcagagtactcttctgtttcaggcattctgccaactgctttccccaaattatcttatttaacctccatcacaaacgaataaacaagtacaaatgtgcttctcgttttacatttgagggaattgatgctcagagacatgtaactcaccaaaggccatctacatgctctagaaagtaaatttgagcttggatcctgtcagaactcagaattcatgctttaaaagtgattttgttttagtcttttgtatatttttgaagacttactctttcatggcttgttcatcatttgtcaacaacacaggcatttctgttcatgaaaatgctttagacaggccaaacagaagagttctgttttaaccatttcctcaattgaccttatggtacgcaatgtcattaaggtagaaagttgcagtgattctaaccactgaagataggcttatgagaactgaagctataaggatgtcatttgctgggtgtcccagagccccagttttttaagctggtcagtcagcttgtcaggatatggtgccccttttctccatacttgcgtccgaattggaaatagagacaaaaacaggtaagcagcttgcaaaaatctggctacacagatttttccaaccaacttctgtctgactctagagccaatgatgttaatcacaactgagtatctgtgtctttatagcttccgtggtcataataaatatattcctagtacattgctgtgaatctcacttcgctaatgcaattccattttcttattgatttacactgagcatcagaaattctttctgtctcttaaacataatggtaatctcagtccttacccaattagtagttaatgatcagtaaacaagtctggagtgtaactgctttttatttgaatgaaataatcacactgagtttttctcattttggagagaaatttctttaaatatttccagttaaaatcttggtaaaactggcctagtatatactgacatagtttcagtaatattctatgtgcaactttgttctttttaggctattttgttaatttttactcttttcagcagtcaatactatttccttacttatttttccagttattggattttctttgtatttttattcatgaaacaaaaaggccagatttgttagaagtaagaggggaaaatcaaacaacaatatattatatttgtagagtgcaattcttccaggtatacctattctatctagcttacttattaatcaggacccctttttaagatcaggagacaaggaaacaaccacacatatactgagcagcatttcttagttgatgggttgtaaaaccgataccaaattttaattctttcttcagaaaatattttggatttctctagaaaatattttatattctaactttgaaactcacgatatagtcacttgaatcatgatgactttcaaagtgagaatagaaataataataaataaaatgatacatgatgagagacttatggtgctagatataaaaataaaataaacagatgggagaaatataatgattgtaaggaaatataaactttaaaaagtgaagtatcccctagaaggaggaagtggtaggtcgagaagttggtcaaagaaaatgaaaatgagtaggagataatttaaaaagactataagtgaaagaagagggaggagagaaattccaagaaaacagataagttttaaagagccaaataaaataattaaatatattaatggaaataattgatactgttttaaatgttggcataaaaatattgtagggatttaagataaagaagaaaatgctataaagtccaagtaagtgaatattttggacaccaaagaatgcagaaatgatgaagaacaaggaaaaaaatagaaataatgctaatagcaatgtggtagttcgacaaaaccagaaaatccaattttggtaatatatttttatttcacaaatattttacaagaactttcccagcccaaagtgttgtgccagatgaattgtgtgatataagcagaagtttaaattaatgtttctgtctttatgtagcttgcagaattgctggaaagtcattatatagtatgacaaatattaatggcaaaagtaggttgtacctaaacacatgccgaataatttaaagaaatcatctgtgctatgaaggcgtaattaaaaagtggataaaccactaaggattcatcatcttccagctcctctgttcccctaaccgcatgcagtcccacttgcccaaaacctgctgctccttctgttttctttatgtcagagaatgccactacccttctctccattcacaggtttgaaagctgtatgtcatctcagatgcttcaaatatccacaagcccccatcactaatacggtgttgcatctccttaatctaaatcctcctaaatctcccctctcaacctcatcttctcctctctttcctttcctgctggcactgctttccttgaagctgtctttctctttctttcatagactgtttgttttttacacactttcccctacagtctctggccagagtactattttttaaatgccaactcagtccaattgtgaaaaatcaaaatttttcaatggttcctttttgcctataatggaaaaatatctaaacaaaagatggttttgctgatggatatttctgacttttcatttatttgtcctaaaagcctccaccacacagtccccagtatctatctcccacatttgcattttcctctttaacaatacttcactatttgcagtttctagaatgcctgtgattattcttgtctctctgccttctcacacgctatatcctcctcctagaatgccatctcctcttacctcacccttcttgggaaggaaggctcaggctgtgatgtaaactaaggatcatcctcgatgctctcattgcatcatggatacattggcctctattacagtatgtcttccgttttgctttatctttgtgtctccctccagactgtaaatatctcaagaacatggagcatagtgtttaaatttctgtctcctccagcaccaaacccagtgcctgtcacatagtagatagttaataactgtgttgagtgaaggatgatctagcgtggcagaaggatgtaaggctttggacctgataggaaggagagaatgcaggagaaagaggttgatgaaagaggggaacttcaatagagtgaaaataatgatgaaaggacagaacaagaagaatgtaggtgtaaccagaggctgtccctttcacaaagctctttcttcctcccataatatgttttataccttgtttggtaacaatagtaaatgtgaatgcccactgtgagcctcatagcgacaattagaaatagtcaatatcatcccaattttacagaacagaaactcagagaggtcaagaaatgtgatcaaagtcacacagtccacaaagggagcaagaggacttaaacacaaatctgtctgacttccaagctcatgatgtcattgcttatttaatgatatttatatcagatctttaaaagctgtgctcagattgccttatgtcattgttcctgcatttgcaatcacgaaagcacaggttgaggtgatgcctctctcagcctggatcacgtagtaacctctacccatgatggacaaatagtataagtaagaaataattggctgttttagactgctgagattttggaacttttgccacagcatagcttatcctgtcctgattaacatagcatattctgaaacattccccaagtgactcagacatgctacccttggctgatttttttttttatttataaaatgagcaaggctctttttaaaaagttccaaatgttgtctatggataagcttccccagattcacctgagatacttgtgtaaaatcataaactcttaatgtgaagtgtaggatgctgcacgttgaacaaactccccaggtgattctggagcaggtagttcatggattgcattttgatcataaccaaatgtgtagtcaggttggagaactgattatttctgtacctttttccagttccactgtgtacagagtatgaaaacaatgcatctcaggtgctggttaggtgtggaggttgagtgaaaaggaggaactaaaaatttcccaataactggtttagtgggccatcaattgcttttctctactatccattttggctaaaaacttaaaaaaaaagaaaagaaaaaacatctagttatttctccttgactttgtagttgaacttatttttactatccatcttccaaaatgaggatattttaaagcactttaaactttgcaattaatataaattgagtcttaagaaatcactgctgcagtaggggtaggaataccaagaaccatacaaagcccttcacaggctctgtcaaataataatgatgtttttcttgtagcacagagatttagaatgcatgatttttctccttttttaattgctttgtgttctctttagaaaatcaattgtagtgattgaggtctgtgattggctctgcttttctcacgctgtgctgagaagagatcatacccacatacgtactaattcatcagccaaattactccctaatatcagtcagtatgtcatttaaaaaagcagaagagatgaaaaaactatattttaaagccaaacttatattctaattccatgtggggctataatttaaaagagaaccaaggtgatttttaaatgtaatcagccacattttgtaagataacttgacagtcagaactttgtaaggaggaaaaagtcattatccaaattgcctagtcatagctttctttgcctttttcaccccttcagcaagtgccctagctgtgcacttgaggtggttaagacaagatatgactatgatatttttaactgggggctgggtaagtgggaatgtctgtgatggaggaattcacctatgcaggtggacattttagttccagtgctgtttattagcaagagagatgagggctgcaggaaaattgtaaacacattcacccactggggcaggagtcaaaatatccagttccaggcaaggaggagagaacagagaaaagggaacaaggcaaagagaaagaagtttctatgctaaggaaccttatgcctaagataaagatttagtgttttataagatatataaatacaaacaatattagaaagaacagaaagaagaaccttactcactcaaatatgttactgaccgtatactctatgccaagtactgctttaaatgttgggaacagggtagtaaattttaaaaatatatactctgatagagtttatacatggacaaatctcaactctaccacacgctagcagtgtgatcgttgaaccttagttcagcatggaattacaatatctaccccaaagaatcttggcgagggttaaataaaatgtcatgtggagtgccaagtgttgttatctggcacattataagcattcatgagtattacttgcccatcctatagtaagtcagaaaacaggtttatctgtctacttggcaaatattttcacatcttaaataagtttttctatatataaagtctatgatcaacagtctagatgaggttttagacaattaggatcctcccttcccaagctctttctccattggaaacacaaagcaaataaagatctctgtagatcagaatgagtcagaaaagcaaacaagtggcatgaatgtggaaacctgtggttgaaagcactcccatgccattcagggaccagagtcaggttaaatgccagaaactaagggctggaaaatggttttctcaaacctgtgaaggacagaaagagctggattgatcgctggctatgatggctcacaggaagcaaacactgcccagctccccagccaagacctcacccatactacccaactcagctagatgactggatccatgttatgctggcaagaaaagaactctagggtgtcaagataagacccatctgaaccaggaactaggaactggctggaagcaactgtaaaagtgctagatgagaaacaaggagtgcagaagaagaaaacacaagaataaagctaccactcagaataaatttgaaaataaaatttcaaaatacaataagacactaaagaaagactgacaaaatccgctcagaagaaatgaaaataatagggaaatcaacaagttaggaaaggaaaaaaacaaaaaaagagaaacaaattatttttcaaaatataaagcaagagcaggaaagtataaaataaaactagttagatatcctggaattttgtcactgagattaaaaaaacaaacaaaatcctcaatagatgtgtcatgtttgaggctcctgggtggtcctagttaaccagcttccccaggggcaacttctcctttttcatttgattcatgtcaaagatgagtcttagacactctaatgctcaacagcttattctcaacagcttctcctttttcatttggttaatgtcaaatatgagtcttagacagcttattctaatgctcaacagcttattctgacttttccaagatgaagatgaagagcaggccagtggcatgggccagatgcagtcagatgactgactgaccaggagggcctccgtccagtgaccagtctcagaatttaaaggacccttcccccttacttatgcttgtactcagcccaggtgagttaccagccatttctctcataaagggagtttaaacaattctggaaagagtaagccttttttgtttatgaaagttgcatctgaggtagccttgtctcctggaaatccccaggccaaggttggaaatccccaagccagtctgcatcacattgctaagtgacacttagtgtcaaccctactctgtgacatactgctacgtgacatgtagtatcagcaagatgcctgaataagccttatggctatcattaatcttataaccagggtatgtctcttatagtatactacaagatgaaataaactttaaactgagtatccttgaagatatattcagtgaactgagaaagaatactaggaatttacctaaaatatcaaatagaatataaaaggatatctttaagtgagagaatcatttggagaatgaattcagagccccaacatatgtataaaagacattaccgaaaatgaaagactagaaaagaagtcatattcaaagtaataattactgaattctccagaatttttttaaaaaagatgagctctcaaatgcatttgtaagtacaaacaacttaattagatattagtccatatttaggcacatcaggaatgagacttcagattaaaaataaggtgaattttttaaagcttccaaatagagaagaaaaaaatctccaaaaggattgtaattagataaatttttcatttcaataataatgaaaacatctaataaatatataatagacctttctggagaaatctacaaaacattatagaagaaatttaatagacacctaaaagaatagagaagttcatagatagaaatacttaaagctatatcttacttcatagattctgtgtaatttgaatgaaaatctgaataaaatttttataacttgagatagtaattttaaaattcaaaagaaagaatgaaaatctaacactattaaggcaatttgaaaaacatataagatgaaggagttgtcatacagattgtaaaccttattgaaaggttagaaatgttaaaagagcataattctgtaagaacttatttttagaaggcagcagtgggagagggagaggacaaaataaagagaccagaagcttatgtgtctgcatttgagaacttcagcatagaaaatatgtagcaacatgaattactaggcaaaaatgagctcattcaatttaaaaagcatggcactttggctattcattttgagaaaaaaaaagtgttagattcctatacaaaaatattaaagctctacacttgaaaaaattttaatcttagaaaaaatatggaaatatataatgtagaaagattttctttctttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacacccggctaattttttgtatttttagtagagacggggtttcaccgttttagccgggatggtctcgatctcctgacctcgtgatccgcccgcctcggcctcccaaagtgctgggattacaggcgtgagccaccgcacccggccgaaagattttcttataaaatatggtaaaaacatgagacaacagaaaagtgtttaaaatcactgcattaaaattaaaatcctcctgtcaattaaaaatacaataaagctaatttcatagacaagccagagactaagaaaaatgtttacaaatacatagtttatagagaaataatattaagaatctaaaaataactccacaaatccatgagataaaagaaaaaataacccaacagaaaaatgaaaaagaactataaatatataatttacagaagagaaacaattatgttcaataactgtgaaaatactccactggtattcaagaacatggaaattaaataagaagattttttcataccatcagactgtcaaatgaataaattaatcccatataccaaggatggtgaaatggaatttctgaacattgttggtgttaatataaactagtatgaccatctcagcttcttagtcgattttcatagtgctataaagaactgcccgagactgggtaatttataaaggaatgaggtttaattgactcagcgtgactgggaggcctcaagaaacttacaataatggtggaaggggaagtgaggcaacttcttcacaaggcagcaggaaggagaagtgccaaattaagggggaagagccccttataaaaccatcagatctcatgagaactcactcactattatgaggacagcatgggggaaactgcgcccattattcaattacctccacctggtttctcccttgacacctgggtagcatggagattacaattcaagatgagatttgggtggggacaaaaagcctaaccatgtcagatagcaaatgggcaatatctagtaaagttccaatggactccttcccgtttgaagttctgatgctagttttctccaccagctaagaaaatctattttccatagacatgcatgtggagataggtacaaagatgtccatagccttataataataaaatattggggaaaaaatccaaacaaacatcagtagaaaaacagacaaataaatggtaaaatattcataaaaagaaatactacatctattaaaatgaagtaacaataaatctacatgtatcaacatgaatgtatttgaagtacataaaatattgagtgaaaaaagcaagttgcaaagtgacatatagagtaaaccttatttaattttaaaaccacttgttattaatgtattaatgtctgcatgtagtataatcacaaaaacatgaatggaaaggatacaaaccacattctagacagtagttaactttgggaatggtggaggagaaggaaatgagggagtggtccttaacatcagtctttaacagaatatggaatgttttatttgtttaaaaataatttaagcaaatgtggcaaagtgtcaacatttgttaaatatgataaggtgtacaaatatgtttgttgtatatttttactatgttctaaatattttataattttgaaaatgcttctaaagaatacactgctaaaaagcttctaatatatatattttttaatttaagggacgaggaactgcccatactataataacttcatgtctctggtagtgtgaggaaatcttataataggaaagacggagctgccatgaatgagccaaagaggtgcagtgtatacatacagagcaggtatccagggttaagcgacatgacattgcctatgatctaatggaatttcacctggtttccacacaattgcctctgtctggctaggtgtgacttgtttgctgaacttcttgatgtaacttttgggagtcgtaacacgtacagagatttttaagtagaaaagtagtatttttgaggaagtcctctggacttttttttttcccctcttttctctttctttattttgagaaggaatcatgatttaaaaaaaaaaaaattgtaaggtcagtggtagtcataactgtaaatctttacagttatgtccttcatgataaataaacaagataaaagtacacattatttttgttgctatcattcagtttaagaattcataatactaaaatacttcagaacaaaatgtgattaaaacgtttacttgttacggttgcagagtaagttgtaataacgatatcggatgtatcagcaacttccagcagacttgggggtaggttgtgggggaggaaggattcactcatactcttaattgacaactggtcttcttttattgctgttttaccatcgttctcttgaggaggtagtagtagtagtgattgtgtgtaatggtggtaaacaatttgtggtggttttatttcttaggagtaggaggtctgttaaggtgaagaaaaagaggaaagagacaaatttggaagaaatttacaggagacaaagataatatagcttgaaacaattggtcactctatgagtttctagtgacaaaatgaagctactttatgttctacctcaaagccagtcctaaaatcaaatatctaggatctctttttagttgcaacacagttccacaacctctgagtagttttcttcttcatcagaagaacttgtccaccaaaagttactcaccctcgtattctttgtgtgcatgtgtgaatagatgtgaataacacaaaagaagaaaatggttgtttttttttctatctcttatacttttcttcttcttagcaagattattcacagatctttgattttaaagtaaaaaataaccctatatactttaataggatagttttaaaagaaaatacttggtgttgtgtttgaattaaccttctgctatttaatgcctaaggactttgaagggaaagaatgctttcctgcattctttcacatacccaagcacgaccaagaaaaatcacacaatagagaaaaggaattagaggaaggaagcattcctgggatgaacccatcaataggatgcttgtttaatttatcagccaaagagggacgcttttgaaaatgaaaggaaatactaatgagaaaggaaactctacaataacactgtcctgagaaaactggggcagatggctaccctacccattaaagagctctcaaacgatcctaaaatttgtattgaaacaaaagaccccaaatagttagagcaatcttgaacaaaaagaacaaagctggggggcatcacactacctgatttcaaaatatactacaaagctataggaaccaaaacagcatggcagtggcataaaaacagacatgtggaccaattaaaccatagagaagccagaaataattctctacatttacagccaactgattttcagcaaaggtgccaagaacacacaatgggaaaaggagaatctcttcaataaatggtgttagtgaaactaaatatccacctgcagaagaatgaaatcagacccatatatctcactatatgcaaaaatcaactcaaaatgaattaattaattaaatgtaagaccaaaaactatgaaactactagaatacaaaacaggggaatagctccatgacattgacctagacaatgagttttttggatatgacctcaaaagcacagcaacaaaagcaaaaatagacaaatgggattacattatactaataaaacttcttcactgcaaacaaaatcaaaagtgaaaagacaacctatagaataggataaaatatttgcaaactattcatctgataagagattaatatcaaaaatacataaggaattcaaacaactcaatagcaagaaagcaaataacccaattgaaaaataagcaaaaaattttgaatagacttttcaaaagaaggcatacatatggcaaacaggtacatgaaaaaatgctcgacatcactcttctgggaaatacaaactaaagccacagtgagatattatctcacctttgttagaatggctattataacaagtgttggccaggatgtgaacactgtttgcagaaatgtaacttagtacagccattatgaaaaataacacagcattccctcaaaaaattaaaaatagaactactgtatgatccagcaatgtcattactggatatatacccaaaggaaatgaaatcagtatgttgaggagatatctgcactcccatgtttattgctgcactagtcacaatagccaagatatggaatcaacctaagtgttcatcaacagatgaatggataaagaaaatatggtatgtatacacacacacacacactcacacatgcacttgcacacaaacacacacatggagagagagagacagagacagaatgaaatactattcagccataaaatgaagaaaatcctgtcatttgttacaacatgtatgaacctgaaggatatatgttaaatgaaataagccagggacaggaagacaaatagcatgtgatgtcagtcatgtggaatctaaaaaagttgatctcatagaagtggagagtgaacttgtggtttccagggtctggggagatcaggtgtcagggttaaagagatgttagtcaaaagatagaaagaataagcttgagagatttattgtacaacatggtgactgtagttaataacattatgtactcttgaaaaatgctaaaaagagtggatataaagtgttctcagcacaaagataataatgatgtgaggtaatgcacatattaattagctagacttagtcattccactatgcatagatacttcaaagcaccatgttgtacatgataaatacagtacatacaattttacatgtcaattaaaaaaataaggataaaaaaatagcattcagaggggaataactctgtcttcctccttttccagacctttggttttcttcagatgtgaaaaaagggggcaattttcacaaattctgggaaggcagctatcaaagacatgcagatatggtgccttagctagctgaaattataatccactgggactcctaggaaaaaatacaaaatgcacatgtgtgttcaaggtaaactccatgatgagacataaatttgaactgcaaatcaaaaggtagacaagttttacaaatgggttatgaatccagggattcagcttaggcaaaaggaaactacttggaagcaagtgtatggaaccagatttaaagatgaaagggaaggtctggaaaaggatgtagcccagtgcttctcaaactttaacctagataaggatcaccttgtgagcctgaaaatgctgattgattcagtgtgtctggggaagggcttgatgtcctacatttctcacaagtgcccagattatgctgacgctgctggttcatggaccaggcagaggggcagagaggggagaagtccaaatgcacaatctaagtgttgattcttgaatgacaaagcaatatttgaaaggcggagcaaataggcaacctttttcctaccagatattttactaaaatgctgacaaaagttgaggaggtaagagaatgagtgaagtaatgtagtagtactgtatagaactgaaaaaatacaagtcaatctctaaaggtgaccctggagaactgttgccatggaagaatatgatcccagtgttaccaaatatctcagtttgttaagagaaggcaggaattcagactttattttttaacattaaatctgctgatttgtaaatcttgactcaaattaagcacatagacttataacactgtgaatcaaatatatagaattgccttgccagacttggctatcagcttgtgactgcttcatccaaatgatcaaacacggtcaaagggtctagaatgtgagctcagacaggtagaaactagcacataaaggatctgggggcttgttggtataccaactggctgaatactatgaattagagttcagagaaagggatgcattatgaggagcaaggatcagaactcaaatatcaaggaagtgtgtaaagaagattctttggatatagaaaattgatgtcaggaggtgttgtgataagacattatagtcaaagtgaaggtgggtttgaatgcaaaatgaggattcttcaattattttcaataaacaactaaaagtcactgacttttggttgatttcagtcagggctgagccacttaaaatatggaagtattctgggccaggtaataatgtgattattgaaattttgctttttattctgtcaccaaagttgtgccatcttagtggactatgactctccacccaaaggcccatgttgacatggatgttcaacacttaaggcagggggtgtatatggtgaacagaaccagctagcactatgtattctatttattttttgatgttttagcagaccctcatagattggtgctccagatagttgtcagggtggctagacctgtatctggctttctgtaagggaatgccaaatacaaaatggattcttggaaagtgacctgatattggaatagtcttgcctgcagtggaggaagtgggtggaggggcagatttgagagatataatgactggggaataaataggatcaagatagtggctagttgtaactagagagcaagattaaaagtggtccattttatctctgcaacctaggttcttacaagtatgatggaaaacataaagtcataacaggaactttcaggctatccatgtgttctcattaagagaaaatgcacaacctttcttccatgctggcattttaatttaagctagtatacacaattctctctagagctgttcaggaagatccattcaaggctcagctttgttttgttgttttattgtttatcaagatggtagaagcagactctgtatgaaactgtcaacatcaaaacactttcattctttctcctttaaatagataacacaataaaggtactgcctaatcctggcttattaaggatatcttagaaatgcactggaagtgtagggatgctggtcaagtaaatcccaagccccaaggactcaccctgaggcagttgaatcagacagcagtagtgccagacaaaaataaaagcttaataacttcattcaacctaaacagcagtttttgtaaatttttcaaatgcaactcagaatttgcagagagtaagcactgtgagagcaaaatagcaccatttgatagctgctaacctttactaaagacttagaacgttccaggtgatttcataccaaagttatctatataagttaaatataatgataaattttgaccatctcttaacaatgccctaaaacatgaacctatagttttatactaagcaaagcaacagattctattaagagtagcattcaggctcttccatgccacacaacttgtcatgtcttttctctgagacacagtacggcaaaggtttctcctaggttggttttccccttttagttagaaggagaggaaggcaggagtgcttaggtcccactcaaccaggcaccaaggaatgcatttaaaaggcaggtatcctgcccccaggggaaaggctgtaacttggctatttctgtactctggaagtatgggggagtgcattttataggccaaaggaaagtgagtagaaacatctatatacactaatatgagcaagaaaatggactagattatctcttttgagggaaatgtgaaataaatgtaatgaatggggatttttttctccctttagttttttatgtttattaaattttgcttcttagaacttctaagaaatgagtatttgagggcaactcaaagatgcagaggtcttcagatcttcttacgttctctgtgacatggctctattaagcaaacatgtttgtgtttgaatgttgacttctccagcctcataatatcaccttttgctttgcatttgttcttaccaggaagcagaatgtgcctacacactctttgtggtcgccacattttggctcacagaagcattgcctctgtcggtaacagctttgctacctagtttaatgttacccatgtttgggatcatgccttctaagaaggtaagtcctcttgccaatgtcataagttgatttcctgttttgtattgagatttccattgagaaaagttatttttaaagggagcaatcatctcgttggtaaggttccacataagtcccccaaacttccaactgtttctcctctctggcattctgcatgtgtgtccaccttcaaagaacaaacacaagctgcagcttcttgagtcatgcatgtcagtgggagaaatgtatgtcccctcttctctcactgacatctatgcctagtgcctccctctcaaaaacagggaaatttgttgacatcctccataagctttttatattcagcagaattcagcctcacggtgttggaaaaacaattttgtttttaatgaagaaaaagtttccctgttttcatttccagaaacctgccatttcaaaagataaagccaaactaatgttcatgtatagctccattttgttcttgctgagaggagtttattcatgctaagaggtgtttatttgttctatacaatctaagagtacccatctgaagaaagtggatttggtttcccaaacgcattgaaaccagtctccagccacccagtgaacaactgtctaaaccacagctgaaacaatctcaagaaagatgttaagttcgagataccagtcagtgcaatttatcacctttggacttctatcttctgcctgggtctaacattgctctcttgaggcttacctgtctgtcattttctttttaacaaacccttgattacatttcttcctgtgaaaggaatggttcccttctttattttcacgtccttcttcctgattttggagccccagtcgatctttttgcactttttatcctccctgatcctcttttcttactgggttttcccctcccacctaacttcgagtcttttctttctaatggccattgatttggaagactggccagggctgtacttcagttcctcttgcctccaggctgacattctgctgccgcatggaatctcagagctataatctattaagcttcttaaatgcttaaacatgctatatggctttcaatatcgggaataaaaaaagaaggggttgatcagttgttaaaaatagggtgtcaaatttttaacccttgtcccatgggcttggatggttctgtgtccagagacaggtgtgtttttaacagttatacctttgtctgttatggtttagtaacaataaaactgactaaattaactgttaaaaagaggctgaagtagaagtgagattcactggactcatggggcatttctgtagcaagctgttatgggaagggacatagaaacattagagggaagcaggagggaagggtgcctgggaagggctggctttgtaggagctgccaaggatatatacgtctgcctctttgtggtgtgtaagggcctgactaaaggcagcaaaattgtaggtgccaatggcagttttgcatcactgtgactgcagacacctgcccaacagtcctttatccccagactaatttaacagtcatagaatcttagacttgaaagggaattcttcttggtcacttctcacccagaacagggatcccatccaatatctccaatatctctaacggatgaaatcattcagaaggtgtttaaaagctttctgggttatgggcctctaatatccctttcaaggagatacatattatttttgaataattttaactcataagtaactcagctttattaagcccacatctgaaactcaatcactgactcattaaacttatttctaacatgtagaatttcataaataaaccttagtttttttcatgaaaatgttgcttgaatttgaaaattaatatcatttcctccttatttcttcccaccttgagccttagtggtttccagacctcaactcccatcctcaaatctgccatttccaactccatcaccaccaccatcttctttttcttcctgaaactaactctagtttgtcaatgagacttaagaattaaatgagttaataaatgtaaatttcattacatagtaagtactccatatatgttagccaatgttattatttatacattcacaaaagtgaatagatcattctagaaacattctgagtgttgtaaaggtgaatgagcctatcgtcttccctatggcatttcagcctaagtttgttttaaactttatgtgattctcttcaccttgtaagtttaactggaacttgcagcaaatcatagtccttagaacttttagtggagaaaactgttctcagacttgtgatcctttttgccgacagggtaacttaccttttactaataagttagctgaccaaagctacaatctattatgaatgagctagagatttagtcataagacctgagcttaaaatttgatatttatcactgattatgatcatgtcctttaataattcttatcatctgtaagtgggatgtgataatgctacacaacccattgttgtcatgatcaaattaaataatgtatgttaaacaatgatacaaactaagtatcaagcattcttactaggtttaatattcccagttaaaatttgttttgagagttttaaactataattcctgcccactgcaacatctttgaatctcagatctgtcactgagtaggataccatgtcattaatgccctcatctaagtttagagccctaaacacctctctctttggccatcacagttataactttacctgtttattaagccaatcctaaatactggtattttgctgagcccattactgtatttgaagaatatcaacaaatattaaacttttctcatatttgttgaactaaaccagaaatctaaagtatttagagtatgttcaatttgatatttcaaaacaagcattaatattatcatcgaaaatatttaaatataaatttcacatatatgaatgtgaaaatacacatgtatggagatatatatatatatagagagagagagagagagagagagagaaagagagagatataggtgttatgttatgtatttactcagttattcaacagatattcatatggtagtaccctgccagggatttaggaacatatcaatgaataaaaacaggcaaaatatttcctgtctttctagaggaaaggaggcaatgaacactgtatctgataaatagaaatattatacagtatagtgagctagaaaggtaattttgtgctatggaaaagatgcaacaggatgatggggatcagagagaatggtagttttaaataagatggtcaggttagacctccttgagatagtgatacctgaagaaagacttacaggaaatgaaggagttagccatttgaatatttggagcatgactattgcagaagaggtaacacccagtgcaaagaccttattgcaggtatatctgcagtgtaattggaaaagagtaactaaaaaggagaatgacagattaggtcaggtacataatgtaatgaggcaatggaccaggtagggtcaaagtagtccattgcaagattttaacattgaataaaatgggatcttttgaagagttttgagcacaaaagttaaatgatcaacctaactttgattttaaaaaggataatttgggctgctgtgttgagaaacaagacagaaagaaagagacaggtaggaggttactgcagtaggtgagagaccatggtaattcagaccaggggcagtagtagagatattgaatgtattgctgataaaatttgaaggtaaaatcagcaaactttcctgattgattagatatggcatatggttggaagaaaagtgtcaaagatgcctcacagcttatctgccaattgggaaaatggagttgctatcaattgaaatgggaggaagatgggaagtgcaggcttactctaggaaaggggctgacacttagagttcagtgctggacagaaaagtttgaaatacctattagacatctaagtgaagatgttgagtaggcagttgaatacaaaagagtccagagttcatgagagagagctaatctgcagatataaatctgagattcatcaaaatatagatggtatttaaagccctaagacttgatgagatcactcagggagtgaatgaagatagagaagcaaagaggacaaagaactgacctctgcatagctataacagtaagaggcaaatgagaagagaaagcactagccaaagagactaagaagaaaaggttattgaggtaggaggagaaccaggagggtgtgggatcttggaatccaagtgaagcaaatgttttgaagatgaggcaatgattatgtgtgtcaaatctgctgataagtcagttaatgtgaaaagtagatattggctattggatttagctaaacaacctaataactaacaaagcaccttttaaaaaatattatctcatttaatttgcaaggttggtgtgaggtaatatttaatttttacaactatttattgatttgtagaaaggttgctgaactggtaaattacataactaagagagaactcaggtgctctgattgcaaaagcccatgctttttgatgaaatcctattttgagacagaaatataactatgttgatcttgcaaatagatatcaaattttattagagatgttatttgacatatcaattttgccttgagaatagttatatttatcagtgtaatttacaaaccaacagcaccttcttctattacctccctggacaagtaggccataaacaaacacatctgcctgaggctaatgtttcttctcaaatattctgactgatgaaaaccatagaataggtactacaatgaaaacagagaatgtgaagtttttttcttaagtttaacaactaattttatttggactgcaggctgtagtttgtttgcatggtctattgagaaaactggcaaactgtgggcctgaaggccaaatcagcctgctgcctaatttttaaaataaactttttagtaggacaaatccatagtcattcattgacatattgcctttggctattttgtgccatgacagagttgaataattacaatgaagaccatatggccaaaaaagtctagaatatttactgcttggccctctacaatatgctaactcctcatataacccaaatcagtaacagcaagaatgtctcatagtcctggacttctttctgtgtctaatcacttactaataatggcttgcttctaagtgtttatttgtatttttaagtaattctgcatttattcttttatttaattctcagagtattggtaaaatagggtatcttagcccattcagattactacaacaaaatacattaagctgggtaaataaacaacagatatttattgctcacagttctggaggctgtgaagtccaagatcaaggcactggcagattgagtgtatggtaagggcttgctgtctgctccatagatggcatcttgctgctgcatcctcacatgatggaaggggcaagggagctctctcaggccccttttataaaagtactaattccattcaagaggttggagtgaacatatttggttccttttaggtgccaacatatgaatttgggtgggggacaccaacgtttagaccacagcagtcaatagggcttatttccatgagccaaactgcaaaagagataagggaaaatgaaaacttaaatctttattcatttttcaataataaactcaaggatcagctcctgtaagaagactttcccaatccctctaggaaaaaaaattatcaccccacttacttttaaaatctcaattatattttggagaggtatcattcaagcatctataatactttattgcactttttgttaacttgttttttctcatctaatagcttgtaagctctttaagtctagggacttattaaatttaacatccattgagtgccagtttgtgccaggcatgtgctaagtccataaatacaatgatcaataagatacatcttgccttcaagataaatctagtgtaataaaggggataaataagtgaagaaattatcaatatataaattaagatgtactataaaaagggagatattatctaatccagtttagtgtcctagggaagatatcttagaagaactgacatcttccatgaaggaagactagaagtatccaagacaagcagagagggtcattccaggttaaattgcaagcaagtgttaaagcacttctgtgtttggggaactaaatacataggaagaagaagggtggagtggcaaaaaactaaattggagaagtgaaatgggaccagatgatgaagggtcttttatgacatgttgaaaatattggatttggtctttaaaactatgggaagttcttaaaaactatactgaagaagtataagaaggacaattatgtgatcagatttacactgtagaaaaggggctatgacaatggtatggagtggatcagaaaaagatcgatcatacagtagccaagtgagaaatagtgaggaacttaatcaaggtagtcatgtgtaaacagagaaaaagggacaaattttaaagatatgaaggacctaggaataataggacttatattggaagtgaaaaaggaatcatggctgacctttaggtctctgtcttgggcaactgagtagatagatgtttacattaactacaaagggagaatgtgtttgaaggatggggagtgagaaaatgagaagtgtcattgtggatatgttgaattgtaggtgtttgtgggaaattcaaatggaaatgaacagttggacatatcagtctgaaactcagaagacttatctgtgtggaaataaagatcttggtgtagtctacattcatttaacaaaggttcattgagtgcccccatgtatgtgccaggcattattttagtcccataaagttgaatctttcaaattcagtcattggatggataaaacaaggagactataaagactatggacagaaccctgtggaataccagcattttggaggaccgagataactggattttcaaagttagaaaaaaaagaaaaattcacaggcaggtatagaaccagggagaaaaaaaaaaaaaaaaacagcttcccgactctggaagcactggcaaattaatatactgaaatacttatacctagagtaagagttgaaagaggtgggagactaggaagtagaggacagagtgtagaaaattgggatataagagctcagagaccatagcttattcattgtccctctctccctcattctttcaattctatttaccaagctctctactgtgtaccagcactatgctaggtgcaaaatacgtgatggttagcaaaatagagtcctggtttggctagcaaaacagattcctggtcctcatcagaatgtatggtataatagagaaaacaataagcacgtaaacaaacagtatttacgtaatgtatatactacgaaaaaaccaaacacggctctatgatacagaaaaatataggacctatttagaaaggcctgatatttgagaattgaagaggtgcaaagagggaaaaatttatcaagcatttattaatatatactctgctcctataatatttttggtgcatatggataatttttcaatgagtaataaatgaaatagcaaggaaattgatataattattttctattatccaatcactacaaaatgtaaagagatagatataaactttgaaagacatcataaatgaacattttataaaatataaaagttgtccacttgcctacttttaatttcaagggtaattatcaatttttgctttttatcgaaacgaagccaagcttagcaaattatgttaaaaatgcagatataatttaatatagcaaaattatcataagaattgattttcctttttgtggttttgtaacattagaatggttttattccaacattcccattccttctattagctattgtttgatttttttagaggggcatttactcttataatcctctttcagcacagccttgtgtttcagtttagccaagtgcttcttaaagtaagttatcttgaataccactctcatgaagtgctccacctaaaaattaaataaaaataagtttttaataattaagtaaatctgaaaaatatgtagtatatgatatccccctctttaaaaatgacattatacactattgtttaaaggtttttgcaaaggcctataggagagaaagttctagtatgtcaaaattctgttttctcaacctaatcaattacacaacccttttaaaaaaaaagattatgtacctaaatgtatttcaaagtattctttaagaaatactgctgcaaatggttgcttaaagttctaggtcctttactaatctctgaatggtgttgactgaaaattgcttaaaatattaagtctcatttgagggtatttgttttacaattttattattattattttttaagatgaagtctcactctgtcgcccaggctagagtgcaatggcacgatctcggctcactgcaactccgcctcctgggttcaagcaattcttctgtctcagcctccagagtagctgggattgcagtcatgcaccattacacctggctagtattttgtatttttggtagagatagggtttcactatgttggccaggatggcctcgaactcctgacctcaagtgatccacctgctttggcctcccaaaatgctgggattacaggtatcagccaccatgcctggccttataaaaagtaattttgaaagtaaaatcattcaatatataaaggtgtgactgcagttacagcataatgggtcatgatgaagacagtagtaagttggagcttgattgaaaacgttcccaaatcacagtcattgccattccactatagatgcataaacaaattagccccaatagaaaagcacttacctgatgttactcagctatttaataaccctgagtactcttttttcggtatacttttccttaacaccatttttgagtaagaatatagaacatgtctaaatttgtattcaaacacatctacatttttctcaacaaaatggaaagattatgcggttgaaggtcaaaattaagagcagcataataatgtctttcttgtgcaatgttatttttccccaccaaagtaaataatcacgggtttaattgttatttcaggtggcatctgcttatttcaaggattttcacttactgctaattggagttatctgtttagcaacatccatagaaaaatggaatttgcacaagagaattgctctgaaaatggtgatgatggttggtgtaaatcctgcatggtaagtactgcatttactgcttccagtttacctgctgaacagaccatttttgtgcagagcaaataatcaaataagtaattcacgcccaggaaattctttgtatcacagtctgacttatgacgttttttcctctgcaaatatgaaagtgatataaagtgtacttgagttgtaggaggaaaaaaaaacaactttcactgcaggtctgattacagggtgcttggaatacgtgcacacaactttctcaccttttatgcatcatagaagtcaaagctgagagaagctttgaacctcaacagacaagattgatagacttcagagtagattttcctccgatcttgtttatttggctgattacacattcagaacttgttcaagagcatcctttatcatcagggaggatgttacaaaccaaagacaaagacattactgacaaaatacaaatgtgtgcagaaaaattccaaggtgaatatttttctttttaaaccaactgttgcaaagtgaaaaaatcaattaagacatttcatctacagagtatgaaatcactcatttgactgataaaattaattggctatttcggttttatttcacttcttgctaagaacatgaatgtaagctaaagaaaatttccagtgtcataatcatttgcatagtggcattttgcgttaaagccttagatgtttcttcccttctcatctttctttgaaaattagaatattgtattgacttatattgcataattcattctagggcgtagacacatctgtgtttttcatttatggtgcaaattgttttgctaaatacaaaaaaaaaaatgactcagacgagacaaattttcaatttttttttacttaaaaattgtataacacatatgtgtttaagacattatctcggccgggcacggtggctcatccctgtagtcccagcactttaggaggccaaggtgggcgatcgcctgaggtggggagttcaagtttagccgggtatggtgacaggcacctgtaatcccacctactcgggaagctgaggcaggagaattgcttgaatctgggaggcagaggtcgcagtaagccaagatcacgccattgcactccagcctgggcaacagagtgagactctgtctcaaaacaaacaaacaaacaaacaaaaaaaaccaaaacgacgtcatctgactcttaaaatgaagtggggctccatgccttttagggtgctacagaaatgtatctctttttcctgaccctctgctcactgttccagaggatgatgtaatgcacttcacagtggggcagaagttctgtccattatgccactaagtggctcttcaatttaaggcattttcaccatccagaagctttatctgatcctggcattttttatacaaagatttcttgttttgacaatgccttaagaagttaaaagttcttaattttcttttttttagaagaaccatttattgcgtaagcagattcctaatatattttcttttattttgttgtatacattgaaaatattcaccttatctgagtctgaaacttacagtgtggtattgttcttgtacatctgttttaaaagggtgtcagattatttcataaattgctctatatagaaaggtgtgcttctgaatgattttctaggcccgcctactcaaaagagatcatttttttccccaagtgtgactttgaaagtttatagatatggcttaaaattttgtagtcttaggtatattatttttaaggagaataactaataactactctatttataaaagaagacaatgtagtgtgtccagatcttgacaataggaaaggatatcagattcaggggagcataaatcagaatattcagaaaattcagaaacctcattttagcaaatgactttaactattttctccacccaccttatactgaactagtatagtgaacaagtaaaaagaggctttataaatattaatctttctttgtccttgtacctccttgacacccctatgaacagagttatggctaaaagataaaagaaaaaataagggaccttaaattcaaaagttgattgcagtttcgtcttaatagcatttgaagataagtggtcagctgtgaagagcattcagatattggtgtaatattataagctgttatgtcatataaccaacttgcagttcgtttagttttaatcatttttctgtttctgaagagaaaatttgcatggttccctgggagacaaatctcttaagaactccacttttacatatatggctttgatttctacctggctgtcacggtactccaatttcatcatctgggcagaatcttaaccttccatgttttgaaagacttaatttcccaactcacaaaacacatcttaaacatcttccagttaaataatacggtgctagttaagctaagagcacagctccacaataatggctctctggtttcaggctgacgctggggttcatgagcagcactgcctttttgtctatgtggctcagcaacacctcgacggctgccatggtgatgcccattgcggaggctgtagtgcagcagatcatcaatgcagaagcagaggtcgaggccactcagatgacttacttcaacggatcaaccaaccacggactagaaattgatggtatcacatgttgatatggccaatctggggtctagtcattagagcaatagacataaactcaagaattctaagttgtattttgaattaaccgtctatacatgcatgatatgaatttaactttcttccctctatagttctcagtatctacaaaaatagttttctacaaatattttacctaaattgttacatttctatttgcttgcaaaaagaagaatgccttttctatccctcagccagactgatggaacactctctcatgtctttatcagtagacctccaggttactctttcctatactgaaatggctttcctgcataatattgggaatctttaattcctacattctatttggatacagcatcaaatttcactgttattatttctggctctgactaactgctctgatgcagtgaaaaagtgttgggaggatatttgtatttataaaataagatgactgttatgttagtacacagtgaattttttattttcaatttctactaatgcttccatcttcgcatccacacacaggcaaacccaatgataatcccttatttaaattgtttttcttttatttaatgttttgcagaaagtgttaatggacatgaaataaatgagaggaaagagaaaacaaaaccagttccagggtaaggaatactgacattttgattgggatttttccaaattatattttaataaaattataactggatcaatgtatttttcagatacaataatgatacagggaaaatttcaagcaaggtggagttggaaaaggtacataaatttgattctttctaaataattatatacaaaattatattagagctgtagttagatacatatgcattttaaaacctgccacttgcttccttttctataaattattttgcttgactaagcagtagcatggtgtaatggtttgataaactttcatgaacagacagaaatcaacatctggataggaaccattttaggctctgaaaattagtatcattattttctctttttaccagaatcaggataatggcagttagccaaggtagtttaaagaaatataattccagtctcagaatattgcttcattttctttttttaacttttattttagtttcaggggtacatgtgcaggtttgtagtacaggtgaattgcatgttttgggggtttgatatatagattatttccttacccgggtaataagcatagtacctgataggtaggtttttttcatccttctcttattaaaatcttgctggcctaatagactgattttcattaggggcatcgtcgtcatttcttccaggttatgaacttggagcaactcctattcatgtaattacaactcgttatctttagtgcttccattgccactaaaaaaaatcaatgcagaattcatgagttgcttctgtcaaatacaggtggaggagttgtagccattctagatattaaaagagggaaggagatctctgtaaactatcccatagaattcatttccccagaataaatcaatataaaaatactatgctagattgcactgggagcaatatatctcaagacctgaaaaataaatcccacatagaaatactcctatagtaactatggcattaggaataggaaagtgggacatatatttcttcatctggccatggaatgcattaacaggcagttcaataggaaaaagaaaaccctcttgttaattacagaaatcttctaggaaagagcaatttctatgtaaagagaaaatgaatacaaagataagttttaagccattagctacagaatatattaaggattttttaagatgggaattgcatatatatttatgaagatattatctttagagatagaaataattcctataaaacatgaaaaattaacagtatgccaggtatgttatagaataatacattagaaatgggctttatgtgcctgatttataatcctttgggtatatacccagtaatgggatggctaggtcaaatagtatttctagttctagatccctgaggaatcgccacactgacttccacaatggttgagctagtttacagtcccaccaacagtgtaaaagtgttcctaattctccacatcctctccagcacctgttgtttcctgactttttaatgatcgccattctaactggtgtgagatggtatctcattgtggttttgatttgcatttctctgatggccagtgatgatgagcattttttcatgtgccttttggatgcagaaatgtcttcttttgagaagtgtctgttcatatccttcgcccactttttgatggggatgcacacgtatgtttattgcggcactattcacaatagcaaagacttggaaccaagccaaatgtccaacagtgatagactggattaagaaaatgtggcacatgtacaccatggaatactatgcagccataaaaaatgagttcatgtcctttgtagggacatggatgaagctggaaaccatcattctcagcaaactatcgcaaggacaaaaaaccaaacaccacatgttctcactcatagatgggaattgaacaatgagaacacatgggcacaggaaggggaacgtcacacactggggcctgttgtgtggtgggggaaggggggacggatagcattaggagatatacctaatgttaaatgacaagttactgggttcagcacaccaacatggcacatgtatacatatgtaactaacctgcacattgtacacatgtaccctaaaacttaaagtataataaaaaaaaataaagaaatgggctttaaaagctgttatgaaaattggcacacctaaacagaaagaatatacatgcattcagtaaatttcttgtggtcatctttggaaacctagttttctatcataaggcctaaagtttcagtcaaaaccattcaaattgatttgatatccaaatactgtcccaggcattgtaggcaggtcttttgatgaaaagacctgctccttattgtaagcagctcagagtctagtggacaagacggacttataaaaatatgtctgacataaataccacaacaaaggcatgcacagatgccaacacttctagaagcaggagcaactagtttgatctgggagtactgcagcgaggaagtataatgtaaagacatttgagtctggaaagacgagagcatgtgcaagcagaagagtgcgaactcatgagtgcaagaatgtgtctaccttgtcagcactttaaactctggcacattcccattgcctgacacaaaggatgtattcgataagtagttatctttatcaattaatgaatgagtgaaagcaaaagagtaaaaagaggaagacactttctaatcagagagtacaactaattcaaagaaccagctaagtaaagaatgtttttttttcaggaaacctctacaatgcagatgctagagatgagctgttgtggggaataaaattattgtatgggtttgtccaggttataaatatctcttcatccaatgcaaaggagtttagagttgattttatggaaaacgcaaagccttaaaactgcggggcaatatgataagttctgcctttgggacaacctgaaagtcagtggtgagctttttgattaactgagcaactgagcttttttattaattagacattggggacgagggaaaaaaatgtaggagatgcctccactgctctaaactagggagcggtagattgtgatgccattgattagaatgcagaactcagaggtaagaataacctttcaatagagaaaagataacggagatgcatttttggcaataaagattaatatctgagtttaggaaaggaaagcgaggcttttgaatgttgattctatggtctttccagaatgcaatgcacaaaaatttagctttatataaaaacaggaatagttttttgctgcactaaagtattctttataagacatgcatgaaagcattattttatatattatacatttatgatatgttttgatttttaacaattataggtatattttcaggaataaatgtatatataatttgtgttacaattataataaactgcagctgttctttgatagatttaccctatataatttaacactgattatatggaagaatgtatatctacttcatctagctataaaatatttatattcataatcttttgatcttatgctttcttcttgaagtaggtaggatattctattgaattaaaataaatcctgtggggtttgactttgaatttgacctacaagtcaaaaaaaaaatacaaatattactctttttttggggagagtggtataaattaaatttcagagaagataaatttccttcagttcagctctgattttgattatttcttgtcttttgctggctttgggattgttcttgcttctctaatttttttcagttgtgatgttaggttgttaatttgaggtctttctaactttttgatatgggcatttagtgttatgaatttccctcaacacagcctaacactcatgacatgagtttacctatataacaaacttgcacatgcacccccaaaacctaaaatgaaaatgaaaaaaaggaagagaaataaaataaaaggcttagctttttttttggtaatctgcacaattttgctatgttcctgcaataaaataaataaattttatttctaatgaaattattacaatttgattcatttgaagcaccatttatttagtacaaaactaaagattttaaaaatttaattaaaatctctttactaatataattaaattaatctaagctgatcaataagcttacttcaatttttagaactataatatttctccccaaaggcaataacatacactgatccatataaagtttagtgtgtagtaagtagaaaattctcaataagtagaaaaaaataataatggcccccaaataaattctgtatttagcagacagtaatattagttaagaaatatacatttaacatttgctcaatgtcaccttttcaacaagacctaccctaatctccctatttcactgcagccaccatatcccatatccttcctcctaatcctcctgactctaccctactttatccaaaagcatgtatcaccttcttacagactatataatttgcttaatttttatttattttgttcattgtcttctttctccactaaaatgcaaggttcatggggcagagatttttgtccatctagtacatatcacaaatatcttgaatagtgactgctgtaaatagtaaatatttgcttattgaataaataaattcagtaatatttttatcaaatgattacaattacagtaaaataactcatgttgtatataaactacactaagtttccagtgtctagttaaccatcagggaaaattcagagaagtcactatggacaacagaaccattaaatactattatttttggctgctttaaaaaaataaactacaccaagcaaagaatcaaactgataaacatttaaagtcaacactatggatcagactggtttcattttgggtagaaagacaaaaaaatgttttgtaactaaaatttatcagctctaaaattcttgttaatagaactgcaaaattctcatacagataataacgatgatcattttgctggcgtgataaagactagatgttagtgttgaagatgatggatatttagtagtccaggaccttattttaaagtattcacatcgaagagtcactttcctatgctgcatatctaaaaaagagatttgtcccatgacttaacttttatgaagttctcttctcactataggccatggcccaaatactaactgagctctctacttgcccaaaataaagtggtgaatagttaccaagcccataaatcccacattaccccctaaaagtagctgaaatatttgtagacaagaaaagatactgggagaagaaaggaatatcctaaaattacactgacagtacctgaggaaatatatttgtcaggttccattggggtacctggtaaaccaaccaccatgcatacaatttccatgggaaatgagttctaggtatccgaaaatccatttgtagataccaaagaaggaataaagttgctagttctttccctcccctgcaagcattaatgtcactcaaagagacagcccagagttttacatcagctcaatttctaaaccttcaggcatctacaaatgaaagagattggaaaatcagtatacttttaatgaaaaatctgagataattgtttttcattagtttaatataagttgtaattcctcaaagggaaaagttcaaagtaaaaatatccttgaataaattacatcttgcttttaattaggtattgtttagtttaggggtgaaaatccttatggttgaaatccaattgtacaagacaacactttttaatgttctccagaaattcaaaggagtcttgtaagtacagtaataaacatggttcataatattagaaactaggggtattagttctgccaaataaggagatattaattctggaatatctggctcctagatcagatatgaaaaaggtattttagcttagatcacgtaacaaacaaaagctggctctccttcattattcttctattttcctaaactgggagaagttggatggcaaaggcagtaattagtactgctcaacccttacctgactcaacctagggtttccttttattcatgcagtggtttatagagaatgtttatagacgaggtaagcaaggagagagagggagaataccatacaccctttaggaatcacagcaacaatctgtgaacgtgacctcactccagatttcaacctttattagagtcaaagtgctatctccattgatggccattcttagttgtggtctcacaaaacatttttctattaaagaaactattgacttttgacaatatcatttctcccatatatctttagtttatgaaatacaaaaatctagttcttcacattttatgttattgaaatattatctagcaaatagcataagctcagccatattagtgatatctgtactttaactgtacaataagccccccacactacatagcttatttgaatactatattttatttcttgaaatactcaacagtgttctcctatgcatcttctagtggtattttctaaaaaaaaaaaaaaaagaaatatgtttgtctccaaattgatttttctgtattttgattaagaaatatttcatgcatatatgcctgtataaaacgtgactaaatattttaaagaataacaaaataagataatgtataccacatcccagcttaataactagaacataatgatttctaaaatctacacgagcctatctcttttccttacagaatcacccccaaccccttgccaagttagctatagtccaaattttgtgttaatcattctcttgttttcttttgttttatcacttgcactagttaaggtatggattggtcgccacagcaaagaccaaatatagcaacaatttcaacaagatagaaataggctggtatagtggctccttcatcaccatgcccctgactctttctatctcttctctgccatttccagcactggaaacttgcagttcaagatggctccccatctccctctgtccattctgtatcgcagctagctgctcaaggaaaggagaaagtggaaggcatatgtacttagaaattattctattactttcctggatttaagagtattcagattttctatttcaacatcaaacaattgcatttttaaaaagaaatttatgtgttccatgtcaaatttagtagtgtgtggttgtttataatattttcttatatctacttaatttctatagtatttatagttatatgtctttatttctaacgtttttcttgtgcttttaaagattatttaaagattatttttaaataatctttatttcatttaaataaaatattttatttaaatcttttttaatgtaaatctttatttatcttattttatttaaatctgtattttaaagattatttttcaaataatctttccaaactatgtctattttattagtcttacaagtcttgtcaaagaaccaacttctgactcctttcaccctctctatttaatgtatatttcatattatttttaatagttttctttattactttgttctgtctactttgttggtgtatttatgctcttgctcttttactaatttttaaaatctgacctttaccttattagttttgagtttttcctctcttccaaagtaaggatttaaggatatgaatttgcttctattactttagctattttccatatttttcagttttgtgttttctgatttccattatactagatttttttcactcaaaagatgcttagaaatgtgttttgaaatttaaaataaattagatttttagctacttttaaattttttctaacaatttttctgcggtcagaaactgtggtctatataacagttctctaaaacttgttaaagcagcttttcggactagcacatagtcagctataataaatatttttcattgtgcttaaaacaaattgtacatttttaactaattaggttcgatgtttcccaaaactctgtaagatcaagttactagttgtgcttctcaaatctctgtgctctgaccaagttttgtctctttttattcagcaactgatgagactgttttgttaaactctccttctatcatgcaggtattctatttcttctgatacttctgtccattttggttcctctgcattgttaaattatgttattctgaacccatttagaatgtttctgtgtgtgtgattgattaaccttttatcattttgctgtgcacctcttcatctatcttaatttttttggtctttgagtttatttgtctgctgataatacaggacgaccagctttttttttttttttttgagactgagtctcactctgccacctaggctagagtgcagtgacacgatctcagctcactgcaacctccgcctcctgggttcaagcgattctcctgcctcagcctcctgagtagctgggattacaggtgcccagctaattttttgtatttttagtaaagaagggatgtcactatgttggccaggctagtctcgaactcctgacctcataattcgcccacctcggcctcccaaagtgctgggattacaggcatgacactaccagcttttataaggctagtatttacctggcatttcctctatcctttcactttcaacacttcatgacactaccagcttttataaagctggtatttacctggcatttcctctatcctttcactttcaatatttctgtgtccttatattttaggtgtatctcttttattatgtttgaaaagttttacctctacccgacatgttttatccatttaaattatttgtgacattatatatttagaataatttctactgccagctttttattttttccaaatattctttccatcttttcttcctgcgttcctatgcagttattttcttttatttcatgctacacacacacttgtatgggtggtctattctatactttgtgtctattttaattgtccaatcattttctatattgttagacagcaaggattgccataacaaaatagtacagaactgtgtcttaaacaatacaaatctgttatattttctcccagttttggaggctagccaagtacaagatcaaggtgttatctgggtcggtttctagtgagacctctctttctggcttgtacaaggctaccttctcattgcatcctcacgtgatgttttctctgtgcacatgcagtagaaagagggatttctggtcccttttgctctttttacaaggacatcagccctatcggattaggcatccttctttgtttaaacttaattacctctgtaaaggcccttttccacacagagtcactttgagtgttagagcttcaacatacgaatattgagagacataattcagtcattaatatcatgtctacttaatatataaacatttaaatataatccatttttttttctcctgaacagtataaagagcctaggatattttaacttagaccatcgctttctatttacatgccattttccaattttttagttctagtctattattcctccataaattacataattgtattattttttaaaatcagtgctctgtagagttatgttcatatttattaatatctttgttcaccattgtattttgcttctcagaccccctatctggggtcatggtccttcttcttgaatatatcttttgaatgtatttcagagagtgattttggtgttaaattcacagtttttgtttgatagatttctataattcttgaaacatgtttttatagttatagtgtgctagataggttattattttttattttgcacattgaaatatatttatatatttctactgccttttggctttctttttttctatttaaaagtcagctagctatcagtcaaattattattcctttgtaggcaatcttttctctttggttgctttaatgatgtgtgtgtatatgtgtgtgtgtgtgtgatagaattttactttgctatgcctaagtgcatatttctcctgaatctgtgtattgatcttttccaacaattcttgcaaattatcaggtgttatttctcaatattcaattgcctcatcctagttctctgtattctctccctctgagtctccaattaaacattctgcactttctcactgtggtttctaagctatttaacatctatttttatgagtagtaacttctgatttatattccagctagttaattttctctttagctatgtctattttgacctatttactgagcttttaaattgttatttaaatttaatttatgtaaactctatttgtcttaagatttgcctgtaacttttataatctttttcatattttcaattgcttctctaattttattaatcatatgtaaatgtaattatattttgtgtctgtgtccaacacctctgaggtccttgtgggtctctttctttgatttagtttttatttatttattgctggttctcattttgttgaattattttcttgcatgttcagtacttttaaacattgaaatttttttttagttactatggaaattctttaagtcctatgttgcagcttcttgtaagagttttcaattatattgctatttctctttaacacacacataacataaattagtgctttaagaaaaaatgctcatggttaggaatttttaggggatattgttttcccttaattcagcatgatattttctttctgcttctgcaaaggataccagctttatgtgtattttcttgtatgattccccacacacatttggcctggagcaatatcttttataccaagctctccttgcaacatgatacactgaaatctgaaatcctattttaaatccagctttaaaatgattgttgcactttaaaagattgtttttaatattttaaatagcatctcatttagcatgggaatctgatttgtcatgctgctggatagaaaaatatgctatgttattatattttgtttcagtcatttttacaactagaaagagcaaggtttttctcagtggcacacacacacaaacacacatacacatatgctttttcctaagaaagtataagggaagcttctaaatagttaacatttagggcaataaaattttttaagtaaatattggatttaatcatgacttttaacatttctgaaaaatagagtttatttataaagaggcctcatgtccttaatgctacattttaaacatctctttattcatcacacacaataaatgtttattactttataaacatatccaaattcacaatatgtaatagttctttattaactacggtggataaaaattctatttcagagtcttaccgataacttcaattttactaccaactcctctgaattcttcaggttattactgattatattttcactagatcttcatgaagagttcatactagctgtaaggagaagatcctctcctacaatttcttgctattcacttatctagtactttcattcaataatttctttacagaaggatgtggggagagtttaggtatcccttgtaagaaagcagaaacacaggaaaacattgcagagtgatactgaggcccatctgaggtcagaggttgtggatttctcacagcaccagcgagcttagccaagggattttctccagtggcatccaagagagcatagaaattgattttcatattaagctgaagttcagggtccataaagatgggaacagcaaaatgataagcctgctgggatgttgaaggcacagcaggagagttgtcagtgattcatctgaagggataggtttgccctggtaaagaatgaggccttgagaaggtctagaaggacttgagctcctgatagggccaaagagaaggcatggagaagaaaaaggatgggaaaactaaagggatcaactattgtgatcagagcttcgtctaataaagaatccattataaaaaaaatttctttacagaaataatcttcttatagacattttaaaccattagaacactgtaggaaggctggtttaattaaataacataatctgttattaacttaactgaggatctttaaactcaacatgcagaccaaaaggacaggttcccactgtctcaattcctctgtgcactatggaacttccactctcctgttccctttttagttacatcatctaccaacatatggaccacgaaagcaccaaggtcaaaagtgggcattaattattagtaaatatttatttctttaattttgaaatgtaaaaagataaatattgcatcttccattaagatggcaggttaaataggcccatttgttaccacttttctaagtcttcattaaaacaagaacaaatagactttcaaatataatccaaattatataaacatcaagagaagacatgacagcaaaatcattttggaagctggaaagtaaaaagatgagtggaaaataaccccattatccccagtaatcccatggaagctgaatcctaaatcggtaatgaaaaaagccaataaacaattcaatttccatagcagcaggcttcaacatttttaaaatgctgaaaagcaggaggaagaaaaaattgcttgtgaagcagttaaatcttctactttcttcctcaaatccacatggatgcaacagcttctaatccaccaaacagaaatatgatcttcagacaaggtaaaacgggataaggagaaccagatccagttctgggctgggggagggtgtcacaaggaaaacaggggtactgagcgatagcttacaagttgaaaatggagaacccggccttctacctacactggtccaggagccaagtctatgcctttcgggtgtcagcaggcagaaggccagatgatgcttccttggagaacacaatcagcgttaagagagatgaaaacattgaccttagaattttctcaaaaaaaggccaagtcagatgacattacagtgaagcttacaggcaacaacaaatcccaaaatacgagtgcagagcttctacacaaatattcaccgcctgaaatgtgagcagacaaccaaaaattcctggatatctgatgaaagcctcaattatgaaagagagattgccaaataaataaaaagaaaaaagagcaatttgcgggaaacagagactatgcaagaagaagagactataaaaaagaaaatatcattaatataatcagagaggcaaacaaatatattacttgtatttatgaaatacaaatacaaatagtattctataaaagagaatcaagaaggcaaaaatacaaaatatgtaaatataaaataaagtataaatgtaaaatatagagatataaaagcataaatggaaaattcagtagacaaaacagaaagaaacagaataaacaggaaataagaggagtttccaaaaaagaataggaaaaaagagaagagtatattaaaaattcaagaaagtttctacaatggaagagtacaagttttatgattaaaggactcactaaatgtcatcaaaatgaatgaagcagacccacacagggcaggtctgttttaaaatctttgagttttcagaatactataagatgaccctaaaagctctcaaaaaggaagaaacactaattccttacaaaggatcaaaaatatgaatgactgaatacttctccccagcagcactactcagagacagcagaaaaactgccttcaaaattctaagtaacatttatttccaacctagagtcaatatccagtcagacttttgatgaaataagagggtagacttaagtctagatagctctttgcagttctagagaaaaaataactaggtttgggacaggaaaggaggccctgaaagagatgtcatcaagacaataaaattggcagaatattgatgtgaattaggtatcctatcacttgattgttctgagagaatgtttaagcaaccagggaatatttgggactgattcagtagtaggtactttaaaaaataagcaagtaaaagaaggaaaagacatattctaacttacagaaggggcaggaaaagtaatgtatatcatatttctagctgttaatagagctctaggcaacatattgaaaatgtgaagtctgtactataagcaacattatgacagagccataattggaggatgatacaaagtatacgtattcagtgaaggaagctgtgaaagaaatctgcaatcgttgccaccaggtggcaatagtgagttacatctggacctgcaggatttctgttgtgacaggtccactgtgatgatgtcattggattctgcattcggtcatgtcctcataggaaatttttcagttacttggaagaagatgtggaaggcatactccacatgtatggtagacagaagggattgaataaaaacacaataggttaccattgtggtaaaagcagtatgaaatggaactcaaatgtagttttaaaaattcatagaagtaaagtattctggaaggcaagttggtacaggggaaattcactgagagagaactcacagacatggattctgctttcaagtctgtagtaatcagctgggtcacacttgagactcattttgcacttctgaaatattaggtctttacaccatataatctctaactacctgtctgccctaatagtctataattcctttatatgttaaaaaaacttatttctggcaataaaagttacaaaaagtatcaagaaggtggaagataccactaagctcatgattaagaaataactatccttaatattttgatatattttacttcagccacatatatatatgtttcatttcaggcacatgtgtatatgtagaaatattttttgttttaaaattttacatcattttgtacttttcacttcacataaatatccttatataacacaagtacttttccattcataatatacctgtgacaatgtcctgtggccataggctgaaactactatctaggcagaagactaaagattaatctgctgtgatacctgccccctttgtataatttctgtaccactagttggctcatttagtggctcatatcaggctttcttaagagccctatttttcagctcagtgccctctgctactgtccctctagtcctcatgctttaccctttacttcagtatcatctcttctgtgttcagcccagcgaacacaagcactcggtaaaaataatgataaatctgaatgcatggagctcatgtttactggctagattaaaaaaatggtgcattcaccattccacttcaaaaactcctcctcttaacctttaatttgcattatgatatattagtgttagcatttactgtagaatttttaccctgaattttaatgcctttataaattgttgatgatatttgcataaacatcagctcatgtgcagtagcaataatgtatattttaaaggtccttattaataaaaaatgtgtggttaattcataaggcataaagcatggcaaacatattaacctgtttctgttttgatttttttgttttatatcatccagtgtcttttaataattctgtatatatgcatatatttacagttaagcttttatatgaaatccaattttttctttatttatatttttgaaagttttaaggtggcaaagggaaatcatataaacattgcatattttaagtttccattcttattatcaatttaataatattcaaattatgcatcactttctggtttgtgtttgaagtctttcctatagtaaactatttaatgttaagcctcaaatttcaattgccactttgtatgactcataagaatttttaaacttatttccctatcttatttacataccacttattttgtgtcaaatttcaatggaatgttttatcatatagaaaatacaaatgatttctatgtataaaatataagggaaagggagacgtttgtaaattagtttattttgggtgaagcgtagagtcctttgtgggctgaccttaaagttaattagaaagtaaaaggtaaattacagtccaatgcacctgactctgccatgctaaatgccattttcatatctatgatgacttttagtgagtagtaattttttccttatcacaacttttcaaaaagatattttaataatgtctcaaatagcatgtttatctgtatggaagatggcatttcttctgttcatcctggagaagggagaacccttgtacaatgttactagcaatgtaaattagtgcaaccattatgaaaaacaatatagagattccttaaaaaattagaaaaaaaatagaagtaccatgtgatccagcaaactcacttctggatatatgtacccccaaaatgaaatcagtatgtcaaagatatatctgcttccccatattcattgcagcattattcacaatagccaagatatgggaacaacttaagtgtcccttgatagatgatgaatggataaagaaaatgtggcctgagttactgtaacaatccttttatggttgtgcttgcattaattcttgcctatttcagaactctcctatacacagcagcctaaaaaatatgtacaaatgtatttaagaaatacacaaacacaagaagacaaaagataataagtgtttatatattccttaactacatttagattcttgtaatcttttagattacaaaatctttcagattttgtaggctgcagtctgtagaatgagtctgtaacaggcaagagttgatgcaagaagatctataaacacactatttcattaacctaggccagagataatgttgactgagaccagggtgacaacagtggaggtggagaaaattgaacagagtccaggcatatttcagtagatacaattgacagaatttgacgggatgaggaagataatgtttttgaggaggacaagcaatacattacagcaaagtggctgagagtatgagctctaaagcaagactgcatggtttcaaaacccaagtctgtcattttcaggctctgggacctcgaacaattcacttaacttctctatgtcttttatttataaaatgacatcataattttacccacctcattgtattgtaagacgtaaatgaattaaaacatttaattgattttaacttggacagtgcttattacatgctaaggacactataagtgtttgttgttatagtgatggtgatgacatcagcttatataagtgatcctgacaaactaggtttgacaaaagaagtaatagccttggtcctgaacattttcagattggagttttattgaagatattatacatatacatatatatatatatatacacacacacacacacacacacatatattcaaatatatatatatagttttgttttgttttgagacgggtcttgctctattgctcaggctggagtgtggagtgcagtgatgcaatcttgactcactgcaacctctgcctcccaggttcaagaaattctccttcctcagcctcccaagtagtggggattacaggtgcctgcaaccaagcatggttaatttttgtatttttagtagagacagggtttcaccatgttggccaggctggtctagaattcctgacctcaagtgatccacctgcctcggcttcccaaagtgctgagattccaggaatgagccactgtgcctggccctcaaattatgttgaacaggcaattggatacatgggtctagatggaggagcctggctgaagacagaagtttggtgatctggcataaaaatagtcattaaatcaataaaaataagatatttttaaaggagaaacattagagtgaggagagacaagggcctgtgacagcttaaagaaattccagttttaaggaaggatggaaggcaaaataactggcaagggagacagaaaaacaggcagagatagaaaaatccaaagagtgagatatcacagaaacccaaagcagagttttttcagtaaaaagaagagataaactcttttagatgcttgctaaggggactacaaagttgagattgaaaggttcctattgaacttagcactgaggggattactgataatcacaggaagtgcattgtgggtggaatgaggagacaagcaagatggaagtgtctaagaaaatggagtcagtgaatgtaaacaactctttcgagtagtttggctgtgaaaatggagttaggacaatagtttacttgaaaggagggttaagaagtctttcttgtttttcttctgtaaggatggctcaaaaataattaaatgttgatgaaaattccaatagtctgtagtggaaggtttctgagaaaatctgagagactgtggtccagaaacaagaagttggaggagaaacattgactctattaattatgtagagaacaggaagatggggcaaatgcaagtaggtttctacatttcacagtgataccattgtctgctggcttctattttctctgtgaagtaggaggcaaagctacttgtaaagactgagaaggaccattaagagggacgtatagagataataaagaaggttttatatttccttgtggaaacaggtagagtaatttggttatgcaaacacagtagggtagaggagcaacatcattacagcactggatgtttgtgatcatgaatgatcccatctgctctactgtgcgtgtaatttttaacaacagtagctggctactcagaagcagacatgacatggagagagagaatggttgggtttataaatcagttggaattttcataaagaactaccattcaagaaaagacaagaaagagagtttggagtttttttaagaaaatttattgaaatggtgtaccatggaatctaaactgaataaggatggaagtaaagaaaggagaggaccataactgggcataactacatactttattgacttagatttgccagtgcagttgaaggactgtagagatagaattaattcaacagcaaagttggaagaagaaactgtgataactgtgccaatttcttgataaccaggatggtaaaatgatactctttctacccctgagtaactataatatcaagcacacacttaggtatttttgcatttcatttccacagtacttgcaagtgaggtgaccaaaaaacagctttagactcttaaacttagtgtttaaaatgagaaggctgagagacagtctgcttatggagaaagttggagtatttccccagtgccccaaccccctgccacttgtaccatcacagtcgaaagaagggaagagtctcctacttaacaaggtgagatagacgttaagaaactactacttggagaacttgctatctaccaccttagacttagaaaaggtcaacggattagtgtttgacacattcttgaaaaattataaagtaaaaactcgtggctgaatttctttacctaatcaagtttcagctgcactgtcactgacaacaggacagaggtgactgtttcccttggaccatatgtaggaaacatgtgggaggagtgtcatgtgggatcatttgaaaggcaacttcctccagaagggatttttgacagcataagtggatttcaacataaagagaccaggtagactatcacatgcagacaccatgagtgtgtcatacgtcaccaggcagaagatgtgtgttacctacatagaaagaacaacaatctgatgttcttatttggataataggagtctcataaaatctcataaaattgcccaccagatggagtcatttcaaaaattcaccatgcctggaaagtactaataccattttaaaattaatacacagtcaaataagacttctcctaatccttaccactcctctcctgatcctgttcttctcttgacattccaaatgttgaaggtttaaaaactgagtgtagcaagtggtgagaagaattggaactaggagagaaagagaaagtcaaactcacaaacctccttccagctatgggttttcaagcaggcctgatctaggggataagagaatgcttaagtttaaaatttgggatttttcttattaaatagggcactgtttaactactgaaatgaagctattctcctgactaaacataactgaaaaaccattcattaaatgaaatgactggaaaagttattggttcttctttgaatttcgccacaggaagaggaagaatcaaaccaacaaagggtgtttacagggtcatgggtgagaaaaagaatgaagttgcttttggcttacaccctagaaagtcatctcttaaataaaacacttacatttggactagtgattccccaagtgaaaccatttcaggatgtgccattgtccaaggtataactatgggggtggggtgactgaggtggagaactgaaaatcgttggaaatgagataaaaaatctgtgaggccaggatatttgaagggctattcatgaacatagtgtagtcattcagtcactgacaagatttggactaaggaagatgattatgtgctgagtgcaaatgttatcttaaatgacagtgggtgaccaggagatcaaaatataatggtcaaaggaatggggagagaaagagatatccaagttacatgatccttaaaaaaaatggatttattttttgtgtgagtggaggattaatgttctggaatagacagtgggagcaaagaggacactgacttatctctcaatgctgaggtatatggtgttgaaaacattccacttcaggagtaatatcccctgggaaccatccattaaggtgtgtagatggggaaacccttcttaaagaagtttagggacttattgagtatgtaccaccagtatcaacagaaaaataatgaaaagctttgggagtagtggtgagaaggaaagacatgggggaagagttgggtaagagacaagaaagaaggatgaagaaatgaatgaaattgggtttttaaaatatttcagtggcttcagcttaaatacttttattgctacatctctattgatggaaagataaatgctatattagtcagctcatatcaccataacaaaacaccacagactaagtggcttaaacaataaaaatttatttcttgcagttctgaagattggatcagggtctggcagggtcagtgtctggtgagggctctctcctggcattgcagacagatgccttcttgtggctttttccatagcagagagagagagagagagagagagaggaatcaagctctctcatgtgtcctcttataatgacataatcctatcagaccagggccacatcctcaaaggaaggtacagtatcttccaaatgccccattgccaaatacaatcacatcaggagttagggtttcaacatatgaattggtgcgggtggtgggacacaaatattcagtccataacaaatatagagcagttctcatggtagttttttgttgttgttgaacagaactcaggcatgagaaccaaatatcgaacaaagaagggccacgtgacacgtaaacttacgtgtttgtgcattgcctactcttctaccattggtggactgacaacaatcactggtacctccaccaacttgatctttgcagagtatttcaatacgtaagtaaccttattggattggtgatttaacataagggcagcacaaaaattataaaaattattcttacctgattcagagaattcaagtacagagatgttatgttaactctcccttgtttcccttcaggacatctatagatctacagaccttcctttatactgagaattaaatattcagggaatactgaattaacttgtgccaacagatttcccaggtcagctcagaggggataactcttggctgaccacccttaacaaacaggaaaaacatttttcattgaaaataataccacaaatggtagttaactaaagtgaaaaggaattattttcttgggacaatttatgtagggtttggggaccaacatgtgaacttaagtaatgaatggtgaacagaggtattaattttggaaggcttggctttggaattcaaaaaagatttgaaagattgaacaattgtaataagtgtcagtaataaagtattctacaaacagatatatgactgttaatatgtttggaactgtgatgacaattccattgcagaaatgggaatctgtggattcaacaggtagaacacttgggttaaaaaatcctcaatttgcaggtacttacattgtgaattattttacttacttatttatttttctgagacagggtctcactctgctgcccaggctggaggacagtggtgcgatctcagctcactgcaacttttgccaagtgattgtcgtgcctcagcctcccgagtagctgggattacaggcatgcaccgtaatacccagctaatttttgtacttttagtagacacggggttttgccatgttggccaggctggtctcaaactcctgatctcaagtgatccacctgccttggcctcccaaagtgctaggattataggcatgagcccctgcacccggccacattatgaatttaacaacaaaaaggtccatgattctcccaagacttaattttttcatatgtaaaatagtcacagttgatagggttattgtgagaattcaatgaagtaaactaagtaaaaatattttgcgctatgtaagtatcattgaaacaatagtatgaaagtccatggtgtcatatgtgcactcagactggttctactaaaagaacagataataatcagaatttcaagaagacagacacaattgagaaagcctaggaacaggatttgggttcacagaaaaattagagtttagaggcaggaaaactactctctgtgaagtagattcatagactctatgaattttctgaaattatttgcaaaatgttgtgcatgcacagattctctaagaaatacaagactcaaagaatgtcaatctccattctagaaagaatgggtgtttgtgttcaacgaacactggtataggagtttaggatcaatattacacagacctccaagagtattgtttctatgaatacacatccattatctacactccaattactgacttagaaaactttaaaaggtttttggtttataaatgagaggcttctgaaactcacagtaccagtgaggatttatccaacgtatcccctaatttaagacaagaaatgcacctgacatctttttgaaaatgacttatatcctttctcatgaattctccaagagaagggattccacatcttagttcctgtctgtgaatttctttttctaatatccagaccgaattcttatgcttcatctttgttgatattagagaactgctggtttccatcattcacatgaaattagttgatacagtcaagtaattcatattactctgtaagatcgcaatatggtaaatactatggaagaaattttgacacggcagagtttggacttagacctcaattcagatttcaagctcaccatatattagcttaacttctgtgactatcagtttccttttctgtaaaatggggatgatactagaacttacaacattattgaattaattaaatgccataatgcacatgtggctctagcagagggtctggcacatagtaacttgtcaataatgttagctgttgttattgccactgctctacttttgccatggctgttaaaaatctcagcctggatcatgaatgataaatagttaatattttgaggaaaatcctctggaagtacacacacacaaaatggaaaagtagctttatctcagagataatcaaaactgtcatcagtcaaaaggtctataattggtgtgcaattatagtatctatagtagcatactatgacacttaatgcccaaaatctgttccaaggttataaatttccaagactacattcattcttttgaagctatgttctgagtatttcatgggtattaaagttatttgttttgcagtggggcataagttgcatataacatgtaagttacttgcagtgacaatgactcttcctaagagtcaaccttgacgtgtaaatgtgctttaggtcaaagcacatctccgtgttatggggcatcatttctacaattgttttaaagtgccaagaaaacataaagtttgtactccagcctgcggatgttttgtaatatatgtggcattttctctttttacctgggagctaaaattgaggatgtaatggtttaatgaacagaggttgtgttttaaactcctcctgggttaaaaatccagtttgactacacaatctgactttgagaaatccacttagccccctaagactcagtttattcctgtgtaaaataaaaatttaatgcttttttcacaggatttttgataaaattaaaagtgcttagctcatctgctcatttctacctaacctctaaaacttacagtgccccaagagaagcacttcagtttctcttctaaatctccattactgcttaaatgatcagacccatttctatgtttgtaataccacctatgtgctgataactaccaattttttatctctatccctgccctttcctctgaatttcagacttacttatccagctgcattccaacatgaccacttcaaaaactgagggacatctcaaatcatcacatcccaaaacagcatgcttgatctgccacctctcccctgccctcctgccaatccaacctcccctcagacttcaccatttcaacatatgacatcttttctccatttcctaggttttattccaaatatatctaaaatatcttgccttctgtttatcttcacatgtaaactaaaatctactccactctaccctacttccgagggactttatcttgtaataggtttccctgtgtattcctcttctactgctaccttacaaatggcaatcaacttagtggcttaacacagcacacatttattatctcattatttttgtgggtcaacagttcaggaagaaaggggcagagcaagatggtggaatacagggctccatggatagtaccccgtgcaaggacaccaatttaacatctatctacatacagaaaagcaccttcataaggaccaaaaatcaggtgagcactcacagtagctccttttaatttcatatcattgaaagaggcactgaagaggtagagaaaacagtgtaaaatcacagatgctgcccctccctcattccctggcagtggcagcatgttgcagagagcattcttgtgctgtggggagaggaggagcccagcaattgtaagtcattgaaatcaatgctgtcctgtcatagcagaaagaaaaacaggaataaactcagcccacacaccaagggagcatttaaaccagctgtagccagagaagaagtgcccatcccagcagttggaacttgacttcccacaaccctcaccactgcgggctaaagtgttctggggccaaaaataactctgaaaggaagtctagggcacaaaaactacaactcctagacatcttctagtgctgaactgtgccttgagccagaggacttgtgtggggggaatgtagtctactgggacaaaagacagggcagctaagggagtcctcatatccctcttcactaactccaggttgcacagattgcagctccaaaaaaagactccttcctactgctcgaggagaggagacgagaggagagggaagagtggagaggactttgtcttgcatcttggataccagctcagccacagcaagttagggcactggccccctttccaggctctagctttaggacgacatttctagacacaccctgggccagaatgaaatctgttgttctgaagaaaaagaccaatcctgggaggttgcatcacctgctaactaaagagctcttcgtcagccgggtgcggtggctcacgactgtaatcccagcactttgggaggccgaggagggcagatcaagaggtcaggagctcaaaaccagcctggccaacatagtgaaaccccatctttacttaaaaatacaaaaattagccgggcatggtggcacatatctgtagtcccagctactcaggaggctgaggcaggagaatcgcttgaatttgggaggcagaggttgtggtgagccaagatcgcgctactgcactccagcctgggcaatagagtaagactccatcaaaaaaaaaaaaaaaaaaaaaagttcttgcccctgaaagcaagactcaggagttacatcaagagctttgggtgagactgtagagactctaagagttgctggcttcaggtgagaatcagtgcattcttagctgtggtggctgtgggttgagactcctgcttaacaaaagcagagggaaaactaaagaggactttggcttgcactttaggtgccagcttggccacagcggtgtagagcaccatgcaggttcttaaggtctctgattccttgacttggctcttggatggcatttatggacctgtcctgggaaggagggggagtcctctgccctgaaaggtgagtcccaggccaggcagtattcacacaagctgactgaagagccctcggaccttaagggaacatcagtggtagtttggcaatgctccccatggatctgtggtggcagtggacacggggtgagctttcactgcctttggaaaggggtgggagagtgggaaagactatgtcttgtggtttgagtgctagctgagccacagtacattagaacatcaagccttaccctatacatgaaaaataaaaagcaagaaactaaaccatatcactagagaaactcaccttcactaaaagcttccttttattgaaggaagtagagataaaaggaagaaaagaccacaaaacaaccagaaaataataacaaaatggcaagagtaagtccttacttatcaatagtaacattgaatgtaagtggactaaactctccaatccaaagacatagagtggttacatggataaaaaacaagatctattggacagttgcctacaagaaacacacttacccaacaaagacataagttgagtgaaaataaagagatagaaaaatatattccatgccaatggaaaccaaaaaggagcaggagtcactatactcatatcaggcaaaatagatttcatgacaaaaagtataagaagagacaaagaaggtcactatataatgataaagaagtcaatccagcaagaggatataacagttgtaaatatatatgcaaccaacatgggagctcccaggtatataaagcagatactattagagctagagagagagggagagagagagagaaagagacctcaatacgataatagctaaagacttcaacaccccaccttcagcattagatggaccttccaaacagaaaatcaacaaagaaacattggacttaatctgtactacaggccaaatggatctaatagatatttacagaacatttcatcaaatggctgcagtatacacattcttttcctcagcacatggaccattctcaaggatagaccatatgttaggtcacaaaaggagtcttaaaacattcaaaaaattgaaataatatcaaacatcttctctaaccacaatagaataaagctaataatcaaatacaagaggaattttggaaactataaaagcatatgaaaattaaacaatatgctcctgaatgaccactgggtcaataaagaaattcagaaggaaattgaaaaattttttgaaacagatgttaatggaaacacaacatatcaaaatctatggaatacagcaaaaaacagtaccaagagggaagtttatagctctaagtgcctacatcagaaaaaaaaagaaaaacttcaaataacctaacgatgcatcttaaagaatgagaaaagcaagagcaaaccaaacccaaagttagtagaagaaaatatcagagtagaattaagttaaattgaaataaagaaaacaataccaaaaaaatcaatgaaaacttttctttttttaaaaagttaaacaaaattggcaaatctttagccagactaagaaagcaagagaaaagatccaaatatttaaaatcagagatgaaaaaggagtaattatagctgatactgcagaaattcaaaggatcattagtagtgactatgagcagctatatgccaataaattagaaaacctagaagaaatggacaaattcctagccatgtacaatctaccaagattgaaccatgaggaaatccaaaacctgaacaaactaataacaagtaatgagattgaagccataataaaattcttccagtaaagaaaagcctgggacccaatggcttcactgctgaatccttccaaatatttaaaggagaaataatatcaatcctactcaaactattccaaaaatataggagggaatactttcaaacgctatgagtccagtattaccttggtaccaaaaccagacaaagacacataaacaaaggaaactacagagaaatatcccttatgaatattgatgcaaaaatcctcaacaaaatactaacaaactgaattcaacaaatacatgaaaaagatcattcatcatgaccaaatggcatttatccctgggttgcaaagatgtgtcaacatatgcaaataaatgaatgtaataatacatcataacaacaaaaggaaggaccaaaactatatgatcattttaatttatgctgaaaaagcatttcataaaattcaacatcccttcacaataaaaccctcaaaaaatttgtaaagaaggaaaataccttaacaatttttttaaaaaaagaagctgtatacgacagataacagacccacagctagtattatactgaatgggtaaaaaaaccgaaagatttttctctaagatctgcagcatgaaaatgatgcccactttcaacactgttattcaacatagtactggaagttctagctagagcaatcagacaagagaaagttaaaaaggcacccaaattggaaaggaaaaagtcaaagtatccttgtttgctgatgatatgatctgatatttggaaaaaatgaaagactccaccaaaaaactgttagaactgataaacaaattcagtaaagttgcaggatataaaatcaacaaacaaaaatcagtagcatttgtatataccaacagtgaataatcagaaaaagaaatcaaaaaagtaattccatttatgacagccacaaataaaactaagtacctaagaattaacttaatgaaagaagtgatagatctctgtaatataaactataaaacatggatgaaagaaattgaataggacaccaaaaatggaaagatatttcatgttcatggataagaatcaatattattaaaaggttcatactactcaaagcaatctacagattcaaggcaatccctgtgacaatgccaatgacattcttcacagaaatagaaaaaaaaaatcctaaaatttatatggaacaacaaaagaaccagaatagccaaagctatctttagcaaaaagatcaaaactgtaagaatcacattacatgacttctaattacactgcagagctatagtaatcaagacagcatggtactggtatataaacagacacatagaccaatggaacagaatagagaacccagaagcaaatccatacacctacagtgaactcattttcgacaaaggagtcaagaatatacactggggaaaggcagtcttttccataaatggtgctgggaactctggatatccatatgtagaagaataaaactaggcccttatttcttgccataaacaaaaatgaaatcaaaataaattaaacacttaagctaagacctcaaactatgaaactactacaagaaaacattggttaaactctccactacataggtctgggcaaaaatttcttgaataataccccacaagcccaggcaaccaaagcaaaaatggacaaatagcatcacatcaagttaataagcttctgcacagcaaaggaaacaatcaacaacatgaatagataaatccacggaatgagagaaaatatttgcaagttttccatctaacgaagtattaataaccaaaatatataaggagcttaaacaactctatatggaaaaatctaataatacaattaaaaatgggcaaaatatttggatatttctcaaaataagacatacaaatggcaaacaggcatatgaaaaggcatgcaacatcactgatcatcagagaaatgtaaatcaaaactacaaagagatatcatctcaccccaggtaaaatggcttttatccaaaagacaggcaataacaaatgctggcagggatgtagagaaaaggaaaccctcatacactgttggtaggaatgtaaattattagtacaaccactatagagaacagtttggaagttcctcaaaaactaaaataaagctaccatgtgattcagcaatcccactgcagggtatatacccaaaagaaagaaaatcagtatttggaaggtatatctgcactcccatgtttgttgcaatgctgtgtatattaataatagccatgatttggatgcaacctaagtgcctatcaacggatggatgaagaaaatgtggtacacatacacaatggaatactgtttagccataaaaaagaatgagatcctgtcatttgcaacaacataaatggaagtggaagtcagtatgttaagtgaaataaaccaggtccagaaagacattacatgttctcactgatttgtgggatctaaaattaaaacaaatgaactaatggtgatagacagtagaagaatggtgaccaaagactgggaaggataatagggtgtgggctgaaaggtggggatggttaatgggtacaaaattggcagaaagaatgaataagacctagtatttgataggacaacagggtgactatagttaataataatttaattgtacatttaaaaataactaaaagagtataattggattgtttgtaacataaaggataaatgcttgagaggatggataaccccatttctatgatctgattattacacattgaatgcctgtatcaaaacatctcatgtaccccatacatatatacaccaactatgtacccacaaaaattaaaaattttaagaattttttttaaaaagactccaggcaaaggttagctgggttcctgctcaggatcttaccaggctgacagcagggtggcaactgggcctgtaacctagacaggggctcagggtattcctccaagctcattgatgttgtcagtagaatttggttccttgcagtttaattactgaggtgtccattttcttgctggctgttggcatggggtcactctcagcttctaaaggctgccttcaggcccttgctacagggccccttcctctgacaacaggatgtttgcttcttcaggccagcaggaaactctcttttaagggctcacctgattaagttaggcctacccgggatagttcgtgcttttgattaactcagtttcaattgctagggactttgattacctaagtaaaatcccttcacttttttcactacgcaacctaatcacaggagtgatatctcatcatattcacagattccatccacacagaagaggagatcgtacaaggcatgtacaccaggaggcagaaatttgaggcatatcttggaactctgtctaccacatcctgaacatcacacactgtttccactcttgttgccttcaatcctgagaatgcatccaggagccattctgttttatgtcaattactaattagatcatgtcacgttactaacttactacgttccaattagtccttattgcatttgtaataaaatccgcatactttcggactggctacaaggttatacatgatctgatccatattgactacttctttcatgtcacactcaccttcactcattacccacagccacagtggcctcctatctctccacaaatgtgacaaactcattcctaactcaaggactttgtaattgctatttcctccgtctggaatgctgtttcccagttattcacatgactggctccttcttgctatttaggtctcatctaaaatgttaccttctctgatggcattacgtaaaatttcccccttccccaatcactttttattacattattctgctttatttcctattttgttatatgtttacctgtttattgcctgtgtgccccactttaacataaacttcatgaaagcccagaccaggtcaatctcattcaccactatgtccccagtagcttggagagcacctggcacttggtagataccaaacagtgttaggtaaaagaaaaggatttcatcagaattaagtgtcttagcatagttcatgacagaagaaatctgtatttgctttagatgcatgtttgaagtctcttcacttgcaggacatgagaaagagtgggaaaaggaacatcacagcaaaagaaaatgcttagagtatgccatatatttctttatttgtccaaaatattcactctaggtataagggtaaaggttatgattatagaggcatagtcccatgtggttgtttatatacttccatactattaaactaaacaaaacataacaatgaagtttaactttttcaggctttcatttttctaaaactattcctccaggcaaaaattctgaaaagcccatcttcagtcaaatacattttgcaggattctctccagtgggtagagagagctctgcatactgatttcaagatatgagccacagatggtgaaaagtgaaattaggcttgaggacatgggtctaaacctaatccaagcagcatttctgagtgtcgttaggttgtacagaataacataggtcatcctgtaatccaagtctaatgttaatgggaaatcagcttttcccccattactttattttccaattggagacaacaaacatttttcaaaaatgaacagttttcaatagagcctcatggatgtgataaagtatttttccattcatcacactgcacattttctaacatctttaattatcatttgtcactttctaattgcataaatatgtaagctaatctttggatctcttcaaggtagataaaaattatcctccagttgctaaagataattctagggcctagggagattaatagcttttcataagctcaaagaaaatgatagaaaaccttagaaatctagagttttgagggcccattattattaggaaccatcttaaagtagaaaaagaaacactctaaagtgtataaatttgctacatagatataacatgaaatattttattacttatgtgatttttaaatgacaaagtacaaagtatgattaaaatagaaaaaattgcaaatcaatatttctataaagttctacatattttatgacttcaaacatattaaaatatgttaatgatgtttttattacttctgtatatctttgtttttcagattttcaaatttatctttatgttattgcttttagaaaaaaagtaaagacaactgtttctcaaatttcctattgtttctccatagtaataaaataaatgactatataagaatttatttagtattagacattttagaacaatgaatgtgaggttaccaaagaaactgtgctagtgtctgatcttatgttgttgttgttgttgagttattatgtgagtttaaaagttgaaaataagtaggtaagataaaaaagaaaagttgttgatttcttcagaacttttaattatttttatctggctcagagttactccatttgactgtgccccaaagcaccacctggttctaggaagaaagagctaccatatacctggttcgatggttgctgtgctttggggtagaagaaacagaaaggaaaacagccatgggagatgacctaggctggatcagagtactttcacatggccaagaattccagccaccaaggtgaaatgggaacagacattcagtcccactaattttcacctgttctcatttctgcttatgtgtctttccttgttcatatactgatggagtattgacaacaaaacgcaaatacctcatgaacacccatttcttgtgcatttaatactcattaaagccaagaactgcactgggttttttccacaagcacttccttaaagatgaaatatagagaacaaaaatcaaaacacatccactcttgcttatatgggatgcagtgataattatgcagttccagaatcaagacaggagacaaggggtaaaagtactctatttaatgatgagtatattccaggacttccttcttggacagaaacacaggaaagaggtggactgctgcttccctgtgacaatcagaaaggattccacctgtctctccatccctgaacacgtctccatgttttcacacagacgctatcctgactgtcgttgcctcaactttggatcatggtttacgttttccttcccagctgcccttatcattctactcttatcctggatctggcttcagtggcttttcctaggattcaagtaagtaaatatttcatgttaataggctaaataaaggtgtctaggttcccagttcttagcttcttatccgatgctctttcccctatgccatgcaggctacctttctgcatttttgttgctcacaaaattaatacacacaaatacgtattttaaggataaggttgaatctcatttaaataatactggctgtggaacagttaattaaagattagaaaggggccagctgcggtggctcatgcctataatcccagcactttgaaaggccaaggtgggaggattgcttgcgcaatcctctctgagttcaagagcagcctggacaatatggcaaaactctgtctctaccaaaaacaaacaaaaaaccaatcaacaaacaaaacaacaaaaaaaacctcccccctaaaaggaccatccaggcatggtggtgtgcgcctctggtcccagctactcaagaggctgaggtggaaggattgcttgagcttgcggggtggaggtggcagtgagctgagatcacaccactgcactacagcctgggcgacagagaacggtctcaaaaaataaaatgaataaaaataaagattagggccaggcacagtggctcacacctgtaatcccagcactttgggagatcaaggcagttggatcacgtggtcaggatatcgacacaatcctggtcaacatggtgaaatcccatctctactaaaaaaaacacaaaaaatagccaggtgtggcgggtagtcccagctactcaggaggccgaggaaggagaattgcttgaacccgggaggcggaggttgcagtgagccaagatctcgccattgcactccagcctggatgacagagcgagactcttgtctcaaataaataaataaataaataaaaataaagattagaaaacaaataatctaagtgtcctttgagtcctaagatgataagatattgaagggcataaataactcaatctgatgtccaacttgttaaaggggaattttaaggtttgcccctccacttggtttaatgtggagatttccttgggttatcaagctacttacactgtgacctatagggcttcctgcatcatgctagcaccaaaattgacatccctttcaatataccaagtacaataaagatctgaggatgttctctgtggaaagaatattgttttaggaattagtagaccaggaataaaattctggcttctcagaggccagataagagatcattgcaagtccagacccattctcagtctcagtgtcttcaattgtaagatgatagaatttacccagaaaatcagtaagatcccttccaaggctataattctaacacatctgggcctaagttgaacacatagaagtcaaagtaaaaaaaaaaatgttgaccaataaagaccgactgatgccactaaaatgtcaaatacatgcattcaaagacaacctcaacatattatcttggctgggatcaaagctggtaggtcataagtaccaatgagttacataacttagatgacaaccagcatttaaaattatgaagggctccagagcaaaatctaaaatgcagcctgtaaattctactcatttaacaatactcctaaaagaaaggtgaagtcgctgtatatcaaatcttgagtattttttttcctgaaaaacaaaacagctcaaatttatttttgtggggttttatttaaataatttcaaggacctatgaataaaacagcatgttattcaccaaaccagagagactgaagccagctatgtgtacttcctttgaaaagtgaaatgctttgggaggccaggggagtggatctcctgaggtcagcagttagagaccagcctggccaacattgtgaaaccccttctctactaaaaatacaaaaattagctgggcgtggtggcaggtgcctgtaatcccagctactcaggaggctgaggcaggagaatcacttgaacctgggaggcggaggttgcagtgagccgagatcgcaccattgcactccaacctgtgtgacaagagcaaaagtctgtctcaaaagaaaagaaaagaaaagaaaaatgctgaaatcagtagtggttccatgcctgtggccatgggttccatgcctagtaatacgaggactgacattctcccctcttgattcctctttctgctttttctccagaactgccatggttttattagtagtgagaagatggtactgatgattaaaaagataattctatccagattgtgggagcagcatgtggcagtcctcctgctgaagcaaatgtgtaaaatgtcactgatttcagcaggtgggcatcaatggggagaggccagctgcatactaagtgcccctttcaggaaatccaagcctttggggactattcaatcatgcaggtagcaatgcaggatacaggagatggcaatcccaagtcaaaagagtcacaggttcttcattgctacatttaatgactttatcaaacatatatgcaaccattgtcattattttaaaatggcacaccatttaaaaaggagaaattaagaagataaaaggcaaatatattgaaatgtgctcttaatgaggaaaaaaatcccatgaagtgcatacactaggcaaagtctgtaaatcatgatgagtggtatgtttaaacagttcccttggtgtccactatctgttaaacactgcacagattcatgctccagctaatttttcagtgtccttttctgtctgccaaggtgtttacctccagagattttagattgacagacggaaattatcagccactcccctggcaaactagcatacattctgattagtatgttgggtattaacacagttaactcacccattataaatgatcccaacatacctgagaagaggagctcatctgtcagtgccattcaattatttaaatggagagtttgatgcattgtcataggctttgtcagttcctttgtgaaggcattaaccttcatttgtagcaatgccaatttggctttcgacttaactatttattgtctgcaaccaaaatgataaactatatatgcaatgtactgggtggaaaattgtttctaaggaaactcatctccttctttactatgattttctcttctacagattgctctctaggtggcgcattaattagtttcttataatagtatttatgtcatgacaaggggtaaaagtttgagactggcactagtcagtaatttaactgagattgtaaaaagcaattatttcctaattgatcataaatgtagcactgtccattcactcatattcaggcattgaagtgtatgcatgaaggtgattatgaatgtataggcttgccccagatactttacgaaagaaaatgtcctttctgtctatacttacacaaaatgtaaactaactgagctgctcataaacattccaagagataatccataagaatctagccattttttcatttagttcttcctctggaggaatttttttaaaagtctccatctagaacagtatttcacaaaaactgttcagtttcgaagacactggacttcaagacagaaaattagtgaggaaggaggtcactaaaacaagcagctgaaaacaataaaaagtggcagttactattggaaataaaaaggaaaattatgttgtgggtgctattaggacatatgagtaaagaaacttaaagaaaaaaatgtaatagagttttacttcttttttaaattttatcttaagttccatgatacatgtgcaggatgtgcaggtttgttatgtaggcaaacgtgtgccatgatggtttgttgcacctatcaacccatcacctaggtattaagccccacatgcattacctgtttatcttgatgctctccctccctccacacccctgacaggccccagtgtgtgttgttcttctccctggttccatgtgttctccttgttcagctcccacttatgagtgagaacatgtggtgtttggttttctgttactgtgttagtttgctgaggataatgaattccagctccatccatgtccctgcaaaggacatgatcttgttccttgttttggctgcatagtattccatagtgtatatgtaccacattttatttatccagtctatcattgatgggaatttgggttgattccatgtctttgctattgtgaatagtgctgcagtgaacatatgtatgcatgtatcattaaaacagaatgatttatattcctttgggtatataccaagtaatgggattgctgggtcaaatggtatttatggtgagtttattttacttctaagactaggcttagtttagtctctgaccatgatcagtccctgcactagtgtaaaactcgagtttagcatactttgtgaaaattgatggatctgaccccaactgtctcatacatttgccaaaggtactattggattgatgtgtcaggtatttactgtgtatgttcagaggtagcagtgttcagagatagcaggccaaaggaaacatctatgaccacctcactgtccttgccctcaaataatttaactagtgggctaaaacttacatgcgtggaagaattaacaaccaagatacacaataaatacattttaaatatataagatccagtacgtaataaaatgttagttagagataagtggcacatggcaaaattccaatggtacaaaataacttggaaaaaggaagagattggtaaaggatgtcatggaaaatatgcaatgaaaattgaacacgaaaaagtgagcaaaccaggcaaaaacagaaaagacagaaaacattcaaaaaaggaggtggaggtagaggtgaaaagcacagatatctgttattaacggggagattcatattgcatgaagggagattcatattgtgtgaagatgacgacgttttacaaaaatatcttccttacagggaggtggtagtaaaagaatttcttgcttacaggcttaattattctttgcagttttaaggagatgttcaaatgtggcaaaaccaaaacagtccaacaaaaagcttgtgctgaggtgattaagcaagaataccaaaagcttgggccaataaggtaagacaaacacacacacacacacacacacacacacacacacagagaagagagaaatgctgtttacactgcaagtagctgttgaaaagcaaacaagcacataattgcttgcaaggtatttataacacttgattagggccccaaatttgctaagctatggagattatagactataactcaacatgataaaacacataccctgtctaactaaaatttgccaggtaaaatgaaaagaagctgagagaccccaaagaggagaaagggctttttcaaactgcactgatgctctcaaattattgacacatctagttcttacagtgtttagtgttctactgcgatcattcctgacaatagctcaaggagtttctacaaatgtcccgactgagaaaataagaagtgatgccattggaatttttccacaggtatcaagaaattgtgaccttggtcctcttcattataatggctctgctatggtttagtcgagaccccggatttgttcctggttggtctgcacttttttcagagtaagctttgcacgttatgtttgtcagcccttcctgttttatactctgcttctctcctgtgtggttcctgtaattctgaaagattggatgagatatttttctttctttcccttgaaaagatattttaagttctaatcttttcaggaaaaaaattataaggaatgaaatctaggataagagcacagaaagaataaccatattacttactctgttactgaaaggcaaagtccattagacaaaattattcccatccctacaaaattcccatccctacaaaattattcccatccctgaaatataacagcacaaaggctatgttctgtggtggttgggagcatagatttcagagccacactgcttgggttcctttcctgactcatccccttactttggacaagtcacttaattctcagggtcttcatctgtaagatggaggtaattatagcatttacaatagtgctggacttctccctattggaagtgctatactaatgttattatgtgaagtaaataccactcaatgcctcttaataatctggtataaattcatattatgtgatttttacccactttgttttttaattctatggaggactatttgtttggtgtagtatcttgtcttttttcttcatttatttacatttttgcactagttcactacaagttcagcccagcctccatttcacagataaggaatttctgaagaaataataggactgattttaaaagctggtgctagaagctaggtcagagttaattttatatctcagtgtcttatataccagtaatcaattgctgagttgtgtgaagtgagggggaagggtatagcataattttctaaattaaggaccatcctatatgtcaatataaataactcagttgtgagatttgtgttcccaatctatctttcactgaactactctaatttctaaattcagcacatgtcttacttggacttcctgtctcaaatcccccagcaaaaaaaaaaaaaaaaaaaaaaaaaaattgtattttggggtagaaaccaaaattgtttaggtcatatgtattttgcccacatacaataaagaaattcttccctccctgaatcagaaccttctggttttataggcattgtcaatgtttctgaagggtgcgaagtctgagtccaaattcctaatgaccacacaagtcaatatggtggtgtgttttaaagcatcagcttcatttttataaactttttgattcccttagaaataaaacttttcattttgagaggtttagacattcagttatttaaatcaagttattatgtaatatttaattaatattttgtggttttgtggtaggatctagatcaacataaaaaataatgcttcccccttttaaaatccaacttctgtcatcctagacagggagagtctttatctaaacaccagtgcgtaagaattaaatgaaatcagagatagctaataaagcccaggcagaaatcccaataggtaattcaatataatcagcttccaatttctgtttcttatgcgaggaaacaggaattgttttgtttgtagcaggaaagcagtgtattggctatgagcaggcactcatgccacctacaattctgagagaaaacaataagaaaggaacaaaggtttgagagaggatgggattttaaaatataaatctaattggcaaacccaaaacaaataaaatttatataagcttaatagtttctaatactgagacaacctaactgcattcctgagaaactaaaaataagttataatatgataagaatagtttttaaagtactttgaaaagaaattatttcagtatttatgccttgatttaatttaatgtatatattttgtaggacatatttgttatgtagagtttcaggcattaagaatttctaaagctaacatgatgtatcaagatttatagctaccacctaatgttttcattccatctgtttgtacctggactgaattcaatgtgtctttttatataaaacaaaatctggttacatgatgcctggcccaatttgccaaaaatacaaccaaaaattataactgaaataaaagaaataaggtataataaaattataaatatcggtccagtttgtaagataaattatggtaaggtagatttttaactagtaatgaaagaaaatgtgtctatacttaaagaaagtagactgctttaaaaattgctagattgagaaagatacggcatttctttggctttttagatttttcaaataaattatagaagtagagaagcttcggtagtgtatacatattactgagttgcaagatagtaaaagaatctttagcatggtacatatttcttctcaggctacagaaatgcactagttaatattgctgacttttaacactaaatgctaattattaatgcctatttcagttatatctggtctccaggttctttcctgttgaggcttctgggaatctgtcttatttgttacaatggtctggtgattctaagaccccatctgttcctgaatcagtcttaatttatatggtgatcatttgtgagcattggctaaaccactccaacaattaatattcttgattgaatttcatggggtgcaaaaaattaagtaggttgctttcctttgtatgatatggttagagcttataaacacagaagcaggtgtgatatctcagaaaacagatcaattccttttcacaatttatagaagagctttagaggaacacagaaatatcacgccttgccacaatttaatagaaggatgttataaatcaattatatggggctttccatgctctagcaatgtttcaacttcaaatcttgatcaatattattaaattaaataattcaaagaagaaattgtttaacaaatctgtaagcttatctaaaagggaaatttgccactttggcctagtatgtcagcatgtgtatacgtggtattgaaaataagaagagatatatgggaacaataagactatggtctgagattattgtttttagtgttgtgtcatttaatcgggaatccatatattttagggcagattattgaggataaataacctacaccacctactactgataataacctattactgatatgttattagcaaaattggtgttttagctcatttaagttcttgatgctatttttaatacatgtatttgtcccttttacaggtaccctggttttgctacagattcaactgttgctttacttatagggctgctattctttcttatcccagctaagacactgactaaaactacacctacaggagaaattggttgagtatcatttataattctgcataaatttaacagaagagcaaaaattacaaaattccattggtttcgcttggcacctagagcagaaagaaagtctatgctggcacaatccctggcctagcatgccctatttgcaaactgcaatgctgtcttcaagccagcacagcttccaccttcaagagagatcgtcttactttgcagaagtgagaagtagatttccttttgtatcatggctagggctctgctacaagcgatactatttgacccatggtaaactcacttcaaaattaatcttactattggcaaacagaggaaaaagaacttggaagacactgcttcattatgataccttggtaataaatgcagaggatctaaaaaggtgatgaatttcaagagaaagagtatttacattctcaaagtagttctggaacaaaagctaaataaacctcacatagccatatcctaggatcacagctgaaataaaagggccagatgtggtggctcacacctgcaatcacagctctttgggagactgaggcaggaggatcacttgaggccagtagtttgaaacaagccttggcagcatggtgagaccccagctctatcaaaaaattaaaaaaattagccaggtgtggtggccaatctggaggccaacgcaggaggatcacttgagcccaggagttggaggctgtagtgagctatgattgtgccactgccctgggcaacagagggagactcggtctctaaaaataatgatagtaataaaaataaagaaaaggtattctgtgacagcattcattgtatttacaacacatgaacaaagaagtgtgcacatttgcctgagcataccatcctctcaacacacacacacacacacagacacacacactttttaaacacaagattcatccatatctttgctttacaacacagcatgttttgagtagtcagattcctatcttgtcaatgtgggacaactaatttgtaattgtctggaaattaactagtagacttgtggttttgtttgtttgttcttatggggatggaactgggatttatgtagttgtgttggcccacttgactcttgtcagaatctataaatgactaatgtatcagatttccaggacatatgtgaccagcacagcatagaaacaaatgtactttgtttttcacttgagattagaatatctcaatgtgtgttaaggaggtgatgcaatatggagcattgattcctatgggaccccaaggactctgatcattgcagtcaaagccctgaggtctggcagtggcaagtactgaggaatccatgtttggctttagcttccctggtttccacatctgaattccctcccttagaaagagccttgctcctacccacctttctctctcccctcattcttcaaaacctcttctccctgctaaagtcattcatacaaggcttaaaaatgacaaataatatataaatatgttaaattttaaataagaagtacatgtcagagatgtttacattttaacaagatatatgaccttaaagtaagaaacctggtgacataatttcagttatcagtgaggatgggtttggtttggatttgggggaagatgataggaaggaagcttattggtaaacttaaaatcttaccatgtagaaggctgcctgttatacacatgttaaatgggcagaatatgtctccaaatgaacttctttatcaacaaagcaatggagagatcagaagccaaatataaagagaaatctttatgataatccttttataagcactttaagaacctcataaataatactttatttaatctgaatcttgaattatttttaaaccgaaatcttggtgaatctatcatgatcctccttatgacctaaaaactaataaaatgttcaaatattaatggataataattaaaatgctacaagatgctattggaaccaatggaatattatggacattttgcatagcaaagaatattatagtctaatgcactgtgctattcacagttggcaaagatgttagtggaatataaatgaatgagtgagtgaatgaatgagtaccattataagtgacaatgttataatttattgaaatatattctataatattacccaaaggatttttttaagttatggagttttctcttttttatagtagaatgttccacctagtccaggtggaaattactcaaactccagattaattcccctctttaaaaacaatataggaatattacaaacttcctgtaagatggctacttaggatgctgaagcaaatgtcatattgtaatattttaagcaatgtgtaactgtaggatttttgttttgcagttgcttttgattactctccactgattacttggaaagaattccagtcattcatgccctgggatatagccattcttgttggtggagggtttgccctggcagatggttgtgaggtaatactctgtgtgtaagatatttaacaattaaccagactgttcaaaagaagagcacagagacattcaatctttgggcatattcaatttcactctgtcattttaatgttgcaaattttgctagctatgcagtgaatataccacacaaatgagatgagttcagagttcaagaaatattacaggctgcaagcataaaacatagtttttatggtgctccagaatgtcaaaagaaataatacaaagaagattaaaatgtttaattcatgaaatagtattagaaggctagtaaggaaaaatgtatatgaaaatatgtaaagtgactcctagtgaaatatacttttcgtttgcttatgcctttaccttatttcattatgaatttgagtagctcttggacttcagtatatcatgatgctattgctgatttaaaaaaaaagagaatgagaaataatattagctttaaagataattagtaaatgtttattgaataaagtctggagaaaaattcacataaccctttctaacattatattatgtctaatcttagtaagaaataaaaacaccatgagatgttggttgactttatttgacctgtctgtccagttgatataaagcaacagtttggggaggccctcatcccttgcaattgccctggtctttgtagagttgttggaagaaaattatcttctcccaaatttccatgaaaattaattactcctagattaattaaaaccactcattctggttttcatagacttatttgaaatattcaaagcttatggctcttccatttccttactcagtcatcaaattgaacagaatggtgagagaactgtcatgttcagccctttggcttccaggaggttaaatttctatactactcaagacaaatcactgtctcttctcttcttgataacttattggaagatactcctttgcttctaactttattgacaatttttctgcacagagttatgtgtctggattggatcctagacactcaaagtgattttgaaagcatcagccagaccctagcatacaaaatctgaggaaacgaaaaggtgtggactcagcctgatgcacaaggttctctcagtagaagaatttgggaacccagagagggaggtctagtttgctataaaaatctcaatatacagagccaaatgtctacaggatacccagaataactctacctctaagtgcccagattgaagccatgagcttcaagagtatggctgtggacaaatatgcccctaaaaactggactgtaaaaaatttggaggcaattaattttcaacacttttctttcaaattgtagtctggcaagtgtccagaaccagatactctttctagttgggaacagaacagtgaaacagcaactactatggaattcacctcattgcaattacttttcttttaaatgcccctgggtttttgttttaacatgatttctctctcatgagcagatagacagtttcaaattcttatcagtgaatatctcctcttcaattttcatacattcttgaaattttctctcctaggttaaacatgcaggatttattttttatttcagatatccattaaaattgcaataacaacaaaaacatgtcaatccataaagacaaagactatatgacagggacaagaagaggcaagaaatgtttatcacatttagaaagtggaaagaggatatttgagaggaactgactttgtacaaatagaaaaatagtaaaatatgaaacatataggctggcaaaatgaagagccaacaagaaacatgctggttatccatagcatactggcagacctcaggaactggaggcagcagataactctgaaagcaacagtaaaagccagagctgaatatggaggatggtttaaaaagtgtataaagatctatgggcttcccagatgctttccccagtcctgctgttgttctctgtcctccgtgatagaaaattgagatttactttgtagcaaaattgagccaatgagacactggctcacaaagagataagaacattagaacatcaatccaaaatgttcaacagtcaactaataggcatttcagaaaaaaagagaaaaaaatagaaaagaagaacatttccacaaaataacacaagaaatttcttagagctagagactttgagattctggactgagagagctactgagtacccaataccaaagcactttatgtagaattttggaactgtggggatgaagatatgatttcagtggcctacaggtaggggaaacagtatgtagtataatcatttccacatctaattagacatagataaaacctattcttaaagtatacctattctaggattaatttgtgtcaatgtgactaaaatggtggataatctttttctacctaaaagtcataagcaaaaacaagcagataaacaaaaatacaagccaaaaccacacatgatatctggtgctcacatctaggaatttctgtgccagcttttgatctgagggtatactgcttgtaattagagtatttctcatgccacttctagttgtcataaagattcatacatgcaatagctcactgaaatttcacaaaaggaggattttcccttccatgtggggggagaaacacagtaacaacatccttgctaatctgagtatagccagtttttctgcactatgtataatgaatcaaaggagcagaatatgatcaggcttctaaagaatccaactggaaaccacaggaaatggagtaatggcttagaagtgtggagttataattattttgaacctagaattctacaaatgcaaaacaataagaacagtgggaacagaaaagaaaaaggttttcaagcatgcaaagactcttataccaattctcaggaagttatagaaggaagtgctcccccaatgcaaaagagtagattaaaaaatgattcccacaaagtggggaggagaaggaacgtcataatattatagtgaaaaggggtcccagaacaacaacagttgaatagatttaaagggaaactaagccaaatggagcaggaggaggaaatattccagaatagatatttctgtgagggaacatgaaaagacatcaattacctgatatgttcatctatttgtggggagttttttagttttaatttcagatgaattagtgataggtacttggaaagctaagcaaacaaaataatgagatagttattccttgtggggaagggagagtaaacgcactgatagtatgctaagtggtgtagctatgaacaatatttatttaatcataggggtaaacattaaatattgatttaaacaaaaatgttaatatatgaatgtgggggaatgaagaaacaaaaaatatatgtttggtagatggtgtaagagagctgaattatcatgtaacatattagaaagtcagtaaataatgtctaaattttaaaagtaagcaaaaatcataattaaaatattattttaaaaggtaactatgaatacctaaatatagctagctataagtggctaataagggttgaaagttgttgcctctgcagaatataacttaggaatagagagaggtgaatcagaagggttgctcttctcttaaagccctctatatgatctattaaaatatccacatatataaattagataaaattaaaatgtaattgaaaaaagtggtaatacatttcaaactttctaaaccatgttcccagtgtcaaaataagactaagcaatagctccttcctaccaaagccacccagacctaccaaaccacagaaaaaaagagagattaaaattatattttagaaagtgagttttcaaaggaaataatgtttttttatggattttattgtgtctgattacaaagaattattcatgagtaacaaatattgcaaatttgttttttaggagtctggattatctaagtggataggaaataaattatctcctctgggttcattaccagcatggctaataattctgatatcttctttgatggtgacatctttaactgaggtagccagcaatccagctaccattacactctttctcccaatattatctccattggtgagtatctcatttatcccctttttactcttcattaagagcagtactctgcttcggaatgctggttttcatgttgtggtatggaatctcttttggtctaaatgggcctcctgtaagtaacttacagggtggtctttatttgtattaatgctttcaggggaccttcactctaggtaactgtttttaagttttcatgttcaagcagcatgatcttaagtgaacaacttactttttctcagtccagcttttttcgttataaataagagagagggtcagactagatccatttcagatgtaagacttggaattcagtgtttgctggtaactttattatttagatctctaccgctgacacttttgcctctcaaacattgttcctaaatttctgagaagtggttcatataagtgatttgcaaatgaatgaaaaactaggctcacacttcaggcttgaggcttaaatatcttagacagttttctactgcccagggaagaatttttaaaaagtaagtgggtttgctaaaagagagagggaaagaatgtcttttcttcttttctcaatctaggtagcaattacaagaaacagctttaagtaaaatgtttttcttattgggatggactggtttggtgaaaggaaagcactttaagaaggattgtctttctggaattatgctgctacaagctcaaagggcatatgttggtgttcataagctgctgattgaaagtagaaaaaatgtaggctgtgtatattggtacaatatcattttgtgttgttttctgcttttttaaaatttctcaacatggaacagttagaaaattatgtgttgatttaaaaatagtagtaactcttcttatatgatgaaccctaagcaaatcttaaattgcatatatcacagaggcagtaaagttattagtgtaatgagaactgctggagccacagggacttgcaaacctacctgagctctgttgctcaccagctgtatgctcggacaagttactttagcctctctgggcctctgtttctttatgttatttgaggttatagtagccatctcataagatcattgtaaaaattcaatatatatataaatatgtgacatttattatatattataaactatattatgtgtaaatatatgaatatatacgtatatgtaaacatttagcccaacacctagcaatagataagtaataaatggttgctgtttttgtttagtttctggaataaataatattttattttctaaatgaactggactgtaatgtttaagtgggcatctgtaactgtatcaacaacaagaggatgagatattttcttaaaaatattcaagttataactgtaataatttatataattttatatcattaggttccaacatgcttctgggaaggcttattgtaatactttttttttttttatgtttcgtgtctaccctcaaaattttacttagactcttttttatctcttacaacaggccgaagccattcatgtgaaccctctttatattctgataccttctactctgtgtacttcatttgcattcctcctaccagtagcaaatccacccaatgctattgtcttttcatatggtcatctgaaagtcattgacatggtgagttagctgaaaaaaatactatcaaatccaatacacatcttggtgtgtgccatgtcttgaattatcttcccttttatacaccaatcaaccaccaggaaaagcagggcctgaattctgtttatgaatgcagtgtgcatgactaatcacaaaattgtttttaagagtgattatcagaagtgaacatgccattaaaacttacggtcacaaacagagagatgttgaatgcatcattaatgctttggacgaaggaaaagagcactgaacatgctccacacgacagcataaacctacaagtcaacactaggatccaaactgatccaggcaaaaggaaaaaatagggttaaagaaatcagcaatcaaaacaacactgtgattttctatcacaaacatttatgcaccaacatttcctctgaatgagacactgagtcagtgcctgactgatgaagaagtatctttcttgttgtgatttcaataccaggacctaacgtgaaaacacaagcaaacaataagtaagaatttcactgataaagcatgcacatttttgccaaatacaaaagtactggcagaatattcagtactttataagaactggcttgagaatattctagtagtttccaaatcttcatcaccaatttccaaaccaacccaaatgataatatagccaaagtaaatttagtgagcttcctatgcaaatacagttccaagataagtcccagctccctttctttcacacagactgctgttcctaagctcctgcaacataaacattctagaactgcctctacacaaaaataatatgcatttggtaaggaaaacgtgcataatagaatataagtaatgcctgatgtatgtgtattaaaaaggataaaaacaggattctgggataaataagtggctggcttgcatggacaggaaagagggcatctgttatcacccttgctaggtattcctcttttgcttcagggctccatgttttaatgcagagaatgcaggagtaagcaaactttctctgtaaaaaggcaaatgatatttgaggccctgtggggccatatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagattgtttaatggactgtagaataatgatataagagctaaaaccatgagaatgctaagaaagataatagacatggcataaaatctcaataagaaaatatcgaaggttaaattaacaattacgttgagtgaatataaaagatacagttgccatatggcgtcctgaattttattcattgaaatataaaaccacaaaactgaaattctgctttaacatgaaatggcagatttctaagggattttcctctaatcagaattacttaggtatattcctaagaggaacttctctgagaatctccaactcaacgatgtttagttggagacagatttttctcttgctacgaatggagaagaacccctggatttaagaaatgacgagttaatgggtgcagcacaccaacatgacccatgtatacatatgtaacaaacctgcacgttgtgcacatgtaccctagaacttaaagtataatttaaaaaatgacaatttatactaatcatttaggatgcatgtaaatttggcatatacatcctacaataggattctaatctcctgtaggctttcttctgggacactgacatttatgctctttcctgttcaaggttaaagctggacttggtgtcaacattgttggtgttgctgtggttatgcttggcatatgtacttggattgtacccatgtttgacctctacacttacccttcgtgggctcctgctatgagtaatgagaccatgccataataagcacaaaatttctgactatcttgcggtaatttctggaagacattaatgattgactgtaaaatgtggctctaaataactaatgacacacatttaaatcagttatggtgtagctgctgcaattcccgtgaatacccgaaacctgctgttataactcagagtccatatttgttattgcagtgcaactaaagagcatctatgtgccttcatcaagaagcccatgtttgagattttgctcatgaaccatctgcaacttgcttcatcataagaataatttataacttgaccttcaaagagattagagcatttgtttcatcttacagttggagttcaatgtaacattttaaatgcaatttattatttcagaaatttcccatgaaactaaaaatagaaaataagatatacaagttaattcggtacttggataaatcatttctgcattgttgttccagagaatttgctgagaaatcaaagccatggtcatctggtgatgaagagaaaagtttaatctaaatgatatgtgcatttcctcatttaaaaaatccaattggattattcttaatatatacatgtaatatgaaaattgagattgaagcactaattccaaaattatggctgaatatactaaataacagaaaagttacagataagaatttatttctactgaactctatagttagtgtaatataattcatatttttatgatattggcacactgagaaattcattttgtagagctatggataaggcttgctatgatttgcactattagtacagtatagttagaaaggaaagctgaacactataaaactattaacatattttcgtatatgagtaacaactttgcttaagtgtttatcttagttcagaaatacataatgtcatatgttaaaaataaagagatgtagaaatctaaatgaattatcactgtgtatacagacagaaaaatcacataactctggtgtgttaacattgcaatgaaaaaatgaaaaaaagaaggaaaaaagaataagaatgaaaactgctgacgtattacaaaacagaaaaataaatgatttaaaatcaaatcaaaaagaaaaaaactaaacatttaaacaaaaatgggataagaatagtcttctagaagtgaggatgcgaaaaagaatgagtttccaattaccctgatgtgacaattacacattgtagacaggtagcaaaatatcacatacacccccaaaatatgtacaaatattatatatcaataaataaatttttaaagagtaagtgctattggcattccaaaattcagctaaaggaaaaatgatcaaaaacaaagtaaggtgcacagttagcaaaagatgcagatgttatatcacagcaattctcatgctaaaaatacaacaaaagacaaagcaaaaaataaacctttgcttttcttttttttttttttttttgagacggagtctcgctctgtcgcccaggctggagtgcagtggcgggatctcggctcactgcaagctccgcctcccaggttcacgccattttgctgcctcagccaaacctttgctatttttaatcttcgttggcactttccagctgttactgaccttgtcattttttattcaaataagattatttacaaacttattcttgaaactaaatatagtaaagagggtttttaaaataatatttaacatacgaattattaattggccatgttcattatttatctatgtttattaatgggccaatgcaaaaaatcattttttcaaagaaaaatttgtccatgtaaagcttaaattataatattgctgctttgtataactcttctatgtttattctattcatttgttcctttccctaccatattttacacatgtatttataatctgtagtatttattacatttctgcttttttctagtcattcaatttatcactgctgaattgcatcagatcatggatgcatttttattatgaaaaaataaaatgacttttcaaattataatgagtaagttttggtctcaataaaataatgcaaacatttcagcttggataattttaatgaattacttccaatagctgctagctgagtatgtgaaaaataatacttagtgaaaatttgtttaattgagtgatatagttctcttaccacagctctatgtttgatatatcaaaaatgacttaaatgacccatttcacatttgtcccatttacattaatgttctcaagttattttagtttgagagttgcatactgtctttgaaagtttccagaaagcaattctaaacagatgatcaaaaatcctttgtcctcccactctatggtagacagtatttttgtcattatcctgatcattacttagaggttaactagaaatctttgtcactttgaatttcagcatcttacttaggattggatcttgtctagatgatagcagcaattctactaagtgcctacctactgtctgctcatgcaggcacttggaaggctgcactggcatatgtatatctttcagtcacctcaactgctgctgtacatgtcagcatctctacaattcagacttcttttctctcatatgtgtgcagtattttcaccatggtgtccaaacctttcttttttcagcctgggaggtacataattttagacagtggttctaatgagcattattagcaaaaattgacaaaacgacatcatggcacattcattgtatcttgacatgtgtaccatgtattattatgtgtcaaagagtattagatatattattatatctctatcatggctaaatataagagtccttgtgatgacatttcagttctaaaattttattggtttagttaataaattttatttttgcttgagtatgtagattttaccaaatgaaatgtttttaaaaaattttagtagaggaaggattggattaggaatgcaagagtaaaactgaacaaactgtatcagtttattattttagcataatctaaaaaatgaaatagttaaaattattctctgg

SEQ ID NO: 15849 - DNA, 68490 bp, Human
tatcaggtactttacatgtgatacctttttttaatgtcttataattttagtttaaaaaaattttaatacacaataactgtacatatttatgggggtacatagtgatgttgcaatacatataacatatagtgattagggtaattagcatatctatcatctcaaaaacttatgtctttgttttgggaacatgcaatatccttcttctagctatttgaaactatacaatattgttaactatagtcatcctacagtgctacagaacactagaacttatacctcctatctagttgtaattgtgtattttacaactttgaagtaggtgtaattatccctatttagactatacctgtatgaaacagaaattattttcattttacagatgaggaaacagacgcagagaagtaatttgtccaaagtccatagggttgtaagactcataacaagaactacaacttgggcctatctgaatcttatacttctggtactatacttgttcacaggtttgaaaagagctttaatttctattatttctcaagaatttgtaatgctttctcttgtcactgtgctttcaacttagaggagttgcagttttgataaaagacaaactgatttagcttctaggtttgttaaatatgtaattcagaggcaactccaggcttatatttctacgactgctttctaaatctaattattttataaatagtcctgttgctttaattcactttttaccctaacataattaatcaagtttaactttgaaatctccatattttatgtgagaactcccaaggctatccacttttattttcctttgtaaatttattgttgctcagcctatttcattaatggcagctttaattataatattttattatattttcaaagtgcatgataatggtttaccagtctggttagtacatcagagatttctattgggagctatcagagatgttaacatccaacaattttaccaaagtgtaattgttatagacgtcttaacatgaatttacgcaacaaaaatatgtttaatgtggagaacagtgagatgcatatttgataattcactgcagtctgcatcatcatctctatattccaaaatttcgtcttaagccgtttagtatttaacttacagaagaaagggggttatcttagataacttttaatatcctaaggtattttccaattcacgatacagggagaaaagaaatgtgtccaggcccttagaagaaaatactttgaatttaaatgtgacacatacattaaacccgcgtgacacgccaggcaggcggtggaagtcaagtgcatttgtttttgtttcatccaccagggcgatctctttcacaattctgggagaggcctgtttgttcctccactcccacagctgaagtttgggacaaagtttgagaaaatcccaggcacctgcggctcctatcgaagccggcgaggagcacagggtagagcgtctcttcccagttttcagtcttcagatcgcaggcctctcggacccgcagagcgagcttcacgctgcagcgcttgagaaataagagctattccaaggaggggccctgggtcctcactgacgcttcgcaaaggtgtacgtccgcccagggaaggccggcggcgcagcgacggcgaggagtccccatccatcttctcttcaagcagcagtagctgggttcgggtacccaaccgacgagccgagacgccagaggccagagtacgaagttggaagcctgcgccccaagccaaccgggattccacttagctccgcgcggtccgcgcctcggccggaagggggcgtggcttcgggcccgcgccgcgaggcccgccgccgagtgggggggtttctcccgggccgcagccgcgcgtttccggcgcgctcccccgcgccctccgtcctgtggtctcgcccgcccccgctgccatgttggattgtgcggccgccgccgccgctgcgggagggttgggggaggagttgggagtttagcgcagtcgccggagtgcgaggacaacgaccatccggccctagcctggccgggcgggtgccgggagcttccctttctcagcgcggcgcgaaggtggctcgccgtcagcgcctgcttccctcgacctcgtcctcctccccgctccggaggagctgcgagatgtggcgcctctgactccacttctccccgcccctgtcaccgagagggggaacgagctctcgcccactcgccggaggagacggccctggactcccaaccccgccggcgaaaccatgagctccgtccagcagcagccgccgccgccgcggagggtcaccaacgtggggtccctgttgctcaccccgcaggagaacgagtccctcttcactttcctcggcaagaaatgtgtggtcagtggacgagacccgcgtcgccacccgtgacattacctcacgggcccgggcttgggggccgggaagtgggagtggggaaggaggcgggagcggcgcgggccaggcctcccgccagccccggccccggccccggcccctcgtcggcgccctcgccctgctcccagggtgcgggccgtggcggtcgggcgccgccttcccgagctgctggagaataagggagtgtcacctccgcaggcctgtcctccagcctggccgggcctcggcccgcgcccttgctgctggttaaaactttattctcaggccacaaggggattttcttgcaagagccgcttggtcctagaatctgggcccttgttctagctctcgcttcacctcttactgcttgatctgggggtacgttccttaacaatgccaggtttgaggagtggataggtcggggaaggaaggtggtttttaatctcccattaggattccaggagggaatgaagtcgagtgcaagagcctgggctctcttcggattagagagggtgcaagaaatgttattgctcttcgttaaagagaaacaagatttatttctctagcaaccttgcctaggcctggtttctactctccttcccactgattttttttttccccccattggtgggagggggtgctgctctccccgcagccatgcgcagggaaacctcaatctctggtagctcttggcttttggggccgagaatgattcttagtttggtgctgtgcggccaattccaaccccagatggccggttgggagcgagcagttctgctgtgggaaggggaatgtgtgttgttgacggaagcattcattacattggctgctggcaattctgggggtggggaggttctgctctgtggtgtaggccttgtcgggatcatactgcggtgactgggttgaagtgtggtttgttgaaatactggctggatccctttctctccactttgctagcacctgcagagtatgtgccactggaacccagaaaacacggaaatttcaacaaagcaataccattttataactcctttaagtaatattaggtatgccaaaccagatttcacctgcttctttaagaagttaggattagacaatttctggaaagttattggattcattgttaacttcataggagtccaccctttgtatcttgtgccatccggttggagattgaatcgttccattcaatttcagatgtgtttcatatttcggaatttagaccttagagaacattgagtttcctgattagaaggatgaaacaagaggagtggctcaaaacgagaattttgggtaacaactttaagcccctccccattcacacacacttttttcaacaaatgagaaaactgatccagtgagcccaagtcatacagcaatttaataatgtaaccagaactagaaaaccaggactcctcacacctagtcctatcccattgtactttgcactacatcatgttgttttagaagggtatttttttttcctgttactgatttatttctaaaagtggtgttaaagaaataaccactttgcctttttcaccaaaaactaattaaaatacaagattcttaaagcaccactaatgtttgcatatgctcagtttaggaaaatcttcagcactttgaatgttagttacctccaatgaaaaaaattcagttgctggtttagtagattagctatgtaacctgtatcaaaaaggaagtagttgtgctgtgttctacataccagacacattaactttaggcagaaaggacattacatttatacacaagtatactaattgttctgtgcttacctgtagttttactggtttcgaaaaatggcagatggggaaaaatactgtgatagagaaaaatgatgttgcacattggttagtgtaagtggattgctgaataggctctcagtattcagtgcttaatttctttatgccatcttttattaatcaactgtaccttttgaatttgtcatttaaaaaccacactttcagttgtctgcttttgtgggatgaagtcgttgcaaatactaatttcaatatttgaagtccctagttaatagagagtgaagtaagagtgatattttaatttttgaaataatcttttcctcccttggctgattattcaggttgtttttgtcctttaaaacattactgaaatatattgtctcataataaatccagcagtaagatttacaggtcagaccaaatgtgttaggcagaagtatactcagtactcagagctctacctaagaattcaagaaatgaaacagaagcagttatagtcgaagctctggaggagcttcatttcttctttcattcaacaaacatgtattgaataaatgttgaggtcaaaatctggaagggctgatacttgtcctcagggagcttactaggtctaaaaagggaaacgtgtaaactgataagtcagtgcttcagagtgatgtgtaagaggctgcttttcacagtagaaaatgccttggctttgtaacagcaaatgtgggttcaaactgggggtcactttggacaagtttcttgagcttcctatcctagatttggttttctcatctgtaaaacaaggatactatctcatggggtagttgtgtggattaagactgtgtataaatatatggaaactatttttataaaggtttaggggattaaaggagagaatggtgggagagaggatgattaaaagctttttaaaatggataactgattatttatatttaaacaggtactccctaggctgatgagaggtatgaaacagcttgaaaagttaggagacctactaataagtttgttaggtttgttagggagcaaggagggcttctgcttgggctctcagatttaggtatgaattggaatcattgtggagattatgagaaatgcatatgcctaggcccaattcctagatattactcagaatcactggatctgaggtgaagcttggacatgtctatttttagcaagcttgacagaaaattctaaagtatatcacagtttgaaaaccactgctaaagtccacgttgtctgataggataatccttgagcacattggaaatcttaatagatttttcttcaatttttggtctatattttgcaaattgaagctaaattaagttaaaccaaattcttttagtacagcatttctctcaccgctgaagataccagtgtacatttcacaactaagaaggagatacagttggggaagtattgcactatttaatggggactcacaagatcatatttgacttagaaaattttcaggggaaaggtggaggcagtatagaaggtggattgaggattgtgagggaaagacaagggaaatcagatagttgatttatagtattgcaggtgaaatatgatgagggcctgaattaagagagtactttgggaattcaagaacaattaaagtctccagcagaaattagtcccagttatatatagaaggtgagggaagggagtttcaataaaggcaggcattataaccaccagcagaaaaagtacacagaaacatatttttattctcattcgctgcaaatatgcctaaatgttaatgagactctggattggtgattggcttcatggaggaggcagatcatcagtaaatcttttgttttaccacagtttctaaaaattcattttgtggaaattgagatttcattgtaatacataaatacatgatatgtacttttacataaatagttctgatgccattcattagctggtagtattatgaagggagaatgagaaggttataaacaagattactaggtcttattttgtagttagatctgttgcctttcatgtagtgtgattcagttaattttatataaagagtatgtgcagttttgctaagtgaagttcaacatatatagtcctgaataagtgagaaactaaggaataggaaaaaataaaacattaaactacgtctctacagccatatctggtttatatggattggggctgataatgttattgagcattatctttccctgccatactcacctggtttgttttttcaagatttagtgatacttaagccatttttattaatcaaccttaatctttatttcctttaactcctcagcacttgttttaacttgcttattttctttagttttttgtttcctcactatatataattcttggagatagactttatgcctaggtagtcttctataatttttgtaacttctggctcccagatcagtgaatacttattgattgattgaataattataattactcgtttattttttaggagctcattctgcgtttcttattgcttgattaggttgttaagcccttcagtttctaatgcacatggtatctggactttagtcttcatttattaagcgaccgaaatggtttagttgtgctgctgaactaatataggtggtaacagttgtctaacagtagtttgtttgtgttctaaatcagacctgttgggtagggattcttacataggcatacagggaaggatatgcttagagggatcattgtattgatgatggcctgagtaaggcactgttggtggaaagtttagaccgggaatgtatttcaccttgagtagtaaggaaagataaaagttaaaattcactggatttggaatatacaaagatgagaagatacctttgtctagtatagaggaaaaagatgagcacaaaaatgtatgtgacgcagcgtagctgtaagcacaagaagagattcagaaaagtccaacagggttgggttatgaattttacttctggttattcttagctctatatatataatacagggacatttcttaactagtctcagccttcatgtctagatttgtaaaatgggcttagtcaaggatttcaaagagtaattcaatcattatggaaaatacttagagtccatgacacaaagtattctgggagtttggaggagcatatgaaagaaagttgttatgaatactattcagtgctcagtttagatttcctgttactggcagggaggatttagagtaaaattttcagctctatattgtatttgttttgacttaggtaaattaacaattttaaagtcagttaattataggtgtgtaaattaaaagttaaggagcagcttgaatgtatctctttggggagtgtctgggcagcctgagcctccctggctgctaattgaagaggaagaaaggggtcctgatgaaaaagttaggagttcctgaattttagtccatgctctgctaccatacattgtgaatatgaacaggaattttttttttttttttttttgagacagagtcttgctttgtcgccaaggcgggagtgcagtggcacgatctcggctcactgcaacctcggcctcccaggttcaagttattctcctccctcagcctcccaagtagctggaactacaggcgtgtgccactacccctggctaatttttgtatttttagtacagacagggtttcaccatgctggccaggctggtctcgaactcctgacctcaggtgatctgtccgcttcaacctcccaaagtgctgggattacaggtgtgagccactgtgcctggccatttctcccttcctgaacttcacttttctaatttgaaaatgaagggtcagacaagataactccacagtctttccagctttaatgcttaatcagtttaactattctagattccagggactctagcagggaaagaacaggcctaatgttaactctagcatatatgtgttttgcacagccgagactaatatagcatatatctaagcagaaggtagataatcctgaattatttcattgaaaattcccatttttaattcacctttttctaagcattgtaatttaataggcatttcacttttaaaacagcagagtgaacagaataaaaaagcattagtagtagaattaccaactcttagctaacttagaattattatttgtaattataatgtatttttgggttattagaaactgcttttttggttaagatggaattatttttaagaatttctcttttgttaaccaattccatctagaatcctaattctggatgaaattgtattagtgatatgataggtgttacatgttactgcttattttccaatattaaaaaaatcggtttttagtttcagtggtagacttaatagttatagtgaattgacttggttactttagagactgattcaagattgaggttactgtggggattcatttgtgtgattaaaataatcttggttttcttaaatttttttgtaatgcactggacaacatgctgaaattatggcttattatattagtgaattttgtattcctgaaacagcataccaagagacactagaacctttgacagaacttttctgaaacccaaatgaatgccaaaattaggcatgcttttaagatgcaaagggctgggttttatcttttactgtctttcttgcttattcaacttctgttcttgctgtgctctggatattagaaagcacagctcttgaggaaaagatgtgactgggccttttgaacagtgtctctttcaccaagttctgccagtcactctttggccatctctctgttgtggacagttgtagggattttatttaaaatatactatttttttaaaaagttatcttttaatgtaaaaattgtatctatgagtaatatcagattataaagtctggaaataaagtcttgattagagagcaggtttgattaggacattcaggattcctcataacatatagaattggagctacttaagcgttggccaaagtacagaggagccgggttctatttgttttgctgctgagcaattcctaccatgtgtatcagtattctagtcttctatagtaagatttttaaaaagtctttataaaaactggtaagagcaaaacttgcctaaggaaatgcatgcttgtagtaatctcatgtatttcacttttgtccatattctatagattttttaaataaataatattaatggaagtataatggtagcccattctagttttgagtagaaaaacagattttaaaagagcagataagggttgaactttgttataatttattctgtctagaagtcatagctttcctaatagagttcactcttactctaaaggttctagaaacaaaagtttatacattcatagtgacagtaataggatatacattgttaactataaatataattcttataggtcacctagcatcgttgatggattcttggaaactgtgactttaggtgaaacaacacataatgaaaccagttttaccatagggtaattgatataaacaagagctaagtttctgtagcatatatcaccaaacttctaaataaagacaaaaacacttctaatattaattaatgaaataaatgtgagctgtaacacatttaagaaagagtaataaaaacaagataattatttacccagttacttcacttcagtctcaggtggctggagcctatcctggcagctcagggtacaaggcaagaaccaaccctggacaggacatcatcccatcgcagggtgcactcatacctacacccacaactcactcgcacacttgctcatcctgggataatgtagacagaccagtgaacctaacatgcacatttttgggatgtgggaggaaatccaagtacccagagaacccaatagacatggggagtacctgcaaactccacacagacagtgaccccagcttgaaaatgattttcttttctcatcaaagttaataatgggctggacgtggtggttcacacctttaatcgcagcgctttgggaggctgaggcaggaagatcacttgaggccagtagtttgccaccagcgtgggcaacatagacctaatctctacaagaaaaagtagctggtagtggtggcccatgtctgtagtcccagttactccagaggctgaggcaggaggttcacttgagcccaggaattcaaggatgcagtaagccatgatgagggcattgcactccagcctgggcaacataggaagacctggtctcttaaaaacaaaaaaaaaagttatgatgaaaggacattgaacaaaatgatgttgaacaaaaggatgttatttgaggacctgctgtattaagtatttagtaattaggagacatttggcatgcttaaccatattcataaatatagtgtaatacaaaataaatcttatttattgcatctatgttagtagtctcagaagtattcgagagttatactgatataatagcatataggagagtaaaactaattagaaaacattattttctcataggagttaatgcactgtagaggaattgtaaccctttttttaaagagaccaaataattgactgtaatgttgaagaggtaaatacagaaaagcccctcaagaaaatgtgatcaaatgaaagatatatatataaaagataatatatgagatatatctgacatatgtatgagatatatatgtcttatcaatcaactcctttactaatacataaactgatgcataaactagctagaaactgaaatgatttttattagtgaaacgtagtcaagtcttgaggacttactaagcacataacaccctcccagtatcttggaatatgagggagcagtaaggaaaatccaggttttacccctcagttattcactgtatagctgaagaagacaaaaattatgcacaaaaagatatatgctgcaaaccagcatatatatatatatatcacacacacacacacacacacacacacacacatatataaatgtataaaagatttgaataatagagaggagagataggtatatcattgtgggacttgaatatgaaaaaccttaaatagcctagagaattgatgtcagaaacaagcagcttatcaggtacagatgctcttctacttatgatggattatgtcctgataaacctgtcgtaagttgaaaatgttgtagtcaaaaatgcatttaacacacctaacccaccaaacattatagcttagcctagccttccttaaatgtgctcagaacatttacaataacctacagttgggcaacctgatgtaacacaaagcccattttataataaagtgttgaatattttacataatttgttgaatactgtactgaaagtacaaaactaaatggttgcatgggtactcaaagtatggtttctactgaatgcatattgctttcgcaccattgtaaagctgaaaaattgtaagtggaaccatcattagttggggagtgtttatatcaggaaatgtgtaaacaaaagtttgggatagaaaatgtgtatagaattttaggaggcattgaggagactggttggctagaattgagaatgacatttgcttgggcagatagtggatggtaagtttgaagagtaaattgaggctagattttggaagacctttgaacttcaagtcttaaggattgaactttattccctagaaagtaaggaaacactaagatttcttcaagaaatttcaagataggaaggatctggagaaagaaaattggaaattattattcataatagaaataaggattgagtaatactttattgtttactaaatttcttatttattagttcagcacatcagatctgactaagaaacctggaattgtggcagcttctagagcaagcttgtccaacctgcggcccaggatggctttgaaggtggcccaatccaaattcataaactttcttaaaacagtttgagattttgggttttttttttgcagttttttgtttttgttttgctcatcacctatcattggtgttaccgtattttgtgtgtgactcaagacaattcttcttcttccaatgtggcccagggaaaccaaaagattggacacccctgatgtatagcaaaaaaaaggactaagtccttgatgtatgtgtccatggcagaaaccaacaatcacagcattttttcctactgagttcagacatggtttctaactacctgttgtattcctagaggcaaccactaccaattgtccaggttcacgatagatgaaatctagttgtcattccaaggctagataccagaaacgtgaagaaaaaattggcaatatttaattggcttgtgaattctggatgacaacaaaacctcatactataaatggctagatagtaggaactagaactttggactctagtgttgattattgcggctgtgggagtgggattagatctgtgaaggtgtcaagctcaatattacagagggaacagtctagctaatgttttacttggccagcagcattggaagaggatggctttggccaagtgctaaagtgctattctctttaatttgctagaaacatggtatacatattgttctgcaacttaactttttcacttttattaatatatataaatatatatttccatgtttatatctgttgcatcctttttattaatatattactgccttatatcaagttatatttatgtgtaattaacctctattaatgggtgtaatagttttccctgtagacagtctcacactggtgaaaacatcttattgttcaattcatagtttttggtgaaattgaatatcttttcatatcagttgaccatttatatttcttctgtgaattgcctcttcttgtccttagaccaattttctattggattatttgtttttgtcttagtgacttggaggagcactttatatgttaaagataataattctatactgtagtattttttgtggtttgtcatttatcttttgacaagtacttggttttggtcattgtacaggtttaacattttttgtagttaagtggaataatctttctattatcatatcaagttccctagctcagaattgcaaaaatatttgctcacatttttctggtatttttatggttttattttgaacatttaaatctttaatctttctggaagtgaatttggaaaaggaatgtaatagaaatccagctttttatttttataaatggctagttgtcccaacaccatttattgagcaatttattttctcccatatgaaatgctttttttttttttttttttgggagacggagtcttgctctgtcacccagactggagtacagtggcgctatctctgctcactgcaagctccacctcccaggtcaagagattctcctgcctcagcctcctgagtagctggaactacaggcatgcaccaccacgcccagctaacttttgtatttttagtagagatggggtttcaccttgttggccaggatggtcttgatctcttgacctcgttatctgcccaccttagcctcccagagtgctgggattacaggcgtgagccaccgcgcctgtctgaaatgctgcttttataatttactaaattacaaggagtacgtagaccaagcttttccaacccgtggcccatgggctgcatgtggcccaggacggttttgaatacagcccaaaacaaattcataaacagtcttaaaacatgatatttttttttgcaattttttaaaagttcatcagctattgttagggttaatgtattttatgtgtggcccaaaacaattcttctttgaatgtggcccagggaagccaaaagattagacagccctaagtcttagacttatttttgaagtttcttctatttctttcatttgtttatttcttggccagtacactggattttaattagtgtagcttcataatgatgatacagtttgataagagtaagtctctcattactcttcaatattttctggctattttaatatgcatgtgcttagtgtttttttctaaggctttatcctttaccaaaaaacatttggcttgatttggagtagcattggatttgtagattaattttggaagattgacatattgaggcttcccattggaaagcaagaatttttatttattatttgtcttgttttcttctgcacttttatacttttcttatatatacattacccatttctttaacattttttttgaagtgcaaaataatacccaggtattacataatgtaatgtatcacataatggtgtttcagtcagtgatggaccacatatgtgataaggccccataagattataatggagcagaaaaatccctatcacccagtgacgtagccctaccgactattatgctgtattgttgccatgtattttacttctacaaatgttataaattccatgatgcatttttatagcttttgctgtaaagattcagttatcttttagagacatttaaatagtaagggaaaaaaaccttatatttattcacttggttatcatttctggtacccttaattcatctgtctaaatctaggtatttctctggtatcattttcttgcagtgagaaggagaagtatttttttctttccttcttttaaaatgtttcttgtaatgcaggtcttctacttataaattctttcaggttgatataacttaaaagtctgtattttatcccagttcttgaaagaaattttctctgggtataaaattataagttgataggtttttctttctgttctttaaagatactgctccagtatcttctggtttgcattatttctgacaggaaatctgctgttgtttttttctttaattttctgtacataatgtatctttttttctctgactgcttttctgatttttcgctttattactagtttgaagggatctgattatgatgtgcctttgtgcagttttcttattctttatcttgctgggttttaactaagtttacatcaagtttggaaacttcagacatgattttttcaagtatctacttctctttccctggccctgcgtttcagatatattagactgcttgaagttgtcccatacctcactgctgtatagcattttttcctccctgtcctcctcgtcttcctcctcctccttgctttttccttttctgtgtttctttcggatagcagttgttgctatgcctttaaattcacaaatattttgtctacaatatctaatctgccataaaaaccgtccactgtatttttcatttcagacattgtagttttcatttctagaagtttgatttgcgtgttttttaaatatatgtccagtctttgctctagctacattttgaaatatatggactacagatataacaattgttctaatgtcctgtctgctagctacattttaaaatatatggactacagatataacaactgttctaatgtcctgtctcctatcatctgagtcagtttctgttttattcctattttcactatgggtcttttcctgtttttttttttttcctgcatttttggcaacttttgattgaatgccagattttgtaaaatttaccttgactcttttaataagtcttgaatttttgatggtaagaagctattttttttccatgaagtcatttgtataattgctaattgatctgttttaatagcaacctgctcttttgtgtgctctttacaataatacttaagtaaatatttctgaagatacagatagttttttttaattcccattgaatttttttttttttttttggtcagacacttgcactgtgtattcattgtagtcactctactctttgctgctggttttcctcagctgtcttattattcttggttgtttgtttatatttatatttgaaggactgcttgctcaatataggtagctggcatgcatttttttaaaaaatgaaatcttattttttagagcagttttacatttacaggaaaattgtgcagaaagtgcaaagggttgccatatactctgtctccttccctactcttcagtttctcctattaataatattttgtattaggtaaatttgttacaattgatgatccagtattgatacattattattaactaaagttcatagttgacgttagatttaagtctttgtattgtacagatcattgggttttggtttcacaagtacataacatcatgtccaccgttacagtgtcataccagaatagtttaactgccctacagataccctgcactgcagttattcctcccgcccctccctgctgaaatcctatcactcactgatttttttttttttttttttttttacattttctatagtgttgccttttccagcatgtcatatagttggaatcatacagtatgtagcctttatagactggctccctgtttctgttgcaccacattcacaccagcatttagttttaccagtgttttggatttttagttattttaatagttttgctatcatatctcattgcttttgcaattccctaatgccatatgatgttgaccatcttttcatatgactatttgccatttgtatatcttctttggtgagacgtccaggtcctttgtcagattttttattgggtgtgtttatgtcttattgatgagctttaagagttccttatctatttcagaatcaattcctgtatcagctgtgtgtttcacatgtatttttatctgagtctgtggcttgccttttctttcttttatcagtgtctttcacagaaagaagtttttaattttaatgaagtccatccagttcatcagctttttctttcatggattgatcatgtttttggtattgtatctaaaaagtcatcaccgacccccaggtcacccaggttttgttttatgttctcttctagaactcttacagttttgcaattgacatttagatctctcatccgttttgagttaatttctgtgtaagtcataaggtcagtgcctggatttgattttttttttttttttttttggcacgtggatgtctagctttttaccacttgttgagaagattattatcagttctttattggattgcctttgctcctttgtcaaagatcatttgactgcatttgtatgggtctacttctgggccaccagtctattttgtctatttgtgtttgctctcaacaaggccacactgcctgattactgcagctttatagtaagtcttgaagacaggtagtgtcagtcctctgatgttactcttactcttcagcattgtgttgactattctgagtctttttcctttccatatctttccgttttttgatatccacaaaataactaggattttgactgggattctattgaatctatagatccatttgtggaaattgacatttgagcagtatttttttcctatgtgaacctgaaatacctcttgtttaggtcatctttgatttctttcatcaaaattttgtagtcatatagatcttatttattagatttatacagagattttttttggtactaatataggtggtgctgtgtttttaatttcaggtgttaattggtcattcctggtacacaggaaagcagttgactttgcatattaaccttgtatgctacaaccttgcttgatataaaggcttattggtttccagaaattttttgtttctttgattctttaggattttctacattggtaattatgtcatctgcaaacaaagacagttttattttttccttctcaatctgtataccgtttattgtgttacattagctagaacttctagaaggatatggaataggagtggtgagaggaaacatttttactttgttcccagtattaggggaggaacagtctactttttctccagtaagtatggggttagctgcaggttattgatggaaatgctttatcaagttgaggacgttccctgctatttttgagatttttttttattatgaatgagtatgcttttactgtatctgttcatatgatcatttggtttttctttagcctattgatatgataggttatattagttgacttttgagtgttgagccaaccttgcatacctagaataaatttcacttggttttgatgtttaattcttatatattgttgggttcaatttgctaatatgttgttgattttttttccatctttgttcatgagagatagtggtttgcaattttccttttttgttagatctttatctggtgttggtattagcttaatgctggctttacaaaatagttacgaagtagtccttctgcttctatttctggaagagatttctatcatgtattcctcatatgtttaggataattcaccagtgaaaccatctgctatggtgttttttgctttggaaggttattaataattaatccaatttttaaatggtcataggcctattcagattgtctagtttttgtgtaaattttgatagatcgtgtctttccaggaattggcccatttaatctagattactaaaatttgtaggcatagagtttttcaaaatattccttgttagtcttttaatgtctggaagatcaatagtgatagacctcttctttttttatttttattttttattttttatttttcgagacagagtctcgctctatcacccaggctggagtgcagtggcgcagtctcggctcactgcaagctccgcctcccgggttcacgccattctcctgcctcagccttctgagtagccgggactacaggcgtccgccaccacacccggctaatttttttttgtatttttagtagagacggggtttcaccatgttagccaggatggtcttgatctcctgatctcgtgatctgcctgccttggcctcccaaagtgctgggattacaggtgtgagccaccgcgcctggccgccttttctgtttttatgttagtaatttgtgtcttttctctttttttcttggttaagctggttagaagcttgtcagttttattgactttcatttctctgttgatttcctattttcagttgcattgatttctgctataattctttttttcttttcatctgctaactttgggtttaatttgatcttccttttctagtttcgtaagttagatacttaggttattgattttaaatcctttttcttttctagcacatttctgcttttcctgcattgtactcattttcatgagttacattttcatcttcatttagtttagaatattttaaaatttctcttgagactcctttgactcatgaattatttagaagtatgtttagaaatatttacgaattttcctgtctgttactgatttatagtttcattccattatggtctgagagcatactttgtgtgatttctattcttttaaatttgttaaggtgtgttttatggcccaaaatgtggtctctcttggtgatcgttccatatgtgtttgagaagaatgtgtattgtactgttgttagatgctgcattctataaatgtcaactagatccagttgattggtgctgtgcagttcagttctatccttcctgattttttgcccacttgtcaatcactgatagaggagtgttgaagtctctaagtaaaatagaggatctatctatatttgtccttgtagttatgtgggcttttgcctcatgtattttgacctgtattgttagctgcatacatattacagattgttatgtctttttgtataattgacccttttatcattatgtagtgtccctttttatccttggtatatatgtgtgcatatatatatgtatgtatgtatatatgtgtgtgtatacatacttactctgaagcatactttgcctgaaattaatatagctgctccagctttctttcagttagtgttatcagggtctgtctttctctatccctttgcttttaatttatctgtgtgtttttatatttaaaatgggtgtcttcattgagtacacatggacacaagacaacaacagacacccaggcctacttgagggtggggggtaggagaaggatgaagatttaaaaactaccagtgggatactatgctgattacctgggcgacaattacctgtacaccaaacccctgtgacatgcaatttacccgtataacaaacctgcacatgtactccctgaacctaaaataaaaattggaaataaataaaataggtttcttgtagactatatagagtcgggttgttattttttaacccattctgacagtcttcttttaattggtgtatttagaccattcacatacgattattggcagttggattaatatcaactgtaactgtttttgttgtccttagtcttttctttttctcccattctttggttttaattgagcattttatgtgattccattgtctctctttttctaacagcagttatacttatgtttacaattttttaagtggttgccctgtagtttgcaatatgtatgtacaactaatctcaatctagtatcgaattatactctagtgctttgtgaatagtggagtactttagaacacaatattcccattttcttcctcccatccctccccactgtcattaattttatttatctaaaagctataataactgaatacattgtgtctactgttattttaatcaaactattttctatgagatcaattaaaaagaaaaaaattattcaccatttattcgttctctaacaatattttttctgtatgtatgtgtattcaagtttctgacctctatcattttctctaaagaactttaaacattttttgctaggcgtatcagtaacaaatttcttcaattttcagttgaaaaattatttctctttcgaaaatgtttgaaggataattttgctggatacagaatgttaggttgttgtatttttttctttcaacactttaaatatttcactcaactctttcactatactctctccttgtttgcatgatttctgaagagaagtccaatataattcttaacttttttcttccactggagagaaaattcctccaataggaatttttaggtttattgaaggcacacagaatgaattcttaattttttgagccttgtttcatgctcctaattattatttttttcctatttttgagaaagacctaagaaagtttgagaagcttttaactttatttgattaaacatacaccgaattatcacaatctcatattaagggagctcaaagtaatgctcatagaatagtcgtaactattgaatttaactgtcagaaattcactgttagaaaatctggaaattagaaattggcttcatgtgtacacccacatacgtatctgtaggaagacttattttagtgctacattgtagattgatttttatgttgttgtatctctttattccataactttacatcaacctgttcatttccaaaaacaagaatcttccatggaatgctaggaacagtttggagtaatctaaaacattatgtaatacacagctgcgagactttgaaaaaagctctgatagcagtcaggtgacttacttaaaaaatactgtgtcttactcattaaaaatatagtgctgattattaaagacttagtccttcactgtccagtatggtacttggtagccattagccacatgagctattgagcaattgaaatgtaattaattcaaattgagatgttgagtaagtgtgaaatacacactggatttctaagacttagtgcaaaaaaaaatgtaaactatttcatttaatattgattacatgttgaaatggtagaattttaatatattcagtatataaaatttattgaaattaatttcacttttgatttacaagttggctacaaaataattgaaattggttattggcttgcattatatttccaacagatactgtagacataggcagttcacagagtaataatgacgacagtgcaaatcatctataaaccttaccacccagaaataacacttattaacatttttgtccaaatcctcctaggttttgtcttacatgaattattgaagaagtacacatgtatgtacttactctcagcaaacacacacccacaggcacagacattaatggtttgtttttttgttcgttcgtttgttttgttttgttttttgagacagagtctccagacgactaacagcagttatgtataatggagttgcccaggctggagtgcagtggtacgagttcagctcactgcaaactccgccacccacgttcaagcgattctcctgcctcagcctcccaagtagctgggattacaggtgctcaccactaccatatttttttgtatttttagtagagatggggcttcactgtgttggacaggctggtcttgaactcctgacctcgtgatctgcctgcctcggcctcccaaagtgctgggatcacaggtgtgagccgctgcgcccggctgacattaatgttttattggaccttgtttcttgtcagtagatatataccattatcagtggacacatttatggaatcagcaatttcctagagatggacagttgttgggttgttgttttccctttctacctttttactccctaatatagcaggccacacacacatgctcttcatctgtcttcaccagacttgatctattcttttatgacaatttctaagaaataagtttgctcagttttaaatttaatttttgccttgccaaattgcattttccaataatctgtaccttttataatgacagtctagtgttttctttgtagttcttgaaagtgcccagtccccaggtaatgttaaacaaatgtgagtttttttatttttttgtatttcattctgtaaaatgctctgaattttaaaatgtgatctttctgaatgctgtccatgctttttgtaagagtcttagagacatctcactttgaaaatgaaagtggatgcctgagatgatgaatacagcagtatattttacaattaagctttcttgtctcccttgtaaagtgaggtacatttcttttcaaataaagcaagtaaggttacattaatgtttattgtttataagagctttctttccaatttatctagctaccatgaaatgaagtgcgtcaaacataagaagtcgttagtgtttttggtggtttgcattaacgcttcatcttaagattctttttttcacttaagaaattacggtataatttatgtataataaaatacacagatcttaaatattaactttgatgaattttgacaaatgatacagagtatgaccatacccccaaaataaagtttagaatgtttgtaatacctcaaaaagttccattgggagtctaaccagttggttcctttctaattcctgcctctctcctatcttcgtccaccctttgcaatcactttctgatttctgtcatgatggcttagttttgtctgttttgtcctcttcactcagtatatacgtttttgagattcatctctgttattgtacacatgttcattctttttttattagtcaactggtcagtgtttaccatgaatttaccacaatttgtttgtctgttcttctgttaatggatatttgagtttcccgtttttgactattatgaataaggctcctgtgttcttgtataagtttgtgtgtgtgtgtgtgtgtgtgtgtgtgtgtgtgtgacacatatttttatttcttttgggcaaatagctcaggaattacattgtcactggaaagatgtatgtttatttttataagaaactttcagatagttctccaagtggttgtgcaatctttgcacttccaccagctatgtatgagacttcccattgctccacatctccagtattttatgtggtcagtccttttgtttttggtcattttggtggatatgaaatggcatctcagtgtggcttttcattatatttccttgatgactaatggtattctttcaccctttcagtgcttattggccattcatgtatctttgttttttgtgtagcacttcaggtcttttgcccatagatttagtgggttgattgctctttattaatgatttgtagggatgttatatatattctggacacaagattattgttagagatacgtacttcagatattttctcccagtctgtagcttgcctaattattattattattattatttgagatgaagtctcactctgtcgcccaggctggagtgcagtggtgcattcttggctcactgcaacctctgcctcatgggttcaagtgattctcttgcttcaacctcctgagcagctgggattacaggtgcgtgccaacacactcagctaatttatctattttgattagagatgagagtttcaccatgttggccaggctggtcttgaactcctgacctcaagtaatccacccgccttggcctcccaaagtactgggattacaggcagccaccacacctggccctaattaatttttaatgatgttttttgatgggcaggattttttagttttggtgaggctaatgtatcttttttttttctttaaccttttctagcacatgtatttgtggtttgagaaatcttggcctatgccaaggggtcacagtcacagtcttctgctgcttctaggagctttgtgattctaacttgaggtttatgatccatctcaaattttttgtgttatataaagtgcaaaaaaggtcatatgagatgatcatatgaattttttctttacagtttcattttttccctatgtagttaatttgatacagcaccatttggtaaaaaagccttatcttttgtcattgaattgacttggaaccctttttaataataattgaccttatatgtttgggtctatttctggagtctgacctgtcccattcatttgtttttccatccttatataatatattattgatatgattgtaattagaatgatttttcacattcatatgcatgaagaatattgatctaaatactggtctgtaacattaacagagttaatactggctttgcaagacctttaaaaaatatgctttagatctctaggtaatatttaacagtgaacttatgtttgcttaaaacactgatctgtttatcttcttttcttgtgaccaaaattaactgttagggattcttacagacttagtgttgaataaaaatttttagtttagggaaggaattgaaatcccacctcccccttccagaagccagtgggacatttaatttaaatgttttctgcactgagacacatggttcacagcatggggtctgcagtaaagcagatctaaatttataaccctgttctttgagtttctacctctgtgacaacgggcaagttactaaatctagctcaattttaatttcctcatgtatgaacttagttccttctaggattgatattaaataagaaaatacaagtaaagttcttagcactctgcctgatacaagtatcagttctagacagttgttatattaatatttttatttgggattctaatgaggaaaaaaacatatttcaagaaattgtttttttttaaatataacctaatgtaaattaaaatagaaataggtttcagaggcataaattctgtgtaaaattacatgtgttttaatttttatctttgcatacatagctttacagttttcaaattatatccctccttttttaaaaaaaacagattattagcatcttgagtttaaaagtctgttccgtattttcatagcacagtagtgatgagcatacttaatatttattgagtaatttaatagaacattaaatttacatacagtttgtgtaccacaataatgtgtaaaagatagaacaccatctgtttttaagaccgtcttgaaaaccacaaaattgttcagttaaccaaatgtactgaaaattatttcgtgcttctatgctcatctgacttacagccttgttgtactttgaaaattagtgggaaaagtacattctttttaaaaatgtatgttgactttagtatgctgttttttgcctcagaactctcactacttccttctattggggaagctttgagaattagtgggaaaagtacattctttttaaaaatgtatgttgactttggtatgcttttttttgcccccaaactctcaccacttccttctattggggaagctgttgtagaagcaaattgttgtggcatttaaaacagtatgaagggggatgcattaactgaggtttttcaccatgtcatataaatgtttatgattagttatgaagtgccaagaagaaaagtgtcatcattcttctaaaaataatttcaataccacagattagcagtttgtaatgttctgaaaaattgtttaagacaattttgatagcatagcagtaatcaatacgattctaagaaaggcacccctctcagttcaatccggcaaatgaataaatgcaaaacgcatataaaatactgtgttggaggctaaaggtaataacagttcaagagcatgtggcccttgtctttagagggtgaacagtgttttggtgaagcaaaccctacatgggaacttataagtcattcaataagtgctttattggatgtataaatgaaatattatgagaatacagaaagggagaaatatttgcttgaggaaattgaaaaaacttgatcaagtgtgacatttgaactctacatatatggagtttgaaaagttttcaacattatgtttcagcagagtgaacactataagctgagaagtatgatatgtttgggggtctgcagattaattggctgctatctctgatatatattgggttcataacaagatagtgtcaaagtgttgattgccccagactaagaaatagcttgaattcttgaagaagagtttggactttatttttatcaaataggaacctgttacgttttcaaatattgatctgtgtcctaaaagataactggcaagcacttacgaaagaataaagtagaggcagtgtctcctcttgggaagggggagctattacaatacttcaggccaaagcaaggtataaatttgagatctcgcttatatacttgtatataacagcatatacatataatgaaaaagtgtgtcatttctcattgaatttcattaagatttcagagatatgagaatatacacaatcttttagaagtgtattgttagctaagcttcttttgtacaaataaaatgaactaattctggctggctcaaccaaaaaggaattttttggctaccagaggatcccatggaatccaaagcagaattgaacaaggaagtttcaggaacagcaggaagctgggaagctctgagaaaaacagcaggagttattggaacttttctgaactccaagcctctccttccttactaaacccatcagtcctgggtcccagtttagaattctaaattcctgggagagaatcttaatttaattgattgagcttagcacaagtgcttgtccctggagagaggcaatgagtctctaacactggaagtattggggttggggaatgggtggtactggcaaggtaggtttgtcatatgtatacaagccagcaaaaatcctattaaaatgtactacatgattattaatttggtttttcactgacctaaacttgctttagatgccatcgttcaaaatatttactctctactgtattgaagtgtttttttagttacagctccaatctgagatttgcacatagtaaaggtgtgaatgttatctttcttatttttggaagcctgggcttttttcagattctctttaattgaccaacatactgaaaataaaagaaatattagtcttttcattactagcttctgttggctagtaatagagccttaaaatgatctgattagaaatgttgcaatgatacatctgataatatcataattagcatttaataatgcatacaatgccagtgttctaagtactttatgtgtattaaccctataataaggaactttacatgtattaactaaataaagttagtcccattttatagatgggaaaacagggatagggtagttcagtaattgcttaaaaccacattgctaataagtggtggaatctattcccagagtctgtgctttcagtcataacactattcttccctgggacattcctgattctttgccctcacttgtgtccagttagcattcagggctcccttcttagccttcccagaacatttttattcttgctttcattttggtacttatactttgttataattattattatttttgttgttattttttgagacagagtctccctctgtcacccaggctggagtgcagtggcgatcttggctcactgcaacctctgcctcccaggttcaagcaattctcatacctctgggattgcagtcacacaccaccacgcctggctgatttttgtatttttaatagaggcgtggggtttcgccatgttggccacgctggtgttgaactcctggcctcaagtgatctacctgcctcagcctcccaatgtgctaggattacaggcgtgagccaccatggccagcctacaattatttttctaaacatatctcctttttaggttattaacatcttggagacagagaccttcttttaatcatctaagatgattaagataataaataattgttaattgaattaataccctgttcagatttagtctctaggttagccagacattttgtgaataaatacgattctttaaattatttttattaggaacattcctttgtgtagttatcccaactttgaccttctgttgaccttataaattccatatcttgttctaataaattatttgcatgagattatccctaggactttccagagcattattgtccaatagaactttttatgatgctgtccaatatggtagacatctgtgattattgcgcacttgaaatgtagcaggtgtgactttgagagacaacatttttaacatatttgaatagccattgtggctagtggtgaccttattaaacagtacagctccagagagcaaaagcaagatgagtccagaaactaacagtaccctcccgcctgcccctgcccccacccccaaagccacccagctttggagcttacctagagaggacagtaacagtgtaaaagatctgtgtggactcaaagtgaaatcattcccaattaatttatacattctaaaaaatagagaacatttattaaatctcaatcgcagctcactgcagcctctgtctcctgggttcaagcatttctcttgcctcagcctcctgagtagctgggactgggactacaggcgcccgccaccacgcctgaccaaattttgtgtttttagtagcgacagggtttcatcatgttggacatgctggtcctcaggtgatccactctccttggcctcccaaagtgctgaaattacagatgtgagccaccacacccagccttaagtctcttaaattgtgaataaaatgtaaatcttaaaaacaaaacttgagaaaggttcttggattctttggtggggttttttgttgttgttgttcgtttgtttgttttttggggtggatgctatctagctcttgtgtgtaatgtacatgagagtctcaaatgttgtactttaagtccttaggttgtatgttgaatttaaactgttacttgttacaaagcccttacctttaccttatgccttcaaaagctcatatttaaataaaatggctctcaaagtaacctaccttttgcacgttttttgcccaccttgattgtacatgtcagtcaagcaaactaaaagtgcttatttatataaagtatatgtacatccctgtgactgtccttaaatgcttattagatcattgaattgctgaatatagaataacaaatatggaagacaaaaaattttaatttgcttatttttattaatcatgtttaagagtttgaaagactgcaagagtaagtttgtaaaagaaatcaaagactttgttgttcattatagactggctatctccctatagtagccagagtttgctttttattagtttaagcccctaggcactgtagtatgttattcagcaatgtttatttttaattttttagggggaagctaaagagctactcaaaattcttgctaggttactgtttctaggtcagaaaggttatttttgtttgtttgtttcagacttgcaccataatgtgatttgagtaggtcttttttttttaacgtgtatatattttaaatcaatttttaatttttggaaagccaatacatccacatggtttaaaaatcccacagtgtgcaggcacctgtagtcccagctaccaggaggctgaggcaggagaatggcatgaacccaggaggcggagcttgcagtgagccaagattgtgccactgtactccagcctgggcgagagaatgagactccatctcaaaaaaaaaaaaaaaaaatcccacagtgtgaaaagaaagtgatgtttctcatttatccagtccttcatttgcctagtcatttcttctccaacaaaatacctgtccacacacagaacctttaaacaactgttactagttttgtctgttcttcagaaggttctgtgcatacataggcaaatgtaagttatttattcttgtttgtggtattgtgtacagacgttagtatatgctacccttacttttacatcttgccttttattcagataacagtgtatcttgttcatcttatcattacttgaataacaactttttttttttttttttgcagctgtatggtatcctatttgtatagctgaactgtgctttatttaatgagtgtgtatttttcttgatgaccaaaatattcgagtaattttggataattttaagattctgaagatttgaattaatgatttaaataatggttttgatagaagtcattgtaaagtgtgttacccctttaccctggtttagttaaatagatcaaacacgttactgaactgattttaattcttatatgataaactggttgttgggaaacaggtttgggggtaaccatatattttgtgctaggtgagtatagaaataagacagggccctatcttcaaggagttgacagtctgctgagaagacctaagtgaacagattataatacagtaactggtataatgaaggttcctaggcactatgggaactcaatggataggcctttgtcacagactgagggaaaggtgggttgggaggttcctgtcacaggtgagcagtgactagtgactatctggctggtggcttgggtggtaaaaagaatttaccaagacagttgtaactacagaaaggcagatttcttagagacagtatgaaaatatgttgcaagggtgcaacagacaggtcagcaagagaggagctgactgccaggatacaaaggcttgctggagattttatagaatggtgcttgtgctctgtactgaagagggctttgtgccatactgataacaaggttgcagtgagctaacttgaatttttctgtcagccaagggtctgctgatagctgagctcaggaagatcatgagttatttgcacagaagggctatgtgtcctggaccatgaagaaaggcagacttacagcttactgctttctctttttgctttccttgggtcatctcgccagcctgacttccctcccagattaggacttcacagttcccataggcaacatcatagctgaagtttgaacagtgaccaagtgaaaggagagtcagagagggtacttcacttttgggagcatggatttcgacataaaggatcaggatatgagagaggttaatgacttctaagacagtcccatgtgacttcagcatatcatgtggtagatgacaatgaggctgcacatttctttttatgatcagaaacattattttcccaatattttgcactgctgatcagaacacatgtaaaatattgacttcattttaacaagggtgaccagactaataaagggattcataaaccaggtcagatgaggaatgatcaaaataaattttaccttaaaaagagatgatgtgacaagtagagttttagtggaacatcgctgtggaagcgaaaatgttgctgccactacacagaagtaagtatgctgtaactggaggatgtggtatataccttcggttttgcattattatagctatagtacctggcattatgcctgccacataacaaatgctcaacagacacttgaatgaaagaataaaaaatacaaaacgtgtgggtggcaattgccaggaaaacaggtttagattaactatttaaaattttctaacagtaagatattcttactgcttaaacagtaaaatagtttttccttcaggttgtgagcaccccattacagcaagcatttaagcaaatgctatgtaatcatctgttaaaaatattatatggggctgggcatggtggttcatgcctgtaatcccagcactttgggagaccaaggcaggaggatcacttgaggctaggagttggagaccagcctagaccacatagtgagaccctttctcttaaaaaaaaatgttatatgaaggattcttaaaacattgaatatagaagactctcctccttccagatacactcattgtcattacccacctatcttagtgtttttgtgtttttttgaagttgcttggctttagttttcttaaatggataagatcactatatgttcaaaagttgtttcgttaagtgtggtttggcaaaatgaatatattcgcttagatagttgtttgttttcttcatatacaaaattctattgttctgattgatgcatcattttctcaccccaagcaaggctaatccaggttttgtggcctgaagcttataattgggagcggctctcattaagaaaaacaatccaaaattaagtctaaaagtgaatgtttatttggtgtgagaaaagatcacaacaaataaaaaatgccataaacttcacaaaatttagacaagtagcttattgctattataacttgctgtgtttattattaattaacagtccaatatattatacctatttggtactttttttctacctattgtggccatgtattcattcatcacttctttacatgacagttttatattttatataggaagagtcttttcctcttgcataagacttgacagagtaccaaccatggaccaaattcagcctgcttgtttttataaataaagttttttgcagcgcaggcatatccatataatctatggctgcttttgtgtgcaacaatggatgagttgaaagagatcatgagttggaagcgtaaagtattaaatatctggctttttacagaaaaagactcctgttctaacatatttgctcaaaatttatttactatcgatagctgtgaagctgaaaaaaaaagttttgaaaccagttactagtaatgtaatagcacatctgtaatttccttcactttgcataaaacatgtttcttgcctggggagaactttacatctcatttgtttggaccactgtccctgacccctgaagcgtccatgtagttggatcatagtatgtcacacccagcaggagctgggcaacactcatgcaaatccttgggttaaagattgagtccggatgcatcatgtggtccaagagggacaggaaattactgctaggagctaggcggatacagagatagtgcattcttgatggaagtaccacgatcatcttcagggacagctaaagaggagcccctaggcatgaggctacagttgctgctggtcctgtgtcccaaaggagaataatcaaagccttgtaagggactctacgaagtaaaagatcctgaaacttaaacctaattagcttcatggtaagttcacctcttttccccaggacaaacaacttaatgtctgtttggagtttttcccttcataaacatgtttttttttctcatgcaccagcaatcctttactttctacaaccactaccacaaactctccctccctgccattttccctgccccaaaattaaggtaaaaaacaaaccaaaagggggcgttagagaaataaaactatattaaggatatatccttcttggaggatcatttagctggcatagggcaaaaatatgacaaattaggattgggatgaatcactgattatgtagtgtatgttgagtatagaattagcagctgattgggaaattcatccaaagctgtataatatgtgacctctggcaaataaattgagctcacctataaaatgaggggattggattatatgcttgataaaatatatggtgaagtggtattaagtgctatttggctctagcattcaggaatacccacatcccaccagcaactgcagtaactacttttcaccctctcatcccaaactgttcccacagaagagtagtagcaaagttaaaaaacaaaaatctctctttctctcccccttccttcctgcctccctctttctctctccctctctctttacctctctctccctccatcctgcagttgcactctccctccctctcttttttttccccttgttatcaggacttggggctccactagtaatgttaaactttgggccgggcacagtggctcacgcctgtaatcccagcactttgggagggtgaggcaagcagatcgcctgagttcaagcaatcgtcaagcagattcaagcagatcgtcaggagttcaagaccagcctggccaacatgctgaaaccccatctctacaaaaatacaaaaattagctgggcatgatggtgggtttctgtaatcccagcttcttgggaggctgaggtgggagaattgcttgaacctgggaggcggaggttacagttagccaagatcgtgccattgcactcctccaccctgggtgagagagcgagcctccatctaaataaataaataaaaataaaaataaactgattggtgagctgggactcctagggtaccccctttccaactttattccctgaaaatccagacccaaatttcaggttttaccataatccaactgaatttgcaagaaacagaaggaaaaggagacagaagagagaggaaaaactccttttaagtagatccacttaagttacagggtagggcagaagagaaccagccgcacctatgagctgcccttttaacacagtgtcctcacccatttgcaaatataacccagtctataatgagatcagtattcctctcacctttatctgtatatgattatccttctggtagtagaaagttgagaatacagtaagacttgccatttttagttttaacatctaattttgattgtttactggtaatgctaaaggtctgtgccacataatactttgcagttttctagatgtatgaatttaaatcataggcagtatataagattggtgtgtggttgtgaatgacctaagcctgctgtgtagcacacacctttccatatggcttttgtatataataaagtgattttttaaatggttccaaacaggaatgtgcactgataatgaaggtgaggtctaaaacttttatgatttgtaaccaaaaatttgtcataactatactgctagaaatggaatagaggaagacgtggagccatttcttataggttatgtcttttagtatattaaaacaatcccctacatctgttatctgttgttgcaaacaaaccacctaatgactttgtgacttatagcagtatcaacaaatttctcattctgtagattgagtgattggtctgctggtgactaatctcaccagaatgtagggactgggctcagaaaggacagttgaaatggactagggccttgctctctatgtggtctttgattccaggttttagggcagcacttccaaaagggcaagctacaaggtgcaagtattcccgcttctccttccatttaccagtgtcttcttcatcaaaacaagtcacatagacaaatccagcataagtggaggaagataatatataagaacttgaatcaagggccattacaggaatgatgtgctactgtaccaaatctccagtcaaggtttccaaactgtatgtggctgtttatctctttaaatcactgaattgagctgtgttttgtattactttaacattaaatctgtgtcttcaatccatgccactcttctctttcttatttcctactccacacagttcaccaaactttcctatggtagggtctttttgatgagtctacttagaatgccatttcctccatacttactcctcaccagcgctttgttcacttgactcaccctttttcattcttcaggtaagatgtcacctcagggaagccttcctacactagttaggttttacatttttcttgcatactaatttttcctagtagcattttaatagttattaatgccaatctcccctttattaactagatgttttatgaggaccttgtctaattcatttttgtatttgccctcattttcattcttgtcctcacccccagttatcccagtcccttgtacatagtaggttcttcataaacatttggtgaacaaatatgtctggcagagaaattttcttaaaaagcagctaagatctaaaagactctctgtgtttggtccctaagatagcagctgtttctatctggctccgtttttcttcactgttgagattctgtttgttattttatgcttttgtggttttcctccttcattcctccaggtttgcttttttagaaatttatttcttgtggagtcttttgtcattgccatattctttttaaaacgtgtactgtttttgtttgttttctcttttcttttctggttatttctcattgtagaaattaccaggtgataagatcccttgtctccaaagtgaatttttgtgttttcttttcctggatagttcttactgatactcaccactctcaggagttgttgttccctgccagatacattgtttttcttttttaaatttatgatttctgtattgggttttgaggtgggcaggtaacaggtgttgctactttaattatttagaacattgtttcatgagatcactacataataaactgtaggaattcaaccaaattctttgcatttctttacttttatactactttttataatgtatagattaaaattttacagtcatctcttagtatccatgggggattggttctagggccacccacagataccaaagttcacacatactgaggtcctttagaacccacccatgtgaaaagtctgccctcctgttttgtgggtatctcatcctgctaataactgtatttttcaatccacgtttggttgcggatgcagaaccctgcgatatggagtcctgactgtatttagtgaagaagatctgcatgtaagtggacccacacagttcaaacccatattgttcaagggccaactgtatattcagagtaataataggtcatttcatgtaaatatatcatcagagcatctaggaatgtatttaaatcttagcttttatataatgagaacacttagaatggattttctcatgttagttttcagacatttgaggccaaatgcaacattcagatacatgcgtacatataaaagttggagtatttgactgttaatctaggccaacatgatcatagaaaagactttattttgttaagtcatatgatttccccccacatttagtgtattttggatatttattgaaaatatatatttggccaggcacagtggctcgcatctgtaatccctacactttaggaggccaaggtaggaggatcacttgaggtcaggagtttgagaccagcctgtgtaacatagttagactgcatctctacaaaaaattagaaaattagcccgtcatagtggtgtgtgctggtagtcccagctactcagaaggctgagtgaggtaggaggatcacttgaacctaggggcttgatgctgtggtgagcgatctcactcaccattgcactcctgcctgggtgacagagcaagaccttgtctcaaaaataaaaagagaaaatatgtttaaatattttctttaacattgtatatttgttagattaaaataattttagttattattaaatattcagttattcagtattaaatcattttagtatttgttgtaggcagttgatggctaaaaacaaggatccctgtgactcctagtattttctagtctttttgtggtctagctgtttctgtagtcaaagaaatacctattttcctgatctaaaattcttattctgacctgttacataatgtggttgttctgaaaatgtgaaaggaatttaaacagtagaagtgctgaatgtttgtggtttaagtcttatgcaggatagaacttttaagaaagttggtacacatatagagggaataggaggaagtgggagttttcttagttttgggccattgcagcagtggctaacatatatagaggtagtaatggctctggggagaggaccaccttctcaagattgctgtggttgtgaaagagagctaagggtcatacattttaatgaatcattcgtgcttgttaaagttagaaataatttcatacttaaagatacagtacaaagaacttctatatatccttcatccagatttgccaaatgtttattacatttaccatgtttttttctctatatatatgtatacatgcatgttatttttttctgaataacatgagaataagttgcagacataatgcctctttataatatttcaggctatatatcctaaaatcagagtcattctgttattattgtagtatcattatcaaaatcagaacatgtagtttttaacaaatacttgttcacttggggacaaagtataggtggagtgaaagtacaagcttgcagaactactttaagtgcttatgggaattgcagtctttttagtggttaggaaatcaatacagaaaattattctgatttagagtaagaccagtggaataacagagtaacacaaggtacacaaacaagcacttcagaaatgtgaaaaaaaaaccaaacaaaccaaaaaactccaataaaagtcatttcaacctaaggaatcagagaaatacttctcaactggtgcagagtcaacctcaaagaggtggaagtcccaggcagaaggacagtgggagggaattcacttcctagaatacatcccccatattcttcctgcccttgatcatcatagttctgagaatgaatatgtcattacagttactcagtactgaagtatcaggaatacacaagatatgacaggttctgtttctaccaaagttgatacagtactttttttccttttaattaccagattttaaccttaacattattagggtaataagaaatagatttcccttcctaagcacttgttcttaggttgtttttcattaatatcttcttaattacgaaagacaagaaggaatggaattgatttgttgtaattacttaaaggaatggaaggaatgtctgtaaaaacttaattaagtcactgtcaatctagagtgtggggattagtgactgtttttatattgtctagcattaatatactgtattaaatgtatagcagttattctcatattcactgtaattattctgaattagaaaaggctttacaaggtgctgtggtatgtcattttcagactgccagatgaaggtaagaattaatgaaatagacacttagactgataataagagtgtagcaaattttttgaaaatccagttactgaaaattgcttttgaatagttgtttttttagttttaatgtttataatgcagtatcctgtctgtgaaaaattatagcattgttagtctttatttcttaagcaagtgttttaagaatttaagtttatctaaaggttaaaatgttttttagtttgggtttttttttgttttgttttgttttttaaagttcacatatatagccacatgatgttttacaacgtgaatatttataacatcatgaatatttagtcctttggctagcaaggggattttcataatgggatttcagaccctattgaataacttttttgtgtgtgtgtgtgagctgttacttcttgatttctggtaaaaagcgaagtagggagatttttagatcttcattttggtacatctagtttcctaattgctatctttttagaaatgaatgtattttgacagcaccatactaaaaaagactttatgcgaattctccttagaactaacaaattgcttgtttgatttttgcattcttcagcctggtatttggtacctttagatagtgtatgcaagacgcatttttctgaagttttcagtgctggcagcaggatgcctgtggcactatcatcctgagattgtgcacttgcaaacacaagtgtgttttgagcaggccaaaaagtgtcccacattcttcagtctcctctttgaaacccagtgtcccaggatacacattttttgtttttaagttatcataatttttattgactcttgcagaaatttttctgttcctttgtgtcctactcagtactgtatgtgaagttcaaggttgagtttggtctgtaatgttaaaaacataacattgaacattgttatctgagcaagtctttatggacttttgatcctaacagtatactgatcttacatttctgaatttagtatctaattataaaagatttgtgcatataattgttctttgaaattcctcttaccaaaaaagggcacccctcaggcatagttcagtaaacctaaaacagcatatcttcaaatcttaatgtagtctattttttattacagagcccaaattccgttgaactaaggtaccataattacttaatcagctcctattttaggttatttcagttcttcctctttaaaaaaatatatatttatatgaaatattttatttttatatttatattaaaatatgaagtattatattctaaatgattttcttaatttctagtttagaagtgaaattactttatcagaaaacataattatggctttcagaggatttgtaagtgctttatcagtgtaagtgtgtatcactttcatagaaacttaaggttgaatagttacattctaggttataaagtaaacttaatttagaataaaattagtttacaccttttcatgatatagtcttgaggaagggggcaacatggtgtactggaaaatcctaatgccctgaagtgtccattgcatgtaacgagttagcttccctcctatacatctgaaagggttctatttagggactatccttggtaaaattgagacaatagtcactcaaatctttttcatatcctcagtatagcattaaaactgcgtggccacttgtgcaaatcacttacaatcttaaactcactttagaaaggagatactataatctgccttccagggtggtaatactgctttcaagtttgtctcaatccttatctagataagtgcttaactgctttatacaagtcagccattactaatgctactacttcattgcttaagtgttcactttattgggaaacagtgtaatagggggagtaagaatgctagatttgaagtcacaaattgcctggatttggaatttcagctctgccatttagctgtgtggtattgggcaaattaccccctttagtgtcgggtttctcaagtaaaaaatgaagttatcatagtaataacaaatgaggctatatttaaaagtgattaacacatttcctaacacattttaagcatcaataaatgttttcagtaattattgttatgtgattattgtattagttatttattactacataagaaattacttcagaaactagtggcttaaaataacaatacatgtttattatttccttgtttctgtgaatcaggaatttaggagcagcttagctgggtggttgcggtcaagctgtcagcaggggctatgatcatctacatattattttgaacctaatggttataaattttatattttgcagactatgtcttcagcagtggtgcagttatatgcagcagatcggaactgtatgtggtcaaagaagtgcagtggtgttgcttgtcttgttaaggacaatccacagagatcttattttttaagaatatttgacattaaggtgagttttgttttgctttcactttaaactaggtgattaggttttctatatcaattataatttagtttagatttgtttatcctatatgtgatatttaaatttatacataaactaatattagaagagtgaagcttggtttttagatattgcatacggaaatcatgaccaaatgggaacatgtctgaagccagaatgtgaatagtttcctattttatctttctcctgctaccacgcattaaggctttttttttttttaaattatgcctgttggttcttgggctttctttacactctgtatttttttaatgaaactcttttattccacctggttcattatagaatagcgtagatagtctgttcaggtaacaacaaaataatattttagctcagtatgtactattatttagcccaggtttaaaacatttcaatatctataaaaatctgtttgctactcatttttccttatattgtttctcatgatagatatattcagattttcatagctttatatccctcccttccaatcataaatcacattgttatagattgaataccttgttaggtattcatttcttacagttgtcataaaaatattttgctaagatgaagtctccattatttttttaaaaaacctttctgtaagtaagcctccatgattaatatttatatgtggcaataagtgcaatgagattttaattacaaaaaactaaaactgcctttaaactcttgggcgctaatatgacctgatagataacagtgaagagatttttacacctctggtctcagctttatttgtaaaatcagataaccatcttggtttgttatgaggtatttcactgagattaaatgagatctcagttatggtatttggtaaattagtgcttcttttgttgttgttgttgttgttttgagacagggtcttgctcttgctctgtcacccagcctggagtgcacagcttactgcaaccttgatctccttggcccaagcaatcttcccacctcagccttctgagtagctgtgactacaggtgcatgccaccacacctggctaatttttgtattttcttatagagatgggttctgctgttttgcccagcctggattcaaactcctggactcaagtgatcctcctgcctcaggctcccaaagtgctgggattacaggcctgagccaccagtcccgggctaaattagtgcatcttaatgtctgcttccaagacagctgagagatatgacatgcttctgtcactagcagtggcttactagtaatcactagcagtggctaactatggcagtgattctggggggtggggaacacatacgtagtttgaaagaaacccccaagtgctttgacatatttctcataaccattgagaagcactatttagaaatggcatacacttactactccactaagaagaaagggattccattgcagtggttataatgtgtgaacagtgtattttacatatttttaaattgtggtctaggtagaaccttgcatttctgaatagggcaatgactatctttctctaaccacttatttccaattgctggacactcataattcgtcacctttggtattaagattaaacatattttttatactatggcaatagatatggcagccatcatggcactcttatccatagtttaaccttgatacattttaattatcagtctctttctgcatcatgattaatactacttatactagtatataattagaaaggtactctgcaaaagttaagaatttgaagatggttaattagcagtacaaggaaggtatatttgaccctcccacatctataaaattgaggaaaagaacataaagtattcctgcagtgtttgatagtacattgtctaaatattgctggtggaactgtgctttggtaatcagttcatgtacaaaagtatcctattccttctatgtaacattgatgacctagtaattattctggttattatgtatttgaccaagtagctgaatttggaaatggttggctagtgagattatatcttagctgaattaaactgacttgatatgtaggttttatgaaagatacgttatccagtgtttgcagttttaagaaattactgattagattatgtgacactatttatatattataaatatgttacatgtgtgcattaaaagttatttttaatataaacagttttcttaatatgagtcatcttctttgttttattcctagagattatgttttggtagttcttattttaatttttaacttttttctaggatgggaaactattgtgggaacaagagctatacaataactttgtatataatagtcctagaggatattttcatacctttgctggagatgtaagtcatatttttctttattgccatctttacttttttcattgcttgccttttctaatccaaattatttatagaaccttattgaaagatcaaattcaatttgctattttatttttttgctgaagatgaaatattcaaattagtatatgtgtctgctgtgataggtaacttctctaatagtaatcttttacttgaacttcttcatgcttttgtgttaagttattcagatcataaaataatgtcttatctgctagtaaaattaacctttcgttctttagaaatatacttcttttcctcattgtttttatgatataaagctaaattcatacattctgttgtttcccctttgtgatgaaaatatttcagacttgtcaagttgctcttaattttgccaatgaagaagaagcaaaaaaatttcgaaaagcagttacagaccttttgggccgtcgacaaaggaaatctggtaacccttttttaattacttaaatcaggccagcaaactaatgctcatggggcaagtgtggtccatttcctgttttttgtaaataaaagtttactgaaacttaactgtattcattggtttacatgttgtctttggctattttttgtcacaacacagttaaatagtgatgacagtgatatatggtcctcaaagccaaaattattatctgaaatatttactatttacaaaaaaatttggtggtccttaccttaaaataaataatatttttgttgagaactattttttttagatttaccgaagggcccaatacaataaccttttttgttgataaaatttcatatatattgacttttaattttgcatttgtgatagcattttttgtaaagttttaaaagtattttatactttgtaaacaaagactttaggtaagcttagaagcaaataagcagagttgctaacaagatctgtaaacattgccttgtctttctattttgttcctaatgctatatactataaaacccataaggaacttagtttagtgtgtgaaacaactctaacacatataaaacaattatagaacaatgcaggatagtataaagctttaagttaattggagtagaactattacttgacaacagtgaaccaggtgtttctcttgtaaagtggagaagggtgactaggaaaggggaacctctccaaaatcatcttaagcagatgagtttcagaagaaagaacatgtgctttcatccagtcctatagttccaaaaactgtatgccaatgactctcaaagttttttcttcagtactgacacatcttccctgaccttcagactctgtctactcaagtggcagaatagcctttagacttaacacggtctgagcagaatatttgatccatgtcctgtatcctgaaccttagccccactcagatctgttcctattcttctactaatcttccttgtttcagtaaaaggcatttgttccatcttatccctcaggctcaccatggtccctcataaatcctatcagagtcctattgactctgccttcaaaaacatgtcctgtctgactatttcttaccatttctgctgctaccatcctaatccaggccaccatgatctgtcagctgggctgccacactagctctctgactggtcttcctgctgctactcaatcctttttactatctcttttctatacagtagccagagtaaacttttagaattgtagattaggttatatcactttctctatttaaaattctgtaagagcttcctatcatatacacataaaatctatagtccttaaccatggcctgtggaaccctacatgatctagtccctgactttccttcttgtctcctttcactgtgccatttgctcactgtagtccagtcttcatgatgttctttcatgttgcaccctccttggggcctttgaatgtattgttcccttacttattttatttagatctctacttaaatgtcgggtcttctgaaaaatcttccttagtcacacgtatgtcaatttaggaataagacagtttagtgaattaatttttttatgttgatgttgtcttacatatatttaataatattcttctaatttattttctaacagagaaaagacgagatcccccaaatggtaagctttttgacaattattaatcttttaagattttagatgacagtttaatccttgtggaaacatgtaccatacattagtaatatttagtatcttttacatgttaatccttgtggaaacatgtaccatacattagtaagtaatgtttagtatctatgatcaaattatacagtttattgtgttcctatttttaattaatgattgacagatgagacttaggaaacaatattctttgatatttttctaacatgaagaaagaatacatagggtgaagatcactaatacttattatattttaattctggattcacagttgactaagtatacaatcggaccttaacatttttcctagaggcagtacattttgtctagaatatttgttaatgtcctactttaagatttacctttcattcttatttcaaaatattatttcacattgcttatgtgttatatgaagcccctttcaaaatgaacacctactgttgtggtgtatttagaactaatttagctctgtataatgctctttaatttgataatgaccacttgaagtattatgaattcattttttaaaaaacattgaataccagagagtaaaagcagaataccaggatgtaaaagataaggtctcaggggtagaaattcttactctagacttcataaactccctgaaattgtgtgctaaatatgttcttttctctggagagagaggatccatggctttcatcgtatttaaatgaggttcctgactctatgaaggtaaagaatcattctccagcacactttgttatgatagagaaaatggctgctttttaaaagcatatctcaaatcctcttatcagaacctagaatgattattcaaggaaaacttacataatacagagttcttaatatatgacagctattggtgattgttggggtttcttttaaacagatacgttgccttttgattttgtccttaaatttctttttctgatacagaaacatgaaccaaatgttgctgtattaaattctgggttgtttaccttattattaattttttaaatgcctgactaccttcagtagtgcttaacaggtaccaaatattgtatagtttcactttttcttttgaatagaaatattaatactttttagggctgttacggggattgaagtaatcaaagcttagcatagtgcttaataaatattagttattctgatgaagatgatgacaacaataatagcaactactagttaatgatcttttactacctgccaggcactgtacagcaaccttctgaagtagctcctattatctcttttatagataaggaaaccgaagcacagataggtaacttgctcaaggtctcataactagtaagtagtgaagcaagattcagcatcagatgatttgaccctagagactggccctttaaccactatgttatgtcaagatgattttgaaggcaaaactgagacacagggtaaatatcatgtctcaggatatataaattagtacatggcagaggcaaaagaaacagaagcagctgagttacaggttgctcatctgtgaacttttaatgtagtagtagaaattttccttgatataagcctagtatttcaacctttttgaatttgttacattattttgagtttggagagtatatacagtattgagtaccaacagagaagactttctagtggtgccatcgaaacactttggggaaagtaaccccatattttaaagtgtagatgctgtagaaataatataattaaaattaaggttgtaaatacatgtatccatgttggatcagttccaggatccccccatggatacaaaacttcgttgatactcaagtctgcgatacaaacaacatagtatttgcatgtaactacagattctcctatatgctttaaatcctctgtagagtactcataatacctaatacgatgtaaatgctaggtacatttggtcttagccaaaaggctgagaagtaatgctgggtaaatagttgttatactgtattgtctagggaataatagcaagaatgttctgtacatgttcagaacagatggacccatccatttttatttttaatccacagttggtcgaatccatggatgtggaatgcatggatatggaactgtgaatatggagggctgaacatttataaaatgaatttctgaagaggcatctagtttccatgaatagatagaatttgaaaattctttatataacagtggtgtttcataattttattacccctactaagagacccacttagaattaaatgtagtttcaggccgggcgcggtggctctcgcctgtaatcccagcactttgggaggctgaggtgggcggatcacctgaggtcaggagttcaagaccagcctggccaacataacgaaaccccgtctctattaaaagtacaaaaattagctgggcatggtggcgcatgtctgtaatcccagctactcgggaggctgaggcaggagaattgcttgaacccagaaggcggaggttgcaagtgagccgagatcacaccattgcactccagcctgggcaaaaagagcaagactccgtctcaaaaaaaaaagaattaaatgtagtttctttctatgagttggccattggttttaaatctttagttttaatcatttggcccagtggtttcagacttctttcattaaataaatggagggttttttttttaatagtgttgttaaaggacaaaattatacagcatgtattgccaatacttgtatacttataaaatatacatataatatggaattaatatattaatacacaaagaatgaaataaataattattaatacaagttgtaatattttaaaactgctttgcattcaactatcttgctttccccactaagtggagaccactgtttaggaggcagcattattactttactgtatttggtgcaccaccactaggtggcagtgggcccctggaccatgtcctccagtagctatgcaggtgctttgtctcagatccttatttagattatcagtttaccacaccttttcaaattttaattattaaaaagatactttatgtagaatttacatacattcctaaaatgcagttcagtaacttcctcactcctaatttctttattggtcagtctcacattttagcatatatgctttccaatgatttgttctcagcttcgtgactgcttgacatcagaggcctctaggccacctgtttttcaactgttttccttggtgaggcttctttgcttcttatgtaattaatgggaaacttgagttcttttagatttaaaattaactagacatgtctgttcacaagaacatttaaaaaccttttcatgcaacagttatccttaatcagaaggagttaatttgtcatttgttttttaaaaaagaaggaaaacagcccgccttcattatatgtttacatagtagttcttaggaggagtgtaatttcataaatggaataattaaactttactagaaatgacttcagtacgtacatctgttactaaatctttcatatactttatgttgtttaaaaaatggctctataccttaaacaggttatcactttttttagtgtgtcgcttgaaacagatacttaatttggctctagaataccattttaaacttatttcctaacatcttcaaactctaaagtaaataaccattgtcaacagaaataaccgagtacctaacctcttgaatgtatagaaatccatttttttctaaattctgtaagttgttagtaaatatttgttgaataatgacttgttggaccacagaccaagaaaactgaaaaattggcaaacaaagaatgtattatgacatttgtaaaattagcggtgttatccaccttgtagtttgacttttgtgtaagaggtataagaggtagaatagttggccgggcacggtggctcacgcctgtaatcccaacactttgggaggccgaggcaggtggatcacgaggtcaggaaatcaagaccatcctggctaatacgatgaaaccccatctctactaaaatatgaaaaattagccaggcttagtggcacacacctgtagtcccagccacctgggaggctgaggcaggagaatcacttgaacccggaggtgaaggttgcagtgagccgagatggcgccattgcactccagcctgggcgagagagtgagactccatctcaaaaaaaaaaagaggtaaagtagttaattggaagggtagtggactaggaaccaagatatcagaatacacttttgcttctgtcactaatcatatgactttataaagatcacctgactcttactgtccttcattttcattaataaaatgaaaggcaattttgaaaagaaactctaatttcccatctaatactaattttctatatatctccattatatggatttttctttatagtcttacttaaataatgttgttttttttttttttttttttttttttttttttgagacggagtttcgctctgttgcccaggctggagtgcagtggcgctatttcgactcactgcaagctcctcctcccgggttcacgccattctcctgcctcagcctcccgtgtagctgggactacaggcgcgcgccaccatgcccggataattttttgtattgttagtagagacggggtttcaccgtgttagccaggatggtctcgacctcctgacctcgtgatccgcccgtctcggcctcccaaagtgctgggattacaggcgtgagccaccgcgcccggccttaaataatgttttaactagtactaatgaaattcatctataatgacttaaagagataatgttgatgcataataatatattcatgcctgatttttgggtagagaaagaggggaaacagtctgattacagtatgagttaaacattgttactcatttcacatatcacttacattttgttcctatcctcattcttgaatcttcctcagagacagctgaattactttctctagtgagttatataaatcaaggttataagaagctgatttttcaaaaatatactagcttggataatttaaatcattaaacttaactttatccaactgtgtttccatgctagtcatctatagtataatagatggcttttatataagctaaagtggcagaaaatatttttgttgttttctgtttttatattttactggtgagtctgattgtttatagttgctatttgaatacttagttccggaaaagtcatatgaataaagagagtgcctaattctttttctttttttccttttttgagacagggtcttgctctgtcgcccgggctggagtcagtggcgcaatctcagcccactgcaacctctgcctcccaggttcaagtgattctcctgcctcagcctcctgagtagcagggattataggcacacaccaccacgcccggctaatttttgtattagaggcgcggtttcaccatattggccaggctggtctcgaactcctgacctcatgatctgcccgccttggccttccaaagtgctgggattacaggcgtgagccactgtgcctggccagggagtacctaattctgatactcctaattctgtcttaattcttacattttattaagatataaagataagaaacaaagtaatttgtagcatccttattgtggatagtgttgctgatactgactggtaaagataagaagtgagagggcagaaagggaagaatgagaagtaaaagtagaccaccagataagtctgtgaaggtctgagtgtaaccccaattcaaccctctagtccctacattctggatattctcagtaagtcctttattttgtacaactacataaatgtcgaaatctgatacctgagcaaatttgaaaattcacatcctaatcaccctttcaggtcattcgatactgcttaactcacctttacttactgatctagttatttttcatattattcctgggcactaaaaaagcttttaatgattttatccatattattcactagctctcatttttcccaaaaactatttcttatccatatcaacaacttcctatggaatttttgaatgaaattgtaactaaaactttaggattattaaaatattatatataaataggatttgaatattaagggaaaagagttgaattttggtgatattaaaaatatgcctttccaaattatttacttttttgataaggtgacatggctttcataaatttgttttagttttgttttatctttaatagtagagttgggagaaaatagggtatatacaatttacccatgtaaataaactttttttttttttcagataattttagtaagtaggatactttggcagtttggggcataattaaagaataacagtcaagttggattttaaggatcaactaatatacattagccttgagatttctatttgccatttattgattatgttggggatccccaagaccatcctcagaggtggtgattcaccaggacttacaggacttaatatatagctgtactcatggcaaacatttattacagtgaaaacacatataaaacaaaatcagcaaagggaaagacacatgggatgaagttcataaaaaaaaaaaaccacacacaagtttccaagagttctcccagtggagaacacagaggttgcacctaattcctccaataatgaattgtgacaacttgtgaaatgttgtctaaaggaaaagcttgagacttggtgcccagggttttcgttgagggctagttacataggtctaccctgccttgcacttaccaagatttcagactcccagaaggaaagtagatgttcaacataaactgcattgttagcacaaacagtttagacacaataagcccaccttgtcagggaatagtgggaaccctcttgaaatccaacttcccaagtggtcaactgagggccaaccttgcaagtggtcctttctaagaagagcagtctaaagtgtgctgccttaaactcttttctacacaacgatgatagtatttcatatgttttggaagtggtcgttaatgtagtcacctcagaggaacttggtctcaaaggaggatttgtcagagaaccatatataaaaataggatctctgaggaacatgtgttgccctttagttgaatttttaagaaatttttcagttgaatgctccacattcagactttcatacttttaagatcaagaattttattttgaattgtaagacaagttttctgctacatttagtaccacttctgaagatactattaataatatggaaagatgcctttgacatttttactgttgattcttgcacaagatgagtgctttaagaatttttgtgttttaaatttttaaattctatacttctgatagtcaaggtgtatgcgtactggtggggaaaatatcatttgacttaaggatgccagttctggaaaaaatggtagtaataattttaagtaccctttttcttcttgactaataaagttgaaacaaagagttaaggctatatttctttgttaaatttaaaacaaaaatagatactttactttctttatccttgttacaagatatgtttcactttactgttgagcaatgtgttggatatgaggctattataatcaaaatttaagagattagactaattatatttaaattctagctggaagttcatattctttatgaaatttaatggcataaaaatgtaagtttgctttgaaatagtgcatctacactcatttcaagaacttaacaggttttagaaatttaggcagcactttatgaaaaaaatgtagaagtttaaaatataaataatttataatgaagtgatcctatttcagaaaaagtatttaaattgtaaattatgattgtatatcagttatcttaaattatatcccttttatataatttggttttatttgcaggtcctaatctacccatggctacagttgatataaaaaatccagaaatcacaacaaatagattttatggtccacaagtcaacaacatctcccataccaaagaaaagaagaagggaaaagctaaaaagaagagattaaccaaggcagatataggaacaccaagcaatttccagtaagacagttcttttgttgttcttatcttcacttttgatttattcattgctgttcttgatttttaacttgttagaaaattttcttctcttttcgggagggtgtgtacattcatcacttggataccgttttaactatgtactttattggagtttttttttttttttaaggcagctgctcaatagatgttcttggaatcttatggtttatttactttttcaactatgagaaaagaaaaattagataaagttgtttcttcaactaattattgaacataaaaatgatttctcactttgctctaaaaatagcatttagaaattgtttacagatactgcctaggggcagtaaaaacctttggtatttaacatatttcaagcattttcatatgcattattttattagctcattatgaaacccttatcccgtcatatatataatgcttggactcttatgctaatttgacaattaaggaaatagatgctcagagagattgtacaaaaattttaagtttcagttagtagcagagtcagggctagaatcctgttcttctgactccttgtacatagtttttatcacaatatggttatgtctgtgagaactgttagttcagaccaaaaattcaaagccaaatgtagattgggtttcatatatattgtgtttataatgccctttatgcattttgtttttctattttttttctattttctacttcaggcacattggacatgttggttgggatccaaatacaggctttgatgtaagtatgttttcaaatcatatacgttataactgtatgtggaaatgtgttggcctattttagatttttttaaattcatttttgtggtttctagtatctgtttgaatgtgcttgtgttttatgtatgtatacaactgaggtttaaaaccatattattgttctgtcattcatggctaagtctctaaagacttagactaaggttttgtgtaccttggctttatacactgtataaataaaatccttgtgctttgaaagccaagagaagaaaatcatttctgccaagtgataatttcaggggagtgtataccaaattactagaaagtagtataatcaaattctgaatattcagttgttgaattctccagatcttttcattctcctgttctttttggcagttttgccgttgttttatagcactgtgaaactgctggcaaaaattaatcagcgtttggatgcattattttaaagagatattatttgtgattggagtaaaaaatatttttagttatttttgttatagctacaacgttaactcaacaaacatactgagcacctcttgtgctgggcattgtgcaaggtgcttgggattacaggaagatccttgctctcagattttcaaattaatttactttttttgtgtttattcctgatttttacatacttacttaggacaaggtagaataaatgagcattggagatgtctgaatcatgaataggctaatagaaatctaaatgagatgccctctttttgaaggcagggaacaaaaaagaagaataaaatagggaatatatctgttcagttttttttaataaaatattttagttagcacataagtaatataagcatgttaaaagtttaggcaaaataatttcagaaggacacagatgagacttaaaattatgttttttaaattgggatatatttttatagttagcagttactttcttttgtagctgaataatttggatccagaattgaagaatcttttcgatatgtgtggaatctcagaggcacaacttaaagacagagaaacatcaaaagttatatatgactttattgaaaaaacaggaggtgttgaagctgttaaaaatgaactgcggaggcaaggtaacttttatctctattcagcgttctgttttgttttaatcttttgaggtcagtttcatggaaaccagttaacattcatacatgtgaacccttccttgagcagaatgttgaagtctatggacaactaatgtggcccatcacactgtgtcttaacattatttcattataactaaaaaaactttacaaggttttgtttattctttattcataaaaatccatacaaaatcttcccagctattctattttaaagtaaaaacttatagttgcctaaatgttatacttaaggaatcctataaaccaccagattttattgtaattcagaagtaataatttaaatataatcactttctaattagtaatatacgcatttccagaatataaataatgtaaactttctattttgaaatacaaatcctttttcttggataaagtatgaaattttcttttgtacctgagagcacaatttataaccttttaagatttgatatttattttaaaggacctcgtatttcagttttgtcttaataattattgcagtaaaatgcagataaaatactctaaattttccaattaacagtcatctctttgctaccttattaggactgctttcttttcttcttcctagcttttgcatactcataatagtgtagttaagcaaaagctccggttaaaacattcttctgaagaacttaactgtcattttaaattaggcattcagtttacttatgtctttttcattgccagtgttcatttaaactttgattgatagattgacttatatagttcataaacattattatgccagtactagtctcaggatatttagatgtaaaggattctcatgcctcagccacccaagtagctgagattacaggcatgcaccactacaccctgctaatttttatatttttaatagaaacggggtttttccatgttagccaggttggtctcaaactcttggcctcaagtgatcctcccgctttggcctcccaaagtgctgggattacaggcatgagccaccatgctcagccaagtttatttttctgttatatcttacattttcactgatgtggaataagaatgctaatatcatgactactggaataatagtaatttttgttaataactttaattttgcagtgtatggaaattctcagttaatttgttaataaccagttcatgtctctggaataagtaattgagcatttcaacaaagcaaccagcctcctataatgccattactagaattgcagacaatttttagagatacagacattatgctataaaagtacaaatgtaaattaaatgacaaaggcttacattttgaaaggaaagcattatatttgggctttagcgcagattaatgtgaatgaattctattaagctatgctacactataattctgaatgtgaattgattttacttaaaaaaataagtgtacttgattcttttttaaagagggaaggtatttatttttattaaaatgtaaactaatgctaattaacaaaatgtttaatttcattggtatattttgttattattttgtaaagtagaaaatgtttattccccttactttcagaactggtactaattccaaaaaaataaactattctgttttagctcatatttttttaagaaccaataagaaagtgatctttaggctgacaattctcaaaaaaaattgtgagatatcatctgtgctcaggtatctttgtaaaataaaatgcaaagatgagacccttttttggtattattcaatttttatacatgttaaaatgaattacttttcaatatgatgtttatgagaagaaaaaagcatgccttctttttttctgtttgcatttcagcaccaccacctccaccaccatcaaggggagggccacctcctcctcctccccctccacacaactcaggtcctcctcctcctcctgctaggggaagaggcgctcctcccccaccaccttcaagagctcccacagctgcacctccaccaccgcctccttccaggccaagtgtagcagtccctccaccaccgccaaataggatgtaccctcctccacctccagcccttccctcctcagcaccttcagggcctccaccaccacctccatctgtgttgggggtagggccagtggcaccacccccaccgcctccacctccacctcctcctgggccaccgcccccgcctggcctgccttctgatggggaccatcaggttccaactactgcaggaaacaaagcagctcttttagatcaaattagagagggtgctcagctaaaaaaagtggagcagaacagtcggccagtgtcctgctctggacgagatgcactgttagaccagatacgacagggtatccaactaaaatctgtaagtaagcttttttttttttcattttagatcctttatcataatggaattttaaagtaatttattgaaagatatttttgaaaagtgtattcttttttcctcttgctaattcattcttaaccctataaatttaaaaatacttttacatgcagtgacatgcacaaatttttaattcagctttgatacatctctatagccatgtaacccatatctctatatccaaatgtagggtatttctgtcaccccagaaggttttctcatacctcttcccagttaatttttccataaacaatcactgatctaatcaccatagattagttttacctattctagaacttcatgtgaatggaattttacaggatgtttgcaattcattgttctagactttactttcaaataaaaggtactttaaagaaaaatccttattaagctgtgagaattaaaaatagccctacttgaaaccaattgtgatcaccttaggaaatctaaaccagtagctttatgaaaattaaatcatgttccaaagttttcatgttctaaaatttagattagtagagaatcagaccaaaaaaattgaaagagttgtaatagaatttctgacagtgatggcaaataaatttaggattatctgatttggatgaggtaatcatttaatcttacaggtcatttaatcttctagagttcagcaaacattttcctataaaggatcaggtagtaaaaccttgggcttatataggcagtatggcctcttgtgaccactcagctctgctgttttaccgcagaagcaccacagacaatacataaatgaatggacatgcttgtgttctataaaactatatttggacactgaaatttgaattttatataactttcacatatcaaaaatactcttattttctttcagccatttaaaaatgtaaaaatcaagcttaatttttagatagttttaaaaaaaaatccaagaacaggctggatttggcccatgggctcaagtttgctgactcctatcctagaacctaacctgtctacatttacatacttcttttggagccttttataacatgttctccaggacttcagggaggtcatggatgatagagtttttctgtgaagtaaatggagacgacagaggatgttttaattgaaaattatttcccagtataggaattaaagtaactttctagatctcagaaactttgtctaaaaggagggtaatagataggaagcacaactaattgaatggaaaacatgtaaacattagcatagatctaagaagactctgatctttaaaatatatctagctcttttctttacatgtattcaggatgacacttaaacctatgaacagtcatctctgttctctttccccctttagatcagactaaaggcctgtcaagagcagttgaagaactttaaagagtggttagtggggagaattaatgtcaaaatgaccacagcccagcttttaccttggaatctctgctagttcctgtgtcattctcattcccgtaactctcactcctaacccacctttttgttttccttttctatttccttttcacaaaccaactttgtttctttctctcatttagctataataaggtgatttaaaatttttaacgaataaagttgtatcctcatttattttaaaaagtttaagagttaaatttctatttactttctccataactttctcccatcccaactctccctttctttccaaaaaaaaaaaaagaagcagcaaaacctgttaattgatgtgtaagaatgggggccatttttatcctaaataatcactttccttttgattgcatttattgcaatcatagggtgcataatcagtgaactattggcatgttatacatgtaatccgagttcgttattttttgaaaaagaccattttgtggttgaaatttctatggctatgtttctttaaattttttgagtaaatcatcaatttattctgtgatgaatatgattaacataaaaccatagacttactttaaagagctagtaggaggtattgaatactcacatatatttttgaattccatggttttagtacctcaaatagtactttgttcaagtaagcacttcaaaaaatgtgtttgatgagagtatgctcacttctgctttgtgctctctgctttacattatcacattgcttaaaggtagtctaaatgtccctaccgctgttgtacctccttgagagccttgtgcagaaatacaaagctctgaaactctctgttatcttttttcatttgtggtacttctatactggaaatagttaatacataatgtttaaagccaaaatactaaggaatgaatctatatcttagggggaaccactttgaatttttttaaaaaaggtgtttactccagaaagaacaaggagtattagaggaagaattgtacagatcaaaatggaaagtttgtctaaataaaattgtctttgggaaatgattaagaatttcaaaaatatatattatatatgtatgtattaaaacataggtaattatttaatacagctatgctgtttcatctttaattataattttttttttcatgaatgcactttggcacagctggaagtacttcagttagggattgttacttgcctagtgaggcaggtacattttgaaagttgctcaactcatctccttaaaaagaaattatatactatgagaaaagaggttcattttgaaggtataaatgtaacataaaggtgtaaagctgaatttttgtaggcaaatataagtttctacagttgtttttcaatatcttcagtgtgcgtcccacgtaacaactctggagtctaaatattaacctctgtttataacatgaaatcccttgataaaagctttaaagttgatcatctaagtctgtgtgtgctggaataaacagaagtaacccagcaagtattattcaggagagggtttgttatctgaatgtaaacatagatttggaaatgtatttttggcttatacattaagatggaaaggaaatatttttgaataatatctttaaggcagcagtttatttcttgttaatttgattaatcttgtcctgcgcttgccagtttgatatcttttttgtcttttacaataagaagtgattctaagaaagtaggactttctggagacaaagattcttggctaaagatttattactgagttttgctaactttcttttccaaggtggctgatggccaagagtctacaccaccaacacctgcacccacttcaggaattgtgggtgcattaatggaagtgatgcagaaaaggagcaaagccattcattcttcaggtagagagagagagagagagagagagagagagacagagagagtgtgcgtgtgtgtttaataaatttgaatgtttgacgttctgttatttttatgactgtctttgctagctttctctctgctaattgagtaactactgatgtgggctctaggatgtattttaaaaagttgttgcctgtgtgactagtctctctgagacttaacaaatgcaacaccaccacagccatagccataaattgaaagaacagctttgggaatattgacagttttgtttcctatatcaggaaatgctaatagacttcctagcaaacaacctctaaacaaagcttgagatttttagatctcattcctgtgacattactgtgacatgaaaaattcagggctgggtgcggtgactcacacctgtaatcccagcactttgggaggccgaggcgggtggatcacctgaggtcgggagttcgagaccagcctggcctacatggcagaaactccatctctactaaaaatacaaaaaagttagccggcgtggtggcgcatgcctgtaattccagctactcgggaggctgaggcaggagaattgcttgaacccaggaggcagaggttgtggtgagccaagatcgcaccattgcactccgacatgggcaacaagagcaaaacttcgtctcaaaaataaaatgaataaataataataataataaatcgggccatttacctcatctgtaaggattagggataagaatttcagtaatttttactgtttctagagtttgctaaagaatactaactttttttaaacctttctttttcattttctaaaaggttgatttgaagaaaccagtacctattctgaggttattattaaacatatacataccaccatataaatattcctttaaagaaagaacaagaatatgagttttgctgattggagtagttgaggtttgctaaatagcttctccaacatgatgtgctagaatcagatctttcttcttagatttatttaatctctgtgagcctcagtttcttgtttgttacattcagagaactcacaaaacatatagatgtgagaattaaatagtatgtcactaacctgcagattgcctagcacatagtaggtgcttaataaatgttaccttccttttgtttctctgtaaggatgtccatgtcttaagatccttgagcaatgtttgttttccttaaataggcatatttgtacctaccctccattacagagatagagataaatatttattgtggaataataataaaattttaacaaaaaaaaagtccctgccttcatcgacatgcattaggtctaatgagagagagagacaagcaataaacaaagaaaactagaaaaacatacagtatgttaaatggtgacatgaagtaaggacaaaagtctaacagaaaagggaaatagggggcagactgttgagagagaggttcattttgaaatgataaaggatgataagggacaataaagcctaactgaggtgacatttgagaaaagaccagcagttcaggaagtgaaccatgtagaaaactagggaaagtgtatccgatggaaagaacagaaaatataaagtctgtgaggttgagaaacaatgaggagatcacggagcttgcaagggagggagggaaagaatagtaaggaatgaaatacaagaagtagtaggaggccagtggtaaggctttggagacccctgaaagtgcactagcttttattctgcatatgatgggaagccattggagggtttttagcagaggtgtagtaatgatccaagcaagaggtgatggaggcttgaaccaggtttatagcaccaatgagaagtggttaaatattaattatattttgaatgtggagatcactggttttgatgatggtttgaaagtgaaggttgaagaaaaagaagagtgcaaaatgactccaaggtttttgacttgaacaactggaaaggggaaagacttacgaagaaaaagtttgagagggaagattaggagtttgattttacatattaaatttgagatacctattaattcaactatagatgtggagtaggcatttcgttatgagtctggaagtcacaggagaggtctgaattgttaaattgcatgtcagtaggatatacatagacacctggtatttaaagttatggttatgtttatggtatagtcttctttagcataaaaacagtgaaaattacctaaattcttagccctaatcctcacagatgaggtaaactgcctgaattttttatgtcatagtaatgtcataggaatgagatctaaaaatctcaagctttgtttagaggttgtttgctaggaagagataaagaaaggtcttcattcattcataaagaaatgtaaggcttctgtgaactacatgattctgaaaaagcatttattctatgctggtatctgtgagttctgctaaatatttccctacaataagtttttttttaatagtatgtaatagtcacgctaatataatgaaaatataggatggtttttacttattttcagacccatttattttaactgttagtatttctgtggtagtacctgatgatgaaattattagctacttcttcctcttcaccatagatactgataagtttctgtcttttgtcagtctgtaatgccagcatagtcaggtgtctttgatgcttttcatccaggtaaattttgtgaagcatgtctagcaaaatctggtagcaaattatttcccttgctagaagagtaaacagaaattaacatgactcaattgaactcctttccaaataaattctgtaacaatttagagctgaccatgagacttaaataaataaataaataaataataaataattatcgttttaaaagtaacaacttagtttagggctaagagaagataatgttgcttctcttgggcttctgttaattttcaagttctaatactagagctccagtacttcttcaaatactaccttcacacaatcaattttacatgagaaaaatagaagaaaaagattgttctgtgttctgtacatgtaacccacacgtatgtcacctagtcttactggctttttatcattatcaagtacaattactcagccactgtcccactttatatacttggccttcatgggtcctatatatatatttatatacatatttatatatatttatatatttatatataggtatatgtatttatatatttataggtgtatatatttatacatattttatatatagatatatgaagaggttaaatatggaaagtcagtataatatagaagtatgcttataaaatctgataactaaatattccttcaacaaatatttattgaatggctggtgtgtagtgctgttttggtgttgaggatacagtgagaaataagataggcaaggtccgtgctgtcatggagcttaatagataaagtacaataattttagatattagcaagtgatatgaggaaagtaaaatgggataggccgttactgattatggggaagagctatactttacatatgatggtcaggaaaggcctctctgaggaagtagtttatgaatggtttctaaatgatgaaaagattcagtttaacgaagaaatagctactgcagaagttctaaagccagaataagattggtgagtttaagggacagaaaggagaccatcttactagagagagtgacttgaagggagagtacatatgagagaagtttggggagagagagagacaataactggacaaatcatgtagggtcttatggagggaggtagcatcagatttcattcaaatagcagtggtagccacaggaggactttaagaagggtagcaacatattttttaaacttgaaatttaaataatatcactccatttgctctgagtcaaatagactctagagttgcaataatccaagcaggatgtgatggtggtgtggagagtagcagtgaaagaggtgaaaaagagcaggcttgataattggatcgtgaaaaaggaggaagtaataataatttctaggtttttggcctgattatgtgacaggatggtgatgccatttattgagatggagcagcagaccaggatggagcaggaaaagaagattggggaaggaaataaaagttagaagttttgagtttgagaatccatatgaagagtacaagaaggtagttggatttgtgacagaaaggtcaacccagatgattttatacattaacaggttgaaatttgtcacatagatattaaggaactagaaccattgtcttctaagccctgttttaatctttagtttactatcatactctatagatatatttctttagattcactttaaactgttttagtaactagattcttctgggagtcacattatctgtgtttcaggagttaaataattggagaaaccacccaagaattatgtaatgtcattttatttatgcatatgttttaattgtcttgattttcttgtagatgaagatgaagatgaagatgatgaagaagattttgaggatgatgatgagtgggaagactgatctatatattatatatatatatatatttttaaggtgaaatactaaacactactttctgtctgtggattctgtaaaattatcatgtaaatgttctaccaatttgctgtatatttttgttgccttttttgcttttttttaatctgtgcaatacctcatttaatctgtaaaggtttgtcgtaatcctctacaaagctactccctgttattgtgtgcaagtttacaccaggatgctcacttgatttgtgaatatttttcattccatcaacaagggagtttaaatactatatgtgagactgacaaaaaccttaatgtaatttacttataatgccagaaggaaaacactattttcataccctactttttctgtacctaaattttcttaaaaaaaaatctagtatagcactacattcttttttaagtgatgcagaccttagtttctttagcccctttattttgaatacaatgctacatatgaatgttgaagctgatacattgcacagttctgtagacatcactacaccgatgtagtttctcaaattttagcaatatgctctacataaaatcactacagagatactagtggggaagacgattaacacacctcttacagtaatactgcctgttattggtatagcagtggtatttgcagactgggatcataaggagcccttaaatacttgttattgactggggttatttttatgctgtagcaaatgtgacaggctctttttagcaaaatttttgaaaatttttttggtattactctgaaacaaaatttaagttggagtttcagggatttagggagtagttttcattctacatgaactgaggtaatattatggtaactccaatatttggttaaaaaaactatacaaatcagaatagtactaaaatactgtagaattttagcatttttattttgcactttgtgtggattgaggtgttcagaaataccaaccataaaaatgtaatctagttggcaaaggtgtgcgctaaaacacggaaccgaacatgcattgatttggataacttttgagggtttttgtcaaatagcatgtgaagagttacatttttcttaaaagattggtggtcccaatgtcagagttcttggaacagataactgaatgatagattttttttttttaaagataaaactttacaacctgcacatttgttatgcatactaaatggtgtgttaaaattagggtttctttgcctctctacactacactaatctgcctaaaggtggttgtttcatatttataatgctaattatcatacctacctactttaaattttaggtagaaaattatctgatttaaatacaaacatatttttctcacattgagtaatatgcataatgtagttccaaatgtatttcattactatagtcacaatatccaactaaaaattacgctatctagaattgtaccaaccaaaatctcgtattggcagatcttgacaggctggacctgcaagatgtggcttgaattttaaccatttattacataatctctagtgatcatgcatctagttatcataagaaataatttaaaaggttttgttgctgaaagcagtaagtggtgcagtaaaatacttaagttattcaaagaatgttatctttcttgcaagagtaatttaagcacatgggaaagattctagactttttgtttcttgcaacaacagtgccctctgctgctagaaacctttttctacttactatcatttttattgtggcttgagctcagtcaatctggtgcagatgaggctggacaactactaaccaataaaatcaggagtttgtacaaaagttaaatggaacattataattattttaagtaatgttaattgaaaaaattttttctttttgacaatataaaaaacattttaaatttcctagaaatgtcttcagggtaatgccaatttaagatctctcttaacttgtggccaagaaattctagattttccagctgactttggtataatatatatttatcaggaacttctctcagcagagagt

SEQ ID NO: 15850 - DNA, 14165 bp, Human
tttgagcagtttcttcagcctcaagaatctctggcttgttcaaaacatatctgggtgacactgggaaagttaagacgaggctggaaagaaccaaaggagaggaataatttgacaataataataaaggggaaggaaaaaagagttgatgaaatttcacctaaaatgggattaacttatcttgttgaatcaagttatctatttctggtcaatatatttataaaaaacaatagtttaagaagtttcttagaaaaaaaatcttacacaaaagctcctttcattcgtgaaaatacttgtaaatatttttgctttaggagaaaatatgtgctttcagggatattacgctggtctcttaaaagtttccttaaaattcttagcttggagtcactgttacttgtaactggaggtattagtcagcctttgggttggacttatgaactatgtaccttggaaatgccacacaacctaccaaatgtgatgaggatacgagggcaatcaacttggggcctaccgctcatgtggaaatttgcttttcatttttcatgttaaagaatgattcccacattatgtacagaagtaatttagaacactaaaattatctcagtatcctgaggcttcctgaggctggaggccattttcagtattgtaacaaagtttagtagttttgagtgaggtctgtagagaaatggagactgaggaggtgccttgtgaatgacttagatttgggactccctttggtcctccccctttggtaatgttatggtttgctttcaccaaagttatagtcttgcctttttcaatatttgtccatatttctgaatttttaaaaatatttatgataataatttatattcaaaatctataacaattttaatggtaagaggattgtatctaaattcagttcttaattccattgagataatatatacataaactcacaggaaatgggaattccaaaaggtagattctgaaggcagtgtcttgactgacttctatatctgttatgattctctagagagaaagcatttatcatggaaataaagcgtttgttgtggaaaagaagagctgaggactaagccaagaaatttggctctttttttttttttttcctgtctgatactctcctctccttacctcaaaaatcctaatcttcccataacatcatgttgtataccttaaatatactcagtaaaatttatttgaaaaaaaatttctcaatcatcaactcctcttccttgtacaagaacaagaatcccctgtacaagcatcctggtagataatgtgtggagaggtttatggttatttgtctttcctcactgaagggaagctgagattcaagtttgttctggcaaactattttctaacattaaaattgtatttgtttccactttttatttgagaaacagtatgatagttggatgaaagaaaattagaagatcagaaatacataatggacactcagaaaatacaaatattctttcatatttttgaatatttttaattccttaagcatgcacttacatgtttttgtatacttcaactgtgtgtatttttgtattttatttcactttgtattttaggcaaacttatttacatgttgcatcattatctttgtaactagttctgatatctgcatacattctttcaggatgaaataccgtatttaagcatttcttatcattggtattgcttatcaattgggtattgaatttgctttttattttttttcatttcatagatgctacaatacatagtggtgaatactacacatgtgaatatctacacgtagctacataatttttattacaaaatcattttgaacttatccttagacaagggattcctagttcaaaggatttagctagcatgtgttccagtgataaaacgcctttacaacaggaataagagcttaagtagaattttagatatattcagaattttaagtttctaaatctattttgagagaaaataatcttttttttttttcaaagggatgctaatgactagccaatgctctaggaagacattgagaccagccaacttcttgccttgataactactgaagagacattgggtggctggattttgaaagcagacttctgggtaagtgtcattgtttgggtttgggggatagcaaagacttagcagaagtgctttaagaaggaattatctgcacaatgagcaaggaagacacttaaaaatgcaactttaataggtgtaaattgaatatagagcttaggaatactagtggagagataaggtcaggcattattacctggggttaaattagttaagattttccgggaggataaggttctctattagggtacctatgtatttattttttattttgtaatagtatctttttcattaaaagacatttaaatttaattttattttagattaagggttacatgttcaagtgtgtaacatgaatatattgcataatggtagggtttgggcttctagtgtacccatcacccagattgtgaccaatgtacccaataggtaatttttcaatcctcatccccctcccaacctgctccctttcagagtgcccagtgtctactgcttccatctttatgtccatgagtactcattgtttagttctcatttaaaagtgagaacatgcagtatttttctgtgtctgagttagttcatttaggataatgacctccagctctatccatgttgcttcaaagggcatgattttattatttttttatggctgcatagtattccatagtgtatatataccaaattttctttttccaatccaccaatgaggaacacttaggttgattccatgactttgctcttgtgaatagtgctacaatgaagatttgagtgaagctgtcttttttatataacgatttcttttcctttgagtagatagccaatagtgggattgcgaggatgattggtagttctatttttagtcctttgggaaatctccatgctgttttccctagaggttgtactaatttacatttccaccagaagtgtataagtgtgtccttttttctgcatccatgacaacattttttttgactttttaataatagccattctgactggtgtaagatgatatctcattgcagtttagacttgcatttctctggtagttagtgatgttgagcattttctcatacatttattggcctcttgtatgtcttcttttgaaaaatgcctgttagtgtcctttgcccactttttaattgggttgtttgttttcttcttcaatttcgtttgagttcctcatagattctgggtattaatcctttgtcataggcacaattagcaaacattttgtcccattctgtaggttgtctgtttactctgttgatgatctcttttgctgtgcagatgctttttagtttaataaagtccagtttgttccatttttgtttttgttgcatttgcttttggggtcttagtcataaattagtctgtctaataacttagtctgtctaggcaaatgtcagcttttctctgtaaacaggtaaagttctctattagatacttcaaacaaaaagaagacgttattcttgatgctaacttctaggtctaatcctcaattttgtgccaattctctgttccaaggctttgcattagatttatgctgaggaaaaatatttcattgagtaaaatttcaagcatagaagtgtccattcttttttgaagacttctatgggtagagacgttctcaataggctcattctgccccatgtttttctttttctttttcctttctttcttgagacagagtctcattctgtcaccaaggctgaagtacagtggtgctatctcagctccctgcaacctctgcctcccaggttcaagtgattctcctgcctcaggctcctgagtagctgggattacagaagcctaccaccatgcttggctaatttttgtatttctagtggagatgaggtttcaccacgttggtcaggctggtctcaaactcctgacctcaggtgatccacctgccttggccttccaaagtgctcggattacaggcatgagccatcatgcccagctccccatctttttcttacataaaatgaacacgtggaaatagatttaaatgttaatttcaataaggttagcttactccttccctgagatacagggaaagctaatcctttattccatttccttttccctgtccctgccattcaggcattagtattgatggttggtatttaaaagcaattagtttttccccctaatattattttaggtgaagattatctaggtcctgaataaagaagtttataaatatttaaactacaagaatatttagctactttatatgttctaaacatgagggaaaattcattatcttcaaaacatgagactataatagtccttatgattttattttattctgactatggtgatctctttagagtcatttatttttcagcaatgggaatgactggataatttgctatggtaaggacacatgttcctgggaagaatagtataattcttgttataatttcatatagcagtgtactactaatctaattaaaaagaaagtttccaattccctcctagaatcacagaacatttaactatatcttcttgcaggtaatttttgcaaatactaaatgctgagtatatacataatttaatttcttgacctttgcccagaccattttattgtaccacttttgtggtttaatacagctaaagtatgtgctacaacacttcactttgtcacaatcagaatcacaacacaatcttacttatcaaatgctataaaaagatgaaaatctacatattgcttttcttaagttaggctagaactgatccttttagtagaaaatacaaagtagtaaaatgttttattaactttaggcatgggagtacattattgtaagatgtgatcgagcagcgtaccaaggagcctttcagcttgtttggtagaagtttttggttgattcaataaattcaaccaaactgttgatttactacttctggcagaagtgagtttgctcccctttgaaaaaaaaaaaaaaagtgaaaaaagagaaaaaaagaaagaaagagaaaaatgaaatttcacaattctatgaaaggttgttttagtatatggcagaccgctagaaagtggtctttcaagaagcaagaaacagaatgagaggatcaacttggaatttattttccttcaatgggattttgctaaggcattgcttggtacagcattctgtacaaccagaaaggcaaaaggaaaatagctacattctcctctctgtaggcccagtagtgatttgggaagatgagaaaaatgttaactagtatagagtttgtatcatacatgagaggaaataatttcatagattcaaacacaggagtagatcctccatcttctaaaatgaaattaaaccccctgcacttaaagttgagaacttggtgaagcttacattctttattatgaaatgcatcataacaatgtattctgtatttctttttcagttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagtaagtaaatcagggtatgagggctaggaaatgaaattcacaaaagatgttgattgaaatttaatattatttttgaagggagtgaaatctagcttttaatattagtcaggaatgtgtacacaagtagatcaacattattatatgaatgcaaaacaagaatacgcttaatctttaatgtaatctctttatctcttagtaagccgggagaattaggtagtatagacagtgtatgaactcagtttcttttttttttctttcttaggcctcgtctcttttcaatagaagtgattgaaacaataatagtatcttatttgttttatagtaaggcaatggctgtgtaagagatagaaatagtggggaaatattaaaattattattattgggtcagcatgcttagcttttgcgttgctgtcctatgtatagcactttcatttcatttttatctgctaactctttctgtcacattttccaggatgaacttgtgtatacatttggcgaaactgttgctctgggtgcttctggaattgtaatatggggaaccctcagtataatgcgaagtatggtaagttgaattggtagaaaataggtgaaaatatttctatgtttaatgtttttggggattgttttggtattaaataagaaaataagtagtactatgcttggcatgtagtaataggtgctcaattaatactggctgaatcaaaatacatttgtgtggtggttgtaaggcagaaaatagtatacccattttccagtggggaaatagaaatttagtgaataattgaatttctctaggctacatgactattaagaagcaaaaacaggactacaatctcaattttatggcatggtgttttgtgtcagaagataggtccttgttcctttactcttgtttaattctctatatcagatctttatcccccacctcatcaaccttgttgactcaataggaaagctgttgtatggacattgctgagttgaagctgaattttttcttctctggtggttgtggaaataccaatgatgaacatgccatgaagaatgccagatgaagctcatggcccaagggtcctatctcaggacctcagcgaatagtctatactctagtagtctaagaaagcctttgagaagcattatattcatctcttattctttggatagaatagacatgacatagtctttatttaaaaatactcaacagcagttacatttatgagaattttttaaggtaatctgagcccatctgcctattttgcataactcttttgtctttaatttgatctctaatataaagaaataacaaaaaatataagttcagaagaaggtatatggcccttggtaaagtattttatgtgtcagaaaatcattgtaaaatgataattttctttagtaaattcttaatttttattagttgtttccccaaatccataaactcccttctcaaatgtcctattatttaaaaacttataaatatttataaattctccatactattttcttttctttttaaaaaaactgaaagctccactcttactctgaggaggagtgaatcaggcattcctcaatgaataggttgacatgacatactatttaagtgtcatgcttgttttttaatggcactttaagcttagattcaaattctactactatgtctctcaaatcatcttcagtattatccataccagagacagtccttcaacttttatatgattattttctccttaatggcattgtcccaaaattgttccctatagactctgttgtatatatttctgctatctttctcaacttctgatcattttaaataatagatctatcattacttccccttttttctatgccatttgtaatcaatagtcatggattacatgttatgttttctctgattcattgacaacttaagaaaccgataattgcaagtttacttgcagttactggaactgacataaaacaaatgcaaatgagccatttcttttcgttccattttattatatctggtggtgtgacagagccagccctactgctcccagctgagacctaattgttaaatattcagggattttgtgaaccagttgttaatcactgccattattaaaaattaaatgataaaaacttacaataaaaaattatgttaaaaacaggtgacacatttcaatataccaattattttacctcattttaccatgatccatgctcttgagattatttacatcttttgcatctttataaatggaaatactatgtaataatgtgctacttcacaccatggtaccataatgtgtaatggtggtgtacttgattcccagatctgcattcagtaatgtttgggaggtagcttgaaattggccatggcaggagtatttacactatggatatatatacaaatgataagaaccaggtcttacctattagagagccaattttaatgtatttccatagactacaaagtatgcaggttaatgattctcaagccattctcatccttttactactctttgtgtaacccttgtctctgtggagttgagaaagcaactgcaatgttatttgaacttggtataaattctcatgtcccttatattgggaacatagtgttgaagaatattgacaaagtctatgtactcttggaacttatgagtacttaaaaagtacacaagtaagagacatatttgatatggtaagtgctatacagagaatttaaacagagatatggagagtttaacaaggaagttatcagagaagggcattgtctaatttaaagctgccatcagaatgacaagatgaagtcaattgtgttaaaaattagaggaaagaccattccaagcagtgggaacagtaaatgcagtttgaaatgaacctgccgtgctagtgaaatagctactatatctaaggtagaatggatgtgggaaggttgtacaagaggaagcaagggttatacaatgtcacactgtgcacaagtcaagagaagaagttgaatttcattcaaaacaccattcaaaaatattggattgttacgaagatggatggtgtattagttttctattgctttcataaaaattacaacagacttagtgggttaaaaaaacagaagaaatttgttatcttgtagttctcagatcagaagaagtccaatatgggtttcaatggaataaaatcaaagtgacagcagggctgaattcctttctaggagaagatactttctcatttgggttgttggcagattcactttcttgtgcttatagcaatgagatccccattatctggctggctactggcaaatggctatttccagcttttagaggccagtacattccttagctcatggccctcttctttcttaaagtcagccaaggtgggttgaatctctcttacactttgaatctctccttccttcagtttatctttctaaccctgcttgaaaagtttctatactttcaaggactcatgtaattacattgagtccatcttgataattcaggataatctccccttctgaagatccattccttaatcacatctgcaaagtctcttttgtcacgtaagttcacattgtcacaggttccagggaattaggatgcagacatttttgggtatcagttattctgccaacaatagatggcatcatctcaaggaagatgaaaagaaatatattcagatggaagctgccaagattccttcacatgcctgcatatctaccactgccacttcctttggcctgataaagtattagcacaaccacctcactcaatggaactgttgattatgaaaaaaagtgatcaacttcaatatttctcaaaggacagtgtccagggtttagaacataccagtctcaagatgaagatgaatcattttagttagtcatcgctcatactctgccaaatttgtaaaagagttgtcattatttacccataacttgactatatataacatttaatagaaagtatagtcagttgaacccgtttaatgtattcgagccagcaatttataagccatccttttccatgctatttaaacttgtctggcaggtgaggcatggtggatcatgcctgtaatcccaacactgtggaaggatggggtgggaggattgcttgagcccaagagttcaagaccagcctgggcaacatagtaagacctcacttctaccacaaaagaaaaccaaaattagacagatctcgtggcatgtgcctatagttccagctactcagggggccaaggcaggaggattgcttgaacccaggagatcaaaggtgcagtgagccaagactgcaccactgtactccagcctgggcaacagagtaagactttgtctcaggaaaaaaaaaaaaattgtctgacaaatgtggtgcttcttacatttatttataatttattgagggtcaactgaagatatggtaggcccctgtgttaagcacatttatatgtatttttcttttttatctatttttataacaactttatgaggtaggcatcataattatccttattttccagatggtaaagctgaagcataatcaagttaatcaatttgcccaaagtcacccagataggaaactaagacttagaaagcttaagaaattcccaagttcctacagctagtcaccaatggaactgggactccaatcagggcaaatgtcctagagaacatactctaacacactttaacagctgtagcattctatcccctgattatgttatgaattacagaggacgagcaagggtaaggaatactaagcctcaattagtcaattattcagtggaatgaagtggcatgtgaaacttataagtcttacaaaaagcagttggaataatcttgttggttaaggtaaaaaagaaattatcttctacttcttgctatctctggttttcattcttctgtaaaaaaattgcttaatacactaaattaattcgcatttgaactaacttgtcctttgatattctgactgtcttataataattttacagaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcattgttagtattttgtttcttatcatttcttctgtagcgagtttgtaattgcgcaggttagctgaaatgaacaatatgtccatcttaaagtgtgctttttcgactaattaaatctttgaaaagaacagctcttgttgaaagatcatttttggaaagttctttctgaataactatacctaggaaatgacgattttctttgaacttgacaaacactgctatattgtatgaattctcaaccatgagttcagggatttgtattccaggagtcaatagcttatgtaaattctgcagtttagagtacagaaactcatattatctgtttcacttgcaaaactgccaggattgttttaacactatcattctgcacaagatactgacattttgataaaataaaacttgatatagaatgtttaagaactcgaaagtgaaaaccctttcaatacaagccatcagtaacatgtagagtgcttggatatttctatttctcctctgctcagaatcaagagagagagggagaaggaaaaagtttgggtggaaaagaagaaaacaaaaggagggaagagataagggaaaagaattagtattttttgctttctctggtgccactgaagactctaatttgcacaggatcgaaaggaatactttcagtgtatacaattaaccttcgactctcttttaaagcgcagagcagttgtacctaaattccttacctagtctgacctgtacaaatattactaccgcctccttcctttccccatacccccctagaaacaaaaagagatgaaaccacatattccaaatccattcggctaggtactctcaaattatggcacaagtcattaggatcttaatttttttgcggcattacattttccgtgaaaaaaaaggaaaatgttttacttgttacagatctcatttctttatgtttaagctttgtttaatatctgaaatgagactgagctctaaaaagcaataaaaataattcaaattattattatgcattttttaaaaattaaaaaaattattatacatttttaaggttgaagtttttaaaattgaaccacttgtatagtcttttacattatgttatcttaaaatcttttttatttttttctcttttaattttagttgacatgtactaattgtacatatttatggggtagagagtaatattttgatacatgcatacaatgtgtaatgatcatggtaataaggataaccagtacctcaaacatttctttgtgttgggaacatgtaagattctctcttctagctttttgaacatatgcaatgttattgctaattatagtcaccccccagtgctatagaacactaggatttattcctcccctttagctgtattgtacccattatctggcctctccctatccttctctcctcccatccttcctactctctaataatcataacaataattcctctctctgtgatttcaatttttttagctctcacatatgagtgagaacatgagatgcttgtctttctgtgcttgccttatttcccataagataatggcctctagttccatccatgttgttgcaacaaacaaaatgactccatttttcttatgactgagtagtattccgttgtgtatatacaccacatttttttaatccattcatctgttgatggacatttagactgactccataccttggccattgtgaatagtgctgcaataaacacgggatgcagatatctctttgatatatactgatttttttcctttgctgtatcctatatgtattgctgtatcctatgtgtattagtccattttcacgctgctgattaagacatatccaagactaggtaatttataaaggaaaagaagtttaatggattcttagttccgcatggctggggaggtctcacaatcatggtgaaaggcgaaagccacttcttacatggtagcagcaagagacaatgagagacaagggaaaggggaaaccccttatgaaatcatcagatcttgagagacttattcactaccacgagaacagtacgggggaaatctgtcaccgtgattcaattatctcccactggatccctcccacaacacgtgggaattatgggagctacaaatcaagatgagatttgagtgggctc

SEQ ID NO: 15851 - DNA, 205044 bp, Human
  misc_feature (1)...(205044): n = A,T,C or G
acaaggaggccaggtcatctttttctttctttcctggggacagaagaatgagaaaatggattagaggctcaggctaatgacttcaaaatttgtacccaggacccatgcctttctcctaaactacacttatttattcaattagatactggacattttgacatcgctgtgtaatagcttatcaaactgaacacgagcacaatagaaataattatttcatgcttcaactccctacacacacacacacacacacacacacacacacacacacgtgcacacacacacataccctttcttctaccacagttgtccccacccgctacccgcctcctgtcttctcaggaaacggggaactacactccactcacagttgactcctcttttcctctcacaccaggcatccaacctgactgaaaattctgcaacttctccctttaatttatacccagaattcaaacactcatcctacctccagcactaccttcccggttcaagccagtgccatcttttgcatagatgttgacataagctcctagcttacgtcatagatgttgacataagcttctctgcttcctgcctacaccctggccctccagagggtattccgaacatagcagccaggtggatgtctttaaaatattagtcaaattatgtcatgcctcagcctcagagttctgcagtggttctggtatcttccagaataacacccagggttctgaaagcagctgtcagggaactacatattctagatcctcacaaactctccaacttcaccttctgtttttttccctccttgttctctctgcctccgccccactgccccccttgttgtaccctgaacagccaaccacatcagcacactggggctctggccccttatagtattctctgcttgtctggaatgcttattcccccagggatccatgtgacttgcatttctaatctccttcagacatttgcttaaagacacctgctttgtaaggcattctgtaatcacctctttaaaattgaaatctccaccttctttggactctccctcttccctgttgattattttcttcctcacttagcaccattggaaatcctagacattctaacctctcggtattgactgttacagtgctgtggatgaaggcggagaagtttgttcattcactgctgtatccccagcgcctcgatagagtctggaatgtagtaggctctcaataaatgttgcattatttaattaataattgagcaaacctatttgacttgatctgagtttatattacaaataatgtaagatcaaaagtgtagggctgccacaaagaagaccttgaaaatggtctgatggagtttggaatttatttgcaggctggggaaaccattaaaggaaattgagcaaaacggtaccaggaagaaatgacatcagggacacaagaaatcatgctttaagaataagaataatgataaagggaaaatgtgattgtttaacattagtcttcttctagctcattgatattgtgtgggctgccaatattatgaggtggaatgctgggccgattttcaaaataaatataaaaccttgttgaattttaaatagaggcatgacaatatattgctttataagattgatagcgatgtattaaaagtgttcatcatttaatacataaatatgttcctcaaaatgtatatgaaataagattgttaaaatacagttggtagaagcgatcttataaaatacaaaactttggaaaatctattttctgaagacaaaaaagcaaaaagtaaacacacttatatgtcttgccagttgaatttggtagactttttctgcattgaaccatattcgtcctcccctatcaaccccgtggccctctccctccccctacacacacacacacacacacacatgcattattttactgaaactggttaagcaagaaatcccatgcactgtagctcctaaccctttggctgaaatttgcagtcagtttgaaagctcaatctgctttttgggttttgcagtacaaccggtaccagcagtatggtgcagaggagtgtgtcctgcagatggggggcgtgttatgcccccgccctggctgtggagcggggctgctgccggagcctgaccagaggaaagtcacctgcgaagggggcaatggcctgggctgtggggtgagtactgcccacacccctggagcggtgtgttcctgtccttgtttgcttttgcacatgggctgggattatatttttattttattttcattttccctttggacttagacatctttgaacttacatataagaaaatagattttaaattcctttataggactccagatttgaaaatttatgtatttattttggtgaaaacagttatatgaagattttctgctttggttgcttatggaagtatttactttaagatgctgtgagccactaggccagacttttaaacttttctcccagcactcagctgatgcagagcaaaaatttattctttcttcagagttgcctttaagtagacaggagtgaaggagaaagaattctccatcagtgacgtcttagtgacattgtttgcctgagtatttcaagaaataaaatgaaggttaatgtggaaaacttgaaatgttattatgtcataaaaatcattttaagtagagatgaacaaaactaatggtgtctcttatggaagcagaataagaaatgtggaaaatgtttgttctaagaggtcaaaccatgtgacctggccggcttttcaaatgaatctatggctgcaagctgatggctcaaggggggaagaagcataactcaaacacaaaaaggcttactaaattataggttaaaatgacaaatggataataatcctgatattaaatttcatgcagcctggaaaagtgagaaagtgtatgtgcatataaaagtctattgaattttgatgagaaacatttcttttaaaattgcaacttcatgaggagttttgtgcaagaaggagcacagatagcagagttgtattagccagtcttgatttggggctgagcactgtaagtcatctagaaataaattagcattggttccccttagtaaagcttcctgtatgtcatgcagtggggctcataaaatcctgggttgagcaatggagtagaggaagtggaagttgaaaaataatgagataccatggtgcctaagtggaaagaaatacctctggattcataatcgtgattgcattagaatgaaaactcaagtgtttactctccctggagacgatggaaatcaggacacactctccagccttagtcattatcatgtgctgaattatctgcaatgattgtgtgtggcctcagcaggttgccaacctctgggatcagaatgctagcaaatgttgtcttttaaaatgagcttttaatgaattgtttttaactactggctaaattatgtgcttctgcctgctaattgcctactgtggttccatcctctaaagctggattttaagattttaacttttcttaggaggtagagacttttgctggcccatcttttgcatttggttgttgaccttgctttaagaatgttgaagggtttatgtaatgtgaaatcttgaatatctttatcttcccttttttatacaagtaaattataagtaaataacatacatacttaagctgcaaatcatgacaaattattttagaagtgaatcaaaatgctgtaatgtctttggattaaaagagtctgcaggcaactttacttaaaggaggatagttatgttctcaaggtttctttgtcctttggcaattgtaggtagcgtattcttaatttatcttaatttgtttcgatttgttggttttggaggtgtgtttgttggtttgtgtattagttatctatgactgcatagcaactccaaattctaacaatttaacatgatagaaatgtatcatctcacagtttctgagagtcaggaatcacccgtgagtggctttgctgggtagttctggctcagggttcctcctgagtttgcagtttagcagggtcacagttatctggaggcttaactggggctggaagatctacttccaaggtagctcattcacatgactgttggcaaaaaaagtcctcagttcctcactggctgttgtcagaaggccacagttcctcaccacatggcccttgtcttaggctgtttgtccccatgatggcagctggctttccccagagcaagttgtccaaaagagagaacagagagaagctacagtgccttgtaggaccaaatccccaaagctgcacctgtcactctcactttattcattagaagtgagatactagatccagctcactctcaaagggaagggagttgggctccatcttaaagagtgtcaaagaatttatgaacgtattttaaaccaccacagtttgcaatttgaagaagctgaaaaaagaacagagaagtgattttctaaaggatgcactgaactgtatgccttcctttccctccctgtctttttgccccagtctccatacacttttgcaagcttatgtccattcccattgctttggcttctcagcagagataaattgatttcatcattgccctttgtcttcaaatcccaaactttcacagaaggatattcacctaacttgaatgctaaaggaattccacagtgatttaaaaagggtggcgttgaatgtgtgaagttcaaaccctggcttcacaaactacttgtggttttcatctttctcggtttccttatctctaaaatagggtatatatgagcaactctgtataaaactattgtgcatactaaatgagataataagtgtaaaatacttagaatagttcctggcacagagttaagtgcagatttatttaatatttaatcaaaagcttaatgaatatttatccaaagctcacccaaaaacccaacattcaaggaagattgcttacatggcattcattggatatactcttccaaatagtctagaatccaggatgtagtcagatctacggcaggaaactgggcacctagaccttactatttttagcctttcaaataattgcttttcctaaatactactttgccaccatgccatttgtttatattgtgatcgttacacaggaaatgtgatgcctgtggttcaggacatcccaacagacttttccacaaggaaccatggtgactattcaagtctgatctgagtaccaggcacatttatgcttgtcctgaggaaagttgcctttaaggatgttaaaccagctgataaggttttcctctgacagttgactgctagaaaatctaaagctacatctgtgggctccctatagcatatatagaggtcataaacacagtggatttggaaactggtttcctggctttacttgtttccttctttctcttccccttttcctgatacatgttgttttgctgtggtttgtataaccttgtaagctgcccatcttttctgggtttaaggagtgtaatggaaagccattgtctggaagaaattgtggttagattatgtcatttcagaagtagaacatggccaaatacataaaagttagaagaaggtgaatctctttttactctttgctctcacagtatggacaacgaagaacaaaataagctgcctcagggagaagtgagtgcctcattcaatacatcgttcaaggaaaagtcattggtagcaaagctatagaagaattacagagttccagatgtggaaaaagccctagacgtcattaactccagtgattatcaggatgtggttcacagatttattgtaagatgcctgtgaattcacccgtgcttaatttttttttccctcaattatcaagatagaaaaagtacaactcttaccatgtgggtatgcaagaaatgttagctgttacaaaaaaaatcgcgtataaaaaagttgaaaaccaaattctctgtcatttgtgggatttaaaattgttcggagctagacacccatgtgttgagctctgggctccagaggattctaatcttctagtcatttcacccacgaccatgtgcctgggtggtcttccgcacagctgtggtttctgttgtatatcctttccatttgaaggcttctgtgtctttagttcagcttctgtaaaataggtgctatagttagtatttatgactcttttgttcaaacatatgggaatgtccattggaaaatcagattccagacactttgctccactgtgtcacaggcttatctgttccccgaggagcaatgtaccttaactaataaatgaagacagggatttccatttaagtgatgatgtcagtccacctaggaaaggcctgataaatgtggggtggatccagtaaatttattaccattataaagaattatttgaaagtactacctcccagaattcaagctgcagtgttacagtggtttcctgtctttatattcctgtcctaagccttttcattcttcttggtgaatcatgtatttggtgtttaacattcatcaaatgtatgaatgaatgaatgaatgaatgaatgaataaaataaatggttgagtgaatcttaataatctaggagtaatatcaacaaactattacttttattttccaatattaatcatcatttatcccagtattagaactgcttaccttgccccaacaaagagctctttgaaaaatacgtaagcacctttatatacttatacaatatacagtgttttaatagcacacatagtatataattcagaaaaccaaaataacactatgttcagggatccacaaaaagtccattagaaacctgaaagtactgcagaatttacagaattggtgtgctctatcaaaggctacatacacggccaagtaaagagtacattctgatatgtaaaatgtcttactcttgggagaactgagatttcagttttgactcagcacagaatatttttacatagatagaacgcagcagagaatgtattttggtaccaaatactagtctagcctcactctgctaaccctagatcctatttttactactgctcataaaaaaattaattgatttcctaaagaattcatgttatgcattattctttttttctggccttattgctattcatcagaactatctcacaaactttaatgactccgatgcaaaatgctgacgtgtttagtgctggaaaacagcaacaaaatatggaatacattatactcactgacctgggaatgcagaaagctatggcaatcaaaccttctgagttctctataaataaaacatctttatcttatttgatattatcttggggtattacatgtctgggtgataatttattaaaataatgatttgaagttggataaggaattttctgtttttaattagaaatccagaaacaaaatgtggcaactgcagaaaaatacacatttaaatgaaaatcgaatttcaaaaatcatattagtgaccataagttaaggaaatgcgatagaatttcttaaggcatctaacagtcactctgtccttaaacaaacaccatgctgtgtcgctcggaggcaggtttgtcagggaactaatgaggcattcaccttgggctcctcacttgcatggaccctttccaaatcctcttaaccatgttcatcttcttgcattggttttcttaaaaagggtttcgaaaattataaaaatgaagttgtaaagcctccctcaaatgtggttttagacctgtgcaaatacaggatatgacctacttcgtgcaaagaaacgtgtatatgtttttggtgaaaatggttattttgaacgacttatcacaacagcattaaaatactgttggaggttttagtgaaatgagagtctgaacctcattttcagcctttaacgtaggaaaggagtcaatgaagataaattatgatgatacctacccttttactcaaagatttaactaattattgagtttaaaatccaaattaacaaatagatgtgaagctcttttttcaataggtggaccttggaaagagaaaacatgtagatgatcaatatttaataataaaaggaaaaaagaaaatggttacttttcttattcaagccaattttaatttatttttgtaaaaatatgtaatttcattaaattatgcttagatattttttaaaccatattgagtttttttaagactagagattaaaatctagtctccaaatatatgatgttttcagggagacatcagaaagaacaggtgtttctcaggatgactaactgtgggttcatgagccttcactccagctgtccccatgtaagtttgcctcaaccgcctggacactccagcacatagagactggaatcaaatcttgttggtactttaggctttgatatacaagatgttcttcatcaaagagcattttaaaaaagaaagttggtgttatgaaatgtcaaaaatatgcagtccatgtttatttgacatgtgtccaaaaatctaatttaaactctaagatcagctcatttgcagattggaaataagcctcgctagactttctgcctgtgagacagcttgaagtgcaaagatggaaagctttggagagtatttattttagttaaagaaactgttcacaaatgtacaaacaagttctgcataccattcatctggaaagcatctatcagttggcagacattcctagaaagtgttccgtgattttgaggtacagctgatctttgatgagctacggggagttgaggggtgccaacccctcctgcaactgaaagtcggcagatagcttaaacttaactacaatgatccactgttgacgggaagccttgtcaataatataaatggctaatgagcaggtattttgtatgtcacatgtattatatactatattcttatgataaagtaagctagagaaaagaaaacattattaagaaaatcataaggaagagaaaatgtattttctgtttactaaatggaagtagatcgccataaaggccttcaccctcatcatcttcatgttgagtaggctgaggaggaagaggaggggttggtcttgctgttaccgaggtggcagaggaggaagaaaatctacatacaagtggacttacgttctaatacatgttgttcaagggtcagctgcacatagaaaagtatattttttaacccaacacagaccactagctattcttattgtctttagccagtttttgttgaaataaaggtaaatatgaaataattatactgttttttttttttctttttgagacggagtctcgctctgtcacccaggctggagtgcagtggcatgatctcggctcactgtcacctccgccttcaaggttcaaacgattctcctgcctcagcctcctgagtagctgggattacaggcacgtgccactacgcccagctaatttttgtaaatttagtagagacgggattgcaccatgttggtcaggctggtctcgaactcctgacctcaggcgatccaccctcctcagcctcccaaagtgctggaattataggcgtgagccaccgcacctgaccaataattatactctttcaaaatcgtaagatccatctttttgaataatgtgttagaaaatcagttttatggcaaatcgattggagaaacttctttagctttataagctgcagagagctcagaacagtcctgaaaacagacttcttgtgaagattgcattgtttctgtgtggagagcattgtttctgtgcatttattttggtcgtgctctgacctctgtctggggctgtgtgtctgacatggcagcctttagccacatatggctatttaaaagtaaatataattaaaaagtcagttcctcaatcacagtaaccacattccaagcactcagtggccatacatggcaagtggctactgtattgaacagtgcagatatagcccattttcatcactgcagaaagttctactggacagttccagtctggaaaaggacagggacgtctgtccaaggagtaacatttgcaaactcaggtttcctgtgttttcaacacaagcactttgagctattcagctgtagttgagggaaaaaaagaaaaaaactttccagaaataaagcaatttcttgactacaaaaatatagagcagcattttccagagtacgggtcatgcaatccaggttccaacagatgctgccaggagcagggcaggagttggggtacagagaggtggagcagagagctgcaatccaagagttggaggcaccaggtaagccagattaaaccaatttctttcctataggacttaaaactttcactatgcaaagatgtattgcttgaacaagcagaacagcacactcagcatttcctaaactctgtagagcaagaactaccttttgtgtggtacattttgtaagacaggtgttttatgaagcaacttgggattcagatggcttgctttatttttttaatccgtagtgctgagttgcatactgctagtcacaatgagcaagtgatacccaaaaatcagagccattaggcccacaatagttcatttctgtagagaactaatgaaagtatgactttttaaattatatggtttatttgcctcaaatgtatttttgagactacaatttatttttacagtaaaatctttttctttctaacactgccattgatatatatttttatgggtttaagatcaattagagaagatgggatgaaattttgtgatcgtgtatgcttagtaactcttcttccaagggttaattaaatgaatatgagagattttaaaatttcatagaataacttatataatgataaataaaatattttcatagggcgagtgtcaccatgtgtcaatctcaaaaacattaactgcatggggcattatgataataacaacaaaaatgacatgtagattgtgtttttgttttccatgtcagaagaagtgcttctgcaaacagtgagaacaatcctaaggatgtagtgcttgggtccagtccagctggggcagacctggcggccccccaccagacaggcagcttgcatctccccaacccccagcattctgaatggtgatcttcccctttccagcactattttgtaatagataaaaatatggaaacgatccacttttccatagtattatagcagttaagtatgttcttgacataattatacagtggaatacaatactctgttatgaagagtaaggtcaatccgtgtcctgatacggaatcacttttaatacacagaatgaagtaaagacagcatgaaaaggggatccatgcacatgagcatataagatattttctggaaagaatcaaagacaccccgggaacagtggctgcctttgggtagaggaagtgatgatgtgagggaggaagcttttacttttcagtttataaccttctagaatgtttgaggtttctgaacatgtagttgatggttacttagggactgagtttatgaattactttttttcttaattaaacttagtaatgttacatgttaaaaataaaagcaatgtgaccaataattatattaggtagaattttacacctttttaggcaaagtgtttctttgaggttaaacttagggagaaggaaatatgcttttcactggcagagaccgagggcacagaaaccaactccgtgaaggctcgctgctgttccagaaagagccaggcatgcaggtggtggtccggctggccactcttaaacctggaatgcgtcaggagcaactctcctgtcatacccatgtagctgaatgtcattttttaatgagaatgaagtccactgggaaatttaatttaccttcgcaaaatagggtctctgaaacatgtcaccaaatgtattgagcagccaatgcaaatcagtgatgttttaattaaattacacaaaatgtttaaatagtttaaatagttcttacgttataggaaaacgtatcccaatgcaactttgcacatatctgtattctagcaatcaacttcctacaggggattttagtgttgtttttgttcagctagtgccccttgggggtaagggcagagattgtctagcacatgccaagaacatcgcatgttagcctcatggcatgatgaagaagcagcacgccctcactcttcacacgaaacaggaacaccaaggtcagcgctaagtacctgctgttattcctgttgttcatgacatttaggcagagttcaagggagcccacacagaatgagcactcaggactagagtgacaggcatttctctcgcttgtccaacattccactgggaaaggctaagtcgatcagttattcaatcaaatctctctacaagctcctgggaggtaatagggcttttcttgggtaaagaccagccagtcccatgggcactggtctccaaggatctgcaacagatgtagaaatcacatttcctgagattccaagaaatgcagccatttttcctccttctccgcttggcatctcagtgggccccagggttctaccagttgaagtcctcaaagactcactttggcctctttttgcaccaagaagtggaaacttgaagtgtcccctaggcaaatctgatctgtcctggcttgacctttagtcccacctcccctaagatttggaggtccttaggaggtacacctggcagagctatccaagcctaccatacaggcctttgtccccactgtccattaagaagttgaggttgtggatagagactaagaaggagatttcttaaagtccaatttatttaagaatttttttcaaggagaagaaaaatatcaagtaactacaaggccatgggtaaggcccaggtcaaatgtataacccttgcctgtctgtttgcccattcttgaaccaggatcagaagaagtgtacaagtgagaaggaacccagtcagaagcagataagcctcactcttgcactctaggaggtaatttgtcaagcgggcctattgctgcacttccaaaaagcaattttcttcctcctttctgtagaagaaggccaagaatgcctgtttctttatccaatcaaagttgcctgttactctccttcagacagaaataatattgttcctgacacacatcacatttttcttcacaaagccgtgttggttattgaccagagttcagggacagtctgggaatttgatgccaagcgattttttcccaattcctctcaaggtattagtgctaaactggcagggctgtaatttggaggaagtctgtgttcactcttcctgtggccgcctccccatgtagacaaacccagtccacttgcagaatgtgacatatgcctaaagaattcttacacacattatcaaatgcaagcttttgattgtgtcctaagaatttgaggccgggcgcagtggctcacgcctgtaatcccagcactttgggaggctaaggcgggcggatcacgaggtcaggagatcgagaccatccaggctaacatggtgaaaccccgtctctactaaaaacacaaaaaattagccgagcatggtggcgggtgcctgtagtcccagctactccggaggctgaggcaggagaatggtgtgaacctgggaggcagagcttgcagtgagccgagatcacgccactaaactccagcctgggcgacagagcaagaatccatctcaaaaaaaaaagaaaaaagaaaagaaaaaaaaaagaacttgaagcattgttctttatttgtacaagcctgcattttgacttgccctgattatctgaaggaaatagaagagatagtccagtcaacttatgttagtcatttgcatcagaaataagatgaaattttatttgctagatttttaaagaatgtagagcttggaatggatgtgtcctgaaagagaaatttcccagtgattaatcaaccttgtttagaccattcatttaaatggttttacatgtaaataggaagtacgtagaaaagctatgtgttcagaagatagctgctatttggaaagaaagaaatctaaatcaaagtaggcttctcaaaaactcttttatgtgaagacatggctgggctttgtataagcagtattgtattgttgtaaagttcagaagatgcttaatcaataagaaaagttgaagtagaaagataggattaaagagataagatctttgttagactaaatctattgacccagaacttcctgtaatgggatggatgggaactgcttcacattgttaatgtaacagaggttttcgatctcaaaattgctgtttggaggctatgtcactgtgtctatttttagtttcttggtctaaagaaaccaaagattgtttttgcaagacctcagaaaagcacagaacttcccttgtaaacatgatttagataaaacacttactgggtatgcttttaatattctgagcatcacattaaacgtcactgatgtataatcagaaatctgcagggacacaaactacctcagaatgtgaataaaatagccagcatgaaaccgactctataggctatgcaccttccctgtacaaacagaactgcttgctgatagagcatgacccccagcacctggctggcagctggcaggggtaagtttctatcaggtcatggttagaatctctgtgtgcacagcagacagactgtacactaaaatgtcggtttccctcctgacggccatctccccctttctcttgctaacagaacagattttttttttttttcaagtgtggaccagtttgggaaatgacctcattttccgggtcagtagtgagttctgagtagtctaaaccagtcttgctaatcccttgacccttactagtgatcaggtttcagaagatccaggcccttctagagttcattgccctactgagttcatcagctctgaagccactccatggttggactgcctgtcatgggatatgatacatttcctttctatttaagccagttaaattggggctttctgtttctccaatcaaaatctcttaatgggcacacaggcatttatttctcttaataatgaccaaaggaattcatttactaaggactttgggcagatattggggaaaaaaaagaagtatttgatgagagcgttttagtagcaaacaaaatcacctccagattattatattccataatatggttgtgtccactgtaactgtaatcagcaataaaaaaaaaaaaaatctttttgttcctctctggctaaatggattgtagtaggctccattatattattctgacgttagttccgtggtgtgtggccagttcctaagactgcagtggcttaaggggatgggagtttatttctctctctcataaaatgtctggagctgggatgctccactccaccaagcctttagttgccctcatctacatggtgcaaggtggctcagccccaggtccacttttcaaccagaaacaaaggggaaagagaagaggacattcccagtctctttaaaggtcaaatctggaagtagcacacaacatcgtactcgtactccgacagagaaaagttacttgtgaggctacatggccagcccccaaagcagttgggaaatatctgtattcggggtgcgatgtgcccagctagaaactgttcctatgaagaaaagggcaaatggatgatgagcggacaaatgtcagcctctgcctcatctggtgtcttttctgtctccttttatcattactcaaataccattcacttgtgtgcagtctcagagtttcatattttcatgcaggaaaagaaaaaagtcttctggcatgaaactacttcttttttatttctaacagaattgagtatttccttggttatctttttttgtaacaatatatatttttcactttccgtattcccaggcatgagaaattagacctctaactctcaataatacccgtaaaattgtattcgccccttctattaaaaggtgttgccacaataaccttctgaagttgtgcagataaatagagtttgcattcagtagtgccataaactgaaagcagaggtacaattctagaaaattctctagttcgattgacatttacacctgctgattattttgttctcatgtcacatacaaaggcactactaaaccatgtagaaccacatgtaccacagactaaagcttttggagttacaaattgaatgtggtatttcacgtagcacttgaagtaatatcagcttctgatttacatttctaacagaagtcctaggagttttagcttttattcttctaccgcaatcactagaaatcacgctgtttttagcaactaagctgtactcataagaaacatgcaccaagggggaaaattcagtatattctttcttatatttaaaataaatcagtaatacttgtaggggaaaattgtttattctacatgcatgaattggttatccagcatgtatgtggctctctgctagatgctacaggcacacagaggtgatgtcacagccactgtgctgaagaaacacgtcatctaatgggaagacaagacatgtctatgcgaaacagcatagccgcatggcaacacgtaactgtgcaggggaatgtcccacagaaatccaggatacttaagggccttcgtacccagtttccgcatcaccttgaacacatctcatagtcacgtgtatcacattgctcgtgtgcataccacttgcccacacgtggagctgctgtggggccgctggtggggtgagcaggagctgccttctattcatttttgtatcctcagcaacgacgcctgcattcagcacactcatcgttgtatcaatcatgaatgatgcagtgagaaaggaaaaggtttggaatcaagaatggggagcttcattaagcgcactgagggatggagaaatttgacctggaagtggtgactgaaatatttcaggcagaagattctggaacagagtgaagggacagaaagctaggcagctgcagagaacacggccagggaggaatgattagccgacggagaggagtcgtgggctcatggtgcctgatcaagagcaggacagggaaagggagtctggccctgtgggttaaggattcagtacttcatcctgcagacaatggaggccaggcaagggcttccaggggaagtgacatgatcagatcttttggaaaaagtaatctagtgtgagggcgaggaggacaggtggaaagggggttcactgaagtcacagagaccactgtgacggcgagtgtcgtgtgaatatacagccttcctaccttataaaacaggaatcgctgtttatcttttctcttcctactagtgaagcagcatcgtagtctagggtaaatccccagggttccttatctcacgccaagaaaattaagtacacagacacgtgggtgggttaaggagtggaaagtttaacaggcggaagaaaggagagaggagggcagctccttgcaagagagagagatgtctgaaaaaaagggttaaggtggcagatcccagcagattttataggcaggcttgaggaggcagtgtctgatttacgtagggctcacagattggtttgaccaggtgtgacgtttacttagcacgcgaagaaggctggtcgccccaccctaatcttattatgcaaatgggctttccacttggtggggctatcttgtctgctccttactggacacgtggctggcaaaaagagaagatggagccgccattttgaacatggctagtcccaggtagtatattcctacgggcacaactgccagcatgtacctgtgcaagcttccagcatgcttgtttgtgtctgcaggtcgattttacaggctgctctttgttggaaaagaaaatgatttgggggctgcttttcattaagaagaaaaccttactgaggacttccataccctcactgcccaagtaatttctttacaactcctgtatcactagtttttcagaaattattttaagaattttagttttgtaatatcatatgcatttaagactaatacctcagggatgtggaagatttagatcattcttttattttagagattatttagaaattgaattcataaccactctctgtataatgtttaatagctaatatggtacactatagaatatttatactcacccatctttattatgctgcataatttgctgccttttttaaatctaaaaatatgagtttaatatttacaagtctgaaatagcaaattttccttactgtttcctcagcatccaccatggtatccaacatacatataattgtataagagggtttcatattgaaaagtcccgcaagtgacaagatttgtagatttataagaggctttctaccagtatttgagaagtggtggcaggtataaggggtggacagtgacagccacccttcttgactcagatatcccagcatccacgtgcatgcaccagtgaacatgaaaaagtgaaagacaggaaagaccttctgaccatgacattccagccatattaccacgtgggcgtctctcccgtctcgtaacccatgatttctatttagcaaggatgttttttcctcaactcatttattcaaaaatacaaacaaaagcaagtaaaaaaaccccacaaagctaatttataacaaccctagatattttcaatgtctctagaacatttaacattagtacactgggaatcacagcctactctggaagagatagagtatggagtaaactcctgagtagggagctgggtccagactcagacacacacactcacacacacacactacatacatacacccacactcatacacacacagccatatacacactcctgcttcacaaactagatccagaaataaatttaccattttaccaatgaaaaagttatttttttgcttaagtgaaccctaaaacttgcgaattttaattttaatccagttagttttacacaaatcccagtctctaggcaaatttttctgcaagaagcatcttgtacttatagacacatagatagattatatatatatatatatagagagagagagagagagagagtgcaagacagagataggatggatagattgattgatttttaatagaactaatcatagtgaaaattttaaattgaaattagttttttgtttcagggaagggtaggatggtgaagatttgcaaatttttaccccaaactccttctttattaaatgcttttggcatctatctaatttccttgtagtgcctgtatctctggtatttgcaaagactttttctatgtatccctaaaagtgggatccattgtaacagttccaaaacattcctcaaagctgttcttttataatctaatccttctcatccctgagcacctccatttcccaagcctggataatagacgcaggtaatccacccgcatgtctgatattcaggtttacaattcccttgctggtaagactgacatgatttttttcagagcaccctgactctttccaaggaataggtgccctagagcagcagggacagtgctcctaaatatcccctacacgtttgcagcgtatatatctatgtccactcacacgtacaagccccctaaagagaaaatcttctcctttgagcctattttggattctgcccaggttcctttctttgggatggtcttactgggccacctaccttgggacacttttaactcatttagttgacttcttccaacactgggtcattaaaatgtgggagtgcatcagtttcctcagcaatgttgctgtgttgctgggcgagggtagggggtggcgttcgcacaattaatttttttttttttttttgagacggagtctcgctctgtcatccaggctggagtgcagtggcatgatctcggctcactgcaagctctgcctcccgggttcacgccattctcctccctcagcctcccgagtagctgggactacaggcgcccgccaccatacccggctaattttttgtatttttagtagagacggggtttcaccatgttagccaggatggtctcgatctcctgacctcgtgatctgcccgcctcagcctcccaaaatgctgggattacaggcgtgagccaccgcgcccggccttgcacaattattattaaggctgggcaaatgatggaacttacggaacttgcattcaggtaaaataaacattattatcagatggtggagtgctatgttctgtttgaagcaataaaatatcccgtaggtagttgaaaatatgaaactgaaatttgatgtgttaggattttggtaaagatttgaattatcattagaaagaaattgttgaagctctctaaaaattggtctgttctctgaagtagagcagcatgacagcctttttctcttaaaagaagcaagccttgggccaggtgtggtggctcacgcctgtaatcccagcactttgggaggccaagacgggcggatcacctgaggtcaggagttcgagactagcctgaccaacatagagaaaccccgtctccactaaaaatagaaaaaaattagccaggcgtggtggtaaatgcctgtaatcccagctacttgggaggctaggcaggagaagcgcttgaacctgggaggtggaggttgcggtgagccgagatcatgccattgcactccagcctgggcaacaagagtgaaactccatctcaaaaaaaaaaaagaaaaaaagaaaaaaagaagcaagccgtataggtcttcttcgacacggaatgaggctgctccaattcctgctggtctccagagcagttaagaaaatggaaagggcaatttcttctaaaagtatgatttttcaaaccagggtacctgatatggaagatgatatgcaatgtcacaggagaaggtgcatttccctagacactgggacaggtctgggtggggaatgatacttttatattgaaccaaacacgtgaatcttcaaaaaatgtctaaatttacaacccttcctttggactatgacctccagacaatccaagtagtttttgttctctttgttctctttcctgtgctgtccaggaacacctgtgagggagagtttgagaagtgtccatttaagtgatggcaagaagcccgtgtgcacagccacggcccagtgaaaaaactgttggctaaaacatcagagtggtgtgaaatgaatgagggttttttttttaaatgcttcttaagtaaaatgcttttgctgctctgttgtttttataacatgctcaataagtttcactactctacaaagtagattaatgttcctgtgttattttattatatatgccgtggaaaaggaactggtccctcaaggattgacattaatttgtgtcaagtggtatttttcttcatcatcaaaatgtaagcaattaaatctccacttctcaaatgtgagaaatatatgaaagaatgtgtaacccatgaaaaattttccagccagagacaaaaatcagttgtaccaataatgtttataaatcttttttgatttcaaaactatttttgtgtcttattttgcagaagacaacttatatgtaggacagcttcttccaaaacagcctcacttaaactgagttgccgtaatcctatgagtagactatacttcgtccaaatatggaggtttagatgttttattactggaactgaaactgtgtgagtttgaagagaaaccagccatttctctgtcccattgctgtgagatcataagtaagccatttcacctttcctgtgccactgtttcccgttcctctacaaaaggaggcctcttccatctctaagactcggagctttcttgcatgctggtattgacattaccagagcagatgggctaatgtgtgactcgcctcactaagcctgtgaacttggtgcttactgcggccccaggtgaggcagctggagggacacagccgtcagccacaaccaggtgtcaacatcatccccatcattgtcttctcaccttccctaaggcatccacttccagcaatcactcatcaaatcagatattcgaagatgagactcttgcctttcaataccctaaatttcactggaacaggaaggcatgcggtgactagggagaggaacgcagcgtagagtctgtggttgtggctcgtatatctcatagacataagacagctgttttaagtagcagactcctaaattaagatattcaaacaagactgttgttgtgaatatcaatgcaataattcaaataaaacaaagcaggattcctgccttctaagctagaatcatgagtcaggcaaactttacttcttcgacccttggtacacggtatgaggccccagagaaggccttatttatttggctccttttttcagttgtggcttaatttccaagaattttcatccagcctcttagattctcattggacttcacctaatcattcaagacaaaaagtcacctccccaggagataattataccatctcctgaggcagtgtttaattccttttactgacaagaagttactcagtgtctaacctcaaccctttactgcagaagtctcaatcccatgtatctcgcaacaacttttcacagcattcttgaaagcaatcagacgttaaaagtatgggtgtgccctggagtcagttgcgtgttatatgagggggccctatttgtacacaaccccatttccacttggacacagttgagaaagaccctgccactctgctgtgatttctaggatcttttctcaatgggagttctccaagttcctgtcttatttcccattttcgctggggtgctggtggatattattgagggcttcaagactgctcacctctccaaaagggttaaggcatcacctttccttcatggaaggggtggaggaacagctcctggagtgtatgagaggccacattgcgttcccacagctgtgcacccactacagctatggaagactctgtttctttaacatatcaggagatatttgtagctgggaggtttaccagtattcattactaaacagaaagagaaaaccaaaaactaccaatcagaataaaatcctgtctcaatatgacatggctaagtaaagtcacaaatgaaaaatctttcccctgaggattactttaacagtgacattttatgcatatattatatctatggaaattcttctgtcccacaaatatatgttaagtattttgaaggaagaaaagatttctatcttttctatcttttcaatctcagattaggggaatttattcaagttaactctaagtctctggggactaagtggggggaaagaaatgtttaaaagcagtgctgtgttaaaggaggcagtaatgcctgtggccttggggtaaactgagctgacctagagaaacggtgtctgtgaaggtccatcagtctcccgcaagggttcttcagacagctgattcagtggcactgtcagaaaagagactccagccctgtagaggccagtctaataaagaagactggagagccggagaatgttctgattagcaatagcttggcctgactaggaatattagagcatcacggaaagaggaaactctcattctagtagtaaaaggaagtgcaagggaagaagatgcagtgcgtgtcctctttgcctccccaccttttagattttacaaggtgctactacccatgggcagatgttcctcactccacccctcaggcagagagaggccacagcacttggtagcagaaggcatcttgctgtgaattagaaggcacccctccctcatgtgggcatagcatccagcaggttgtaaggttcagggagggaaatgccctgtttcccagcccttctggccttataggtggaattgtttgtgtgaagcacaaattacagaaatgtacaccaaagccctggctccaagttcatacttgatgccgttggggctcaagacacttcaccccaaaatatgatggtaggagaccagaacatgccaccccagaatgtacttctttggcatattttgagctggttattctgagaagttgcagacacagaagtgcctctgaatagctgttcttttgtaaaagaaatctatatctataaaggaaaataattgtcataggaatctcatgaaacagagaagatcttatcacaggaggtaagattggaggtgataccttacccagacagactctgtcacaggtgatcacagattcttctgagagatgcactgaaacaacttttactactcctgaggctttctatcggtataacaagatagcctttgttcatcatacatttcctcccctcacctttccataacctgtcaccacctcccagccagagaccccaaacctctattcctttctgtagcccagggattctatataaactccaattacctaccccttctttgagccttatattttgagggactctcatgcatatgtatgtaataaatttgtatgtattttatcgtgttgatctgtctactgtcagtttatttcatagactacattatcgaaccttcagaggataaagaaagtcttttctgtcccctacagtgcttagcaaacatttgcaaatgaatggatgagtaaatgtaaaattatatcagagggtttgctcctcatgtagcaattactgatgctttgagattttatttcattatatttatttatattacttatatttatatatatattttaatatttctattttatttaagatgttagcagagcttctaatggttatagcatgtaaacaagaaagaattagcaagacaggacaacaaaaaagaagacaataggaaaatatcacttaatattttagtttgtgtgcattcgagaaactttttgcccattgttgtagcttaggtacttttcaaagtaagcaagaagcaattattcaatactcaagtacaatacaataagcaactgtaatctgttgaacaggtgtgtttgtgtgcacgcacatgcatgtgtctgaacacatgagtgtctactggaggctggagccagctgtaccaggttcacaggagccagttatgcacatctttttccagctccatgttcagcaacttcatgttggcagcttgaaactgactgtgatgagagtatttatgggactgacctttttttttaggaaggttggaaaagagctggtttatcagcccactattatatgtgagtgatcatttaattgtattcaagcagtggtctttagaagatacacaatactaaattgcttatatacacagatttgggttacaggcaacttaaacctatctttcagttaatcttttctgttatatttgttatatatttgagacattggtataattagatttaaaatatttgatacccatattaataacattatctaagttattgggttgttttccaaaaattactttaaataattattttttattatatctgtaggctattctatagccaagtagtatacagaacatttttagcatctataattagaacacctatttccagattaacatagaagcatttctgatgcaatgcgctgaatagaataattttttaaaatagtatagccttcaaagatcccaagtacagggatactaagtgcaggtaggttctcttgtctctgttcatattttaatacttaggctccgggaactgcctcctacagccttctcataaactaaacttttcctctctttgctttctgatcatttttccttctctgatcttataataaaaacatcccttaaattcatgcagcaccacagttctcctgctcccaatatccctgacctgttggcccttttattccagtatttagagggcaaagctgaaagcaagatgttggagtgcagggagaagagatcagagcagcctactcactggcaggctaggctccaggaggaaagtcctcaggacctgggagaggtggaccctcatctccaggcccaggaacaggacaggtgacactcctaaactttctgaggcttgcaactctacagagcaaatttttagtgtaagatttgttgtcctgttttataaaggatggctttatactatatatccttatggcttcacccgtccatctcacacagaaccctactcacacacacatacacacacacacacacacacacaccttttagaaaatgaatgaatgtgtcaactcaaaaatcttattttcacattaagagatgaaatatcatttgcttaggcagaatagaggtaagaacaagctacaacaaacatatttgatgttttgaaatgtgtaaaagatgtaagaaattttaaaaccaggctgcagaatttcacattgtttcctgtgatctcctacatcaaacggatgcaaggacagcagccagccctgctcttctgacaggctccgtcctgcgtacacctactcattgggaaggaaagcagatgagtgtctccctccaaactcttacgatgttgtgcactgataagaggtgaaggtataattttgaaaacttttaatcatcaagactcctttgcagaaatatctcttcacctccagattcaccattttttgtttagtatttgataaatattatatgctatgcaagcagatgaggttacggttgtttgaggaaattcagctccgaaaagcataatccctctggaattcaaaaccttcaatttaaactatttttggttttaactattgttgagtctaaagatagttttgagcctgggcagcatagtgaggccccgtttctaccaaatatactaaaaaaaattagctgagcacaggggcatgcagccgtagttctagctacttgggagactgaggcaagaggatcacttgagcccaggagttcgagactacagtgagctatgttcatgccattgcactccagcctgggcaacagagtgagaccctgtctctggaaaaataaaaaaataaaatataattctgaaatatcttcctatagatacacaaaacaatttttttctatttgggagcatttcattcagagcacttctgcccaatattatatggagtcatttttcatgggtgctggaaatacaagactggaccacccttgctgctcagggagtccacgatctaaaataattccaacatccttttggaagtgctgtgatagatctatgcacagaaagctggtattattttcttgccttttcacaaatagaaaatagtggaaacaagggatttttatgttaaaaaatatttaatgaaaaaataatgagaactatctggataggaaaaaaattttttttaattcatggattgaattgtgttcatttttttcctcttacttcccaagtgatacgggaaatgttattcccagtctctctcttgctgagaggctctcctctggtcacaggtgctatccatgcttgatgggtttctcagatggtattttgaaaaatggtttgcttctgtgttcaaatgttttgcaaaagaagaagaaaaacagtaacaggagggagaagaggaggaacagagaaagataaaaggataccattttaagataaatacttactctccatgaaattgatttataaaacaatgtcacctcatcaaacacacatgagataggggaaagacctttttcatcatacagtaaatgttagcaatagggacttttgacaacataataatgatagccttatgagctgtcacatagctagttccatggtgaagtgttcatggtaatgaccaattgagttattttgcgattttgtgtctaatgcaaaatgacaccatgaaaagcattgcaattgatatgaatcgccattgtctgtgagcaaactcaagtgtgaatctactgtgtcactttttctgtctctatctagagagactctaacaggagatacatttgtatttttgttacatgtgaacatattttattctcaatttatgtatgaatccctggcaatatgattgataagaaaccacactgacttaaaataaactgatgtatcagtagatattgccaaaacgttttataaaaatttagttatctcccaattttgtaattggtacatgaagctgatttgttatgagaattcctatcaaaaatattatcctagcataaattatcttagcataatagatacactggattcaaccatgtctttattatggaaaaataaaatagaaactaatattaaagtatgtaccaaaacataatgcatttagagtttttttttaaaaagcaagaatatatttttcttgcatacaggctagtgttaggaggtggaaatttaaagggcttccgtttattttgtcttgcatagcatcaaagatagataagtaagtttgaacatgcaaacgtgaagttacctcttactttgaccttcctcaaacataggtatacaacatctgtcatctaatgttacttatttctttattgatacgatgtcactgggctttttgtttgtgtctttgtgatgggattgaggtagaagggaagtaccctacacaggacctccgttcactacggaagggaaagacacatgaattgaaactgatgttcacagataggacaatgctgctgtcatctttgcattacattttctattatccttggtctgactgtttactagaaacaccagctttctctagcctcaagacagtgagaatgtcttctgtcgtgtacttctcgaagctgttgcagtgccctgtagggcattctagctgttgtcctaaattgagatgacagtgttgctcatattaaattgccttcttgcttggcttggcatgctgggatccatatctattaatgcaggagtgtccaaatgtcccgccaggaaagcaatttgttcctcagtagggagtcagagaagcagctggtctaagaaaccatcagaggtgatgttggggggcaagttgtgtttttcttgatttaatggaaaattctactgatccatcgcctcgcttgtcctcaccacttgtcagcaaggcagcacatatccatcttcagccctctcctctacctccctcgcctgtcatcggtctcttgtggggagtcagcccttcacacagcccaagctttggaataggcattctgacaacaacaaacactttattaatggatttttttaacgtgctggggaggtagcacaatttggcagcattcggttaaatatcacgttgaaaaccaactcggctttttaagaaacacctctcccaggagaacattatatacacacacaccgcatcaatattcgccgtccacatccgttctgccacccctcccagccccaacagagctttctctggaatgaaactaacaaaattcaagatcctcagtttgcatctctgttctgatggagtacatgtctgataatcaaccagaatgtcaagtcaagaacaatgattgagtatcaagtgcatgttcactgggcatcaagtgcatattcattgcatgcaagggaggcttgtctggaagaggcctaatgagcaagaaatgttcacctcagctctcacgggaaagctgtttatggccccagtaatcaaactgagaggccagataatccaaagatgaaaatggacctcccaaatgggtcaagctgaagaccagccagccactccctgaccttcagagcttgccacgttagtaatgtgtataataaagtgttgctatcttaacatcatgggactattcaggatactttaaaatgtagcagtgaagcttatatgaagtgcacagtcagtggttatctttcatttctttgagggcagagtttattcaggtttttgctcaaatatgaaaatgacatgtttaatacttaagaagaaagcaagcttccccagggcaaccactgtatctttaatgcactcttctgtgcagttgagtttctgcataatttccatggaactttaacacaatgggatttctatcctaattttatgctttgctttcggtaatttgtcagacctgcaacaatggatgagcaacaaattcttggaaatgaaaaatatgtaattccatatagtgcaaaatgaatatatgtaggcaaatgggtaatacgttgctcatatatggtcactgtttgtcactctcttattcttcattttcttgagaactagaagtctcctgcttcatcaacccaacctaagactcacccccaactctgacactgtctaataattgtcaatctttgtagctctcttatgactttgagatcctgctgaggacaaactcatttaagacccgggattaataagaaatccctcttcacatacgggagaagaggccagtaaacatgagtttattcgtaataatgaccaatgatcttgttatatgtttaattaagctctgtagctttgtgtctaactgaaccctgatttcaagaagcatttatgggtattgaccctatgtcagatactaggtaagcatctgtgatacaaagatgactatgcggagtttcttgtgtctttatgtaaaatgtcttcactacattttgatttggaagaacagctttctcatcataagtcaagcctactcatcagcattagatttctcttttatcataataaaggtattttgaagattcatctgtagattcatgagcctactttcaaatatgttattcaagtcaccaattaaataagacccaggactcaaatttttgggaatctttagctgtatcctctttgttgatatttagctattaactactaacctttggatatggtcagatttttttttcctcctcctagaatatttcaaaataaagaattaactattggctgagcacaggggttcactcctgtaatcccagcactttgaaaggccgaggtgggtggatcacctgaggtcaagagtttgagatgagcctggccaacatggtgaaaccccatctctactaaaaatacaaaaaaaattagccgggcctggtgatggccacctgtaatcccagctacttaggagactgaggcaggagaattacttgaactcaggaggcagaggttgcagtgagctgagatcacgccattgtactccagcctggacgacagagcaagactctttctcaaaaaaaaaaaaaaaaaaatgcatagagagatttgagcatagagagaagccaagaaagtgaagaaagctcaggagagtttcaacccatcatgtacccatcatttgtcatcgaagactcataagcatggccttccatcaactgtgcacctgcctacagcaagaacaggcaaaccacagacaatctctactggtgaggctgtttcttggaaacacaagtttcctcaagctattcctcctccccaccctcaattaatacacttcctccctttagaaagaaattagatcagcttaggtgatttttctctttcaccttctaattgttaccaaaccctgcttctttgaggtggtatcagactgaatgacaatgtgttcttcttctggtcctgggtgtgggcaggagaataagatggaggaatgcgctgaaggccaccactctatttcctctagattctctaaggtactctaagaattgcatcgtcaatgaagatgatggctaaatgtaaaaatgatcttaccttgcacataaatggaaattattctagtacaccataaggactaaccttatgtaaaattgtaaagaaatacgtaacagataagctcatatctttttgcttgtttatatctcttccctttcatggtacccttgtaagttctccatcacacctgcctgttcctgatctccagcccacattctccttgggctcagcccatccagatctgatcatgctgaatccacctgtctttcactatatccctcccctctgagctctccacgctttggagggagatatgttactaccctgatactaatcaacattgctagaccagtaaaagtctggaggataagcttagtgcccatcctgcagagtaattggcgtctgcattttaatggaggctcctgtctcctcattcagagcaatcctgctggtattttcgactagatgaggaagggaaatgggccctttatgcaggcctgccagaggtatttaaaggtgagcaggattcagaggggaaccttgaacagcaccatccacacaaacctcctctctcctccctacttccccagcttggaaaggcagaccccctccctacttggtattaaacattccacttttttcactaacagtgcaatctccctcaattagcctatactcccaaagcaaagacttggcaagagggcttattgtctctgggtgttacaagtacattgcgctataaatgtctatgctctctgtctgaagtctcgaggagtttatcatttacttgcatctggacacgagtgcagttttcccagagttccatgctcaggcatttctgtggacagagggagattctcttgtgctcagccttcctctccctgacattggtgtggagggctgctctctgagtgagagctgctttctatttgactcaattcagtcagtgttcaccaggtgactcttctgtgcaaggcagctgccaggggctgctagaggtggatgggatgcatagccaagtatcaaggcacaccgccggccctctgcagcaggcaggaggatgtgtggaaacttgcaatgggcccctggacaggagccgtggttcacctcactagggggctgggtgagcggaggctgggcttgtgctgctagggggaggccgtggcattaacattgaaccaataatgctctttgccagaaggtggtggaacccagcaagggcagatgtgagtctcggttcacctctcacccagagccctgggattgcacagccaggggcagcgcccagtgccacagcagcctgcacttgaccttgctgcccaggctgctgcccagcctcccaagtagctgggactacaggcgcccaccaccacgcctggctactggctgtttctgggcccttctgctgctttccctgcacaggacattctgtttgctcagtggcagtgggcagctttgtgaagtcctctcatcttctggaaagcagggctgagctgtcctgagagaatttcagcgccagcagatatgcagggtgggggcagtccccctctcatgcacctatgttgccacctccccggccccatggtgtggagtcactgtccagctgccagtgagggaggcagtgagtgcccccggccccatccccaggccagtggccttcatctaaggtatctggagagctagactcgcacatgccctcatagaagccaaatctccctccagcttgaagccactgtgcagccaacttctgccagtctccccgaggaaataatagtcctcttgatttcatgtgtgctttactttttattttgaaatagttatggatacacaggaagttgtaaacatagcacagaaaggtcccaggtacccttcaccagctttttccaaatggctacctcttgcatagctagagtacagtaccaaaaccaggaaattgactttgctacagtgtatgcgtatagctctacttatcacaggtaggtttgtgcaactaccacctcaactctttttttttttttttttttttttttttttgagatagagtctcactctgtcacccaggctggagtgcagtgacgcgatctcggctcactgcaagctccgccttccaggttcacaccattctcctgcctcagcctcctgagtagctgggactacaggcgaccgccaccatgcccggctaattttttgtatttttagtagagacagggtttcaccgtgttagccaggatggtcttgatctcctgaccttgtgatccgcctgctttggcctcccaaagtgctgggattacaggtgtgagccaccacgcccagcctagcacctcaactcttgatttcatcttataactgtgtggctgggtccttacccaagcagaaccccatgaaaccaacagattcagtggttttgatgtacgttttggtgcgctgtgatgtcaccatataagtagccaaatttggtgattctaggttgacttactgctcccagatccataaagattggtcaacacgaatgaacctaaaaagataggtcagtcacacggaaccctgccccagccaaacaaactcacacttgtcaatcatgaactcatgattgaaaatgtgcttcccagataaaagaagtcatctactcattttgcttccatgttgctgatagaattactttttctgttctggctttcccaaggcaattacaaaacctgtttactccatcgtaagttgaaatcaacactattactataaactctataatactatatttttaccctaactggaagaaattaatcattaaacctgtggattaaatacaacttttaacatgatgcatacaatgagaaacaacttactgaaagcatcaattcaataaatgcatccactgaaatggtggcttatttaagagtcatgttcctgtacttttcttttttctttcttttttttttttttttttttttttgagattgagtcttgctctgtcacccaggctggagtgcagtggtgcgatcttggctcactgcaacccgcactgcccaggtttcagcaattctcctgcctcagcctcctgaatagctaggattataagcatgcgacaccatgcctggctagtttttgttttttagtggagatggagttttaccatgttggccaggctggtctcgaactcctaatctcaggtgatccacctgtctcggcctcccaaagtgttgagattgcaggcgtgagccaccatacctagcccacttttcttctttttcttcttcttcttcttctttcttctttcttcttcttcttttttttttttttttttttttttttagaaggagcctcactctgccacccaggctggagtgcacagtggtgcaatcttggctcactgcaacctctgtctcctgggttcaatcaattctcctaccttagcctcccgagtagctggaattacaggcacccgccatcacacccagctaatttttgcggattgtttttgtttttgttttttaagtagagatggggtttcaccatgtcggacaggctggtctcaaactcctggcctcaggtgacccacccacctcagcctcccaaagtgctgggattacaggcgtgagccactgcgcctggcccacttttcttcttaaagtaacactttggaaacactaggaatgaactggctctgttttaaggttatatagaaaaaagtaatggagttgggcattgtattagcagtaccataatgaagcttcttaaaagccagcttgatggttatttttaacaattataggcactacttacaggtcactgagataaatcacataatgttgaactttgcagtcttataaggaaaaaaaattttctcctttgccagaaattatcaggttattaatttttttcagtgcatgtgtgaaaagccattagcttctcttttttttcttttctttaaatatccagctatactaggtgactgtgctcaaatggtggtgattgccatggactaaaatcccatcagaagaaccttgagacctgtcgaggtgaaagctaacccactggaaagtggatgccatcagatttgtagtagttgataagtgtgtagaagtcaagaagcactgaaaatggcagtgtactcaattttaacttcatttattcaatgcttaaatcagtcctaaggaggatttgctgtagttatcatagtagcataatgatatactgtttcaaatgaaacacatgtgaagtaacacaattgactcctcattttaaatgatcctgctttaaatgttgagatccagcttctcatagcctaagcatcccacaaccaaatgcctgaaaattaagattcatctctaaaggcagtgtagtcatataagaataagctccacaaaattacatttactatgagtacaatattacaaaaatatatgtacatggagaaaaactcacaagaaatccagaatccagaaaacttaaccaggttaatacggtgttattattggtcacttttgctgttttcattttaaattatctaacgctgttctgtgttttcagataagaggaagggggaaaacagttggatgctgatttctcgttggtaccatgcatataatagatgttcagtagatgcagttggaggaaggtgtaacaataaaagcaggacatgtcagtagtgtgaatgtgccctttcatggcacaatttagaaaacagcctggaagacactgcacgttggcctcatgctttttaaaggaaataagacatgtatagagtcgcttttatgcatcttgtgatgaagatattccccctggcccatctttaactaacaattgggcctctcaactgccacctcaaagttcagtgctgcttgagaccaggggacacccttggcttcaggggagaggaacccggaggactccgtagtaggcaccatgacggcagcactaaggagcttgccgctctggacttcctagtgcagttttcaaggggtgggttcctggcctccccgcagtcctcctggaaccagagcccttctggtctcctggttcccacagcaacaaagttttctttcagcccctagtcactgggtcccctttccctggacctagtctctttacaatgaggtcccagataccagcctctaatcatcaggacaaacggccatcccccaactccagtttcctccccacccatcacctccctcctaagccagcgtgagtcacagacgcagatccttaaccctctctcgctttttgtcaccttgtccctcgcgttcagatctgttcaagctcatcctcaaaatagctggccttggttttattctgttttaaaaccttgccttcttcaccctttttccccataacccctatcactcctcaaaataaaactttacccccaaaaaactgttcagagtcccagtcccagccttatatggtctgaccctgtcctgcagctcagacccggtttgtttctcaagatcatgaccacattcaccatccaactcctgtctgtgcaacctgcctaaagagtccttgcccagttggataaataaatatctttcatttgcagaaatcttgagaaagcaaggactctggggttttgttttgtttttttccactctctctactcctttttctttggttctctcattcattcagtcatttgttctttaaatctattgtttatttacagttcctgagatcctagttgcaccaggaaatatactagataataaggttacaaagaaatacatttctgctttgagaagatcgtaattcctggggtcctaaaatacagctgttacagttacacaaccaccaacttttcatagaccttaatgattcccaaaatgctggcacgttggttgtctcaattagtcctctctacaaccctgtcaggaaggtattctatttgtcaccattttatagaggagggaacaaaaggtcaggaaagttaaataatttccccaagatagcccagctttcagtgatggatctgggagataagcccacctcccatgctcgttgtaaagtagtgctttccccgccttctcatgagatgtcttacaggggaaagtcattcttaagttaaaaacaacagcagcagcaaggcccgtacagcatgctcaggtagaaaatcacctcctagaaggagtccaacttcgggttccttcatgtagtggctcagtttgtttacctccttgcccacatttaccttcaaaaatttatcttgtaaacaaatgaaaaaaagcagaaagggctctttcaaaaaaaaaaaaaaaatgtgctgtaatcccagcactctgggaggctgaggcgggcagatcacgaggtcaggagatcgagaccatcctggctaacatggtgaaatcccgtctctactaaaaataaaaaaaattagccaagcgtggtggcatgcacctgtagtcccagctacccgggaggctgaggcaggagaatcacttgaacccggggggcggaggttgcagtgtgctgagatcgcaccactgcactccagcctgggtgacagagcgagaccccatctcaaaaaacaaagcaagcaaacaaacaaaacatgtatctttaagctcaaatgggaatatcccgtcacagtttgagaatgtaatagcttaagaggcagccaaatttttatttctagaaaccagtctatcattttcatgagtcgccaaataggaaactcctaaacatctgctttcctaagtgagtggaacttgtcctggtcctgacctgagaaatcgaaaccgtggcaagagtggttctgtggaggccagatgggcatttctctgagaggcaagaggaaggcaggttaatgtatgactcccaaagttcttacacctagcagtattgatgaaaccatattgttatggaatatcatcagcacggatattgtttcttaagcctacagctattcaaagagaaaggggaaaaagctgtgccaccttaatttaattggaagtaattatgctaacttccagcccccatagctgtgtgcaccagggaggccaggaggacggcaagtaagagtcaggggcacttgcctctccgcgtttgctctacatagtcacacgtgattgttttctcctcgtgtagaacaatcatctcacaacattaaaaggtagaaagagcttcctcttggttgtgtggttattttgggtgcagagttaatgacaaaccttgtataccaattcaccaggaatttcagtccaagccaggtgtgttcaatatggtgacctgaaaggaagcccgctctgttgaccgtgagaaatgagcagttgttagcacgtcaaaggtgtcatccctaccaacgaggtgtcccttcttgtggtttgttcaatacttctccgcatgaatttacttacaatagcaatacacttcatcagattcatttctatcatattgtttccctataattttattatattgtctgttatgcaccagagcctccctttttggccaagtgtgtttccacttccatttgattttcagggggggtcatttccttagagttgttttaaaccatttttctgagcttgggatgtgctgttttatcatatttgcagcagtcagaggctttagagcattttttactaataaaaatgaaaccacctctgttactgttttagtaatactgttctttgtagacctctttccattttcagacttacattgaatagattaggtacacttgtgttcttattcccatcaagctactgtataatttttgtcactttggctcttggcaggagattctgcatacagtgacaacaatgtaggtgtgtgtgcacatgtgtgtctgtgttagggggaaacgtgggcctgagccttggctgaaccctcacagcaagtctagccttcccgcggatcgtaatgaatggaactgcgggagctgtctccgctaaagtgagatattcttctcccagactaatgttttctgcaccagttagcagatttttttttttttcctaagatcaacccatctgccactttcattctgcagtaacctggcaacttgcagtctggatcgttctttttcatcttgacccctggccttggaatgctgcaatttagtgatactcctttaaaggattgtctggtcacttaggcaggtcagtgctgttatttgctcatgtcatgagggctgggtgttcttgaatagatggtgacagtatgaccataattcctaacgtgtccagtcaattgtcatgggctaaaacctttcacagaaataacggtgtcagatatggctgtggagtccatgaaagatgcattattattttgctcatccttcataatacttattttctttatccttattgccaattccccaggagtctagaaatgaagggatttgtttccagttgacatcacagtcttaggcctcgtgcggtttatattctattggaagggaaaactgataaataccaagcatcattttgttgcaaaagtttaaatcatctgaactatatatgtagcagcaatctagattgtgtttattttcctctattttttaaacttacatcatatttccaatctgacaaattgaactgctcctgcagtgccgtgatttaagcctcataggccaatctcttcaggtgattgttttgtctatttttaaaaatctccacaaagaacatttatttttcttcctagtaaacgatgtcattgtttacctgttagaaatgtcttatcaaattttaagataacctgtcctttgttatagtttgagtccattaccctaagagattacttcattttctatagcaaacaaaagatcagtggcctctttaaaaatagcattttccatattggaagaagaaaatcatgtctggactggcttcttttgatataacaaaaactatttcccttatccacgctcaatacggtcaacaccctctcctgcaaaaatggccacaggggaaaggagggccattttcagcccacttccaatggagaccaatctctttccaacatatttcattcaaatgataaaggattatatcctctatcatttgcttttacaaatagaacattggaagtcttgacttgctattattttcttgaaggttagcaaaaacataacttctgctggagtaacattgactctcttgggtctcttaatacccagactggttacttatgcaaatagctttgctgtgtaattagggtaaagcattttggttaaattgcctttctatacccagaactctatcctagaccaacctttgtaagggaattgaacctgctgggtttgaaaattagaatactaagcacaagtgggtgcatttcttcaatgggcttcgcgttggtctcagattaactggaaacaacaacttgatgtggggatctcagggacagtcacacttcacgatgcctcactggcgacctcagggacagtcacacttcacgatgcctcactggcgacctcagggacagtcacacttcacgatgcctcactggcgatctcagggacaatcacgcttcatgataccgcacatcctgtgatggttgagttattacaaagcatcaagaaggttcatctccacaaatttgtgtcatttttagtagccactgcatctggaatttcatcattagagagtaaagagcctaggttcctgccctttaaaatctcctcttaaaacacaattttataaaagtgttcatgtgtaaagaacatgcctctcaacgatgcatatgtcttcagaaatttcttatagaaatcataaggacggtagaggattagcctcctggcaagggcatgaatgcaggagcccatgggcaaaaccttgcttgcacctttttgagcccacacagggttgagctgcacaatggattaattaagccattttatatttaaatttaaaatatcgatttgtggcttaattttttttttttttttttttttttgagatggagtctcactctgtcacccaggctggagtacagtggcacaatctcggctcactgcaacctctgcctcccgggttcaagcaattctcctgcttcagcctcctgagtagctgggattacaggcgcgcaccaccacacacagctaatttttgtatttttagtaaagacggggtttcaccatgttggtcaggctggtctcgaactcctaaacttgtgatccaccctcctcggcctcccaaagtgttgagattacaggtgtaagccaccgtgcccagcctttttttctttttttccccccaaaggaagctcctggtgcactagatgggcattctcatgtgaagaaaaaaatcagcttaacatgaaaggccatcccctcctttaaacagcacaggtgcttccaatctgccaccatgcccacctggctgccccctattctccaggctcctccctggctctaaaagccttgagtttcttacctctcttttttgaggctttgccattctttttgatctcagaatggatcattttctctctgcgaggatgaataaacagctaacactaggactaagtgctttttctcaagcactgctgagaaagatctggaaggtagtgttgcccaagaacaggaggtgaaaaagttttctggtgctcttctaatttaaaaaaaaaaaagaaaagtctttagataccaaaatgtttctgtgatgttgtcatagaatcataacacccggccagacatggtggctcacgcctgtaatcccagcactttgggaggccaagactggcggatcacctgaggtcaggagttcgagactagcctgaccaacatggagaaaccctgtctctactaaaaatacaaaattagctgggcatggtggcgcatgcctgtaatcccagctacttgggaggctgaggcgggagaatcacttgaacctgggaggcagaggttgtggtgagccaagagcgcaccattgcactccagtctcggcaacaagagtgaaactccatctccaaaaaaaaaaaaaggaattataacactcaagaactgtgaaactttcctattcttagctctggtccgttttgcattaccatggtgtttaattgagggggaaaaaaagtaggctacagataaattggaaatgattcaactgagagtgacaaaaattattaaaatgattaaagggttgcaaaactgatctgtgaggatcggcttgaggaattggatttatgaagtctgaggaaaagggagctcagggcggatttattcagtgtattaagggacatgatacggaggaagctgaccaatgttttcctgctctgctgaggacagagcaaatggaaatgatcttacaatatggcaggggagaatttttcatcatgtgtaatggagccataaggactgaccctcaggaaaagcgtttccgaggttaaagaaaaagaaaatacttaaaaatattctccttgagacaggtttttaaaggatagacagtcgacaaggagttttatatcttgttctgcctaaaggcagggtttgtgccaggtgacctttgggggcattttccattcctttgagtctacagatttatagaaggtcttgaatctgattttagtgaattcaaaagcaagtacacatcagctcctaaccatcagaaactaaagtacaaggacacacacatttttttgctattgaattaacacctggaatctcagctattcatgcaatcatttcttttgtagtctgtgattgcaaactaacagttattagtcctctgtggcacttaaaaaagggtacagcttttatgcctaacgtgtgcgatacttctattagcaacgtgtttccctggatacgttttatcagaaacttcactaccaaaaataagaatatagaaaggcattcccatgtgtcagaaaaggtaggtcatttatttcatctactattatgtattgagcacctattataaacctggacctatgttttgcactgagcatacaaagatggaaaagtaagtcaacgagcttacttgggtggtcggggagtgattcaggctggacgtgaaaacccgttatgaaaatatagtttactgaatgtttaaggaggttgcagtgagggtaggaaaatatgaaataccaccgaaaatgggattaaattgacagaaaatatcaactgtgcatggtaccatcaggagcagagagaagagtcaagatatagaggaggcagagaatggagggtagggggaagggctcaaaggaagagagcatcccttcctgaacagctgcgtgctgggccgagaggaaagcttggctgtccccagcagctgtctggaacttccctgaccagtggaatgctagttagcaaaagagattgtagattataattggcggttccccaccccatagccaccttcgagggttaaattgggccatgtacaggcagaccagtacataatgtgatttaataatctgcccaagtcattgtgtcaaaactgagaactgatgccccaaattcacttgataggaaatggatcattccatttcatagagatgagcagtgttacaaatgccacactgaaaagatactttgacaaaaagtcactcgtcttcttagccccacagaatcttaggctgaaaaggaacttaaagcctagtcaccaaacctctttcccactactggaatgggttccgcacaccttccttccttggcaggtgtccaacttaagtggcaaaaagttcagatctttcaggaaggttgtttaggaagagaggaatttttaaaaagttcttccttacgtgaggcttaaaactgcctccctgaaacatgcactcatggcttgagacccactcctgggagctgcttagtgtagctgaacaggcggcctgtgacatcctcttgtgggtctcttctctggaggcttaatgcccctcctcagcctcctgtgaggctgctcctggctccgtggcagccttgcccaaatgggttacagtttgttaatgtctcacagaaggtggttccccaaattgtctttttggtactgcagaccaatggcccagtttacaactgagcaagctttttggggcagccatatcacacttatctgtaaagaattaaatgtgtaataaatcaatattactcttttactgttagcattattgagcactggctgtgtgcctctcaataagcccggttaggtccccacagccgcctgccactcctgggccccacccacctgcatcgtcctcctttctgcacttgtctcactcgcctgtgaccctttttgaccagcccagagcagtcattcaatcagcatttgttgatgaattcattaaataggcaacaaatttttcagcctctattgagtttgcaggtaacgtaaatgaaagtttggaagtcaaattgtcactgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaatagcagacaaacagagagccaaatcatgagtgaactcccattcacaattgcttcaaagagaataaaatacctaggaatccaccttacaagggatgtgaaggacctcttcaaggagaactacaaaccactgctcaatgaaattaaagaggatacaaacaaatggaagaacattccatgctcgtgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagaacccgcatcgccaagtcaatcctaagccaaaagaacaaagctggaggcatcacgctgcctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaacagtctagccatatgtagaaagctgaaactggatcccttccttacaccttatacaaaaatcaattcaagatggattaaagacttaaacgttagacctaaaaccataaaaaccctagaagaaaacctaagcattaccattcaggacataggcacgggcaaggacttcatgtctaaaacaccaatagcaatggcaacaaaagccaaaattgacaaatgggatctcattaaactaaacagcttctgcacagcaaaagaaactaccatcagagtgaacaggcagcccacaaaatgggagaatatttttgcaacctactcatctgacaaagggctaatatccagaatctacaatgaactcaaacaaatttacaagaaaaaaacaaacaaccccatcaaagagtgggcaaaggacatgaacagacacttctcaaaagaagacatttatgcagccaaaaaacacatgaaaaaatgctcaccatcactggccatcagagaaatgcaaatcaaaaccacaatgagatatcatctcacaccagttagaatggcgatcattaaaaagtcaggaaacaacagatgcttgagaggatgtggagaaataggaacacttttacactgttggtgggactgtaaactagttcgaccattgtggaagtcagtgtggcgattcctcagggatctagaactagaaataccatttgacccagccatcccattactggatatacacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatttcctttgtagggacatggatgaaattggaaatcatcattctcagtaaactatcgcaagaacaaaaaaccaaacaccgcatattctcactcataggtgggaattgaacaatgggaacacatggacacaggagggggaacatcacactctggggactgttgtggggtggggggaggggggagggacagcattgggagatatacctaatgctagatgacaagttggtgggtgcagcgcaccagcatgtcacatgtatacatatgtaactaacctgcacattgtgcacatgtaccctaaaacttaaagtataataataaaaaaaaaaagaaagtttcacagtgtttggtctgttcccatttatccctgcaacaactcctgacttgtaacatgactcagtcagtacaggtctggggaacacagggttcacccccttttcccatccccgcacacctgaggtttccgacccgccctgcctgaaaccctgctcggacgctcagggttgggaaaaggctatgcctggcagggagtggtccccatggcaatccccaccggctcttcctcagggagtcagaccttgcccagctctgaggtgcagataacgctgtgttcatgcctttaagtcaccctcattagatttcttgtggttcggttcagcccatccttccagccttggagaccctttgggatctttcttcaagcctctaagttattgaatatcttatggctttttgacatctaactgtaagaagtcacatcttctgtctctttacccatgtcatcggtatagctttttaaatatattaatacctttcctcatgtaacaaggacagacctaacactatcataataaactagaagtcaaggctgaaaatccagatcatggatatagcaaagaattaggttgaccacagaggttcttcaatgctttcctcctgtctagggtgtctcaatgatcaaggctgaaggggactctggtggtgatataatcatcattatcagaatagaagcctgtggattcctgggggaagcaggcttttcctcacagtggattctaaaagaatgctcacatctgactttgtgtcacggccaccctgtggtgcagtgagtgatgtttacaacctcttttttaaaacagcaactgcaggccggactgcttctggttgtgaccttcatagaagcatagaggctctcgaagcagggctctgggggcagagcaactgccttagaacccagctagactaggtcgcccccatagccccctcagtccagtccctcacctccataaacctctgttaaatgagggtaattaataagtatctacctcctggggccgttgcagccattaagtgagttaaaacatgtaaaagtcttagtgcagtgggggcaaaggttatttagtggcagaggttatttaggatgaaaatggtacttatcccatatatttgtggtgagaatgacctgaataacccacagaaagagcacagtgtgcagcaaacagaagttcatgagtcttggctattgtataaaagacttttttatgacttgttcagacaagattaaaatcttcagaatgacagccataaattcatcaagactctacggtacagcagcagccccctcccgttctaccctccttttagtcaatctagtattacaagtagcacccaggccttccagatcccatctcctccctctacatgggagatcagtttgcctttataatacacacctgctgttagccttgggccagaagacataccctgaaagtcactagaaccattcgttcatcaaccataaaatagtaagatttccaacatattaagaagtttctatcagacatggtgcttaacattggatatgtatcatctaactcaatccttgccacaaatgcatgaagtaagtgctgttctcctcctacaattaaaatgaagaaagtgaaggttaaagcaattaagcgacatccccagggttacgcacctactaagctgtggagtcaggtttttaatccagagccttctactccagagcatgtacttataaccattccacacctgtccttcccacacattcaccgtagagcatggatcagagccacctcataccctcaccgacactgctccaccatcattagtcctagccgataacactgtgttctaactattatctttccataaatgcactggtactccagaggttgctactcccaaatcccccatttctctcttccctgcttgttactggtcccctccttcaggatactcttactatcctcatccctaccagtcaatgcacataaatgacagctcacattatcccattttttaaatgtgggaatggattccagagttgggatgttgcttcagaagagaaggggtgggaaggcaagtagcttggggtgctgggaaaccttgctaatttcccagggttggttagaaggggtcctttaccatcagtcatgtttacttctagaagctctccttttgatgtcattggttttctgcacagccaaacattgttcatgagcttagagaaaatattgttattggcttggttgacagcgtcttaatctctttatgtctcagcgtcctcagctataacatagggataggagtagtgcctctcccaaagagtgcaaacttaatcaattgactaatgataagcatgtgcagtgcatggcccaaaatggacatgattagcaacaatgatgatcaggataatgcatttcagagttgcttcatgtgatccacaaaaagcagtttttaacacaactcataaaaaagcttttatgcccagatgattcagtgatccaggtattccttctcacatggctgataactaagacatgcagactttctctctcatgtcactcactgacagcgcatcttagaaacgtagtgttatatcttcccccagaacagccgcatcttagaaacgtagggttatatcttcatatcttggtgttacatcctcagcctcaggatgctgctgtggctgaggctgtgctgcctgaaggaaacccctgtctgtccaaggcctgtctgtttggtttatagacccacacaacccatggctcaagaagccactgagccttgtacaaattcacaatgtgagatgctatagagaacaaatgaccagtttctccagcatctgagaggcgtggagtacaaagcagaagagagacagttgcagatggcagacaagtcaaacaaccacttgaacatctgggctgggtgtgaagcctgatttctgattcctggaaacagaccaaccattaaaaaaaaagcattcaacagtctgggagaaaatattgcaaaagacctatcggataaagggactattaccaaaatatacaaagaacttttcaaaattgacagtaagaaaactatcaacaagattaaaaatgggcaaaagagctgaacagaaacctcaccgaaaaaagatatacagatgcaaaaaagcatatgaaaaggtgttcaacatcatatgtcatttggcatttgcaaattaaaacaatgagatacctctacacacctactaaaatggccaaaacccaaaacatggatgccaccagatgctggggaggatgtggagctccaggaactctcattcactgttggtgggaatgcaaaatggtatagtctctttggaagacagtctggcagtttcttagaaaactaaacacagccgggcacaatggctcttgcctgtaatcccagcgcttgggaggttgaggcaggcagatcacgaggtcaggagttcgagactagcctggcaatatggtgaaaccccgtctctactaaaaatacaaaaattagccaggcatggtggcgagtaccagtagtcccagctacttgggagtctgaggcaggagaatcgcttgaacccaggaggcggaggttgcagtgagccaagattgcgccattgcactccagcctgggcgacagagggagacttggtctcaaaaaaaaaaaaaaaaagaaaaaaaaaaactaaactaaacatacgcttaccatatgatctagcaaacatgcttcttggtatttacttgaattagttgaaaacttatgtatacaactaaaccttcatacagatattgacagcagatttattcataattgacaaatctgggaagcaaccaaggtgtccttcagtcgatgaatggataaataaactggtacttccagacagtgagatattattccatgctaaaaagaaacgtactgtcaagccatgggaagacatagaggaaccttaagtgcatattaccagtgaaagatgccaatctgaaaagactacatactgtgtggtttcagctatatgatattctagaaaaggcaaaactctggacacagtaaaaagatccatgattgtcaggggtttggggaggaaaggatgagtatgtggagcactgagggttttcaggaccatgaaactcttttgtataatactgcagaggtggataaatgttatacatttgtccaaacccataggaagtacagcaccaggagtgaacctcatgtaaactgaggactttgggtgatgatgtgtcaatgtacattttgcatttataacaaatgtaccactcttgtgaggaacactgatagtgggggaggctgtgcatgtatgggggagaggggagaggggagctctctgtactctgctcaattttgccgtgaaattaaactgtctttaaaaataatctctattgaaaaatgaaaaattctaaaagttttgacacaactgactttagataatagtaaggatgcattgattttcattaacatttcaactgcaccttaaagatgcgtgagattttgtaaggaaacatggccgaaggacttttggcaaagacactgcatgaacaaaagtggggaaggaggagagtgagggcagcattcagaagacaacttggtgttcagtttatctgtaatcttgggaacagctgcggtttcaaataattcattgtattattcctggacaccatttcagaaatcatagcattttggcatccaaattctaccttctgaagggtctttcaaagctagaagagaataaaaattctttacccattcgtagaacttggttctgaatatatgatgacctcagccacagagcagtaattctcaagattaattgtgcctaagaattgtcaagggaaagggttacttatggaaaatgcagaaaccaccaccacctcgaatccagtaggtctgaaatgaaacctgcaatctgcatttttcacgagcaactcagctaacttggatccaggtggaccagggaccacattttcagaagtcaaaccatagaggtagatgcaagaggctagaagagaggtcccacattccaaagccaataagaagcaacaggtgacatgaacgagagaaatgaggggtgggaaacactgatcttagcttttcactttcatacttaggagaattatgcactccacaaagaaatacactctttctcttacttttagaaaaacacagccctttcccacttttgatagagacatgggacagaaatatttccctatatgcaacagacatttatgtgtaatgacaaatagcaactgaagggaaggagtggaggcccagggtgtcctcattcttcactttagcaagggaagtttaggatgcatcttttacgttgatctcccaatctgtaaatgttgtcttagattcttttcaagcactctgtgagccaaaaaaaaaaaaaaaatgtgtgtgtgtgtgtgtgtccacaccctgctcacaagccaccagttgtgacctttgaacgaaaccctagctgggaaggttggtttggactagatcacagggtttcagcctgagttctgagaaatgtgcggaggttgcaaagcatcgggggcttcagtagaagataaagaagaatctcaatcctcccccatccccatacacacacactcaccccatctcactcttcaacatgaccatctctgcttttattatgtataggtgttccaaagcatatttcacttgaaaaatagaatgtagccgctagaattcccaaagaatatcctggatgtattagtcagcacagactaaagtctgttgcagtaacaaacaacttcaacatttcagtggtttgaaacaacaaaggtttgtttctcacgcgtaaggcctgtccaatagggttggcagggagactgatgtgacctcgttctccatcagggtcggcaggtggagcccttccttcaggaagcaggatggtgggagggatggagagttgagtgccagaaattaaaggctctggcctcaagttacacatgtcattgccacccacatttcattggccaaacaaggcatttgacgacatctaactgggttaggacagcacacccttcccacaagctctcagggagaagggagctgaagaccctgtgagcagtgtgaatggctggcacggcggggtcatgtggtgtgttgggaggaggcttgaattccaaaccagagagtgagcttttatttactgaggaataggaattataatgggatcgttgaggagaggagtaacataacaaatgtaataaatacaaacactaattataaaaagctaaatattccatttattaattaatacactctataacatgatactgatttgcagcctgaataaaaatccccttggtgagcagaggtttctatcagctaaattatgaatagtataggttagaaattgattaacaataatttgtcttttttcccacatgtgaatttaaccaatctaataagagctttataaataactaatgaaaaaagccagtctcagtgcttgtgagtcctcccactgtggaaaattagacccatctattgaagaacaaatatcccctcatggaagcaaaggtttcctctctcccgtcatttgatcagatttagaagcataattaccatcatgcaatttgaactaaatatattaaagtatttctttgaagtgaaaataattggaaagcatcaggaacaagcctttctatttgagacaccttgggaggagagttagcctcaacaaaggctgaagcagctacagctactgatccctgctgccgacttcccacccaccttggcaacagaaccaggcagaatcctggtctcatcttgtttgcatttgatgtgaattctgtcaaaaggaagagataattgagctagagttagccttctgaattgaaagggaaaggagcgagaagagcagctgaaaatactttgtggtgcaaagtattcagtctgtaagtgggatatggtgtgtgtgtgtgtgtgtgtgagagagagagagagagagagagagacatgtaagcactgtgcacacacacagacttgagaattgtacccttgactcttttcaatgggaatacagagttttaaaaaggagtaatatctgtctcttatctctcctaatttattcccagttcaagacagaggagcaagaacttttttttctttaaaggataacctttgccagagggtctgttttgaaggaggaatgtctgtgagagctgaatgatgatgtctctctttcttcctgtagtggggacaccctgtcctccactcgcccttacctgggaagttgtcctaaggaggtacaaatcccttccactccttggcagagcttcctgtacttctttacctgacttttcatgttgggagtgaggaagtactgataagtgcccctcctgcaggccactagccagcaatgccgcctggccctggcctgtgggctgacccctgggaacaggctgtggagtcgtagccaggaggaacgggcatgccagcaggtttgtgacgggttttctgccttgatgtatttgctcctagggctgccattataaagtgccacaagccgggtggcgtagaacagcagaaatgtgttgtctcacggttctggaggccagaagtctgaaatcaaggtgcctccaaggtcatgttcctctgaaacccatggggaagaatccctccttgcatcttctggcttctggtgtttgccagcaatccttggcttgtggctgtgtcactccagtctctgctcccatcatctcatggccaccttcttgctgtgtctccctcctcttcttctgaggatgccagccatgtttcagttagagccaacctactttggtatgaccttatgatatggtttggctgtgtccccacccaaatatcccttaaattgtaataatccccacagatcaagggctgggccaggtggagataattgaatcatgggggtggctttccccatactgtccttgtggtagtgaataagtctcacaagatctgatggttttataaaggggaggtcccctgcacatgctctcttgcctgccaccacgtaagacgtgcctttgctcctcattggccttccgccatgattgtgaggcctccccagccatgtggaactgtgagtcagttaaatctctttcctttataaattacccagtgtcgagtatgtctttattagcagcatgagaccagactaatacatcttaccttgactaattacatccacaatgacactatttccaaagaagatctcattccgaggtactgggtgttaggacatcagcatatctttgtaagggatacaactcaacccatgacactcaggccactcgatcctcccagctagccttgcctgtgtgcactgtcattctgatgctctctaacaggaaccaggaaaatctaaagagattctgtattcccatcaaaccgggaagggcaagagcacatcacttacatgttaagcctcttaattacatttattctttgaacaaatgtttggcacttctatgtgctaagcactgtgccaagtgcccagaagatggtcacagcatgcccccatgacacagaggtctagaacgaacaccaacattaaataaccctgtgcacggatgctgagaaaggggaagctcagggtgccatggtagtatggagtgagggctgtaacctagtcttcagaacattagaaaggcctccctgctgaaataaagcttcactgagacctgaaggaagagttgggtctaaccccaccaagagagcacggaattagattctagaaatgatgaaagtaaatgaagatgaccgtgcttgtcatagatgaacaatagttgtgtgaacaaaacaggaacctctttctctcaggacatggtccccatggctggctctgtggtaaggaaacagaagctcccgtctgtggctctgctgtcccttgagcgtgctcaggtggttgaaggtgactggcaccatacctgccttccagcttgcacaaagagagaaggagaagggctgggaacatgccttctttaagggcgtaacccagaaatggcacgcttcactttcgtttacatctcaggtgccagatccagtcacatgggaccctgagtgcaggagaggccaggaaatgtagtctgtacctggcagacacgtgcccagtgaaggcttcttatactgcagacgggaggagaagatacacatcgggaggagaagatacacatcaggaggacaactatgagccatagcatgttgtctgacacgttaacaactaaggattccttccctcccctaggatatgccgggcaatgcagtggccactagccagcgtccttggagcactcaaaatgtgggtagtccaaagggaggtgtgttgcaaatgtaaaatacaaaccagatttcaaagacttaataccatagaagaatataagatatcttattagtaatttttatgctgattacaggatgaaataaattttttgatatattgtggtaaataaaatatattatcaaaatcactttcacctgcttctttttgctttcctaaagtggatattaaaatacaatttatatgtgtggctcgcattttatttccaatgtatagcaccactctagaatcgtttaacagtgtagagggcaagaaagatgtcaacaacagagttcaaggcggagcaagggagaggagtcctagaagactggggaaaggctggggacgaatcctagaagaacttgatgttcgcctggagacttggatcttacaagttcactggaagcacagagttcatcagatgcacctcagccagctggagcatgttcctgaaacctctccagcccatttctttgcccgtaagatgggaatacatgtgcttattgcagaccgttttcatactgattaaatcagttaatgtgtgtaaagctctcacacagtatcagcacattaaaatcttcagttttgttactgaatgaaggaaccagtcgatgaagaaactagaaattcagttcaatccagtgcctccttgcacaaacagatttgaaatctttggatagttttgaaggaaaaagcatcattgatcattaaacttcatagaaatagtttcttgaatgcagaatgtaagtaacacaaggtctccactctccttaagattcagtcccttgttccacaggcatgaaaaggaccagtcaggcttctcagctgacgtggacacctgataacatggtgatggagaacatttttgttgaggctttgaagtagtcaagtatattgaccttgacctacctggagagcaggtgttggatagagttggggtaagagttgccaagacatcacaaagtcctgatgatacggtattttcattgcactgagtaacccagtgggcatttgctatttatttatttattttttattttttaaaagctgccaaataattatgaaagtttgaaatgttctattaaatatggtataaaactaagtataggctgtgtctgcaagcacccactaaatcatacagtgctgtcaaaaattatttttcagtttctgtctccatggtaggaagaaagcatttgtttagtttagtgggtggacccgttaacattgctggaaacggctgatcgagcgtccctgccttcccggctcttgtcttgtctgtgcggagatagccctgtgttctgccttctggctgtcacttctttagtcacttacagatggcattttgaaggaatgctaattgagggacttcactgttcacttctaactaatcattctgacagaaaacatctcctctgcaaaggaagaggaggaacccaagagaagaagcttttgcttctctgtgctaatgcacgtcgttctgtttcaccctaagatgctctatgcggaatcaactcaaagaagagcagtgactgaggtgttgccagcgtccctccctcatcggccctttctgcatctgctcttcgtgtaatctgtgcccttctttgttcattgccacatattcaggcgactctgtgctgcaacccccgttagtccttccgttcgtccatctatccatcagttcatcaactggataaacactgaccgagtaccttccattagcagaggcagtagagtgtgatggtaaagaacacaagctctggaaccagactttctgagttcaaatctcagccctggcacttattagatgtgtgatgttggccaagtcatttaaaccccagtgagtgccagtgtcctcatgggtcaaatggaataatgatagtgtcaaaattattgagcagttttgatggttaagtgaattattaaatataatgggcttaaaatacttctttaaacaagagaacattcaataaagattgtctactttaattattacatgtgtgccagacactttgtgggagatggaaatatgaataggctatgatcctcccctttggcatcttaagtcctcttataatatgaccaagaagacatttcagataggtcaccttgcaataagtacaatttgaagctactttattatttttatctttggtggcatttaactagaatttaacggttatgttttataactatgtatatatgcatgaatacatttttataaaaattaagactatattaaaaatggtctgtacagcctgctatattataaaatcataaaacatgatagggcccttagaggtcagctggtctaacatgacacccagtgtgagaatcttcccacaatcaccagcctctactcagatccactgggaacagcacgttcatcaatgcatgccattttggctgcagagattactactgagttttttcttttgtgaaattatattctttctctcaccagtacccacttctctgtcacagtttcactttccatgctagcaagaagcatgtataatccttgttttagatggcaacttcaaacatttaaaggtccttcacccaccgtattttcaaaacagtgacttgccaaggttctttctacctaatataataaggccctcctaatatgtggtgtctagaacaaagtacaaaatttcaactatcttatgattagagatggaatttagcagttctggtcttcagcccaaaacagcattagctgaccatcaactaaaacccccaggaacttttcacgttgactgcttccaagctgggtctcctcccaggagttcttaatgcacctcatttttgaacataaaagaaacttttacttttaccccttatcaatttcaactgtcaccataatcttggtcttgtccaagaccataggccataatcttggtcttgtcctaccaggagacccaccccgggcctgtgccatccatctgacaagaatagcttctacatctttaaatcattggcaaagttactgaggagagtagcatcaaggatgaagcaatactcaacctcatcattataataattaacattgatttaggtcttaaagtgctttcacttatagagtgatatttaatttggttctcaacaacgagatggatgacagctaacatgtactgagcatttacttgatggcagttcttatatgtcttatgagttttaccttacttaattctcccaacaatcctatgaggaaggtaatgttttgacccttgtttagaaaggataaaaaacaaggttaaagaagttaagtcataggccgggcacggtggctcatgcctgtaatcccagcattttgggaggccgagatgggtggatcacctgaggtcaggagttcgagaccagcctggccaacatggtgaaaccccatctctactaaaaaatacaaaaattagtcaggcatggtggcaggcacctgtaatcccagctactcaggaggctcaggcaggagaattgcttgaacctgggaggcagaggttccagtgagccaagatcgcgccattgcactccagcccgggtgacagagaaagacttcatctcaaaaaaaaaaggaagttaagtcactttcccgtacaaagttccaggagcaaatgaaatggctgggatttgaacttctctacatgccactctgaaatgtgtgtctttacctaataccccagcactgaaaggtgcagagagtggatttgcccaaatcacaagctttgtaagttgtttctccaagattccaactcacattatactcttagactccctctccctttggactaacaagaacaacccaacaaacgatgttcagccaggtgcagtagagcatcctgaaacaaaccccatcaacgccctctcacgctccctgtgtggttcacagagcaatcgagaaagccttggggaaatgaatgagtacgatccttcttccttcaggcatcaccctgcccatcagcccagccacctacccaactgtccatacgaagttttctaagagaaccaaatcatttcaaaagatcttgaagtcatctgatatataactgaaagtgctcgactctaaagaaatctgaacacaggcaatggtatctgtaatagttcatcctcgcactgctataaagaaataccggagactgggtgatttataaagaaaagatgtttaattggctcatggtttcacaggctggatggaagcatgatgctggcacctgcttggcttctggagaggccacaggaaactttcaatcacagcagaaggcaaaaggggagcaggcatctcatatggcgggagcagggggaagagagagagggaggagagataccacacttttaaacaaccagatctcacgataactcactcatgatcacgagaacagcaccgatgggatggtgctcacacaagcatgagaaccccacccccacgatccagtcaacactggggattacaatttgacatgagatttggtggggacacacagccaaaccctctctgtatctatgaaaagtagagagatctggccgtgcacagtggctcacacctgtaatcccagcactttgggatgccaaggtgggaggatcacctgaggtcaggagtttgagaccagcctggccaacatgaagaaaccccatctctactaaaaatacaaaaattagctgagcgtggtggtgcctgcctgtaagctcagctacttgggaggctgagacaggagaatcgcttgaacccaggaggcagatgttgcagtgagctgagattgagatcatgccactgcactccagcctgggcaacagagtgagactctgtctcaaaaaaaaaaaaaaaaaaggaaagaaagaaagagagagagagagggagagagagagagagagagaaagcaagcaagcaagcaagcaagaaagaaaagtagagagatttacgtagattagagggacagaccaccgccatggcacttttgtgctgggagcgagcatgccaaagatggctctccacacctgggtaagagttcaaagcctttgtgaccagggatactccttggccttatgtttgtcagctcctcttttcttcttcaacttgactagaggaggaaaatgcttacgtcattgtattgtaattgctggtctaggtcctcctggtaagacattaagttggaatatcctaacagctaccttctttatggggcttgatgccactgcaggaacagatgggcaaggagaacccaggagttactgtggaaattggatgcccagcttaaagtaattgggagcagtatggcaggagccatcggaactcaaatgaatccagaagttggtgttagcataatcagcaacaagccaagaactggggagttcctgcagagcctggaggaaagcctttgtataacagcttggtttttaacagcattcctttcccttgaaaacaatgtcatccttcacctaataaatcaggtctcaacaattcaaggaagaaatataccataagtgttgtagtaatgacaatctaggaattcctgcataaataattcatgtattagatccctagtaggttaaaaaaaaaagttccaagtatagcaaaaaaaaattattacatacatcatttttaaatatagaaatttgtttttgttttgggtttgttgttgttgtttttgagatggagttttgctctttcgcccaggctggagtgaagtggcgccatcttggctcactgcaacctctgccctccggagttcaagtgattctcctgcctcgcctcctgagtagctgggactgcaggtgtgtgctaccatgcctggctaatttttgtatttttagtagagacagggtttcaccatgttggccagactggtcttgaactcctgaactcaggtgatccacctacctcggcctcccaaagtgctggggttgcaggcatgagccactgtgcccggccagaaatttgtatttttatgattatattgcccatgtttttttttttccagtatgaatgtaatcacttaactgacaaggcaactaaaatacaaaatgtataaataaaacaatttctattaagaaaaggaaggaagggagggataggaagaaggagagtgaattatgtcttagaaatcagtatgccaaaactggttttgatttttgagactctttttaaaaagtattgtgagaattctgaaaactcttagcccccttttctttcatgtttttcttctagtcgcctcgttcctgagaaatgtcatcacagtaggttatcagccaatggtaaatcgtgacctcttcatctccaagggtctgtgttctattttccattgccttaattcctcttcatcattcaatgtgtcagccatccttttcctggttaatgtactgttttctttcatggtcccctagtctcttagtagtcaagattcactgtcaaaaattccttgttatgccaggtgtggtggcttacgcctgtaatcccaacacttcaggaggccaaggtgggaggatcacttgaggccgagttcaagaccagcctgggcaacatagtgagaccccacctctacaaaaaattttaaaaattagccaggtgtggtggtgcatgcctttagtcccacctactcaggaggctgaggcaggaagatcacttgagcccaggaattcatgcagtgagctatgatggcaccaccacacttcagcctacgtggcagaggaagaccctatctctaaaaaaattaattaaaatataataaattcagatgtccttctcggtctctgttatcttctctgctcctctgtgaacattacttaaattccattataatttatactaacagtttaagcagctccactccggagaataaaatttggagttcttctcacactacaaagacctatgtgacctggccttctgtcctcggcccgatcactttccccttgttgacaatgctccagtaccctggcccttcatggtgttctctaaatgaagcagacttgtcctcttcctagggccatgactctcccttcctggaggaccttccttcagctttttgcatggctgcctccattcatttagccctctaaacaggtgtcccctcccaggagaggcctgcttagaccatgccttccccaaccactgcacgatctcaccctgtaagccagccctgctttcttcatcacttaccactaactggaattacattattcaattgccttgcttattttctgcctttcccctctctccaccccatttcatgggagaatctcattggttttagtcatagaagttttgtaggtattcagtaaatatgtgtttaatgacgggagggaagaaaaagaggaaggaaggtagggggaggtgggaagggagggaggcaaggagcagggcaggaaattccattcattcattcactgaacattaatgggaaattcctagtgccagacttcatgctggaggcagggtatgcccaaagcaatgagcatggtgcctctctattcgcgagcctccataggcgcttttttctgaatgaatggaaaagaaggcacaacccctacctcctacatgaatacacatattatcatatcagtagtcaatatttaatattattcaactaatttctccttgtagttgtttgcaagtctaaaatagatcttagtttacctaagcgaccatcaaaatgtgaataagatggtctacaaaatggtgaaggcttagaacatgggctaaaatcctttttctggcttttcaagctttacccaaactaacctttccaaacccatctcattaccttcccaacacacactcttagttctagaaaattcctttgccatcccacaggccccagactgtcttccttgccttggctcacacagatgggcgaaggggcagtataggaaggagacagtagtgtgatctgaaccaggcaagtgctgggagtcccagccccttcactgagcagttgttactgagcaagcccacttcatgggtctatgcctcaatgtcttctcctgtaaaaagggttgagggataggacttcactcagaattgcttttggattaaacatgatccatatacagtcctgggcacagtgtttatcaggcaatggttcataagcattagtcattcttacctcatcgcccctcaaccaggacacccatctttccccgtctcactccgtggcacctattcactaaactcacttgcccctaacctccatgaagacgagctacacctcccctaaactcttactcagacactgatgtgcattgttactaatatgagctctccttaattaaactgtgagcttcctgaggggaaaaatcaggtcctgctagcacaaagcaagttcttgaaaaatccttgattaaagagtgtatgatagagctaaaaaattggaatgcacaattcattctgctctggtgctttaaattaatattaaatatgtctgtaacatataaatcctagactttcacatttaatcaaagtcttaatcataatgagcagcatttatgaaagggcaattaacagattcccaaaagaactggaaatagtaaattgctaatagcatccctaaggttttgctttttgctctgataaattaagtaatttaataatagaggcagtgtgaaccaaaaagaacgcaggcttaaaaggcagaggacctgcattctgatccttgctctgccagcctgtgactcagcaccagtgacttatctgctccgagcctctgttaactcacctcttatgtgagaagctgtattcataccactgcttgtcagaacacgttcctaaaatccttatggttctatgcatgaaatctgacttcaaatttcatttttaaatatatcatagactatttagaaacaaaaacaacatatacatactcttagcagaaactgaaaattcattattttgtgcagccttgagctaaagtttctgtttaataaagtgaattacaaaattgtaaaatgaggtgtttaaaaaaaaacacataactgtttgccacacttatctgggtatatcagtgtttgcttgatctaggcaacgtaatgaaatatagaaagaacgaaataatacatgattacatgtgtctttcaaaaaactaaatttcaaaagtttgtgttcaccaaaaataagcttaatttattaaaaataaatagtttatctatttctaaaaaatgggtttctggacaatattttctttgctaaaaagtaaacatctcttctacataatcttaagggaccttagaactttcacagtccataaaattatagtcttaaagcctaatagaatcttacagtttaagataaataaacttatatgtttaaaattctcattagattcatcagtgtttccatctttaactgattttcctatactttaagagctaaaataattccatgaaatttcaatataaagcaatatatatataatatataaagccttatatattattgttctaagtctccagattatcccagttcagtctaaaatattctgtttttctcaggatacctctctctacttgaattttcttcattctctcaagtgaatctgtccaaaaaaattttgatttctaactaattcatcacaagtagaagcttctctcttatacatattgcatctaaattttagaaacatcttcgtattcctctaaactttgaccccctcctatataaattagagtggtttgggaggggatgaaaactagcctatggactttaaaataaatatagtttactatggtaatattttcatttctaactccagttgttaccattgattagaaaatcagccctgtctgagtgttcacattgtccattatagaacacaggcaagagcaaggtgaattaggaagagggaaacaggacacaggttttatttcaaaagagccaatggggacattacaggaatcatttgatggagatgcctattcagttttttatcacaccacacactagtataaccaggaaatgcaaggcactctctgcctactctgcctagcctaccaaattaaatctaatttatttcataaaaagacctaaggcatatagtcatctgaatgactggctcggtacacaatgaattccccagaatattaataggtttgttatagcctgaatgttgatttactgaaagtgtcattccagcctatgcatattgattctcaaaagctaatatgtgaccaaaatgcttggtctgtcaaagctgtcacatgagctgatctgactggttcctttgccactgatgctagtccgacctgatttttgcctcaaagaagcagggggaagccggcggcagcaaaggcaggtggttaggagcagacacctttgaggggcaggtggttaggagcagacacctttgagaggcaggtggttaggagcagacacctttgagtcagagcagtggtgctcagttgccagcgattttgtccccaggggatatttggtcatgtctggagatagttttggtcatcacaacagggggatgcttctagcatctagcgggtagaggcagggatggtgccaaacaccatgcagtgcccacaacgggcccgtgagaatggcctggtctcaaacttcagtagtgctgagattgaacaccctgagtcagactccctgcgtttagttctgatgccgtccgtacccacagcttgctttgggaaaccttcctaagcttcccaagtgtcaactgtctcatctttaaaaagagtgaatcccatgtcctatttcacagggcaaagatggttgtaaaaatgaaactaatcgatgcttactaagcacttgggacgctccctaacacgtaacgtacccagtgcatcttagttattgttagtaaaggaaataatgatacaaatagcagcaacaagaaaggctttcttcaggctggatggcccatctagaggtttccagtgcgtctcagcattccaagaggactttggttcaaaagccagttataggagttcagaaaatggccatgtgcaaaacccagaaattttctttaagctgaaaccctgccaggcagggtcttttttaaaaattttcttcaacttttcattttaagttcaggggtacatgtgcaggatgtgcaggtttgttatataggtaaacgtgtgccatggtgttttgctgcacagatcaacccatcacctaggtattaagcccagcatccattaggtattcttcctgatgctctccctccccacaaccccccagcaggccccagtgtgtgttgttcccccatgtgtccatgtgtgctcatcattcagctcccacttataagtgagaacaggcagtgtttggttttctgttcctgcattagtttgctgaggataacggtttccagcttcatccatgtccctgcaaaggatatggtcttgttcctttttatggttgcatagtattccatgatatatatggaccacattttctttatccagtctatcaatgatgggcatctgggttgattccaagtctttgctattgtgaacagtgctcctgccaggatctcactatgccactcccatgccttaagaaataagtagaagaggtcacagtgagtaatagcctatttgagctaccaatgtgctctctattggggatgaggggcattaatgtagatgtcacctttagggatgtgacatgtgaggtaaggatagaattgtagcttattgaagtttagtgaattctgtggaggatccatgagtttatacgctgggaattaatgcaagtccatattctatgagctatgacccctttcctgaccttatagatgaggcctgaaagttcatgaaggcaagcatcctggggctaattagcacttacgcatgacaagcctttcaaccacgctcaatctttatcatggattttcagggggaagccgacatggagcactgtgaaacatttttataactattaaccagtgctttggagttggcctgaaatacaaagccaattcagtcaattaatgcatagctatgaaaatagttatctctatttcacctaactctaagcatctctggcgaagtctcattaacaatgcatgtttttttttttttttgaaacacaattgttagttgtcacgagccggaaagaacatttatctgcagaacacatagagagaaattgctgagaagtcccttgcatcttctccctagcatacttttacaaaaccaaattcactctcaaacttaaaaagaagccgagggagaaggaagaattctgtactgccagacttcgtgattaaatttagtgaagatgctgagaatgtctgtggaaattctcaaaaagctatgaaacattaaatatgccacagttactaaagtctaagctaaaatacttaaagtgcttatgaaagtcatattgtaagtctattataagatggccttttgtttataccaaaaagttggcaagtcctctaggaaaccttgtaaaattaattaaccttgtgcagaaaaacagaaccaaaacatggcaaattgggtcttaaccgtgctgcccctggtgaaaaagcctactcatgatgcttgaaaaagctactgaannnnnnnnnnnnnnnnnnnnttttcctgcttttttattcaggattcaaggggaacccacagaagcctgtgaaacatttacaacaataaccagggttgggagtggcccgaaaacaaaaccaatcaggcaattaaggcaaggctataaaaaagtttctccatttccccaactctaagcatctcggggaagtctcattaccaatgcatgtttttttttttttttgaaacacaattgttagttgtcacgagccggaaagaacatttatctgcagaacacatagagagaaattgctgagaagtcccttgcatcttctccctagcatacttttacaaaaccaaattcactctcaaacttaaaaagaagccgagggagaaggaagaattctgtactgccagacttcgtgattaaatttagtgaagatgctgagaatgtctgtggaaattctcaaaaagctatgaaacattaaatatgccacagttactaaagtctaagctaaaatacttaaagtgcttatgaaagtcatattgtaagtctattataagatggccttttgttttaataccaaaaagttgtgcaagtcctctaggaaacccttgtaaaaattcaattaacctttgtgcagaaaaaaacaagacccagaaacaatgccagaattggggtcattaaccacgtgctggcctcatggtggagaacagccacgtactcagttgaatgctctgaaagtcaggctagcttgcagggaattagccgtaacatagaaagcattcttcatgcttccctgcccagctaatgtgcattgtactttgttcccattttgttttctaaaacattccaaattatgtagagaaagtatgtatttaaaagccagttctcaaactaactagctaatctatggcggctttctcccttaaagaacttagtcatattatttcatgcatctcttcatattcatattgatgacaatgttttcttgacctaagagtagggacaaggacaactttttatataagcttcctgagggagattgttttgatcctaacagaacctaacactgcacgctggcatgctgacaaatattcttcacacagtcaataggtcatgagaacctggttagtaaatgtttgccacacagttcctaaagcattaatattggagccataaaactttaaatgtatcatttgttgtgaaatctacttgagtaacatgctttaaattattcttgtttttatgttatctatttgaatatacagttttcaaaaattgataaattttgttaacaattttacttgagattgtttctttgaaagccacctacatttttcattttaagtgactgctgaattcatcattgatacagtatgatgttgttgcagtctcccccaccccccgcaaaatgaacatatttatggaccagtgtggcactaatgttctaaagtgactccaacaaactcaatccttgtttcttttggcttcccccctccctcccttccttccttctttacttcctttcttccttccttctttgaaaaattgcccaaactaagtttatatgaagagaagaaaatgacagaggaattgtgccaattcactaatgtgttctagggcacaatcagtaagaacaataataaagtgctcaaacagagtgataggatttcatcttgaaactcaggatttaatgacagctgccttttaaaattaccagattcactacctaccctctttgtgcggcaaaggttctttttttccttgtttgtttttgtttttttgtttgtttgttttgtttttttgttttttgagatggagtcttgctctgtcgccaggttctagtgcagtggtgcgacctcagctcactgcaacctccacctcccaggttcaaacaatcctcctgcctcagcctccggagtagctgggactacaggcacacgccaccatgcccagctaattttttgtatttttagtagagatggggtttcaccatgttggccaggatggtctcaatctcttgacctcatcatccgcctgcctctgcctcccaaagttctgggattacaggagtgagccaccgcgcccagccaaaggttctttttattacttttcctgatgccttctgccccctgtactgggtacagaggtaggatatgttgggtgggagagttgataggaattctttaggaaaaaccaatgtgattttaattggtagagccctttctaaaaaaatcttgatacggtttgaatagcttttaaggaatatgtagaaaacagttctatggtggcgtgtaatattttcagttcaaaacactgcccttgactggaatatgccaatgttctttgtggcatctgaagtcaggggcagtgcctgcccacttccacgtgctgctgcctggagcccgcgtctcgtgcttccctcaggaaccccctcttcgtggctgtgaagcgcttttctccttgcccggttaccatggagaaagctgcaccatcagctttcctttccagttaccaatgggttgttagcacactgcttatgaaaatggtttctctaatgctaattagttatagcaatgaaattaaaagcggtgcctgcttttctttattgatactttcagcatgtgctgaggcaggtatttcagataaggcctgaaattactaattatactttctggcaagagaaaacattcacttagcatgtaatgggttagacgttaactctttcttaccttccattgaaggttccagttaggtgatttcctacaaaggagacgatatttcctgagtcttgtctgcttcctgtaatagtgtacttggctccttgtgccccaaagcccagaaccaggaatgcacaaaagacccatcatcgcagtgttattaataccaatggaatcaaactctcgcttctggcattttgtgagtctgctattttaagcaagctgtttaagctctcaattttctcatatgtgaaataagagaattaagattcttttccaggattgttgtgatggtggaataggaaaatagggccagcttggagtgtgcgacctgtacagtcacacagggccccatactcacagggccccatactcacagggccccatactcacagggccccccagagtttgaggctctactgctaatatcttgaaatgctaaatcatttttgaagaaggggctctgtgtctttgttttgcactgggcttcacaaattatatagtcatgatcagataggaaacgctgcagtgataataaatactccaaaatctcagtggcttcacccaacaaaagttcatttctcgctcatgctatggcctgcacacggctgaaggctgccctcctcatcaaggccgaggctgacagaggctcaccttcacctgggcttccatgatcccgcaccagagggaagggagcaaggaattgtgtgctggcccttaaagctctcacctggatgacacttgtcactggtgctcacaactctttgtctagagcaaatcgtgtggcctggtctaacttcaaaggagatgggaagtgcatttccaccttgcacctggaaagcagaggctagggaagttggagaccagccccacactgtcacaatacagggagggggtgccccagtgaccccggctttgtgcaagccacccttcagagggctacattgtaagattccagttttctcctaaaacaaagccaagccaaattgctcaaaagtaaaatcacttaccttttaaaagaagcccttaattttcttattttccaagaagttcaagattcccttgactgtcgtcttccccggggacagagcatatgctcagaaagttaatgttgcagcgtcaggattaaatcctttccagccaaactgagacactgaaaccagcattgctggttccctcattacacttcctcaagatggaagtggcattgctgcttgcgttctgattatacaatataaatgtattattataacacattcaagcaaaatgaaaaagtagaaagttaacataaaaagcaaaaaccagtaagatcaggaatctcactacttattattacttatctttctaggcattttaggatacatacccacacttgaaactttttaaactattagtattattatacatgtgaatgcgtagatagtgttttatggactgctctattatgggcatgtacgtactaaatatagtgataatgatgctatttttcaaatgtcatcattgtgcgaagtaatcacctaccacacagcaatcatacggcatacagaacgatttagttccctgtcctcaggcctcagttacaggttctagaggcagccacttagcgttgttattccagaaattttctgcacatctataagcaaatatatcttttttctttcatccaaattgttacactctatgtataaattgttttcattgttctatagtatttcattttatgaaatatcattatttgtttaatgaattacatatttatatgatgactatagctgcatcattgcattagtatatccacataaaacttatttacttgtttatttgatacatcatttttgttttgtttttgccacaaagtctcactctgtcactcaggctgggagtacagtggcgcaatcagagctcactgaagcctcaacctccgaggctcacgtgatcgtcccacctcagcctcctgagtagctgggactacagcacccgccagcaggctaggctaatttattgtatttttttctaaagacaaggctttgccatgttgcccaggctggcctcaaacccctggactcacatgatccacccacctcagcctcccaaagtggtgggattacaggtgtgagccactgcacctggctggccacatcattcagaattttttgaagaagccagataacagctattattttgggagttaaatgaaataatcctttggaaagtattctgtagatcaactatcacatgtgtaactatactgatggtaaacagtaattatttgaccatatgtcctatctacttgtgttattttattaataagtgcaataatataattctgcatctacaatgtgtaaatctcacattcccgtggaaatcatactgtaaagagaggcataatacatgtgaaaaagagacacataattgtggaactatagcatgagaagtggtgggagccacattactcagtttgcccgaggcaagctgctttatgcccattgttcaggagtagctgctactatgttccctttcactctcaaatttgttcagttgaacaataaatcatattgtcatttgatttatgagtaaatcaaccaggccccaaatcttgaaagagacatccttaatctgcctgtgtatattgtcattttattgtcctcagaatagctaaaatggaacacattgcaactgctccttgttaaattagttcactgtgatacagctcaggtacaacagttcatttgcactttacacaaatctgttgatttaaagccacttttcatgccgctctttcctgcttcggagactggtcgccatcttgtccctctctattccatcctgccaggctgattatcttcccctccagataatactgggaagcaaggaaggcctgcatgagccgtcttcaatatatttgctaccattatcaggatagttacatttgtaatgcttatgcattctaataacatgatgtatctatttaattttcctaatttcccatttgtgatacagaaaactaaaaattatttctaaaaagtattctgaaaacaacttatcctttcacacttccaatgattatccaccaaacaaagttaattttcttctatgctgcaactgaattaagaaaggccatcttcatcaccttgattcattaaccttatcctaaggaaaagtaccagtattttttttttttttttttgagatggagtttcactcttgttgctggagtgcaatggtgtgatctcggctcaccacaacctctgcctcctgagttcaagcgattctcctgcctcagcctccgagtagctgggattacaggcatgcgccaccacgcctggctaattttgtatttttagtagagacggggtttctccgtgttggtcaggctggtctcaaactcccgacctcaggtgatccgcctgcctgggcctcccaaagtgctgggattacaggcgtgagccaccgcgcctggccaagtcccattatttttttccatcaccaatacaagctgctgatcgcctgcaagaagagtcacttcatgtttttaatacttttaaagccaaatgtcttttcaaaatgctgggtaggaaactacacaggaacagcattctctgataattaaccacactggtgagttaagtgctgttggcttttcctcaggatacctcactctccaacatcatccaagttaattagctgacatcatgcgcacttccgtgcctgccttactgcctcattagaactgcatgcactggtttgtgtccaagccatttcacctcagctcgcccaccagtttttctgttagcagctcctgtatgctggctctcggtttccattgccttccttttcatgctggataacgtcttcacagaggatgcgagacagcaaagcacagtctcatttcgttgtaatgacggaatgtcccagtcagagccaaagagtgtagaaattccacactaattccagcacatctccagtgttctcagaaatcgatcactgtgtgactaaaccgccagtgtcaaagaaacaaatcggtgggtcttctgcctcccggctgccctgacttcctgacaactgttcttttcctgggagccatttttaatggcctttttaatcaccatcatcaacagtggggaactctcaataacatcttaagctttaaaatgtttttgaaagtgagttggagacgcataaatatttagattttctcaaggaaaagtgtcttaagtgtctgagttctaaatttgagccaagttttctttgaaaatgtatcccaattacagttgtaaatagtaatcccacaaacaaaagcttcggggggaagttactaaaaacagttgaattccctaaatgttgatttccccacacatcagaagcagcagctttttttaggatgtaattattttcctgatatacattctcacactcctgggaaagagttttagccattttgtactagagatccatttggcagtttgatgaacagtttggacactatcttgaataatttttttttttttcctgagacagagtctcactctgtcgcccaggttggagtacagtggcgcgatctcggctcactgcaagctccgcctcccgggtccacaccattctccggcctcagcctcctgagtagctgggactacaggcgcccgccaccacgcccggctaatttttttgtatttttagtagagacaggctttcaccgtgttaaccaggatggtctccatctcctgacctcgtgatccgcccaccttggcctcccaaaatgctgggattacaggcgtgagccaccgcgaccagcctatcttgaataatatttttaaatatataaaatatataagattgaaaggaaaatgcagttatcagagtaataaaaagaaattcatggtttttaatatgtgtttctttatgaatgaattaaataacaagtcaggccaggaacagtggcccttgcctgtaatcccagcactttgggagaccgaggcgagcagattccttgagctcaggagttcaagaccagcctcggcaacatggcaaaaccctgtctctacaaaaaatacaaaaatgcctcagctacccaaaaggctgaggtgggaggatcacttgagcccaggaggtcaagactgcggcaagttgtattgcaccgcggcactccagcctgggccacagagcgagacctcgtctcaaaaatatatgtaaataaaaataacaagtcaataccgtgcatttaaaatatagcaagttaaagtaaaactttattgtttaaagaaataccagtgcaaagaacatttttgctgagtttacctgggaacaataaaccatgcatgagaatgagtaccctccttcctcgtgatgaccaaaaacaaatcgcaaatgggaatactggaaagcaacgtgaatgtctgggtcaccagtgtgggaagaggtgactgcattcccccaagttggcagctccatcacaccagttgataggacagcagcgatcacatgcaatctactataagtataggtaatagtgggtcaggcatggtggcttatgcctgcaatcccagcgctttgagaggcaggcagatcatgaggtcaagagatcgagaccatcctggccaacatggtgaaaccctgtctctactaaaaattagctgggcatggtggtgcatgcctgtagtcccagctacttgggaggctgaggcaggagaatcacttgaacccaggaggcggaggttgcagtgagccgagattgcgccactgcactccagtctggtgacagagagacttcatctcaaaaaataaaaataagtaatagtgggccgggcgtggtggctcacacctgtaatctcagcactttgggagtctgaggcaggtggattacgaggtcaggagatcgagaccatcctggccaacatggtgaaacccagtatctactaaaaattaaaaccaaaaaaaagttagccaggcatgatggcgagtgcctgtagtcccagctactcgggaggctgaggcaggagaatggcgtgaacccacgaggcggagcttgcagtgagccgagatcacaccactgcactccagcctgggcaacagagcgagactccattgccgaaaaaaaaaaaaagtaatggtgaacatagttggtatttcaaggtgtctacagctgctctaaaatcatacgaagatatctgtgattctcatctatgactaagtcacagataccactaacactactgatattcatacctatgtttataactgaaggaaacaccaaacttcaggtagggattagtgatattaaatatataattaattcccatccaagttcacaagctccacggactcctgttaccagtctcaatcttataggaaacaagaggcttggtctatggttggagcaggaaagacaagatgaaggagaataactatggggtagccaacaaggtaagagttatgaagagccattacacaccaggccctgtgctgggcacttccgtggagtagccaattcattcctcacatgactgcaccatttacttgtacatggtactagtaaacagtggcgccataatacaaatccatgccaccacaggagaggtggagtgacttactggtaagtttggaaagagtaaactgatcatgctccacgcccatttttttcttggtagcagatgctctgcagagaacttatattctgctctgtttttcgaggaagtctggctctgcctaagcttgggtggatagatttccacaagcataaaatttgatattagaaaacccgctagtctacatacacaagtcatgccctccatcctagcgatcttgtatataaaaatgccactccacctgctctcctttcttatttacttatttttctattatatatagttaaggtgtacaacatattttgatatatttatacatagtgaagtggttactatactcaagcaaattaacatacttatcatcttcatggttacttttttcatacgtatacagtaatagcacctaaaatctacttttttgcaaattttcattatacaatattataattatagtcctctagtacatttctagaatatttgtcctacctgtaactttgtatgctttgacccatatctccccattttctgccacaattccccccaccacttccggtaaccaccattttattctgtctctatatatttgacattttttttttaagattccacatgtaagtaagatcatgcagtactttttcctgtgtctggctcagttcacttagcataatgtcctccaggttaatacatgttgccaaaaatagtagaatctcctttttaaggcttgataatattccattttatatatatatatgtatataaataaatttatggatatataggtatctatatatataatgctcccctctccctaatatatatgtatataatatattccacaatttctttatccattcatcctttgatgcttacttaggttgtttgcatatcttgctattgtaaataatgccacagtgaacataagaaggcagctctgtgaggtgctaattttacttcttttgagtatatactcagcagagagattgctggatcatatggtgctatagttctatttttttattttttaaggaaccttcgtactgttttccataaaggctgcaacaatttacattcccaccaacagcatgtcagggttcccttttctccaacccgtgctaccgcttgttatgtctttttgataatggccatcctaacaggtataagttgctatctcatggttttcatttgcctgtccctgatggtcagagatgttgattaccttttcgtatgcctgttggccatttttatatcttttttggagaaatgtctattcaggctctttgtccgttttttaatcaggttatttggggttttttgctattgagttgtaggcatttattttacattttggatattaaccacttatcaaatacatggttttcaaatattttcttccaatctgtaagctgccttttgattctgttcgttgcttcctttgctgtgcagaagctttttagtttggtgtagtccagttgtttattttcacttttgttgcctgagctttggtgtggtatccaaaaagttattgccaaggcgatggggtttccctgtgttttctactaggaatgttatgatttcaggtcctatgttaagttctttcatctatgttgagttgatttttgtgtatgatacaagctaagggttcaattcattattttacatgtggatatccagttttcccaataccatttattgaagatattatcctatccagataccattgtgtcttcttggtgcctttgtcaaaaattagttgacccatttttcttttcaagctgagacagggatagtaggtgtcatggattgggtttccttaaactcccaacacgttctgcaagtaagacttgctctcttctaaaggcatccattctattttcaaacagttctgatttttacaacgtttttctttatatctagctaaaatcaacctccctctgttgtcctggggtacttggaagccttagtccttctgtgaagggcttatccttcagtcattaaagcaggccatgaagaagattaccaactctacaaaacaccctggtccaaacatgcatgtgtccttccttcttaacatggtcaaaatactagattaggtttttcaaaaatttttcaaatgagagagaacttcttcttcataggcttcagtatttttttttaatgtctcccaaagttggtattgaaattaaacagattccaggtgaggtcttgccaccacatagcaaaagaaaactatccacaccttcagtttatgctgtatttttctattagtgttaccttagattaatttaatctttcatagatgcatttattgtatgttaattatctttatgacacatgttctgttaagctataactcccacagccaatatagctgttacatatattctagtactgggatttaaactcttctctaaaagtcggttctgtaatcttgttagattacccagtgatgtcagacggtggggggatgtttttgaatcctgattctgtttccgatagaccatccaattcaagagcatatagaaattaggtcatcattctgtcaaggtctattttcaagttgttaatgaaagtgcctaagaggatacattcttcattacccaatccatatttctccatttctttctttttcatgtcttgaagatttgttgttttgatttggtttggtttagtttggtttttcatcctagtctaatgctgacattatactgggaacttattgaatattcataagtttgaattcataaacaaatattttcttattataaagctgcttacgtaggtgtatatctgtaagtgaaataaaacaacatccccataaccccaaaactcagacattgcagactctgctaatgtttggctatatttctttctaggctttttgaaagagcatttttctaatgtacatttttcactctattcattacctggcctttctctgtctctccctctattgagagggagtggttagtccagtcctaacatttgcaggacctgggataagaagacaagtgtgggttcacatggccctcatctcaatgtttaaaaattctaaatcacactagcaagctgttaaataaaatacatgctatcctcttaccttaaggagtacaccttcataaggaccttagaggccagattctaacttagaattctctgacccctcagaattctttaccagaacttagtggaactgggagagtcagcccagaccccttctcttgtctagctctgccctgcctagaaggttctctgcacacacataggcagacacccagcccacaaatctcagattcatccacatcccctacatgtggcagcccttcaggcagccttcgggctcagggtaggcacatcactggaacagtccactctcagaaggacagatgggaggaagctgcctacacaagccctgaatcaagcccaggccatttgggcagggaattctggggctcaggtgcctggggcatagtctgaagggcaagcatgtgctgttgtgggtgcagctttttagctccacagactctttgctccaggaagaggggtgtggccagaggagggccagggcagaaccctctaagacataggacatctcttgagtgggtcaaagggttagactgggagtgcttctcaggtaatccagagtgtcctgctctcaggaagttctgatccgttgagaattactcttgagtgttcataatgggagttccttctacctagaggaaaacctcaggtcttccaccactcccagctccagcagaagagtgatgagcactgggtagagccgttgaagaggggaatgaagatttagatgagtgactacattaaataataccctaatgggcctatgacagcaaaggtagtaatataactaaagcatataatcaaacacaaaaattatgtggcatagactgtacaccattattttagtgtaggttacaaggctcagactgtctaggtttagaccctagccagagttcacttcctagctatgcaattttgagcaaattaacttctctgtggctcactttcctcttctattaaatgggtgttttttaagagtgcctaccttggtgaattgaaggaaactatgtatgttggatgttcagcctagcaatgcccggttcatagtaagcactttgcaagcattagctaatttttaagcggaacaattattattaccactattattaatgctatgctatagcttctatgagaaaatgcaggctagtggtcctctacctctcacagttcagtaatatgtgtattagtttccagtggttgctgtaaaaaattatcacaaatgtcatggctgaaaacaacacagatttattttcttacagctctgtaggtcggaagtcctaaagttaaggtgtcgcagggctgcattccttctggaggctgtgggggagaatcctcttttctcccttttctggcttcttgaggctgcctggattccttggcttgaggtcccttcctccatcttcaaaaccagcaaagtaaccttcaggtttcaatctctctctctttctctttctctctctctttctctctctctctctctctctctctttctcttgttcactggacccacctggatagtccagaattatctccccacctcaagacccttaacctactcatttctgcaaactcccgttgcgatgtattagtctgttctcacactgctatgaagaaatacctgaaactgagtaatttataaagaaaagaggtttaattgactcacagttctgtatggctagggaggcctcaggaaacttacatcatggcggaaggcacctcttcacagggtggcaggagagagaatgggtgcccagtgaagggggaagcctcttataaaaaaagtcagatcttctgagaactcactcactatcacaagaacagcctgggggataccacccccatgattcatttatctccacctggtcccatccttgacatggtggattattacaattcaaggtgacatttggatggggacacagaaccaaaccatgaatgctaccatattcataagttccagggatgagtacacagacatgggggaggtggcagtattgactctttggcagcattttggtggggagtcattaggagatgcatgaaggaattttacttggcctgtagggagcgcccatttgtgtactgctgggttttaaagtaggaggaagttgccttggttgtagtcagcattatcagttaaccaggttggtgttgagtatgtcttatgggaaggactgacaggtgtataggctgacagtgagcatgagggccttcaactgtggccacaaggacaacttcacaaatgaatgaacatacactgtgcatgactttcctgtccttgagaagaacatacccaagtcctctgaggctggatcctcccggcagctgcattagtggtaaatagcagagtaattccccggccatggatgcaaggacaggagatggtaacttagactgtggtgacaccttcacttaaatctgagccttcctgaaatatgagtatttgaaataatagcagacgacattgggcagatttcagtaaaggatgaatgcatttttaagtttctaaacatgttaataagcacatgtcaataaatggggagtgaggcaaaaatggagtcaggctgaagtacccccttgccatttaaaggatactctgtaggatttgacatttattatggttgacttttcaaggctgagtattttcccagacccactgcctcttctctcttcctgtctacacctggcgtagtacactatttcagattgaagattaggtttggctgttttttttttgtttttgttttaaagtatagggtaagaggctgggcatggcggctcatgcctgtaatcctagcacgttgggaggttgaggcgggcggatcacctgaggtcaggagttcaagaccagcctggccaacatggcgaaaccccgtctctactaaaaatacaaaaattagctaggtgtggtggtgcgtgcctataatcccagctactcaggaggctgaggcaggaaaattgcttgaacccggaaggcagaggttgcagtgagctgagatcacaccacttcactccagcctggttgaaagagtgaaactctgtctcaataaaactaaaaataaaaataaagtgtaggctaagggagtgagaaggaatagaattttactctttctcacatgaaaaaaaaaagctggaagtatgcaactgacggacagtgtgggacctccatggtcacaagggagccatggccattcctcctgagaatgtagctccctggaatccccaggaaaccctctactcacagctcactgatcagccctaatgcaagcaaggctggaaaagtagaattttgctgggcacatagttggtgttctgttactgaggaagaagaggaacatgaatattgggcaggcatttgcagcctctgtcgctcctgcacatcctttgagactcctctcaagcgtcatcatctccaggaagccttccctgtatcctccttttaggctcagcacctctcaacctgcattcccatagcaatctgcatgtttctctgttatacaacagtaaagcattgtattaaaattgtatctaggtcttccccattggaccatatgcttacagagaaatgcccatcttactcgtcattacactcttaaatgcccagcacatacaagaacttggtaagtgtgtgctggactgaacttatcagttaataacgtatatactccatagggctagaatcgtgttcgtattatatgtgtctatatcaaattcaccgcacagtgccaggcacacagtccactctcaataatatttactgatgaatgggtgaatgaatgaatgaatgagtgaattatacttaagacagaagggtgtagatggaagaagtctctctcaaaatgccactttcccagtacattgaaaaaaacaactattcgtcagcacaaatggctcccccagcagcaggacactgatgagcagtaatgagagaggctttttaatccagaggcaacagtgagaagaaaatgaaatcagtggcaaacaatcctggtttctgggatgtagaacattctgcagagagaagttggcttgtatataaggacgcgaatctagacaggaacctcttgatgagatttcattcctttgccctgaaaagaatattttatttctgccaccagaaacaaaagaataaaaatccctcattaactaacttcgtgtgactgtcccagaaaggaaaaagcttgtatgcccatctgagaaccatagtcttgccaagagaaccctgagattccactctttttgggctctacttgacagctttgaaataaatctatcaatcacttgtcagaaagcctgtccttgggttgtttgtatgtctgtgtgtctgtgtgtggatgtttgccctagcagtatggctgcatatttatttaaggttaggccctcctgttactttgagtgcagtccttaccagagaggatggcaaatctcagagatgtactggcttatcttttaatatgcaaactgtaccttcatcctaacatccacagtgtctgagttagttgagcaagcagaattgtttaagcttctgcctaaacagatcagagcagatgagtgcaaaaatagaaactagttgactggaggagaaatgataaaactattttctagatttctaccgtaacaaaaagaacaagccaaacagcttacatagtttcagagattttttaacccatcagagagctgagatcaaaaaaaacctaagtgaagaaaattactaaaagtaataagactttcctggaagagaatgttatcagaattgactaaatcattcaacaggttaacagaagactgagcagaagaggtaagtatcaatgatcttgaagagcggtcaatataaactgttcaaatagaaacacagggggatctaatgtacagcatggtgactagagttaataatgttgtattgtgtacttgaaatgtgctaagactaggtcttaagtgtcctccccacacagacacacacacacacacacacaaagataactatgtgtggtgatagaagtgttgattaatttgattgtaattattacatagtgtatacagatatcaagtcattattttgtatgtgttgaatatatgattattatttatcaattatacctaataaagctggagagaaaggaaacacaaagtgaaaaaaagtaataaacatagaccagagtatccaagatctggtgaatatcaaacactgtgtaattggaatccaagaagaaaaagaaagagaatgggccagaagaaatatttgaaaagataatggtgaaaacttttccaaaactgatggaaaacatcaaattaaatacccaaaaagcacagtgaatcttaagcagtagcggtacaaagaaaacaatgtgttaaaacaaattgcagtcaaaatgctgaaaacacaagataaggagataatgttaagagctgccagagggaacctcattgtatggagagcacggtgataagagtgagggctgacttctccatcaaaaacaatggaagccagaaaacaatggaatgatatggaaagaaaaaagtatactaaaattccatgtctagtaaaaaaaaaaaaatccccaaaagaaaggcccccaaaaataacattttcagatgacaaaagctgacagaatccatcagacttgtactgcatgaaatactaaaatcacgtctgcaggttgaaaggatatgaagtgaagcccagatctgtacgaaggaatgaggaacatcagaacgtataaaaatgtaggtcagctccaagatgattttttaaaatcccaatgttaagaagtcatcattattaccaaaagaagcaagccagaaagcatgtcgcctttcaaaaagaactagagcagtaagcaaacactgaggcagaaaggcctaaagcaggtcctgcatgggccagtctcgacggtatgaaagaagactcaccgtctagactgctgtctctgtcgctgcgactttttgcatactccaagctgcaagagtcagtgattgaagggctttctaacctctgcagctcacctggagaggatcgcagcctatcgcttttgttgaccacaaggacctgagctctgcagaagcagttgtcacctccttgaagagctaaggcttccaaggagatattttgtgggtcgaactggctaagcaaaggggagcaagtgacccagcaagcaacaggtggggaagccaaggtggaggaacttgtgtattgcctgatggttttacctgacatttgactaattcgtttcactggggattcataagagaccttaggggcctgtatgtcagaatttgaggtgtgacttactttggagcccttcaaggcattatttaattatttggtaattcatttttctatttgtctgctaatgaacatgagtttacactttctgagaaattaccaataccaagactgtagttacacaaagaagttcaatgatttccttaggctaggtgggcataggatggtgttgactgcagatgggcgtgagaaaacctttttcagaacatggaaaggttataaaatacatcctgattgtagtggtgcatatattgccaaaactcatcaaagtatacaattaaaactgacatatttcatattatataaatgatatatagatgaagtttctttaaaaaagaaaatctgagattcaaagtttccaggaatgaaatgtgacttccataggaattggccaactccatcagttttcccaatccaatccctggcttgagaaagtaccagctgggcatggtggcccacgcctgtaattccagcactttgggaggctgaggtaggcagattacctgaggtcgggagtataagaccagcctgaccaacatggagaaaccctgtctctactaaaaatacaaaattagctggacgtggtggtacatgcctgtaatcccagctactaaggaggctgagacaggagaatctcttgaacccaggaggcggatgttgtggtaagccaagattgcaccattgcactccagcctgggcaacaagagcaaaactctgagccaagatcacaccattgcacttcagcctgggcaacaagagcgaaactccttctcaaaaaaacaaaaacaaaaacaaaaacaaaaaaaaccctaaaggtctctgtatgttgatgtctaccatcctagctctatggagtacagtatcttaaatataagtgaataatactataatattgtgggatagttgcagggcttggatttaggtgcttccaaaatttggatggaaatgttggaaaagtgatcactagataaagattatacttccaaagtggacacttgatctttaccactgtgtatgcagttctgatgttgctttagctggggctgagtttcagccaagtctttccagcttatagtacattgaatttctcattcatgctgaatcaaaactttggcctttacctgtaaagtttcagtccatgggaaccaagaaattggaatactccatatctggatatcaagatggtcaaagaaagcatctggtaggtatagtgtaggttgatgtaaagatccctccaaccttggtagttgatgccctcagaaaagtgctgccagatcccaaatgcatcctgtccaaaatcaaggaggggcaggatgatatggccaatttcaggatttttaatgtcttcttagactcagttgacctctggaaaacatgattcaagagccagttaggcaggatcagtaaggataagccaggtagaaccaaacagtcgtcattctgaaagctgggaaagttttggcatccttggtaacaagggaggaggggtcaggagaggcaccagctgacagtgaagctgacctggcagtcaccttccagaggccgtgctgaatctggatgcctcaggaattctactggtgccccatgccaccttcttcaataatatatcactgaccactccagccagaagggctcacactgaccttggaaccccttggtgctcagtcacccataattctcattaggtagttttttctctatttagtatttatgtaagtatttatctctctgactttcctgttgcttccagtacattgcagtctactatacatagaacttctgacatcttcatgcccctatagcctactgtagtgccttgttaatactaagtgctctaccaaacaaaaaaactgagtgaagaaatcctgaggaaatagaaaatattattggcctcagacctattaagccagtttagaacaaaaaaatcatggattatttaaagtatgccaattttgggatgaaagtgtattctgtgtgtttttattgctaccgttctccagagaaacagggtgatattttccagctacagaatgttttagcagcaattcccaacgaattcagcttatttttcagcaagttaacctctgttaatgacatattaaattttgatttttttaatatgatcaccctggggagacattcaaagtagaccttttaaaataagggtgagctatattgctgatcagacatcatggtgtcatttcacttcagagaatatttttccagaaagacacacattttaatgactggtcaaacatactaaccatcttatctttgctttgggccatataactaatttagctagtcattagcttcaaggtaatggaagagcacgttctacagtattaactgaataccaaatcagctcctaaaatacctctccctgtggtatttcgactgaaaaatgccagcttatgccagcttataaaccacagatagctggaagttcaggtgattcagaataaaagcatgctgtctagataacattgttagatgtaaatgattcaggctcacttttgatctgatctctctagatggactagactttggtcatattggaagacagtagaggctaatattgtgcaaagatgaaaaggatgagacaaagcatgtgtaggtccctaccgtagtgagtccccgctcattgcaggtggcggcatttggcactgttgactgttccctcccctgctagcttgtgggtgcccttctcacccacctttccagccatcttcccccaccattgccatccttcacagcccacattacaagctagtcttccacctgccctttaaccgctgttattttcaaggtgaccatccttggtcctctcttcaagccaagccctccctcagaccttctcgtgtatttctgcagttctgactgcctatagttgataggccccaagtctgtgtctctaactagaccattctctagagctcctggattatacttcacattgcctactggatacctccatttggaattttcataagcatttcaaatgtaaaatgtcaatatttgagctcatttttccacctcttccctcacccacatgcaaccctgtcctgtctcttcttacctcggtccttgcaatgagtggcacttagaatcctccgtgcatgtattccagacccttttatctccagtggctgactgataactgattgattccagaaggccagtgattcctgcatccacctcctctttcctattaactcagggtccccactctttacctcaactactggaacaacctacactcttcctgccttgagtgtattccccctagtaatccatcctttatccccataccataaaatatgctcataacaccccccataaagtgattccctagagcttaaaaacctcagctccttaagaccatctactttgttttctggaccctctggcctcatcttccacctaccctccctctccaccatccccctcatctccagcgacaccttatacttaactcatgttgaaccatttccgggtccggaactcactgagtacttttcagacctccagacctttgcacaggccgctgcttcctctgagccactggctagcaaaactctttctctgtccctgaggacaaacttgacgttcagttctgttttctgaaaaactgatgcaggtggaatgtttatggggttaatagacagtaagtacttatgataaagatgactcttggaccgggcatggtggctcacacctgtagtcccagtactttgggaagccaaggcaggcagatcatgaggtcaggtgatcaagaccatcctggccaacatggtgaaaccccgtctctgctaaaaaaaaaaaagaaagaaaaattagctgggcgtggtggtgcgtacctgtagtcccagctacttgggaggccgaggcaggagaattgcttgaaccagggagtctgagattgcagtgggccgagattgtgacactgcactccagcctggcgacagaacgagactccatctgaagaaaaaaaaaaaaaagataactcttggttggtgtgtgggatcttgacaggcaggactgtaaatgaactataaatacctgggagaagccacagctgtggacatccctggaagtcatgctcacggcgatgaagttgtgtcttcttcagcttggccttgtgcccccggaactcctgccagcacatgtggcacctggggcttctaccccagcattgctccttacctaccagcatgtctccttccccaaacccaagtgatcacgggggttcagagaagtgtcccctggcccttcctgctgatatgctgcttcttgtcctgtgtccttctaaatgactccaatgccaagtatagcccattatattccagagatcctaaatggatatttgggcctgagactatccagagggagtatggcacctcctttgcccattattcccaagcaatatctaacccacttttcaagatcttggtcaaaggcactctcctctgtaaacacacggtgcccatcaacaagaattaaataaaataatcttttgttgcaacctctgtgacatcctaaaataacacggattatattcctattataaactttggttgtattaccaccaaaatctgtcctctaagcagatgacttattgagggtaggatcaattgctgtttatatttgttcgtactattcctgcaccatgcctgcttcaccctgtggggacacattaaaagttgaatggttggatgaatggatggatggatggactgatggatggatagttgaattaaaggaaagaagcatatgtgatttgatggataaatagatttttttttttacaaaatatcaacagccattttcttatctaaataaaataatgtaagcagcaccaagaaaccaactttcaatataatagtttctgctgacccatttctgggccagaaatctcccattaggggtaagtcattgaaagcctctaaattatgaagaaggagacaaagagaaaaccaaataactgaactgttataattatagcaaatgttatggtggcaccagttagctagtttcctaggaccctggacaaatctacatataagtggaaacctctaaacagcgatgagaaaaacgggaaaatagcttgcttgtgagggagttctagggctgacagcaggatggatctcagagaagctggggcatcaggaaggcctgctaccctgtgtgccagaagctctaggcattcctgtgaacagatccagggattcagggaattccatccttcccactactttgctcagaaccaggtccctgcactccacactaagaaatggtggctccatttgtaaacaggcctctgatttatttcaacatgtgcacagcttggactttctcaaaagtaaactaaaaccaaatgaattacttaattcacaccatattctggaattaatagtcacttcaagggcatttctgagaatgttctcattcttaagagagagaccacagcatttcctttaggttgcagactggcaggaagagaagcccacaaacacactgactgtcaagttcgatcaggtttccactgtaattaacctggagaacaagtcttacctgaaaaatggtgatcactgagggcaggtgctaagtaccacttctgaaagtagcttcttttggctactgggccactaacaaggccctggctgtcagcagacactctctgaggaaggaagtgcttgtagctttagaaagctcagccttgccttaaaatccctcctggatactatcatggttttcattcctgtcttccctccagataagatgaagggatttgaggctgtccaaataaagatatgcactttaaaaagaaaaaaaaaaacatgaaaatggcttctggtaattataaggtttagaccaaggatactagcaagtcatagtgaccatatgctcttcactttcctaaaaatttacgaatttctggcaaagtcagtatttctccattgacaagcttgcctacccacagcctaacacatgcagactacagaattccacagacatggagttactgtcatggtgagcacgaagctaataaatttagtgcccattgctctgtagaagaaaacaaacatatattttaaacacaaactttgagcttaatggctgaaatgtttttgtaccttggaaatgctcctttgctattaaatcaagggtaatcatagttcatttaaatgtaggaaggaaataattgatgttttcacattactgagcatttggttcaaacactggctctgcagtaaacagcatgcagacattttaggagacaggcagccggcaggaggtagacagacggctgcctccaccgcggcgagggccagggagctgtgataacggcttccaggtttgcatcagctgcacttatggtcgatcacaccaggcacccgagatgctggatgaaagtgcttcacaattccccctacttaataattaaaatttcaatcatattctccaataatgatcatgattaaagaatgacaacacgtttctgaaatctgtaagtggcagcagagacaccaggccttctttagctcgataagcagctgcactaagatttatttatgttctgtcaaacccaaaggttttcttaaaggaggctaccctttttctttcaagctaaaggaatctgaatgtacaaagagctgtatttctctttttcttcttataagtattcccataacagctaggatattctatttttctttccagagttttgagcagcccaagtaaatcagaaggcggtcattgtctgcatgacagttcagcttgtgtcccataaaagcccacaacccttgaaacaccaaatcaccttttctgcaggtcttttgattattggcgtccttttcccaaaaaactacaaaggaaagacaaaagaaggccactatttctttaacttacatgtgcggtcatctacaaaatgttggacttcttatcacacatgttttcatattaagagtgtggtaacacacacacaggaagttggtggttcccattctccctattttcagaaccagtctcttctctagagacacgtttgtacctaacagtagattttcatattccttgattttgctttctgaccttcttggagttttcagtaatgtatcttcagccctcagatcacagagcattcattaattcattcatgcatccattcatcctcccatccatctatccacacattcagcagtcatgtcttatcattgttctaggcactgtacataaatataaacatgaattttgagttatttatatgacatccatgtatcctttcagaatacagttgtatcattgtagggcaattagaagaggtaatttctattaaagtagtagcttttttatttgatgttttcagtagaaattactagagttctctattcagtagggatgcattcagagttagtgtcaatatattgtgtaagtggaggaatcttgaatagttggatcctgcattggcccagctgcccatcctccttgcaaagtgcttaacagagacacatgtgtaggaaaagtaatggaatgcattattattagccttggctttattacaaaatctcatgggtttaactttggtaaaactgggtgtaccgagtggagaactcctggactccaaagaaccaagcggtctggaagagagccttgcgtagcgaagacgctcagtggatatttgttaaaggaggaagttggactattcagccttgctctcacaccgcccttccacgcccaaacccaggtcctgaactcagctctctggtaggaccacagtggaggcaaaggctctgagagggcaagtgtttggcttcaaagtccaagtaccactccaggcctcttccagctgccacactacctctgtttgcctaggagaaaaggttccctgagcaatgagaccatctcttctcctgaggaagccctgagctctctgggcatgtgggtggaagaggaagaggaagggtcatgtgcatgtaccccagaccctttcaccctctgaccacccatacaaagcagacccaggtcagcattcgcaaacccaaagagcagctttcttttggtacagttcagtgccctgtccttgatcctctttattcttgggcaggattcaagctggtgatgtgggagattattagtcagggttctctagagggacagaactaattggatagatgaatatatgaaggggcatttattaaggagaattgactcacacgatcacaaggagaagtcccacaatagactgtctgcaagctgaggagcaaggaagccggtctgactcccaaaacctcaaaagtagggaagccgacagtgcagccttcagtctgtggccaaaggcctgagagcccctggcaaaccactggtgtaggtccaagagtccaaaagctgaagaacttggagtctgatgttccagggcaggaagctttcaatgcgagagaaatttgaaagccggaagactcagccagtctaggccttccacacccttctgcctgcttttatcttagctgcactggcagccgattcaatttcgcccatcctgactgagggtgggtctgcctctcccagtcccactgactcaaatgttaatctcctttggcaacaccctcacagacacacccaggaacaatactttgcgtccttcaatccaatcaagttgacactcaatattaaccatcacaacacaggagccctttgcttcccctagaggccaacgttctccttaggaaaacattttttcatagtgattttgaactggaagaaactataaacacacatggccagccttgaaattcttttcaatatttgtttctctataatatgttgatatgagttaaagtatgtgtatatgtatttatttgtatgcacctaatttttttttttttttttttgagacggagtcttgctgtgtcgccaggctggagtgcagtggcgcgatctcagctcaccacaacctccgcctcccgggttcgagagattcccttgcctcagcctcccaagtagctgggattacagacatgtgccaccatacctggctaattttttgtatttagtagagatggggtttcaccatgttggccaagatggtctcggtctcctgaccttgtgatctgcccgcgtcagcctcccaaagtgctgggattacaggcgtgagcccctgcacctggcctgcacctaatatttctgtaacttcatggcaccagggaccggatgtgatttcctccactagaatagcctacactgataggcctctataaaaaaaggaatgattaggatgctttcatttgaaatttttctactcactgggtagcatttagtaggctgatgtaaatagcaagtcattcatgcagcaaatatttctgcagtgttttctgcatgctggccattgtgctgggtgtttagaacacagcgtgtcaggccgggcgtggtggctcacatctgtaatcccagcactttaggaggccgaggcaggtggatcacaaggtcaggagttcaagaccagcctggccaagattgtgaaactccgtctctactaaaaatacaaaaattagtcgggcatggtggcaggcgcctgtaattccagctactcaggaggctgaggcaggagcattgcttgaacccggggggcagaggttgcagtgagccgagatcataccactgcactccagcctgggcgacagagtgagactccatctcaaaaaaaaaaaaaacacgtgtcaaattaaaccaaactgacagtccatcgtctcaagaagtctatgttctaataggagagacaggatatgacaaatctagatgtaatataatgtctagagaaaccagtgttatgaagaaaaatatagctggggaagaaaagacagagaaactgagacaactgggggagtggaaggatgactttagacaggctagatggttttactggagaggtgatgtctcagcagtgacctagatgaagttatggaccagagaaagtcactcaggaatccaagttaagtgcaattggcctccagaaagtagtcaacctaatgggacttcagtagccctaatggtgggctggatttctcacactggctttggtgcttttcaacccacatattctaaatttcagtataactacaatgctggcgcaaagttcccccaaaataaacttgggcttgctccaagaactaacagtttcaaaaccccagatattaagaaacttccatgactatcattatcattgagttagagagcacaccaaaagcatagaccaagcttagaacctggaacctggactcaagaccacgaatgaactgctgttcctcctgcctggttaaggaaggaattggaaaggattcctcaagcagtcaagggtttcccaaagccaccctaaccccagccagtgccttcttcaagaacttcagagtatggagaattacccaaggatctaataacgtgagcctgaggtctttctttcacaggacctaggataacatggaaagtgagctcaaaagacacaggctatgtgccgtcagtgctaatgccaccccgacctatagaacccatgctgccgttctgtgacccaaggggacatcgccaaaatgctgctggcaaccctagcgagttgtgtacattgttacttttaggtttccttccatctcagaaagaaagaaataaaaagaaaccatgtgtggtctgtgcttgcttgacaaattagtctctcaatgtatttactgacatcagaatttgcattgcagacaccaagaaaacacttctgttatatattgtagtaaagaatagtaatgctcttttagttcctcatctcattaaataaaaaataagatactaatctttccctctgaagaattcaactaccaactggtacattactgatttttctatgtgaataatgtgtatagtaacaactagtattcccagaaagggtaatcataaagttaactttttttgaatttggggagaggggaaggggaggggaggggaggggaggaggaaaggaaggaagggaggaaggaagggagggagggagggagggagggatggaccgaccgttgtgcattagttggagttctctttatttcaaagaattgacttacatagccatggaggcccccaagtctgaatcctacagggcgggccagaaggttgggaacggagcaggagctgatgttgtaatcttgaaacagaatttcttcctctgagaaacctgttaaggcctttcaactaaatggatgaggcccgttaagattatcaagggcaatcccactgattgtagattttaaccccatctacaacataccttcaccacaacacccagagtaatgtttggttaaaaaaccaggtactagagacaagccaaggtgatagaaaacacacgttgtttatctacacaggcaagagtctgagaagtatctgaaggatttaataacacatgcacacacacacattgtgggagtttctatagcatgatgattaagagtacgaaatgagtgacagagccacgacgttaagcccaggcagtctgactccccgccctcctaactgctactcagtactgttcactggttcaaggctcaggccctcattggctataaaggattgaatattccattttttaaaaactttcatcaaatagattgtgggaatgaatggccttagaatttgcaactatcaaaaatggctatgagagatatcaaaaatgcgattgaatacacgaagaatgtgtgtggtcctgtatagactttgacaatacagaattttattaagcctgacgtgaccttgagatggaaatatatttatatcttaagagcacaatagtgcaaaattctgccaagtgacttgaatggaggtattttatatatatataaaatatatatgatattagagagagagagagagagaatttggatttaaagtcaagggctccctgcccctcgcctgtgggttatggaatcatcactatggcaactataaatagggctccatggaacccacttggtcaccatgaagaatctagtcagcaccccagctaaacgttttgattataacgcaactacaagcaaattgagaggacaatcccaaaaataatacaggaacatcacctaaaatagttgtgtgggatggtgcaatagtttccttagtagctaatcatctttcaccctaaaagatttagaattaagtagagaaatgttttaaagaattaaaaaacacagaaccaatattttgtattaaggaatttatacatacttgaacttctaaaggaatgtggttaattagtgaaacagctcagccttgtgacttagcttgaaacacaattgagtaattgactgaggctagggatattaaattgaactctgacaaagtttgtaaacagtatcaaagcctttcagagaacttaaggcgcactatatctattgctttgatttatttataagttatttaagtcctcaggaaaaacaaaactattttttaaatcagactttggaagtacttaagagtgtgttaaggccgggcgcagtggctcatgcctgtaatctcagcattttgggaggccgaggtgggatcacttgagatcaggacttcgacaccagcctagccaatacggtgaaagaccatctctactaaaaatacaaaaattagctgggtgtggtggtgcgcctgtaatcccagctactcaggaggctgaggaaggagaatcgcttgaacccgggagggggagggtgcagtgagccaagatcatgccactgcactccagtctgggcaacagagtgagactccatcccaaaaaaagaaaagaaaagaaaagaaaaaagtaaaagaaaagaaaagaaaaaagaaaaaaaagaatgtcttaaatttataaatgtagtttacaacgtttaaaggtgacaccatttttctacaaaattaagggacctattttgagggttccatggactggccaggaaatctgccaagaccaaagcagtcccctaattctctaagtttcactcatgggccacctgctgtcactgttggcagctgcctgtccacccaagcttgcaaatgacgcatcctggatggcctttctaatatttatccgcattgtacaaaaccactgttgactgccactttctcttggaatcatcttgctcatattcttgagacaggttactctggccattcaaggatgggtggtgcctcagctttgggactgggtaggtccctctgggagcagaggctgtgggcagcaggttccctcaggtgggccgtgggcaggtggtatcctgaggctgcgttgcctcctgttgatggagtctgttgatggaagtgtagtgacaggcacaaggaaggcttctcagtactctgcctatgctaatcaggccacatcctaactttatattcaatgcttggtcccaaaatcaagagggagctgacagaagacaatgttcagacctctccagagaggtcttctcgtggaagtcattgaagaaactggaggtgttttatctggaaatgagatgacggtaggataaaagagacccctgtttttaatagttcatttgttgcaatgggagattggccttgggaggtgttcaagatgattttctgcggtgctgggacctaagagaaataacatggaaacacgtcatgcagaagttagccccttgccagttctctttccatcggttctgttctagtcctcaaggcttctctattacctgcttacctgcctctttaaaaacaagaatgcaggccctgggctcttccacaggcaaaagtgtttgactttcatatcattcatattgttgattttttgcagttgtcttctatgtgtggcaagtaacacaattcagtgttttctatttacattaatggtatgatatttattttggaataattttaattaaattaagaaaacaagccgggcacagtggctcacgcctgtaatcccagcactttgggaggccagggtgggcagatcacgaggtcaggagatcgagaccatcctggctaacacagtgaaaccctgtctctactaaaaatacaaaaattagctgggtgtggtggcgggcacctgtagtcccagctgctcgggaggctgaggcaggagaatcacttgaacctgggaggcagaggttgcagtgagctgagatcgcaccactgcactccagcctgggtgacagagcgagactccgtctcaaaaaaaaaagaaagaaaaagaaaacattaagtaaatcatggtatgagtggtttatagatatgctgaaacttatggagaagtcaagaaaacaattgggcattggaaacaccagtgcagattgttatgtattgcaaagtagggtaaatggtatcacttgcatgtggcatgtcagaggcagccggcagggcagaagttctcacaatagatggagcttcgcaacatgggatgtgttcttacctgtgagcttctggttgagtcagggaggcgtaggaagacatcatttttcaagaatgctgcagcaggggtcctgcatgcctctggatggtccctaaggctcagcgtctttgccagtggcaatcagggcaagtcctcctttggccatacaccttccccctcttcactcctctctctgatcttaggagagactcgaaaaggtataaaggaacaccaagaggccttcttaagctcaaggaatcaacagtttgtttattttcagttccccatgtattttgaggctggaggataatgcaggcagccagactacctgtaccttacctcttgggagccaaagctatgaggcagctgtagggagaatgagtaatggatcagcaaagaggcaggcaccgttggctctggaacagctaaagtctcgtgggtgggtgtgggggtcatggcagtgcattgaaatggagaaaccaaagatgttccattcccaatgcttctgttttcctgcactttcccattgcttccctacacctgtctgtgtagaacaataaccatgaatgtcattataaactagaaagtatggctggttacggaagtctagtcagtgcctcactgtcgctgactcagtccaacacccaccatctctggtgggacaagtctccactttggttctgatttcctctttgaggtctagatgccagttttcagcaactaccaaacagtttttcttggctgagcctcttcaacacgtgcacttatgggtcagcttattttattgttgctttgacttaagatttccatggaatatgaacatgaaaagagagtctttttgtcaaacactgggagacatttcacatattacggccctgagtacgttcagagttaccttctttgaataaaatcgcctttccctggggcccacgatgagcagtgggagagtacatacggatagatgagaaaagatttttctctatgtcaatcttgaaaccttctttgagtttatgtttctttgtttgtttttctccctagttacttgtgttttaagttgttgaaggcaagtgatctggttggacagttattttgcttagaggacatgctaaatcgtgggacaaaatccaatatcagattttgaaaccggggcattactattttatattggcagaattgactgagcatacaaattataaattgcaagcataaaccaagaaattgtaataataatacacacagcttcttttctatcaggttggtccagatcaataaccacaaaccatttatcccagacaatgttcttacccgagccctgatggtctcattcataacacctgtaagtaagccatccaccttttgtccccttatcactttattctgagcagtcaccatctcagatgcaccacctttttaatgtgaccttggggagaacacactgggcttcctgtgttgccagagtcccaaagtcatcctctaccttgaacgcttttattttaaaataatagtgccactcatttgggaaggttaacttggactccagcttataaggattgtccagcaaagaaacgaaagggtagaggaacagctaatgctcctgtggctcatggcttcccagatctgcagggagtgcctttccagccagagatgtctagcctcttgcccccacaaattaggaggaagcagataaaagccttgcacgtaatgtgtagcaaaaatgcaaatatttggatggaaaagatatacgggaacgtcagcatagatgctacctcgggggacagagaaagagaaagaagagaagaaagacggaagaaactgggataagagaatcgcaagatctttatgtctgtaacctttgctttttacaaatttgaagcaaaaatgccccccgaaatcagcattaaatctaagatgtggatatgtgagtcctgattacattagtctttgtattttctgtgttttggaacaatttcattacatatgtgtatgtacacatacgtgtatatgcatgtgtatatgtccatctaaaataatcaaaatgcttaggatccagttaagtaattcattcaagggctgcatgggagtggccattcagagatacgcagacaccaaagaatgatgaatttctgatattccaagaatccagtgaaatattacggtgtggggaaaagtgaagatcttttatggaggcaaaagggaggcgctgaacagaatcacggtgttttccatacaacggctaacacacagatgtaagatttgattggctactgttgacttcactctaagggggttgcttagcattttattataaagagataacaatgaccaaggtccctacctcccacatcattcagtctggtttgaatgaaggctataagtctggttaaggtctaagatctcaacacaaaaatcaggaagcagtggtcacgcaccagagagaaaaaacagcctgctctcacaactccatttccagggcttaactttcctctaggcctgtgaaatttggaaggtcctgaaattttcttttgtttttacatatatgtatgtatgtgtttaaaagaaaaaggaggccagccacggtggctcatacctgtaatcccagcacattgggaggccgaggcgggctgatcatgaggtcaggagatcgagaccatcctagcttacacggtgaaacgctgtgtctactaaaaatacaaaaaattagccaggcatggtggtgcatgcctgtagtcccagctactcgggaggctgaggcaggagcatcgcttgaacccgggaggcggaggttgcagtgagctgagatcactccactgcactccagcctgggcgacagagagagactccatctcaaggaaaggaaggaaagaaaggatggcagaggaatatgggagattattctccaacttgtcttctttacagggggccttttctaaacttaaaccaatacacagaagaaaagttatttataactaaatcaaaatgtaaattcatttctaatgagttcagttctgaaaaggtttggggaattctgctgttaggagtttcgaagtgaattttagggtttagccgcgggaaaccctagattgagcatgtcagagagaaccgaagaatttagacacgcaggaaaagctggtcaatgaacagcagcccattctctgagtgaaaaagcagctttcggttaacttcacagggggacttaactgtcctagtagcaggaaagatgttgctatagtaacgctcagtgtggggtgagaaggaaaatgggattaaaaaaggatattttccttgtattgacttctttccttaaagatcattaagaagtcacctacccatagctaacagaaaagaaatcctatttagccttaagggggaaaaaaagcccactttttcacctgggaaggataggagctgctcccatgtcctggggtacagagtagcttttaactgaatgtagggatatttggttgagggagtggctgttgtccttttctatgtatacagcagaaaaatgggttgatggatggaattaaatggcaatttaaagaaatccaaagagctgtctgttctgcagttgccacctcccacgtgaacctccctcattcctggctccatattcctagtgtgggaggatggttataaattagatgaggatgaattgtttcgtttgtgcagagctttaatttgatagaaaggggaggtctaataaatcatgggtagaaaagaggctgcatttagtttcaatcttaaagtacagttcaggttaacaaggttaaaaatagattgctccaggaacaggtatgaattcctccatgacgctcagccatcacaaacatcctactccttttatgcttctacacaaagtcagatctggctcagacgccaggcttcagggcaccagagtctgcatctggtagcggggagggcctttcccctcccacagctgcataggtcccaagccaggcccctttgggtcgcagtgtctgctggcatctcccagttcctctaagtcacacttggacctcgaaacctccccaaaggcctacaagcatggtgctccctgctcagccccaggcagcctccaagcctcccttcccaaagggagaaatcagagaaatcccttctccaatttttttgttttgttctgagataagatctctctctgttgccaaggctggagtgcagtgatacaatcctagcttactgtggcctcgacctccccaggctcagatgatcctcccaccaccccaccaccaccccatgctccagatacctgggaccataggcatgtgccaccacacccagctaagttttatattttttatagagacagggtttcaccatgttgcccaggctggtctcaaactcctgggctcaaacagtttgcctctcctctttgtttatgctgctgccctctctgctctggtccctatccccgccactccatctccccacaggaggctttccagaactaaggcctctgaactctccgggcaaaggaaaccaccaccctgcaaggctgtcgatagggaagggaagggaagggaagggaagggaagggaaaccccttgtattctttgctggcggccaatagcaggaaagtgggcccagctcatcactctgtgcagtcacctggccccgcacgtgaagggagaccatgcactctgccctgtgacacgcagacctggtgcggggcagctggcctctatcatgctgcaccgatcccattcagctgcagcacgggtggatgatacaggtggcctctttctcctgctgccctgtcagacgctgggatggcagccagctgacacttcgatgccttgaagtccaggaaaagagtcacagtcatcttccttcaagcttggagaaaggacagtcttcccttattccactcagaggtgtccatgtgtaggagaaaggggagggtgggcctcagctctcagctcctctgatcaatctacgctgcttgactcggtggccaggggcaccactgagcccctcatgagcccccagcaactgcattccagcccaagtggccctcctcccctgggtcagtgccgagcaccagcaggtcacatgcggtctatgttttacagtcctgtctttgtggtcaggcagcctctaagtggccgtcagaaagttgagccccctctccccgttcctgtctgactgctgtacactcgtgcagggggagctgtgtcagcgccgcggctttggagaggctgagcacgtcaagttcaagaattatgggttttaggcagatgtgccagccctggcatctggtccctgaagcccagtctactcttggaatccagagtaaaatgtaggcaggggttggttacctagagattaaaaaaacaaaaaaagatattgtgccaaatgccctttttagaaaagaccatgctaaggataaatgaaaatgaagactggagaggtactggctttttttaaaaataaataactattacataccttagcaaaacaggaataaatctattaaactgataacaaatacctctggccaaaaccacgggaaggcttttttcaaagcatttgaaatgcaaaataaacgacatgtaaagattctgtccgtacagcatgtcaagagtgccgtttcattcatcaaggggaacaaatgtttccaccgccacgcggtagcgctcgtgcaaagctcgctgttactcaggagccctcgctacccgcagacaggctgagcacagtgaattagcctctcaggaggaactcagcttttcagagcacaacctcaccacgtcaattaatatttgctgactgaatgcctgctctgcgtctcccactaaccaggggctgcagggacttcttggagcatggcaagcaccccaagcgctagtttagtctaaatggaaaaagcatgcatggaaatggaaatgccggagtaaattcatgagatctaatgaccttgaggacttcacacagacatacacattcctggaggaaggtggtggggatgctttggctaaacccattacagagcacattctgttcatcagagaatgtgtctttaaggaagagaatctcaatcgtttgctaaataggaaagacaagttgacagatgattgggagcctcttccaggcaagaggatttccttaggaagctcactcagccaggcccatcccatgaagctgccctgggatgggtcctggagaagtggtatctgcagctcccacccgctgggcctggcctggccgattcccagtcccccagtccaggagccagaagctccagagctcaccggccccacccagcctcccacacttttgctctttgtctgcctaaggcctaagcctggcgcctcctagttagttcgtgcacactgaatcgaatttcatgtaaattaaatgctaacaggctgctgatgccagcatctctacctttgtcatttaaagtcacaggctccttaatgactgcaattaggcagctccgttattacttgagctagagacgtttagagaggcatctgtgatggcaaaatgctcagcgtgctccactctttccattaaccccttggctctgcctaccggggcatcagtttaggcaggagtaatattagcagctgaagcacacttgtttctaccaaaggtaaaactgactgaactaatgactgcggaggatttctttctctttttttctttttttttaaatggttatgaccatttaaaaaaactgattgttcttataaattgcagtatgtactgtccactctgggttatctatttaccattaataatttatatggtgtgatttgtaaaactactgtcaggcttctttccttacaatgttacaaagtctgtgcgacaatgaacttatcttccagcgggcattgcgtgagtacctctcaggctcccacaccctgtggcgcttcgtggtaccatcaaactcctgcgcttgatttaggcaatgcacgccagttcccccgccccatgcagggcatgtggtaagtcacagtgacatagtataagaccacgcgtgttggaggaacttcactccctgattttttttttttttttttgagacggagtcttgctctgtcacccaggctggagtgcagtggtataatcttggctcactgcaacctctgcctcccaggttcaagcaattctcctgcctcagcctcccaagtagctgggattacaggcatgcaccaccaccacacccagctaattttgtatttttagtagagatggggtttttccatgttggtcaggctggcctcgaactcccgacctcaggtgatccacccgccttggcctcccaaagtgctggtattacaagcatgagccaccgcgcccggcctcgctccctgattctaatccctactcattttcttcacctcgagcaggtcagttaacctctcagagccccgatttcctcatctgtgcactggggagaatggcttgcctgaggagcagcgtggacacattggcagtaagtgagagggtttatgttaaactgctgacagatagtgatataaatgttatgtttagttgttacgatgtccaaaatgaaagggaagagaacctctcttttgcttcctggcagaggctctcggtaagctgttcgtctccacggctgcattctagcaacttcgttgaaaagcattcatgggtgttggtgtgtaagcggggccccgaaggaacagctaaattccaagccaccttcagctgggagtccagcccgtccagtccaagacagcgaaggccacccttggtccaggtcgccaccttagatacaagcagtgctgcccttccgcttggtggtgcggaacggcacgctattcagtgccttcttgtactcgcccactaaggagaaggtcatgtgaattatccaaaagatgaagcccgagattttaaaatcatactgagtaatggttctgaataaaagccatttgttatgatcactaaagtaaacctgtttgtggacagtaagaatagtgtcttaaatctagccttcaagattaaggactttaaactcatttcatggtgtattttttgtgctaatcattttatgtttttacttatcgtaggaggtggaaagccccttcaatggctctgtactgacttttgaagtggagaaataattctccttcaatttcagagaaattgaagtttacttaaagatgattaaaaatctttctgacagactttgagaaggtctctcttctgactgctgtaattttaaataattcagagccagcttggcacatgtatgtttattaaagtagggatgaaaataaaactcactcgtgtggctgcattagcccactgaacagtatttcatcttacatcgtctctataacttctgaagtgaaaaccagaaactcattggcgatgtcctccctgcttgctgggctgattggcatgaggcagggccagctttatccacttcctgaagaccattcctccatggtagcccctttgccagccgccagacgctcttctcagagactcagaacagcaggccagggatggagggagggaagatgccggatggccgaggagcccccaggcaggtggcagctgcagccttggcccttcctgggaccctgaggcccctgggatgccttggcagcagaacctgtatcagcaggagcagctctgggaactgcggggaagaactggagctctcaggaccccagatcctcagatcctttttttttttttttttttttttttaagagacagagtcttgctctgttgcccaggctggagtgcagtggcatgatctcagctcactgcaacctccacctcccaggttcaagtgattctcctgccttggcctcccgagtagctgggatcacaggcacgtgccaccacgcccagcaaatttttgtatttttagtagatacggggtttcaccacgttggccaggctggtttcaaactcctgacctcaagtgatccgcccgccttggcctcccaaagtgctgggattgtaggcatgaaccaccgcacctggacaggaccccagactctttctgtagctcacaaatcaacaaaattagtaagtatgtgaactgtgatgcagagcttccaaccacatcccaaactgccatggactgcgcttctcttcacgctcgagcagtgatggctgagcaccatgcttctccgcagagctgagctgctctttcttgctcctcaccaggttctctcctgctcctcctgcggtggccacagctttggctgtgctgtgttttgtgccgcagataggccctttctgactttatttgactaaccccccagaacccctgatggtgtttagctggccaaaattcaaaaatccctctgagatgcttgtagttcagaacatttttgttaggaaaatcctctctctctttaccaatgagattttgcaagaacaatcccatctttctctttgtctttcagctgacattttagtcttaaattttctagggacaccttcagttcagcctcttatcacattagactcttatttgtattctggagagatgctggtctttaatattctcgaagacaaataaagaaccctcagaaaacccagggccattctactttctaccttcagtcctgaatgatgtcagggagctctcaggaccttcaggtggcattggaaatatctcttgggtttggaaagggcaatttagatccaagcaatctcagaatgcatttgtgatagatatgttatgaatttttactgcctcacctcttcacttcctccctgtctgcgaggtagaactaggattttcttatccatttccagcaactcccagacccctggtgagggaaccctctgtgtctgccgaccatgtctttgcagaacaattcaatctatcccgagaggcagcctcccagaggcagcaatggggaaatgccaggcttctcaacctccgtgtcagcattcttgatatttggggtgggataatcctttgtcagggggactgttctttgcattgtaggatgtttagcagagtctctggcctctgtctgctagacaccagtggcactctgtagtgtgacagtgaaaaatgtctccagacattgtcaactgagaacttctgacataatgggaagggtaaaaacttagggccaggccaggcgcagtgtctcacacctgtaatcccagcactttgggaggccgagacgggcggatcacgaggtcaggagatggagagcatcctggctaacacggtgaaaccccgtctctactaaaaataccaaaaaaaattagccgggcgtggtggtgggcgcctgtagtcccagctactcaggaggctgaggcaggagagtagcatgaacccgggaggtggagcttgcagtgagccgagatcgcgccactgcactccagcctgggcggcagagtgagactccgtcaaaaaaaaaaaacaaaaaacaaaacaaaacaaaaaacaaaaaaacctaggcccaaaatactgatgctcgaatctcagctctactgggacgaccttgaccaagtctatctgagctcatagtacctgccccacgagattgcttgcataattaaactcaatgatgtggtagctttcagtacatgtttattgaagccaaatctcttatcatctgttttcttaattaatggcaagaattacgttcagatgcgcagtaagcaataaaaaaaaatctagcttccttgtttcaccaaaggtacacttctagctctttggcacaaaccggtttagttcagtgtagatggaatcgctcggagatctggcttcatcacgggagagaggacatttcacttctggtggtatctctcttgtacccgttgagagctgctcccacgcagttaatggcgcccagataattacagacggagctgccttcgggttgtaaacagagctttgggtgattgcacactgccatttatccggcctatttgcattcgtacttatttgcatttctacatctcccacagctgacacttgttttttcattttgtgattccaaagcacttttctgattaccctgtgcctgctaggagtgctccccatcaggcgagggatgcagcctccttcccggctctgccctcttgatttcctccatgtttttggagggaggccagttgttgggagaccgcatctgccgtgagcccgggactaatgagtcattgttcttctgagaagcccgttggcgtcagcttcctttcagctgcggcatcgcaggaccttgtctgccttttcctccgggttacacctgggacctgctgcattatgttactatgacaagggtcaccttactttctcttttcgaaagtgagattgactttccttctgtttctgaaagaaatgcgacttaaaatttgagtctgtagcaatcagcttgagatagcctactctgaaactgctaaaagaacagtttccatttaagaatttagctgcagtgctgagaacatacaacccctacctttttaagcctctcatgtgcttatatttcttaaacaaaatggctatgtctattccttgctttcagtaaaaggcatactcgtcagtttaataaaatgtatgttaattttcctaagccaatttacaagcagcattggtcaaatagctacatgcgggatgatcacccgaatatctaataatgatagagcacttaacggtttactaattccttaacaacatccatcatctatttttcgattttcttctctctctcggtttccacatgacccatgcattgaaagatttagatttcctattttgccgaattgtactgttttcccttcccctctgagtgaaagtaagaaaacctatgagtttaaagtatgtcttctgccctacatgctgtatgtaaaatttaacagaattcagccgggcgcagtggctgatgcctgtaatcccagcaccttgggaggctaaggtgggcggattacgaggtcaagagatagagaccatcttggccaacatggtgaaaccccatctctactaaaaatacaaaaaatagctgggcgtggtggtgtgtgcctgtagttctagctcctcaggaggctgaggcaggagaatcacttgaacccaggaggcggaggttgcagtgagtcgagatcacgccattgcaatccagcctggagacagagcaagactctgtctcaaaaaaaaaaaaaaaaaaaaattaacagaattctccctgtaagtgaatttgtaagaaaacaagaacattgactattccatttaataacaaaacttctgggacagaccagctccctcagtggattagttaaatgatgtgcagattatattaacccatggaatatagcatcacggacccacataccatcatcctgacttagtacgactcacaccagctctgtatttaaacggatgaggatagatgtgggctcatataattactgtgtcaattacaagggaagaataaacaaatgtttaccaatcaagtagtcaccagcaacctgcctttggtagatatactagtgttcctatttggggaaaggtattatttattttaatagttgcataatggtcactttcaaaatatgcctttgactacgttatgcttattttctgcatgtcacagactagccctgcttaggtgagcttagtagatacactaatgttactactttgagaaaggcattatttaatattcctttcaggaacacattaatatacgatgtcagaattatgatgcttggtttttatacacagcctgtcccagctcaggtgaggtcacatcccttggccatacctgtgtaaaaagccaaagggggccccttttccagacagcaaccagcctagcccaggctcccctgccttgtggcatccacgccaccagtcactgccaaagcgcatacaggagtccccgcttatccatggtttcgattcctgcagtctctggtactcacagtcaaccgaggcccgaagatattaaatggaaaataccagctcaacacttcctaagttttaaattgctcactgttctgagttgtgcgatgaaatctcacaccctcccacctggatgtggatcctccctttgtctggcatctccacgctgtagacaccacgcgcccagaagtcacttagtagccatctgggatagcagagctatagatcacaagaagaaggatgagcgcaggacaatgagatatttagagagagcgggagtccacattcacgtagcttgtgtcgtggtcctcgcaccattatacctgctctgctgtagcactgttgtgaatgtcttactttgcttaatttataagttaagcttcgtaataggcatgtatgtgtaggaaaaaacagcatatatagggtcggtactacccgtgatttcagcatacactgagggtctgggaacgtatcccccttggataatgggggtgactgtgatggtaacagaagcatcctagttgttattttcataggcactgctaccaagcttgtaaacctcttcactgtacccagtagtgagacagagctgcagagggtgaccggtctccctaagtgaataccaggtggaacctaacacatagagagagaggaaaggccaatttcagacactgaaagctactcttacagatacagacatttcaatagccaggagaccctgaggaatggctcttaatccaggtggcctgtgtatagacatgcctgcaagtagccaaccaggataataagagtcatcccccggaagggatgaggtcagagcaggagtttcaatttgacccacgttcccatcatgcctttctctctttctctcccatcctcacttccaaatcacagccattcacccaagcagttcatgaatgcaggaacctaccaggacattacaaatcattaaaaatttaaccctcccagggagcaattacaactccaaaaaggcattatttgcactctccgcccacccccccccaaaaaagtcttgagtttgcagagagtggccaaaaacattctagaacttcatgtctctatgccatgcctcctcttccatcccagcgaatgaaatccacctgatgagggcacacagcaggccctcccatcccgcctcctcctctctgccctcccatcccggcccctgctctctgtccctcccattccactcccctgctctctgccctcacatcttgccccctcttctctgccctcccatcccaccctctgctctctgccctcccatcctgccccctgctctctgccctcccatctcgccccctcctctctgccctcccatcccagcctctgctctctgtctctcccatcctcctcccctgctctctgctctcccattctgcctcttcatctctgccctcccatcccaccccctcctctctgtcctcccatccctccccctcctctctgccctcccatccctccccctcctctctgccctcccatccctccccctcctctctgccctcccatcccacccccctgctctctgtcttcccccactccctcctccccaagtcattgctgggaggagtgggtcggcctcagggcctcccaggcagtccttgaggaaaccacacacttcatgaggaaaggaaatcctggaggagttttcatgtagatacaggttttatttagggaaaaaaaaatccagaaataaatacaactgcctggaaaactaactatattttacattttggaataatttaaatatcattcctggtaaaggaagtgatgcagaaaagtcaagagagctctgaaggcagagagagctggataagcgggtcctgattcatcagtgaccttgagctggcccctgacacctctgaaattccatttctgcaatggtaaaacggggatagcaatgacacctacattattatatttaaaatgaacacattttatttttttaatgcgccaatatttgtaaatattcataaagctcatatgaatatttgtaaagctctctgcacaaagtagaagctcagtgcttctttataaacaacattaacaaaacgacttcacttaccttcacacgatccctttgcattagggattatcgccaaccaggcaggaggcgtcagagcatggcttgataaaaatagagtacaactatgcagggagttttttaggacaatgggaatgtaaccgcttataatgcatgtccaaaaggttccttgtaaaatattatcttgcaaaatgattttagagtgaaatcatctctcttttttctggcaaatctttgaattccacccaatttaccttcattatatccagctgcacaaaagcccatgtgttatttcttcccatgctgtctcaccagatctgtctgttcacattaacctagttaccagtggaacaaaaatgcaattggccaaaggttacatttctttgtcatgagcacaagagagcaagatcatgccgggcaaaggctttcagtaaatttcagccaagaagttgggcttcttcccaggaactctttaaccctcccctctccttcctcccagaaacacacatgctacgttacccttggtgtttttccgcgccaaacttgtggtctttttttgttttatttttaaagatgaatatattacagaaaggaatgatactgaatttccttcagcatgccccccaattttaggaccttgaagattttcatgtttcaaattgcattaaacttttcaaagagctttctttccctacttcagctataatcctgaagagacaggtgaaagatgctttgtaaatcctcattttacaaatgagaaaattaaggctccaggagatgatatgacttgctcagcgattacacaagtaggaaaataaagaccccattgtgtgttgattctcaaacggtctgcattatagtcttgtgtctacacaagtcagcgcacaccccagccttggagaggatgttgttctgaggaatcggagtccagttcctgaagcttgggcggctctggcttcatgaagacggagtctgggtacaaagcagaaacttagggaaattccccaacagccggcaggcagatgccaccctccctcaccctgcaccgtagacgttagcctgggataatggcagaggaaaaaagcacacagaaaactaagcagacacagaaataagtaatcattttccctatgatctatggcaatgttgaactcttccaagagcatactggcaaaatctcttgagtaaaatagcaagtgaatagaatgcttactattggaatggtatggagtggtggtcttcaaactgttttcctaataatatattccccacatacaaaattttgaaaacaatgtacctcctcacaagtgtttaagtccatcataaaattttacctaggcttaagtagtagcaaaaagtgaaactcctggagtgttataaaaactgacaattttttttttaatggagtttcgctcttgtcacccaggctggaatgcaatggcgtgatctcaactcactgcaacctctgcctcccgggttcagataattctcctctctcagcctcccgagtagctgggattacagacgtgtgccaccacgcctggctaatttttgtatttttagcagagatggggtttcatcatgttggccaggcgggtcttgaactcctgacctcaggtgatctgcttgcctcggcctcccaaagtgctgggattacaggtgacagccacagtgctcagcctaatactgacaaatattttataaaagaagagagacagcaatcttttaaatgacagaaatagaatctgtacaccagagggtccacatcattcattttgtaaacacatgaatgggctcttctttatcaaagggagtttatatcgggcctcatactcctagtagtccatttcacttctcttattctctaacatgtgtttatatttgaaaatattttattggtcatccagtatatatttctgtaatgaaaatatgtacaaagcctttaatttttaatttctagaattaaaaacgaggttctgaggttaacattttttcctacttgagttattaaaattaattattagtagtaaacagttaatccaaacaacaaaaatacattataagttttgttgactacttgttaaacaaaaagtgaaatggtaatgggaacatccaacttactgagatgccgcggacgcatactgcttacagctggaatcagacagccctcaatatgaatttcttccatttttcattttaattaatgtaagcactaaataactttgttcatataaataggtacattgcaatggaagaagtcttttagcagtatcattctattttttaaaagtcatttgcagttatatgccaaaatcacatgatagtctatcatcaaaacatatttttatttttcaaaatcttcaggaacaaagaattagaagcaaaagtattttttgccctttgccatgaaattattggcacgctgatttaccttttcagttttttagaagtatgccataaaggttttatgaggatcttacgaataactattaattgtaccttttattttgtgcatttagaaacccttcatttaatacattcagaaagagttgaaaaaatattaaatattgttattttcaatacgcctttgccagtaaagcatctcttgataaaatatttttgtcatgtgctttaaatatattcttacccaaatggaagttgctgagtcatttaatttatagaaaaggtaaaatatttaacaaactcagtcttcacaccaatagctaaaatcagaggctaggtgcagtggctcatgtctgtaatcccagcactttgggaggccgaggtgggcagattgctggaggtcaggagttagagaccagcctggccaacatggtgaaaccccatctctactaaaaatacaaaaaaaaaaaaaaaaaaaaattagctgggcatggtgatggcgggcgcctgtaatcccagctacttgggaggctgaggcaggagaatcgcttgaacccgggaggcagaggttgcagtgagccaagatggcgccattaaactccagcctggatgacaagagtgagacttcgtctcaaaaaaaaaaaaaaaaaaaaaaaatcagaggaagtgaatattgttaatgtaaaaatatgctaacatgtgttccaaggaatattgttgggggtcactaaaaagtagatatctatcttgcaagatgagttatgaaaaacagtcaggatcagaatgacatagaatattcatttaaccatttcacaaagtttaacaaactaaaataaatctatctgttcttgtacttgatttgtaataaaggaatattatgtgttgctgaaattacagttatttatgaagcaaggatagcctggagtcctttggtgggtacacatgtgtgcatgcattaaaatgcaccccagtgtttggcatctgtgaataattaagtaagagtcatgtaataaagagaaataactttattcatgatcaaacattgtcaagaaagtgaaaagcttaaacgtagatatagctatagatagaaaatattattgccggatgcagtggctcacgcctgtaatcccatcactttgggaggctaaggcgggtgtggattgcctgaggtcaggagtttgagaccagcctggccaatatggtgaaaccctgtctctactaaaaatacaaaaattagcggggtgtggtggcaggcgcctgtaatcccagctactcgggaggctgagccaggagaatctcttgaacccgggaggcggaggttgcagtgagccaagatcgcgccattgcactccagcctgggcaatggagcaagactccatctcaaaaaaaaagaaaaagaaaaagaaaagaaaagaaagaaagaaagaaaagaaaatattctgactcagcagctagcaaacaattttaatttgttgttaataagaggtggaaaatattaaacactttataatataaaatatgagtattgattgcactgggaataaaaattttatgatatgatttaataaaacaggttttaactaccttgttaaataatgtgtaccacatctaaaaggaaccacataaaatgtttatctgctgatttgatctagtattaaatttaaaaatttcgtagttcctaaaaacatttgttatgtttgaaagactatttaatttatagaaaaagccatttcttcagtggctcaaggtttatttctttccagttaatgatatactctacaaataagcattgagattagctaatcataattgctcacattaaatacatgggaaaacgtagattttagcagtcaatatttcttttttttttttttgagacagagtctcgctctgttgcccaggctgaagtgcagtggagtgatctcgactcgtttcaacctccgccccccaggttcaagcaattctcctgtctcaacctcctgagtagctgggcttacaggcatgcaccactgtgccgtgctaattttttttgtagttttagtagagacagggtttcaccacgttggccaggctggtctcgaacttctgacctcaggtgatccgcctgccttgacctcccaaagtgctgggattacaggcatgagccaccgcacctggccagcattcagtatttcttttttttttttttttttttttttgagacggagtctggctgtgttgcccaggctggagtgcagtggcgcaatcttggctcactgcaagctccgcctcccaggttcacaccattctcctgcctcagcctcccgagtagctgggactacaggcgcccgccactatgccaggctaattttttgtatttttagtagagacagggtttcactgtgttagccaggatggtcttgatctcctgacctcgtgatccacccgcctcggccccccaaagtgctgggattacaggcgtgagccaccacgcccggcccattcagtatttcttatccattctctctgtgtttgctctcaccacatttttccccaagagcagtgcatttactgacaatcccaagagagaacaggttaagcaattaaacagaagttggtgaaaattgctatcattctgctgtggtttcactgttctctccaaaactcatgttgaacttcaattgtcagtgtaatagtgttaagaggtgggacctttaggcagtgattaggtcctaaggactctaccctcatggatggattaatgccctgtgtttcataacatagttacaataataatcgtacagtgaacagccttggaagatagagatactgtctctttccgcagcagaggggaagtttgcttataacaaagacaatgtctccctctgttgacaatggcaggcctgctcacggcccattataaaagactcagattccctaaagtcagggtcctcacacctgtaatgcaacccatgccatgtgcagctgccatctggtccatttcaaaccaccctgtgagaactgggatttgagaaaccagcacaggaaaaaagatattgctgtaaataatgcatggtcctttgtctctgacccaggaacctctggtcttctcctggcctccgtaaaactgagcagactaacttgttagcttgcaaagaaagcaaaatcttggatccttcacagttcctgacaagaattaaaatgaagtcttctcttggtagctacctggagccatgaatatttccaggtatccaagtggccatactcacttaggagtattctgaattactgaagaaaaggcccattaatgactctgaaactcaccctcctcccacacaccctcggactggaacttctggattcctctttcttcattgatctacttgtggcccaaacctgaaaccagcagccatctccgtggcctccctggccctcccgcttcacatccaggttcttctagttccatctcagaatgttttctgagctctggaacttgcttccatttccttcttctagcaacatcctagccattgcaaggtctcagctctggggataccaccctgcctcaccacattcgtgttatttctccgtccctcttaaccatggctccccaggttgcctgttttcccacacatagagcaatagcacttagggcactgctgtgttataatgacctgtttacttgcccatgactgactataagctccctgagggcaggaactttctcaatcttgtttaccattgtattccacacctagcccagcacctagcatgtctcagcacttgatcagtatttgctgggtaaatctataaatgaataaatgagtaaatgagcaagaatatataaattgtatcttacatcatatgaagtgtgatataggtgataggagcattcactctgaaggaaaggtgaatatctcaaggcacaatcaaggttagcaaaggtgccatctgcaggtgtcctgtctaagagaagtttagcttcaggaacatcttacgttatctcttggacatgagcaaaactttcccccttcttgaaccagctgacctgagctggtctgccagccttccagtcttagggcaggaatgtatgcctggccatcaggaagaaggtgggagaaaccagggacccctagccataggtcagcacatgatagaggcctgcttgaaacactggcagggtggccatgtaggacttacacagtcatctgcctgcaaaaacatgacttgaaatacatgaatgcttgcccatatatgacaagatggaggttttccaaggtagaggtactcaggcagaaaaatgaaagaaaaaaaatgtgaatgtgctttttttggttgtgagctttattatatgtgtgaattgctgattctttagcaagacagtagcagttgacaaagaatcgcccttcagatgtgtggaaaaacactcagagaacacagcaaaccgccaaacaatcaaaggcagccacaatgccacacacttagagatgcaagaaggtgccacggcctttatggctgctgccctgggcacgggcatctgcgatgccagccaggttagaagatggacggagcagccgcctgtctctccgtgaggctcgtgtggaccctgaagctcacagactccggcggatggcaggcttctgtctgcactctccaccccagcagcccgtcctgcctccctctgcccctctctgccagtcccagcaggaatctgacaccttataccttcctcaatatcaggtagcagtcaatggaaggaaaaatgctggagtcttttgataaaggattggattcttttaagccagttattaatgtatttcattcagaatgtgagtagaagaaagaagttgccctatgttgccctgagatggaggcgcacggctttgaggaaggcccccacagtgcaagtgccagaagatgcaggtggaagagcatcactcatgcgtgtgagctgtgtccaaatgccgagctccacggagacacactcagactgcagcgagcttccttctgcaaccatgcaagtgtcaccctctgtcgggaccctctgagcccatccccgcaccaaagcttctctccagtgctggaaacctctgttttcaggtatatcgacaagagtgatttcagtctggagtcacgcctggagtcatgactgatttgcttgagaagccagtgcaaatcgctgagccacagcatatggaaatctgcagattgcaagtgaaacgtgggattcatcaaaagcctgattgcgtactcttccatgacacttgatacatgggattatgatgtgactttatctatctatttgaatacttccaacctcagcaaaggcctaaatgtagaacacagtggcagtgaaacaactctaccctcaagaaatatatactttacatccatgtcacaaaacgtcttccaattgtgtttcactttcacatgtcagatttcatgtaatgattgctaattactagcaacccagacaagatatagacttatgaaattgcctcatgagtttagtgatttttcagcaactggaaggaaatagaaaatccttgggtcagttctacctgagttctaatcccagctgtgtcttttacgagctggtgggcttgagtaagttattcaacttttgtgtgcctcagtttcctcctctgaaaaatgtggatgataatagtacctaccagttagggtggctgtgagaattaaaaaagatgattcgcataaagcactagtttagggcccaatagtaacatgtaatatcccagcattttgggaggccaaggcttgagtccaagagttcaagaccagcctgagcaacatggcaaaatcctgtctcgtctaaaaatacaaacaattagctgagtgttgtggtgcatatcagtagtcccagctaccagggaggctgaggtgggaggattgcttgaactggagaggtggaggctgcagtgagctatgatcacaccactgcactcccacatggtggaccagagtaaaaccctgtctcaaaaatataagtaagtaggccaggagtagtggctcacgcctgtaatcccagcactttgggaggctgaggtgggcagatcacaaggtcaggagatcgagaccatcctggctaacatgaaaccccatctctactaaaaatacgaaaaaattagccaggcatggtggcaggtgcctgtagtcccagctactcggaaggctgaggcaggagaatggcatgaacctgggaggcagagcttgcagtgagccgagtattgcgccactgcactccagcctgggtgacagagcgagactctgtctcaacaaataaataaataaataactatattagggttctccagagggacagaactaataggagatgtgtgtgtgtgtgtgtgtgtgtgtgtgtgtgtgtgtgtgtaaaggggagtttattaagtagtattaactcacatgatcacaaggtcccacaataggccatctgcaagctgaggagctaggagagccagtctgagtcccaagactgaagaacttggagttcgatgttcaagggccggaagcatccagcacaggagaaagatgtaggctgggaggctaggccagtctagtcttttcatgtttttctgcctgctttatattttagctacactggcagctgattagatggtgtccactcagattaagggtgggtctgccttccccagcccactgactcaaatgttaatctcctttgacaacaccctcacagacatacccatgatcaatactttgcatccttcagtccaatcaagttgacactcagtattaaccatcacaatagcatagaatcatatccctgaggtacttcagcacgcccctttgggtattcaggggcagtgggacatctcattttctctcttgctttttacaaatctccgtttttctctcttcctctttttgttttcctttaaatttgtcaccccatcacattttttgctcctacaacgctgtacacaggcacccccttaaccacttgggaggccatcactcatctttgttaattcccctgaacatccagtgtgggaacactccactgtcactcctgctcggtgttggaactgaggctgggtattagtctctaaaaggaggacaggacagaccactgcacttttcaggaatcctgtgggcccaacatgagctattaaaaaaataccatgtcttccaaggaacaggggcaccgtgtgaatatggggggaattactgatgtggcaaggcgtctcgtctatattatacaacctactgtgttttacaaagcacaaaatttgagtatttggacaaattcatctcctcataatactttacaaacattttgacccaaaagatacttagttgtaatcttgacttccccctgaagacacctctccagtgggtgatgaggcacctttatcatgtctgactggggagcagccaagggggactagtccttgatctggtgcatcagaaatgaaaatctgtggattctgatctcaaaagacaaggacaactgagacatttgagaccagcgttggacaccaatcggaccacggacctacaccatctctccctgaagctcattttgttgcctctgaaataagtcaatggagactctttctgaagggttgctggtagacaggacaaacaagtactgtgaactttcagatcaggattgcaatgggtgcagcgataacctttcaggaggtgcatttttgatgtgttgtaaggcaacgctgtgagtagagaacctcaatgcagtttgtactctttgcccactgctctctaacacgagtcagtagaaagctggtgggctgtacagttcaatctaggagggagtttcagctcttccaagactagtggggtcaaagtagttatatgagcctctcaggatgcagtttcctcctatgttaaagtaagtgtgtgtgagagagaggagacagagaaagagagtcatgcctaactcagcacataggcactcaataaacattgggttctccacaccaattcacagaaacagaagacacctgtaggcatcacttacttaatgtgggcctatgagtactttcttaagtgtttctgaacaaagaaactcccatagtctccctcgacagtacagtccaacttttcagagcacatttaactaggaagttcttcccacatcgtggctgctgtctcttagaattaagatgtaaagacgcttcacattgctgtcacacaccaaaagcccttccaggtactgcagaataaggaacatgcattcctagatgagttaattcctttgatactttgattgctcacagtggttttgcctacatcctctccaaattctccactcctccttttagtacagggagtggccaaagagctataattacactcttaaggacagttagaggtgtcctgtggttcctgctgttaaagtaattaaatggaagcctgctagaccaaggtggccccaatgccctgagttcctgtgtctgcaatctgaaacccaactcagtggtcatgttctaggacaatctgaaacagccagctaagccctaacttgggactttccactgggatgaattctttgccttgcttctgagttcactccataaaagccttcctctttgccccttctgtggagccatgaaccacttgtgatccagagctggcccacccatgattgctgtttgctcaaatcaaaatcaattcttttttttttttttttttgagacagaatctccctctgtctcccagaccagagtgcagtggtatgatctcggctcactgcaaccactgtctcctgggttcaagtgattctcctgccatggcctcccaagtagctgggattacaggcacccaccatcatgcctagctaatttttgtatttttagtagagacagggttttgccatgttggccaggctggccttgaactcctggactcaaatgatccacccaccttggcctccgaaagtgctgggattacagacatgagccaccatggctggcctcaaatcaactctttaatattaatatgcctcaatttatcttcaacactacatgccgtactccagtctcaataccagccttgtgctttgacattgaccttcattggccagtgcttttcttgtctgtagactttagaaaatcaccagaaacctaatagtaaagatcatattcattcatttaactgatctgtgttcagcactgcctgtaaactgggcactgttctgtcaattcatacacaatgatgagacctaggcagagtcccctccctcttctagacaaatggtggagaaagatgatagtggttgtgtgtagcctatgagaccaggaacaagagcagtggaagggactggtgggacaatgagccatggtaaggccctgctgtagctagagtgtgcagaggaagcttccagaaagaggcagctttaaacagaccagccaattttatgaattccagcttgggattgacaagtcatctaaatctgtaaatgtcttgcttgtcattggccccaaatcaaggaattttaagatgtcctttgtcatccacattccagagcttgacaaacactgcctatgcccctgttcaaatgtgtgttcttcatgcatgaatacgtgcagaaggttcccccataaaattcaggtggttacgacgtgtaactgcatcgcagtactcacctccgaattatttacatgtaagctgcaagttacacagcgtgtctcagctgctatccgtttgcatgtagacacctctatgtacattagaaagcagagagagcatgacaacccttcagatactagttgagaaaaattaacgtgagtgcctccctattcatttgggggccacgtcttctcagatgaggacgtcccaaccaaacccatgcaaggctggcatacattaaagatgctgatatctcacacccagtgcagctgtcaagtctgctctaagagtgctgcagctcctgatgtttcaaggccttctcatagtgcgtgcatttctcactacgatactgacatgtaaatggatttataggaaatataaatgctttctaaaagacacaaataaaatgtctgaatgcatgcccagcttgtctcatattttggtccacatgctgtgagtgatgtggcagtcgatgtcagccctagaaaagggctgctgttggcgtctcgatcattggcatcatccccgtttatttattgaagtctggaatgcaaggtcagggcactgggaaattaccagcctagaagaagtagctttgaaaatatgtcatttgcctctggggcattttttcctttttctctcttccttccttgctccctgcctgcctgccttcctttcttccttccttcttccttttttcctctatttttccttcctattttcctctattcctttcaaattttcttccttcttcataattctttcagcagagaaagggggaataaaaaagaaacaagaaaatgaagcataaacagagcatctatgagaatataggcgttagtcaaagaaagagaggagataggtgtaaagttaattttctcaagattttatttgtgttgtctggccaggcacagtggctcatgcctgtaatcccagcactttgggaggccgaggcaggtggatcacttgaggtcaggagttcaagaccagcctgactaacatggtgaaaccccatctctgctaaaaatacgaaaagtagctgggtgtggtggtgggtgcctgtagtcccagctgcttgggaggctgaagcaggagaaccacttgaactcagaaggcagaggttgcagtgagccgagatcatgccactgcactccagcgtgggcaacagagtgagactccatctcaaaaaaaaaaaaaaaaaaagattttatttgtgtttccttagtcggttattttgggttattactgttttgctttcaactggaactaagtagaatccttggctaataagttttatgtggatcctgccacagttatctcaaatgatttcttggagtaaaacttgaaaaatattttcctttactagattatgtttctataatgataactcgttaaacagaaatgctacatagaaatccaaagaacttcagttgttcttttctatcaaaattctttacttctgaaattcactaaattctaacctttttccattatcatagccactctgttgctgaagaatataccaagaatttcttcaacaccactgatagtaaatctctgactatactgaatccagaatttcaagaacatatttcaaaattttaactttttaaaaaatactttttaaactcttcatgtgatttcttctgtgtagaccctgcacaaaagttcttcttatgctaactttatactatccttaatttttccctaaatatctaatgtagtctctttagaataatatacaacagccagggttggaaacagttcaaggggtaaacgtctctatctgaacaaactcttcctgtgatctccggagtcccctccattcccccgttaatgctacatggggaaaggaagttatgctgtaactacagaagatacaacatactctctatccaccctcatgctggtcctgcttaatttttagtgaagatcaaatgtgatttctgcatgaactcaggacattggttctgacccagaaagtaaactccaggcctaactgccaaatacccaactcccttctaaccacttttctacaacttttggatggaaattctatatctactcattaattgtctagaaaggactgatttttgccattcaaagtcacctgagaatttccatttatgttgggaattcagcacgtttcaattaatacttaagtacccccactcaagcatcaattcaaaatcaagatgaggaatgcctcaactctcctggtgtggggtatgggccctcgagtgcctggagggtaaaggctcacccaggtgaacttcacatgattttcttacatcatcactcaaaggcataaggaccaggaggatccttcctttctctacttagtttattgctttctctcttgctgtccttttgtgctccctgtctccaatggttcacatacaaaattaggggttagcaaggaataggaatttcagagaagcaagctctgtggagttgaggaaaaccacaaatattgtagcacatgatttagtacggcaaatggaaaaaacaagatccagcagcccggcaaattctctcttcagctatgtgaccttggacatgtaacttcatctttgagctttcttcatttgtaaaatcaggatcttaatttttaaaaagtaaagaaaactgaggctgatgtaggggggaaatcactggagcccagaagtttgaaaccagactgggcaacatagggagaccctctctctacaaataatacaaaaattagccaggcatggtggcgcgtgcctgtggtcccagctcaggaggctgaggtgggaggatcaccgagcccagaaagtggaggctgcagtgagatgttattgtaccattgcactcccgcctgggtgacagagcagaatcctgtctcaaaaataaataaagaaagaaaaaaaagaaaataaaggaaactgttcatcatgccaaaagcccatgagccatgcctggcaccaacagttggcatctctgttcatatatagtcattttatccagataaactgaggccactccagcccttgcacctttgaaaactgcttaagactaactcctgacctctcataacgcatttcagaaaagaatgctttattgcatattcattactcttaatttatttcaaaaatcagggttttttactttatcaagttctttttttttttttttttgagacatagtctcgctctgtcgctctggctggagtgcagcggcgcatgatctcggctcactgcaacctctgtctcctgggttcaagcaattctcctgtctcagcctctcaagtagctgggactacaggcacgtgctaccacacccagctaattttttgtatttttagtagagacggggtttcaccgtgttagccaggatggtcttgatctcttgacctcgtgatccgccctcctcagcctcccaaagtgctgggattacaggcgtgagccaccacgcccagccttatcaagttcttaaacaagtgccttttacgtgccaggcgcagtgctaggaactttcttaaacacggtatttgaatctctacagcaatcccacaagtagctaccaatttccccctttcacagtgaaataaatggaaattcagagatggtaagtgaactactcagagccactatcagtcggaagtaggaggactagaactgaactccggcctggctagaattattcaacacaagcagaatctaattatttcccttacaaaagtcagaggaggctgggcgtggtggttcatgcctgtaatcccagcactttgggaggcagaggtgggcagatcacttgaggtcaggagtttgagaccagcctggtcaacatggtgaaaccccgttttttaaaaaaatacaaaaattagccaggcgcagtggcgtgtacctgtaatcccagctactcaggaggctgaggcaggggaattgcttgaacccaggaggtggaggttgcagtgagccaagatggcaccactgcactccagcctgggcaacagagcgagactccatttaaaaaaaaaagaagaagaaaaaagaaaaaaggaaaggccctctgtgttgtggttaggacctcaggttctagggccaaaaatctcctggttgactgctagttggtcactttctaccactgtggcgcagggacctcactgtcctctttaaacatccatttcttcattgtaaaatggtcacataagtgggggaacaggtgagatcacgcacaagaagcatcaaactctgtgtagcacgttagctcgtaaaggattctcaccattttcattgcatagctacgcatttagtgaacactaatgaccttacatatttgtgtgtcactgtgtgaacttataattccatgtccttcatgtaaacgatgtgtttacatccaacgtattttcagagactcgctttactgcctcacttctaattttctatgatatacgattgtttctgtgtaggcaacaccagacattgttttctgatttaggctggaacgctagaaaactccaccgcctgtatgtgaaaatgccaatgcattttataagcaaagtcaaccgcaaaatgtttatagggtcaggcagttagatctgaggtacaaacatggtttagaaggaattcttacaatggtgctaaagctctagaagcaaatactatgtgggaggccatagaaagagtgaattgttgttcacacttcagctttgatttggagacacctgtgaaagaaaataatctttttcccagtacttactggttattttatttccagaaaacatgcttgttattttagccgaggtaattgccttgcctttcgggtatggtttgtgctaaatgaacagtgacacctactggcggaagatgatcacgtttatttactaaaagaagctcctgttctcactttgctgggtataatcccagaaataatacagaatgttttgatttcaaagagcaaagaaccaacactggagttaaaaagaaaaatcaaaccacgtcaaggccgatacatgaatatagacagattcactttctggagtgaagattgctcttttcttctctaaaaatgctgggttcccccaaccaccaccacaaaaataagcttgtcagagctgctccaagtaaggcagttcaagtgccaaggaaagatgtttggcttgacacacctgttcttcttctctccgtggagtaaacagattggcagaggctgcttcaaacacgttatctgtctaactcattacatattaatacttccaaagtaaatctctccattctgtaactttatttaaatatttttattaatatacagtaatacttttccagatggccttatcagaagttttagtgagaataagcagctgaaaacacaacagctgctctgctggcagcctgagagccctgcgctgtgatactgccaggccccccatggagtcagccaggcctgggggccaggcccaggagggagcgtgggaagccagcctgcagctcccagcattactcatgcccctgggtgggccactgagtctgcgtctaggtttggagtggaaagtaggaggtctgtctacattcccccagctcagctttgcctagggccctgtccttgggggattattagacactgttgatttacaaaagctggtattttcatctaatttggttctctaggtctagaggttaaaacccaggggggccggagggatgactaattggcagcctaaatttccaatgtgttgtgaaagttatttaacctgagtttccttgcctgtgaaaatgtgtgtattgagtactgctgtgacaattacaggaaacaatagatgtaacccccagccccgtgagttttttcttttctaagacacaaaccccattctcagagttatgggagaaggtacatttatacactttaattcagagacctttaattcagagattaaatcaatagcgtgtggtcttggaggcattagatgactttttttttttttttttgaaacggcgtctggctctgttgccaggctggagtgcagtgacgccatctctgctcactgcaacctccgcctcccaggttcaagtgattctgctgccttagcctcccgagtagctgcgactacaggcaggcgccaccacacccggctaatttttgtatttttagtagagacagggtttcaccatgttgaccagaatggtcttgatctcttgacctcgtgatttggcagcctcggcctcccaaagtgctgggattacaggcgtgagccactgcgccaagcccgttagatgactttacaggccatcaaaaacccgctgccatcagaaactctggacccacaagcaagctctcttcttgctcttggcccaggtctggagcttgaatgaggggtgagcatgagctagcatagccacacctcctactccttcctcggccccatctccctccagagttctttcctccatcttcctttcttctttctggtacctcattccagagctttagctgcttccccaatagacgtggctttcaatgcaaatcctgcattctgacctctctcctgggtgctcagcatctgctggacgtctagatgggggagtcttcaaaacgccaaggcccctgggcaggaggacgggtgacagttcggtgtgtatcaactccgtagcacggttgatacaagccttgccttgaagcactttgtcttatggtcagaaccatgaaccatcctttctggcccatattaataagattaaaagctggtagcttgcctttttccctgcctggtttttatgagcaaatataggacactgtctcctgcgaggcagcagcggatgaggctggtcgggggtcactggtaagaacgggtctctgttgctattactctctgttggtctgcctgggtttgaatttggatgccgagagctgatgggcctatcactggagtgactttgggtgagttgtttagcaaatatatgcctcattcacacatttattcaacaaatatgaactggcatcatctacgagccaggtcctgttctaggcactgggaggcgtcagtgctcaaaagaaacaaagttcctgccccccagtgtgtgcgctctcctcgggggaaaacagaccgagaaaaacaagcccaatccgtcatcaagctctccagttatgttagagcagaggtggccgcacttttcagtaaagggccaggcagtgcgtctgttagctctgagggccactggtcattctgtgaaagtggccacagacaatacacgaaccaaaaggtgtggctgtgtcccagtaaaatgtgattgtaaagtggttcgctgacctctgtgtcagagcatttccataggcgccgtggaagcaaagcgggggagtccagttaaggcggatctgctgcgcctggggtgggaggatgggaagagcaggttgaacttcagagtaaacttcatcgagaaggtgcgatttgagtaaagacgggacccggagggagccagctgggtgggcacctgcaggatcccagggcattcccagtcgagtgacgcaggatgaaagcccacggcatgttctggcacatccagagagcaatgcagctccaggagacactgtggggagagagggacgcagtggggaggcctggtgaggacccctggctctcattcccagtgaaatgggcagtggcggggagtgagagcagaactgacaacatctgaagtcctgctctgactgctgtctgggacgaagctcaggaggggccgggcagactccaggagagattagactattgcagcaaccagggcaggaggtggctgtggcttagttccgggcggtcgggggctggcggggggtcggggggggggggggcgacatttcctgaggattgtaagagaggcgtgagaaaagagttataacacctggaaggctctgcgtttcctcatctgtggctggaacaatcactctgccgcaggattatctgaggatcaactaagttgactcacgtaaagggttcggcacatgcttactacttagccattgctcagttcatgtaggtagtgtcgttattgtttattatgatgattatggagttgttcaaatctagatttgactctaagctaaatcacctactagccagaggatcttgaaaatgttcgtaatcttggagtctcaattccccacgtatataaaatgagtttaaggcagaaaatggggaggcctctctgcatgaatggttcctcgcggacacggtaagttgttactgggtctgactaggtctcaattatgtgatcaccactctcttggtgcccctctccggtgttattctgtattctgttgagttagccatgttctccccaagtctctttgggagcagactgccctgcagtcaggccacagagctctggagtcctgtggactccacactcacggtgaagtcgtgggtaagaaccaggtgacgctccgcagaatggcaggctccgtccttccctctgaggagctgccaacagtgtgtaggtggaagaaagtgaattcctcctatgcctagctccctttcaaaaggcatttaatttcctgtgactgatgagagagtttgtatttgaaacggaagcctcttaatttatagcccacaataatagagtctggcaactacagaccctcccggtgctgttcagcggctgccctgcctgcggagaccctcctctggtggagaagcataatgtgcctttcatgccttttgcactttggggcttcatcaggaaaagatgaccttactcagttaaaaaaaatcctcttcatcagatgtgcagtagctgtgaaacatcaagaagaacacatgccattgaagggtgacacctgaattacctgccattttctatttttcaaaacagtctcagccaaaaggctagaagtgaataaataattctaccacgactcctctaaataagattttagcactctgttatttgcttcgaacaggagatcagagaacatttgagagtggcactttgcatttgggacatggcacggaagccgtggctggaggccaaggactgtctcaggcagaaacctttgcctggggcctcgggtgcatctaaacagaatctgggaataaataccaggacctgacacagagcgcccgagaacacagagactggccgctgcctgtgacaaacaacgctgaacaccctccagccttccggagaagggtgcacggctctgacatctggggagaaaatgctggaaagagcctcttctgcaaaattgtgcatggagattgagagcatagtgtcgagtttccaccttgttgagagtttgtgctccagagagccatttgcagcaaagaaagagagaagtctgaattaaaatgacaccagtaccctgccctcactgaccctccccacctcggcccaggacacagtgctgtcgaggagtttcacgtcccaccgctctgcctggctgcttctctcaggcaccccttccttcctggagttatcatctctttctgccacctctgcctcgcttccctttccacagtctcctcttcagaaggcaggaaagagaaaggaacagcagctgggtgaggctcaccctgcctgacttcatgctgtaaatgctccctgtcctctcaggaagtttcccttttaattaaaaattgcatttttgaatgagcttcctcagagctagggagctggaacatctcatttgtgtggcattatccttgttctcaggaatggccatgtggcttccttctcagctggactcctgtgggaagctgtgaacagaaggcgccctgagacgtgctcaggtgtccctgggacccggtgcagcccatgcctctgtgagcttcatctcatgccaacacccccagttcccaggctttcctggcccacgctgccatcccaccatggccagcgtgcccacatgagcccgccaggttccggccttctcccccagttctcactgcagcatgcccacttggcttccattcccagctggccagatccctatgtcctctctgatgtattcggttactctgtgttgatgcactggcgacctgctgcagctgtcattccctttgctgcagtatgtgtatatgaattcttcttctaatggaaagagactcaggaagtgaagggaaagcggagggaggacaggaccctggcagtggaacaaggaacaggaatgtcacggggagtcttacagaccctccagaccgtgccctggaggccagtgtccgggagacagtgggtttccacaaataaatgggaaggggtcccacgaccctaaatgcacattcctccgcccctcagacttccacgtacttgacctcctggtgttatttaggtgttcagaaaaggtaatataatttccaaaggagctgaatttgctgccagaataaagctcaatccctgcgagattctagtccagcagtcaggaaggcaggcaagagcagacagagcctgtctctgattactgttccttctccagcacaggccacagggacacgtgcatagctgctgcttaataagctcttgctgactgaatgagtgaggaaggaatgagtgagtgaaggaatgagtgagtggaggaatgagtgaggaaagaatgagtgagtggaggaatgagtgaggaaggagtgagtgaaggaatgagtgagtgaaggaatgagtgaggaaggaatgagtgagtgaaggaatgagtgaggaaggaatgagtgagtgaaggaattatagaatggaggaatgagtgaggaaggaatgagttagtaaaggaatgagtgagcggaggaatgagtgaggaaggaatgagtgagtggaggaatgagtgagccgaggaatgagtgagtggaggaataagttagaaaggactgagtgagcggaggaatgaatgagcggaggaatgagtgaggaaggaatgagtgagtggaggaacgagtgaggaaggaatgagtgagtggaggaatgagtgaggaaggaatgagtgagtggaggaatgcgtgagaaaggagtgagtgagtggaggaatgagtgaggaaggaatgagtgagtggaggaatgcgtgagaaaggagtgagtgagtggaggaatgagtgagtggaggaataagtgacaaaggaatgagtgagtgaaggaatgagtgagtggacgaatgagtgagcagaggaatgagtggaggaatgagtgagtgaaggaataagtgagaggaggaatgagtgagtggaggaatgagtgaggaaggaaggaatgagtgaggaaggaaagagtgagtggaggaatgagtgaggaaggaatgagtgagtggaagaatagtgaggaaggaatgagtgagtgaaggaatgagtgagtggaggaatgagtgagtggaggaatgagtgaggaaggaatgagtgaatggaggaatgaatgaggaaggaatgagtgagtggaggaatgaatgagtgaatgaatgagtggaggaatgagtgaggaaggaatgaatgaggaaggaatgggtgaggaaggaatgaatgagtggaggaatgagtgagggaggagtgagtgagtggaggaatgagtgagtggaggaatgaatgaggaaggaatgaatgaagaaggaatgggtgaggaaggaatgagggaggaatgagtgagtggaggaatgaatgagtggaggaatgagtgagggaggaatgagtgagtgaaggaatgagtgagtgaaggaatgagtgaatggaggaatgactgagtggaggaatgagtgaggaaggaatgagtgaggaaggaatgagtggaagaatgcataagtgggggaatgagcaaggaagcaatgagtgaatggaggaatgagtaaggaaggaatgaatgagtggaggagtgagtgagaagggaatgagtgagttcgcagacagacactgtgttggtctcttaggcatccctgtcgccatggcccccagactctctgactgtattagtctgttctcacactgctaataaatacatacctgagactgagtaacttatcaaggagagaggtttaactgactcacaattccacatggctggggaggcctcacaatcatggcggaaggccaatgagggagcaaaggcatgtcttacatggcggcaggcaagagagcatatgcaggggacctcccctttataaaaccatcagatcttgtgagacttattcactaccacaaggacagtatggggaaagccacccccatgattcgattatctccacttggccccactcttgacgtgtggggattactataattcaatgtgagatttgggtggggacacagccaagccatgtcactgacctagagcctccagggtctcatgagtaaaaacagaggccctaaatcctgcctcacagtgaaactagagtttgccagcatcccagaggccctgcactggtttatatcaccgctgataatattaggttttttatctgaaaaataaaatctactacagggaagcaggatgagtcaactgccttccttccacctgaggaaaccggtttcaggatgaaacttcctgtttagccagattttgtaaacatgatcaaaccatcgagtggccctttctgttattcttatgggtaggtgatgagttgctttgcttggttttaaggaatcccatatcattctgaggattcaacgttctgcccatacctgaggctgctgccatcaagccccttggcgtgccgttgtcatgagcaccaatgatgcatttcccatggcactgttgcccctccctcacagtgaccccgattctcttccctgcatcctccccatcctccattccatgtttccccaactccatctgcttccttgtaaccaacgcatggcccacgatgagcaccagaatggaggaaatagctcgcccttcccctctcgctgctgtgtgtgtccagctcagacccgggctccttagagtatctgccaggagcagggccttaggggaccaagagcttgctgtgaaacctgaaaagctcaaaccagcagcccccttacagttggttgggaagccctcatccttacttaaaagctggtgccactgttcatagctcagggattgtacgtgcttcccccaggccaggaaaggactgaaaaagagctgggcccagtgggtatgagcggggctcagcatggcgctcacatcaaccaccactcccagatacactggaggaggacacagcaggccaccagctctgggacaagggctaccagctgagacatgctcgtactctcactcatgttcactctcattcagattcctggccacccacctgccccaggccccctgccacaacttatgcaatccttccccatccccttcttcaagggcagcagacactcaaaaaaagtgccagaccgctgacccagcagatgcacgggctgcccagagcctacacctatgatcttttgcatcctagcacaggtacaggaaaggtcactgtgcctggcttagcacttttattcatgatacacatgagacagaatttaatcttcctgtttcaaatactccctgaaatattttccaattctgcttctcacctgaaaagcaagacagggtaaactttatgagaatggatctgctactcagatttatatagatacatcacagttctattgatctgaggaatgctgagaaccttgggaattaacagaaggcagactgccactgggcctgcgctttcttcaggccggtgctgaaggggttgtcatctaacagcgacctgactctgaaagaacactgggtttgcagcacgtgacctcaaattgggtcttaaattcttattccatggattgctgtttattgcaaaacatcacaccaaggttgggcttgctttcatttttatagtgacggccttatgtgattccactgaacattctggcaatctaaaaatatccagcaagcacaccactttcctttgaactgagaggtgctgtcagtaggaaagctacttgtctatgtcctgagaaaggggcactctggaaagactgggtccttccgcattttatgtattagtgtcagcacactgcgtttttgtgtgccatttggtaatttcttctggaaaatcctactcagggagacatatggccgttataacctggcgctttagagaacacacaatgctgtcatcgtctcagagattttctgtccaaaatgcttgtagtaatgaagagtattctcaaccattaccacagagtttaaaaatgtgttctcctggccgggggtggtggctcacacctgtaatcccagcagtttgggagtccagtgcgggtggatcacaaggtcaggagttcgagaccagcctggccaatatggtgaaaccccatctctactaaaagtacaaaaattagctgggcatggtgatgggagcctgtagtcctagttacttgggaggctgaggcaggagaatcgcttgaacccaggaggcagaggttgcagtgagctgagattgcaccactgcactccagcctgggcaacagagcgagactctgtctcaaaaaataaaaattaaaattaaaatgtggcctccttaatacagcatctgcaagtcttgctgcatgcttgtgaattacttggggggatagcatataaatgggcaaagtccacctcattttagataagatttcattggctatttcctaatgttttattttaatgaaataatgaaaagagatgtcattgtggattcttttttaatgcccatgaatggtttctagtgacattgtatggggacaaaacatacacagcagatcttgccaccaacagcattcccacaactgttttcttcctgcagatcctacttgcattccacacatgtccactcccggtatcagcctcgccgaccccctgacccatggcacaggctcatcagccctcaatattgttaagtggaaaaatgaaagagtttttattattacaaaagtaatacatactcattagacaatgtcagtaaattgtaccaaaaaaaaaaaaaaaaggaaaacctagaaaacaaacataatcccacgtggctggacatgggatttttgactcattgctgtagagctttctagatacgttttacatgtatacgcaaacccacatgtccgcaattttaacagagacgagtttatgctgatgggctttttttttttttttttttaccagtttttcacccttaattgtgtgtcacaaacatctttgcatttctctaacgccatgtttaatgatgaccatttgtcagggtgtgccatgacttatgtaaatgtgtatcttgcggaatgatgataattttcccacggccgaatttttcctgtgttcctgacttttctctaaaaagaaaaattcctagaagaggaagttagagagtcaaagcatgtgcatgtttttaaagcttttgtcaagcctgtccatgtgaagagaccaccaaacaggctctgtgtgagcaataaagctgtttattcacttgggtgcaagtgggctgagtccaaaaagagagtcagcgaagggagataggagaggggcagctttataggacttgggtaggcagtggaaagttacagttaaaggaggttatctattgttagcagaggaggggattacaaggtgcatggtggggagatcataagactcattgtccgaaagaagaatgtcacaaggtcaactgatcagttggggcagggccagaacaagtcataatggtggaatgtcataaggttggtcaatcagttatggcaggagctggctgtttcacttcttttgtggtttttctttggctgcttcagacttcttggctcctgcaggccatctggacgtatatgtgcaggtcacaggggttataatggctgagcttcgactcagaggcctgacagctttgcatccaacacttatcctcaactctaagaagtacctttttgtgtattttaacatttctgaaatcaggatattgtaaattgatgtggatgtttacaatggtagtatgatggagcttttctttctttggtcaagccactattaaattgaaggtgctttttaccattaatgtcatcttagaatggaggcatttcagtcctgttaaattacctcccagcaaacaattgtgccagtgtgcagagcctcccaccgagtgcagctgcccccttccccagcccctcccttttcagctttgccaaatgagaagcaatattgtttcttatttatcaagtcagtgcgtttctatatttatgactcactcatgattaattaccattaacatctctcttagcagttataattttggtatgactttttgttttccatgtagattatgactctgtaaaaaattgtgaaaccatatttataaaaatataaagacattttaatgacaaatatagcatactcattatagaggcttttatgtaaatataatttggtgatcttaatttgaaataaatcttaattaaatttctctgaagtcccattttgttaaaaatatccaacgagcctaaaccttggctggcctaagctcatgatgtttccaagtcagcaagaagctctgtccttacccgtagcagcagtgccgagacgctcctcttcagttctgtctgcatttccaagtccatcaatgatggtgcaattgtgttgacataattcattgcctgagaaatgcttacagatttgcaaattccagattgtggtaacatgattgaacatgactcggcgtgaatcactgattgacagaaacaagttgtatgtacatttgaaatgcttgctcatcactgaacacaaagagagaaggatccattttgcctgcagagaatggaaatgactggggccaaaggagtttttgttgaaagtcactgtattgccattaacccaaaacatatttccttcgggctaatactaagaagccactttgttgtgctatatagagcattgcactcaaaatcctgtggttactgatattataaagcagaacttagggtaccattcaaagaaacaaaataggaagttcctatcaagttacagtgattgaagcatttaaaaagtttctatatactgagcagacatctcgccctaaaagaagaacttgaaagcaaccaccttacgtttttggtggatttgagaaaaatagctaaaatgtgcccatagtggatcagcacccttttagataacatcaaactaaacttcatgactttgaaaaaaattgagaaaagtagatgctaagtgggaagattttactgtaaaccaacacctcaaatcaagtgtgtgtatatatatatatgtatatatgtgtatatgtatatatgtgtgtatatatgtatgtatatatatgtgtatatatatgtgtgtatatatgtatatatatgtgtgtgtatatatgtgtatatatatacgtatgtataaaggaacaaaacataaagccaggagattgtgagggtcatttccatccacagaccaatccccagcttcccttatcaggttctttcccagtgctcttaaggaggtgggtttactcccatgctgagccagtgtcagatatatgtttattttagatccttgaaattaacttgacattcctcttcagcaaagaaaagcatcattttccaaattagtgggagcaaaagtctactttaaaagaaaaatctatttggactgccaaattggtaggaacaggcatagacttggcagttaacccttctgctgatcccctgttgccacttctcaaatggcccaacgggtacgagacttggaacacgagcctgcctggctgtgagcactcatggaccctcagtttcccttccctttctcctggaagctggcccaaaatgctgattatggtggacccaaatttatttatttatttatttatttatttatttatttatttatttttaatttttattttattttattttttagacagggtcttgctttgtcacccaggctggagtggggtgcaatggcacgatcttgggtcactacaacctgcacatcttgggttcaagcaattctcctgccccagcctcccaagtagctgggattacagatgtgtgccaccatgcctggctaatttgtgcattttcggtagagacggggtttcaccatgttggccaggctggtctcgaactcctgacctcaattgatccacctgcctcagcctcccaaagtgctgagattacaggcatgagccaccatgcccagtcagacccacttttaaacagcaattttgaaaaagaggggcatgaacacaggatggcaaatgacgactaatgacttttcccccaaatcccattgtaaatcttgtcactgtgtgaccaagcctatttcacccactgccatttgttcctggcccataataaagtaaaggcctgtgagatatttggagagataaatcagcattcagtttaaagagtcagagctggaggagaaggtgggaagcaatgttatcatttagtctatcttcctgccttcaatgaaaatataaaacattaaacgtatatcagaccatcccagtaagagaagaattagtccccctttttatgactttacagaaacatatacttttctgctggaactccattccattgcagtatttacggcttcgcattctgtttttagaagtatgttgctaccgacttgaaagaggatgtcaggttctctgtagcaataaaggggcaggtgtggccatctgtgccatttcagtgacttatctgaataagcatttcaatccttagaaacagagccttcccatggaaaatgcttgattttgacttgcgtcattgtgcagggagtgatatacaccatgataaattttcctgcagaaaagtctttctgaacacagagccatagaaatgaattcttacagataatgtaaacttagagacaccctgacacatttttgttctcttaattttgaatcttaactaaattttgcagatgccattggggtcactgagacaagaaactgcgttcagtggctcatggacactgatgatattagctcaatttatagagttgtcttgtttgcgtcttgatgaatcttgtttacccttcaagacacaaagtgtcactggggctgtggaatttggacagactgtccagggagagcaatcatctcctcctctgtgactgctctaacctctgtcatcccgtctatgcgttgccacacaattttctgtctaggtgcctgtgttcttctttcttttcttcctagaataaacctttattaagctcctactcagggccaagtacttagatagcagctctcagaacacatggggtgagagagctgggaacttgagtctagtagggatgatggataaggaaatacccagtgcagggtggagggatttaggatcaggtcagtacagagtggtgagaacacacaggagaaacagcaaacccaggcctggggtcagggaggtttgcccaaagggatttcctaatggggaatcagagtactccctagaatgatctctgttgctacatggaataccacagactgggtaatttataaagaaaagtttatttggctcttgattctggaggctgggaagtccaagagcatgatgctggcatctggccaggatcatcccacagcagataggcagaagggcaaaggcatgtgtgaaagagagagaaaggtttttaacaaagctcctcccacagtaacccactcccacctcacagcattaatgcattcatgagggtggagccctaatgacctaataacctctgaaagacttcacgtgaataaaatctcagcatgagttccagagaggccaagcattcaaaccatagcaatccctattccaagtcatctaggcaaaggagggctagggagaagataggctgaggagcagaggataaaagcgtggctctccagagagtgattctcacagagatggggcagagtcattacgtgctcctgccctgaggccctgcactgccagagagaagcatcctctcaacaaatgcttgtgagataaaggaatgatttgatttggaacaataaccgaccccatgagcgtttttccgtttctccacaggacaacagtaaagggccctttatgagctattagccttttgaaaatttggttctcatcacagagatgggatttcaaagaataaggagttagatcattgttattatcaaaacaatctggcttttttgtgcttttttagtgtttgccatgatctatgtcgttaggcaatttttaaaaatatagaatattaggtcccaatattattaagagagccagaagaaaaaggggcagtattctaccctacagatgatcagctctctgagggccctgcagttctaacagtctgtgccactaaatcgagagggaggaagggcgcccagcactgagaacagttgatgcttcactctccattgttattcagctttgcaggagttcaggaaatgccacctcaaaatatgatgctttggtgtgctgactccttaacagaggacacttggggaacagcaaattcggggagggcctttctctgaactagcttctctgcaaatacaattgatggatctcagttgtcgtgaatcccctcccagggaattgtgtcagccggggaagatgagtacgtggacaccatgcctggagagactactgcctgttctgctcagggctgctcggagacaacttttattacctgagagattgtttatctacataataagacaacctttattcaccatacaattcctctccttgccctcctctaacctcctccccctcacaagaatccccaagcccctgttcttttctgtatctaggatatagttctgtaggcttccatgatctaacccttcttggagtctcatattctgtgggactctcatgtgtacagaattgaatatgctctttctcctgttaatctgtttatatgccattttaatcaatagcccagccaaagaacctgggagggtagagggaagccatcttttgctcccccacagcttccagaatgtctctcatgttatgggaccaaaaagctatttattagtagagaggcagcaatgtctgtggcatttcctcgactcacctgagatccgcgcattatctcagccgccctgggacacagtcacttgctctttagctgtcatttaattagtttgctttctatgtccttagcaaagcaataaaattgagagagaaaaagaaaacttaggcaggggaagagtcttataagtctgggttttattttataatttcataagacactgcaaggtgtgcatgttgctgggagatagcatttttcaggtcactgaaggcatttggcttcacctcctgctcacgacccccgaggcatgagttatctttggccaacaggcatccagaggagcctttagagcctggcctgccactgagactgtcagggcggtgatgacaatcagctctctaagtggttctggctctcaccattgtctgatagtcatggcagagatgcatatcgagaggataatgtgggaaatgctctcaccattattacccagccccaagctgggaaccttctttaagaggccttaagaatataagtagaagcattaacggcttccgctccagagattggtgtgtgaacaaacatctcagacctctggatctctcatcttctctctcctcctttgagccagaacattcatgaataatcatttagggcagaggttctgggccagaaacatctgagatccagtccagcccccggaaatccaaatgcagctgtctgagaatctcatggagagacacaagcctagaaagtgttcaagacatttgggggatttatttcagcttctgtcattagtgtgtgcttaacttcaagggtgaaatccagatcagtactctaattttttttttttggtggggagtggggacagaatcttgctcttgtcgcccaagatggagtgcagtggcacaatctcggctcactgcagcctccgcctcctgggttcaagcaattctcctgcctcagcctcctgagtagctgggattacaggcgtccaccaccacgcccagctaacgtttttgtatttttagtagagatgcggtttcaccatgttggccaggctggtctcaaactcctaacctcaggtgatctgcccaccttggcttcccaaagtgctgggattacagatgtgagccaccatgcccggccaactctaacttttaaaattaattctttggtgctaaagcaagactggcctttggtagggtggatcttctcctcaattccccaggacgtgactgaactatcacaaatgaaagtcctgttgctaaaaccatgcccgaccaagccttccagcctgatactttacatgcaaaaacaggtgtctttgagccaaccttctttgttggctaaattaagagactgcaataacaccaggccaaaacttacgtgaatggtggatttctatgacttcgtgtttattaagctcattctataatgaaggatggtgctgcagccatcagaaacagatgtttgtttgcagtgtactctgatcaacagtcttccccttgagtaatggcctggacgctatctgtccctggtccaagatttgacaaagtgtgcaaacaagtaaatcagacacagtgaaagttagcgataacccaggacagttcttattctctggctttctttaacaaatgactcagagtgtgtggcagaaaaattcatatgctctcactgcagggcagttacgcctcatattttctttaatttgactgattttctgtcccctgcagctcttttcttcaacacagtgtgaagtgaaactcatatgggtcgtccaaaggctgaaaataaacacagcatcctttattcgaaaaaaaaaaaatctgaatttctttgtcttagaatacgtttaattttcggccgagcgtggtggctcatgcctgtaatcccagcactttgggaggctgaggggaacggattacctgaggtcaggggtttgagaccagcctggccaatatggcgaaagcgaaaccccgtctctactaaaaatacaaaaattagctgggcgtggtggcacacacctgtaattccagctacttgggaggctgaggcaggagaattgcttgaacctgggaggtacaggttgcagtgagcggagatcgtgccattgcactccagcctgggtgacaagagtgaaattccatctcaaaaaaaaaaaaaagattaggtttaattttctaatcttccccatgtccccagctcacctcatcctactttcttctaaaatattggaggtgttctgtcgcttttgttctgtggacccttaactgaactctgcatcgtgcaaggagtcctcagacagcagggtccttgtagacctgcgcagtccagcgtggtggccagcatggtggccactagccctgtgaggctcctgtccaacatggtgcccacgtgaggctcctgagcccatagaatagggctagtcccaactgagatgcattgaaagagtaaaagcagacccgattccaaaagcttagtaaaaatgaatataaaataactcattaccaatttttatatcgattgcatgttgaaatgatacaattttgaatatatttagttaagtaaaatattgaaattaattttacttgtttctttttcctcttttcatatagctactagaccattaaaaattattgctgtttcaattggacagcactgttctaggctgtatcctttcacggtggtttcaaaatcaaaaagacaaaagtgttgcagaattacactagcagagtgaattacactagaatgctggcatcatccctagcactgggattggtactttctgggggctatcatttccagcaaactccattggtcccagttcaccttcctcttcttactgctgaaacgggagagttccctgacccaccccggttgcaggacatgcaacaggcatatggctcatcagttcagccaccaccactgctcaaactccttatgggagggggagcatgcagatgagcaggtgcaggagccaggacgagcacttctgggctctggccccacagtagtgtctagggatgggtgcctgtgactcccaaagcccagttagctgtgtgttacagtgcgctcttttaattttgctgtctgcagacagcttaagtgttaaacagctcagtggaccctctgcctttttgcaagggcagagggccagtgtgacagctttccatattccaagttcttgtctggcatccagaaaaatcaggtcacccatggacttgaaggatggtgactgcagggttttattgagtggtggatgtggctctcagtgggatggatggatggggagctggaaaggggatggagtagaaagatgatcttcccctggagttgggccgtccagcagccaatctcctctctaactgtctgcagcagaactcctctcgacattcagatattccttctcttctctcctctgctgctcttctgctcatggagcctggggtttggagtttatatagggacaggataggggggcatgacaggccaaaaggcaacatttgggtgtgaaaacaggaatgcctgttcccatttagggccatgggtttccaggcttgagggtcaggcctttgctggggaactgccctcttctacccaatatttccctgtctcctgtctgtaacctcctcatctcctcactacaacctgcacctcccaggttcaacactgtgctcccatggaacctcacatccatcatatgatcaggacacagctgactgtgaactctgtgaggccatgaagaatggccagtgccttaccattcacacacagtacatgcttgatgagtacttgtggaatggagggagcattgggtagagcaagggagaggtgaattgtgactcctctgaaactggaaattacatacgttctgcatctttgcaggctccagcaatgcacagcatacattctgagtggagttcctgagtaggaacttttggttgaatgaatgagctagaacagggtctctaaatggtgcatacaagtcactcggggatcctggtaaaatgaaagattctggtctagtacttcttgggtggggcctgaaattcgggttttctgacatgctcctgggtgatgctgatggtgctagtctgggaaccacattctagggaactaactagagccagtgctgtgatgtgaatttagttatcaacatggatgggcgtcccttcaattcatgtctcatggatgctccaactgacagtaactgtttcagcctcctctctatctgtgactctcctctccccctagactccagaagattcagagctgctatggtgctctgttaggaagaccaagggcatgggtgtcatctccttgagaaaactctctcatcaatgtgactctcctaggattttgctgcaaaaccttatcctcctccattgaaagccataaacctttgagtgtgtctccctagcctcgactttctctgggacttcactcccatcctgccccctctctggctagcgtcttcattctctctcttttcatcatcttttgctgttttcaaactgattcagagctctctgttgtgaagccttttccaccccatcatgcctgtgatcttagcctctgaatctagctgaccattgaaccattggaccaaaattatggcctccgaggtcactaaagtactttccctggcagaaagtcttagttattcctcttgtactcaggattgacctctccattctcagtactgggtttcctcagcactgtgctatcctcttctgcttctcagaagttgaggcttttccagctactactgcttgtttattctgcaaaggtttgatgattgccattattctgttaggtccttgcaacttcatgataatcacgtggaattagaagtgacttgaatttgaggtgactgcaacctatccaaatggaaatatgcaataggcaaagtgcatcttaaaagaggagttgggaagggtggaatagattttgagaagttgttagaagagaggcagtcaattaagcttgatgttagaatgctccctgaaggggcaaatgtgaagggcagaaaaacaaatgctatctccacgtgctcttacccactgacctcaacccgcctggatctcttctatgggacccttaagacttacacaagaatactcaattcaacccatgattgtgcattgtatcatggagtacacaattgtccttcagctcttttatgctttataaacatccaccttagctgtaagctacttgactccagcacctggattgccacaaagagacactgatcacctactatgttctagcacctggatcttgggaagacaaagatgaataagatacaaatcctatccctttagaagaggagataggtggagacagtttcatatagagggtgaaacagtttaatagaggtatgagtaagaaacagggcttgggaagaaaacaccttgatcattttggctgaggctgcaggggaaaggggccagaacaggtatacctgcagggcacctatgagactgctcaacatacaataaagggttaatgtatcattttgactgattgattgattgatcattgaggagctgcaaaacctccaaagacaaaagtctgtaagatgtgctggcagggtgtccccaaacatgttcaggcctctttccaaagctggccttgccccaagttgcccagggcgggcccaggtattcagggaaagcatttcgcctcccctgctgtgctagagagcataaggatacccacaggcacatgggacaaattgggctcaaattgccatatggcttggatttcacatttttactggcgtagcgtaatcatttctacagagtctagtgccttgctgcagattgtaaatgataaggtcacgaggattagggaccagttaaaaattatagaagacatatgctgtgcgttttactaatgaatggccatattcaaacatgttcactaattaatggcaatatttgaatgggcccactaatgaatggcgatgtttgaaagtggcattgaatttgatactctgtgaccagtgctccagttctagaaggagccaactgctccataaggtctgagaaatgctcattttaaagcaaaattgggcaggccttgcaggatggtaaagggaattctcagttagatattgaaatttgcccgccaagaagtttgtttagatgaacaggatggtgtgaacatatcattgaacaagagttccagcttgcaaccaggtcctaccttagcctttgggaacaaggtaagccatgacacaaatgccagagctggggaccttggaagataaggactgtccccataggaattgttttcagaaatggttacagtaaagagaaagtaagaaaagaagcgggggattagggaccgagagcatacagcactcccaccccagcttcccctgtcctctggcagactgctgcagtcaggtcacctggcaagcgtcactgagagccaagtctgcaaagctgaggctcacgacacagccacaagtgagggaagctgccgttcccccattcactgtttctttctctctaacctggacctctaatttgttggctgtctgtgtttaaagccgctgagcttaaattcattacaagtcctttcctggcaggcgggccagattcaggcccatcagaatgagacgaccagctccatgtgtgttgagctgaggaaagtcagagtgagcctgaccacaggccactcctgacccagctttggctgtgtagacaagacttaaacgtggtcagagtaattgctttggctaggaacacaactctgtggtgacaaaacatgtataaagaaggtcttagcaaaagtgctgggatgtatttgatattcttttaaagcagcttgacaaaggcggtggttgagaccacagcgtgttggggaagcagcttccacccaccttgctgctaagcctgtgactgacaaggctcgcgaaagcaatcaaaatggaaagtccatatgcccttggacccagctatttcatgtctagaaatttctgctacagatttcctttcacatgtgtgaaatgacctgaagagcgggacattccctgcagctttgtttgtcatggcaaaatattggaaggacctaaatgctgatcggaggggctggtgaaatgaacgaaggcacatctatccactggaatattgtgtggctgttcaggaagaatggagcagctctccgtgtgctaatagacagccatctgtagcatgcattaaacgaaaaaccaacaagcagagtacagcacattatacaatgttttatagggtatttttgtttaaaaatagcataaattgatgattgagtgcagaacatatttctggaacaatacctatacaaacaggtgacagtgattgtctctgggaagctatgtagctgaccaaggaggaaaggagacatttttcacaatgtaccttttgaatctgtgctacctgcacatattttgcattcaaagaatacctactttttaaaaatccatgactctgcaaatgatatttcagtaacgctcttaaagaaaagaaaaaaataaatggccaatacacatttttaagtttattttccctttaagttatggtaaaaatcaaaactattttggagtaggaagtaaatgtaaatgtctttgtccgtaattatagactggatagttaattcccagcagaaccattgtcaggaggaccaccttatcatggatcttttaatgtgaggtgctgaggtcagcctgttgaaagtaagctcagtgggtcttttctcctcattgcatgaactcatcttctctgaggggccctagttctgagacaggtggtactaaagtttcctactagacggtactcatagtgagtgggtcagtgcagactgcacaactgaaagatgggatggttacgtgcacgcgcatgatgatagatgttggtgtaagaaaaggggattttcggggatcttttcagagcttgcaagaatggaaattaaaccaaagaaagtaaggacctgttcaaagagcaaacctaaaacaaaaataagcctagggctgcagggtgttggaggtcacaatattttgtgggaaactaattggcattgtttaatatccctggggattagtacagaatttgtgaaagacaaaggaacgtgggtactctacagagctgtatccagcctcctgaaaattctttctttttagccctttggagaccacacatagaacactgtcttcgtctgtttgcatttggagcttagcacagtttaagattgcctcacaccatgagagtctgtgattttaagatgttgtgtacttgaaaggaaataaccttactttcttcttttcaaaattgtgttttaatgcattataatctaacaccatctccgttctgtggcactgtcttgtcagaacgagttttgcatatatcagcggctggtgactcatagggagacttcctctcttgatagattccctttacagaggctggacttacgtatctctgctgccatcttctggaaagctacacaccaaaaagaaaaatatttcatctattcccaaagaagtacaaatgtgtgcttcatgcctttgatgtttgccttgactctagtaaggggtcctaagatggtatttgatcctctcctattcttttaacacagaatttcagagccgtggaagaaaaataaatgcacataatagaatgcttttataatagatgcagccatgatagaaaacaggcacaaagaaatcttggcttccatagagagatcatcatcaagccttattttaagggtcattgcttgtaggtacctactggctctcaacctgattgatcagcagccactggaatattccgattgcattagaagctgttcatttgcttccttttcatgcttccacagagaaagtacacatacagccccttttgaatgtgttcattatggaaatatgggaaagcaaactcaaacatcaatcaaatgactactgcactgacatgatattgaatgagaggcatgatgggccattcacatagctctctggtagtacagagcgtctaagggggctgacagtgacttacctcagcatgtataccagcaaagagaggcctcatccctttctagacagcagtcttatgtcttatgagtagtttacaagtgtggcatttctggggaggtgtcagttttacccgagattcacataacagtcattattatcagtatactgggaactgctttaattaacaaggcgcttactaccctcttatttttctacagactcttaccacttgttaaacatcatagccccatggagaaaactatttgttgtgttgttgtgtttactgtgtaccagaaactgtgttaaatattctttatcttattatttcttctttgtagatgcaaaaaagctcaagcaaagagatgttgggatcacacagataataaatgatccaagaggcctcagactccgggtctctctacctcaaagggttcacttctaaacactaatctacatctggtatttaaacatgtaaagatctagtacacgatttcacagattaaaatgtgctattcttttatatgttgcctagggccaagattttactcatcctaaaagtaaatactcaacacatattagttgcaagacaaaaatatgacttcaatgttaagaatagtttagctattatgcaatagaaaaaaattggcttattgaatttagcctctattaaatctttttttttttattctatacctccttttaggcatttaggataagctgatgactagaattaagttaaaagtgtggcaccaagctctcaagcttgaaaacataccaaggagaatgtattaggtgaccatgtttattgtcaaatgaaaggaaaccaccacactgttggaagtggtgaactttctcctggtgttgaattctgagaggaatttgccatatggctacctggaatttatatatgtatatatatatagcgagagagagagagagagagaggtttgaactataattttgcaaataacagggaaagtttaaatagttttcattacatcagttcttttgcaaaagattgggaataaagtgaccttgttaaattttttctttttctttttttttggagacagagtctcaccctgtcacccaggctggagtgcaatggcacaatcttggctcactgcaacctccgcctccagggttcaaacggttctcctgcctcagcctcccaagtagctgggattacaggtgcctgccaccatgccagctaatttttgtattggtggttcacacctgtaatcccagcactttgggaggccgaggcaggcggatcacgaggtcagggttcgagaccagcttggccaagacggtgaaaccccgtctctattaaaaataatttgtttctataggagctttatcagccagagcttcaccagagagaccagaccagcaggatgcttatatcaaatatacatacacatacacacatatatgcatatatatgtgtatatccctacatatatatacatgcaggcacacattgtatctatatatctgtgtatacacagatatatggagagatttactggaaggaagtggcttacacggtttcagggctgggtaggcacctcctaaatccacagagtggccatcaggaagggcaggctggaactcttgagcacagcctgacgctgctgtccacaggtgaaatctcttcttcctcagggaaggctcagttatgctcttaggcctttccacagattgaatcagcccccttcaggttatctaggataatctctcttacttaaaataaactgattatagatcctagtcacatctacaagaaagcttcacagaaacaccaagattagtgtctgcttgagtaactgaggaccatagcctagccaagttaatacataaactctcgtcacagggactataatacagtccatgtgtttgattgccttctaaccaaatctataagggaatagactttagagagccaatgaaataagtatgtattattttatgattgtttaaagacatttaaaatttctcgaaaaaaaaaaacaactctacggaaatggatcacatttgttagatccaccacaagagaagacaatcctgaaaatgtatacggtataaacaggactccatgtttcctggtatactaacttccattcggttaatgttgactcataaggtttggagaggtattatgcagcttaagggagcctcagcaaatgtaagaccatttttaagtaatagcaaatccctgggtaaatttcagccttctacatggttggttaaagaaggatccaggcgccccagatatgagacatgcagctcagcagaatggatgtgaaaatgttggagctaggtctgctttcttccccggcaagctttttctctagaaacagctatgccatgggaagtgtttgcaaactggcccgaacactgtcttaagaaggagttttgtatctgcctaacccagagttccccagaattctgttccccatgcccttagcggttcagtacatttttcacggtatttctaggccaaaagaaatgcctaacagttgtggttatgaaaggttttgtaccacgtagcatagtaagaattaatgtcataacgacttaatagttatctgaaatgataattcacacaaatggaaggaaaaattagctttattttattcttaaaaataatcacgtcttggccaggcacggtggctcatgcctgtaatcccagcactttgggaggccgaggcgggtggatcacctgaggtcaggagttcaagaccagcctgaccaacatggtgaaatcccgtctttactaaaaatacaaaaattagccgggcgtggtggcaggcgcctgtagtcccagctactcaggaggctgagacgggagaattgcttgaacccgggaggcggaggttgcagtgagccgagatggtgccactgcactccagcctgggcaacagagcaagactctgtctcaataaataaataaataaataaatcacatctttgttccaaatggatgtttacatggtatttgttttctattctggtaacttccaaaagcccacctttgcaaagatacaatgtcaccaaaaggaaaatagcacaatctacattaacactgggaactaccttgagttaataaatcacatagtgttcaatagccatgctgtgttttacttaaaattctagaatatcccaggcacccctgtgagtttgttacagtaccgcagggcactctggtgcgtagtgtgagaactgaaggttgagagtcttgagtcctggataatgtaattgaaaacccaaacattttcaagatcaaatcagaccttctacattgcacatgagacagattcatgttacttaattgggaaggaccactgcatgatagatctaaatttaaattatactttgaatagaagcaaattagccagtgcctccctgtgaagtcatcaccggaatattcctgcagcatttgcttgccttttgccatgctaaagtggggaggctttcatttgatatgctcttccctttctcttatttctcaatagtccattctttgtagtactggtgtgaaagggaatttaatgtctttgtgtcaggaaaagcctatttattctgacaaactgatcagcctccagggtgttcctctaccatgaaactgattttatatctcatccacgagctaataagatgtgaacggttttccctttcacaccaacagataagatttgcttctctagaaagcagtgggctgagaccccattgccagttctccatgattgggcctcccgtccacatttttccaacaaagcatgtaagagcagaggaatgagtgtgaggcagacccaagtattaacagataaatgtttttaaaaataggagaaaatcctagaactcaactcactattcagtgaattcgcttttagttcagagaaaataagatgtcagaagctgaaaccaggtaatgttggtgatttgtgtaaggacgttctgatgcacacacgctgtcccaccaacctttaaataaagtttacatttcactaaatttgagttcagtctctctgctgtgagaagaaataagaatataatatgctaaaagtgatggcttgaagatcaattgtggcatatctctgaagagattgtttccttataaaatgcttttcctttttgtttctgatgtcctgagattaaaatacttttcagatgaacttttaaaacaagaaattggacgtaggaaaggagaaaactctgttcacatggtgaagacaacatgaaggaaaaatagtgttgagtaaaagccattcttttttgaggcaaggaggaattatggtatattttgggatagagttggttttatatcctggtttctattatttttgtttttcaattcaaatcagtcctgtcttaagcaaaattaggctaaattcctaacttatactataaaatattagtttgagaacttgtaagtctctgtaaatttttgaatcttccagacactactttcagcatattatattcttatttattactgtatcagttatttattgctgtgtaaaaaccaccctaaactttaatgatttcaaataacaacagtctacttggaatatgacccagtcacatagctggcaagttggtgctggctgtctactaaaagctcagacagggctattgttgcggctgaggccgcagctcttctccatgtggggctcccatgggctgttgagcttccttaccatatggcagctgggcttcaagagcaagtgtcccaacaggaaatggaagcttctggtttcttgaggcctgggcctagaaagtggtacaccatcatttctaccatattctaggagtcaagtactcaacacatctggctgtcagcagaagagacataaagcccacctctcaagggaaagaggatactgtcagtttgcctctatgctctaagaccaccaccatcatccacacaccatacttgtggatggcactctctcctctgctgaaatgccttctctgaatacagtttctgctgtgggagatgttgcctacaacttattaaagaaagttccattgaaagaaaccagttttctggtgaggaaactccttcctatgaaatggagtaggggcaaaatagtccctgttgttcttatctccttaaagtttagaacacattgtatgctgtgattgtagccactcagcatgtgctatctcactacctctcccaggggtcatatgagaaagctatcgctgttatcctagcatttccaaggtggaaaccaaggcacagaaaccaaggtggctttcccaaggtgtttcaggtggcaggggatgggatgatgactccagtctggtgtgttccactgctgatccacaactcaaccgtgacagtaacttcagagcatggctggtggcgatgagaatgggacgtgctttcaggagaggtccatggatcccagacagacagccctaaacgagcctctctggcattcactcttccagctttcttctttgtacgatggcgggtagagggcattggttccttgggcgtcttcagtcccatggtgaatgctgctcatcatctctcagtccgtgtgtctctgtcctaatctcctcatcttgtaaggacaccagtcagattgaagaaggcctcccctaacaacctcatcttccctttaccactttaaaggccctgtctccaaatacagttactttctgaggtcctgcttccacctatccattatgtgggggcacggttcagcccatagccacccatttctttttccataataggcttttaatacgaaagtaagtccactgacatgggcatataaatcttctgtgaatgcaaacaaatattgaatgtaaacaaatattaaagggaatgtcttgaatgaagttttttccttacattctaataccaattaaactttgctgtgggtatttatttgcattactgtgtgtattagtctgttctcacactgctataaggacatacccgagactggataatttataaaggaaagaggttcaattgattcacatttgtgcagggctgagtaggcctcaggaaattcacaatcatggtggaaggggaagcaaacacatccttcttcacatggtggcaggaaggagaagaatgagagctgagcgaagggggaagcccattgtaaaaccgtcagatctcgtgagaactcactcactatcacaagaatagcatgggagaaatcatccccatgattcaattacctcccaccaggtctttcccatgacacatggggattatgggaactacaattcaagatgagatttgggtggggacacagccaaaccatatcactgtgtcttccactagactggaaacatcttgagggaaggaaatgtgacccatcatctctgtagccctgctatggtgcttggaacactcttgagtaaagagtgaacaatcccatcaaaacataacttgatttctctttgcaaaaaaagtatttttatacagaaactgttgcacaagccagaggaatgaatataatgaatttggaaaaggaaaaatgtgttattgccaaatgcaacctaatgtccctaattaatggatgtgtgttcttttgcagtttgccttctgccgggaatgtaaagaagcgtaccatgaaggggagtgcagtgccgtatttgaagcctcaggaacaactactcaggtacagaatgccctactcattcctccaagcagggctccggatacagtgggggactggagccgtttcctggaggtcatggagagttccattctaaaaaagcaagaagcagactggtagctgacagccatgggaatggggccgtggcttctcccagaatgactcccctccttggggcacagtgtagacttcccagtggccacttggggcatgtccaaaatagcttttccctgggcagatatggaacagggacaaggcatgtgagcattttcaaaggagtccttagaggggaaataaaacaacttaacagtgtctaaatcagagaaatccatactaagtctacttcaatgtttttaatgccctagtttagaatctctggtgaaaatacctctgtgagtggcatgtacagaaagatgacattatgtaaggatatcattgtcctttagcagcatcatgccctatgctaactggtgtttcagtcctcattaagtaaagaatgtgttggccgagcctcactctctaaggtgctatctcagtcttaggaaagtgcaaatgcattttattttatttattaattaggatcaaccaaaccttcagggaaaaagagtaaaaacgtcatcacagtagatgaatttgctcattatttttctcccaatgtagatgttaacaagggtttaaacaccaaatctttgcaaataaatcctttagtcattgtactgataggaacctagtaaacagacatagaaatcccagaatattttgattttacaatagagaatgttaaagatctgaatgctctaaaatcagagcatgaataagtgtatccctatatggaattctgcagatgagtttatccaatattagcataactaaataaatagaactggtgaatttgggtcttctcgtctgctcctaaattgccagccatgagcatatgagtggatttaggactgagttgccatttccatagcccaggcagcaaatgctctttctgttaattttattttagctcagggacattcaaacgcgagcttaccaggtactgacagcaaaagcaataatggcccagagacccctgcctcaggaccgctgtaatggaggcgggtatacctgaggctctgggaaacggagttagtctagcaatttacatccatatgctctgagactgcaaacatggcagaggcttccacaaagtgatactctggcatctacagtatttatttggaaacagtagctgtaagggaaagaagagcattgcttaacctaaagccatccaggcgcctgaccctccctctaatcccattcattcttcagtcaagaggaaccatccagccttggtgttaaagattaaggtagcccaaattaaatgtttttaaattgttaaaaccttaatattggattcagaaaaataggaaaaagaaagttagagatgacctaaaccatagatgtccagcatcgggggaactgtgtctgcaaatagtgtcaattagcagacattaagttgagcatttgggtgggtcaagcagctgctagactctctagaaaaatgcattgaaaagtatatttcccggccgggcgaggtggcttatgcctgtaatcccagcactttgggaggccgaggtgggcggatcatgaggtcaagagattgagatcagcctggccaacatggtgaaaccccgtctctactaaaaatacaaaaattagctgggtgtggtggcgtgcacctgtaatcccagctattcaggaggctgaggcaggagaatcgcttgaacccgggaggtggaggttgcagtgagctgagatcgcaccactgcactccagcctggtgacagagtgagactccatccccaccccctcaaaaaaagaaaagaaaagtgtatttccctttagaggctcataggggagccatggggggagatttactggaaaatgaatatcgtaattacagtaatatgctaaaccaaagcttagcaactctatagctttatataaaacacttccaggtttccctggaaaagtcacagaagatgggtcagagttggtcaggacagcaggatggtgtggtaaaggacattccagcagagggtgccacatgggcaaagttgcagaagccagaacctcttcaaccagactgtgtcctctgttcccctgtgtctccaggcccaagatgacatctgctgcacagacatttaatagatggtttgttgagtgatggcagcatctataaagaaagagacattatttcattttttttgaaccagggtctcactgtgttgcccaggctggggtgcagtggtatgatcttggctcactgcagactccttatccttggctcaggcaaccctgccacctcagcctcccaagtaactggaactgcaggcacatgccaccacaccaggctactttttgtattttttgtagagacagggtttcagcatgttgcccaggctggggtcttgaactcctgagctcaagcaagcctcccaaagtactgagatgacaggcgtgagccactgcgccccatgagacattatttcattcattcaacaaatatgcattaaacacccgtaatatgttaggcatggttctaggccctcgggacaaagagtaagacaacgtccctgctcccatggagtttctacggcttcaatagatgccacagaggttgcacaagcaactgacatgataggaattctgaggaggtatagttaatccacatcagggtcatcccagaaagaactcaggatgaagcagccctgcagttagacccccccaggagatgaggctcttcctgcttctggttcctgatcacagggccagcctccaattcctcttatttgaaaacaaagcaaaccaaccagccaaactaaaaagatgtctgctggtgaacagttgccagacaacggaaagcaactaattggggtctttgctgccatgttttcctacgtctctgattcggtcagggtccctcgggagagagaagccaacccagatgggcacaggaggagatgttaatgaaagggatgacctgcagaggcgggctggggacacaggaaccatcacagggctgagggcctcagagcgagcatcactggggagccatgaccaccccaggcctgtaaaggcagggggaggaagagtcccatgaaccccatgagctgcagccatggagaaggggcctcatgacaggaggtgtcatcacggagcatccagcgttgcctggaagtagccccacacaggaagggagtgagcatggacatcttgcctcctgcctcctgccatccgatctcttgctaatgtctcccatgggccataccccaccgaagccagacacaagggatcctaggggcacagcccatgggagccagccttccagatgcaaagcagagaggggaaagaatacagaattaccagcaccttctctatgagcgaatttaccaatcttcccaagtttccttatttcaaccatagctgcttttggatgtgggaaggcacgaaccaaacaagctatttcttcaaatttcatgacccaattcgatttgataacagaatgaagggcttttattttcatagagctggcttattttctgttccctacatttctctcaagcagcatggtctccaggaggatgacctctgcagtttcattgacctgaaatctttgaaaggatgacactctacacatctcacaatgaaagcccaattgcagcctcccttggaaccgaaggctttagatgtgttctcacatctgaattttgctaataataactaaataccctcatcagccctcttcacactttctttcaattccattcagttgcagggttctttgctttgagccatttgtgactcgtttctgctgttcttccctttagcattgattggtttctgttcttgcacattacatgctccagccaggagagcccatttctcttgagtcccaatcagcttttcctatcagttagactgttggacctaaaacttaatgtattttttgattaatgcaataattctttaaagcaaactcaaaaattggctttaaattggttttaaaatattgaacaagctttacgttgaaactgctgggagtttgggaaagcagtgacagaagatcaatccatcacagactaacgagagtccagtcccgtttgctttccttgtttttccctgcttgttctcctccccgtgttccagttccttccgcgtattgcccctggaggcttgctaataactacacacttgctcttgcaaaagccacataaactggttctaggtagttgatgttcctctccctattcagcaggagtgcagactgagacttccagatttttagtggtgctctctaaagccgcagaagagatcaatttcagtggctatactttacctaagtagttggggatcagcaactgctctctctaatagatctacagtgtctgaggggaatgtgcccatgcctgcctaccaaccatgcctcctgctcaacattctaggcccagatcatgttacctcctcccagaagccatctgccctccccactacatcctgtaagctttcagacaactgtacattctgatacattcgtcacttgaaatatcgtttctctgtatcttcacaaaaagtctgggctttgttttgtttgtttgtttgtttgtttttgttttgattttttttttttttttttttttgagatggagtctcgctctttcacccaggccggactacaatggcgctatcttggctcactgcaagctctgcctcccgggttcacgccattctcctgccccagccttccaagtagctgaaactacaggcacctgctactgcacccggctaattttttgtatttttggtagagacggggtttcactgtgttagccaggatggtctcaatctcctgacctcgtgatccacccgccttggcctcccgaagtgctgggattacaggcatgagccactgcgcccggcctaaaaagtctgggctttgttagtggagggtttgtgcctgtcgcatcctgtatcctgcagtgcctggcacagagtaggtgctcattaagtgtttgttgaatgaatgacaaatccctccttcatccacacacctccctccctaccatgaagctgggtaagtacaggaaaagaatagacagtagcttcagggctggattatgtctcagtaatcttttgaatcataaaagaaaattagatttccacagtaaacctcagttccttccatctgcctcctaaattagaaaaataaacccaccatttgcttgggataaatataataatttgcttgggatatgcacttgtatcgtgcttgattacaaagcactttcacgtacaccatcttattctgaggcttatctcaagtttttgtgatagattttgtccataggcaagggagagggagggagagtggccacccaggggcatagagttgacaagccccagaccattattttacccaggtctttgggagctgcaccagccagcactgatgaccactccagtcccagtgaagcagaaatgcgcttccattgttcttactggtcactctgccttttgaaagagggggatgagtgggctgttgttggcttgtcaaacacaataccagggatggccaactcaaatgccaacagcaacacaacccttaaatgagtgaggcagagttgaagcctgcttcatggacctgtcaatattttgataaggatgcaaagataaatttcattttcttctgcttttcctattaaaacaaacagaacaacaaaaacacatcaacacaaaagcctgcaagcataatgacacatagccccatgctggggcgggtgggggtggtctgtggcaaactggagtgggcatggcttgttgtggggtgttggggagacacctgctacacagctccccagttcaggtccatgtttacccagcagaaatgtgagcccaatggtaccaggccttccagtgtgattttgtgatgtcagtagcataaaatccatgcgtttttgttaaatatctttatttttaaatgttgagaattaacatttttttaaatcttaaacacatctataagtggaattttggctgcaacgttgtgttacacttcctacattatgtgcctttgaacctcatttcaactgtgaatttcttataattagtggaaagaaggaagaagaaggatgctcagtacacatttataaagcaccttttattaccacgcatagtactaggcattttggatacaacattaaagatagacttggtgggaggctgaggcaggaaaatcgcttaaagctgggaggtggaggttgccactgcactccagcccaggcaacagtgcaagactctgtctccaaaaaaaaaaaaaaaaaaaaaagatagacttggactttggacttggccactgttctcatagggtttgtaatctagtgaagtagaaaaacagtttgacaaataattaaaatgttgtatgctaagaggcacgagagagtgttcaggatgctttggaagcataaaagtgggacctggccagttctccacggggttggaggaattgttcattgaaagaagtgaaatttgagacctacagggatgagctcttcaggcagggaaggaacttatgggtgtcctaagcaaagggacagggtgtgtaaagttctggagatgagcatgaatgacacgttcagggaggtggaagacactcccttgactgtgccataaagtgatggtggctgtggccacagactaggctggagacggagccaggaaatgaagggccttatcagccacaggcaggagcttgggatttagggcagtgagaaggcatctggagattttttaaagattgacgtcatcagatgggtgctttcgaaagatctctggctgtaatatgaaaaacacttagtagggaattgtaatagtacatgttttccaggaagaaaaccctgagctgcttgagattcgagtgcagactgtgtactggaggatgctgtggggaatcgcatgaagcagtttgaaggaaggctgaactgccgtgcagttgccacagcaggtcctagaaggagctctggagctggatgagccttctgagttgttgtgcatggacacagagtggtcaggccttacatccctatgcatagaccaggttttcgatgtgggcttcccgcagaaggaagaaaggctttgggtgaagcagctttcttcagctgggggcacttcccgggtagagacttggcagagagctgtctgctgcggacatacccagcagcagggatatcagtcctggaggaggggtctggccagcctcacagcatctgctgtcgtctgccccttgcactgcctggagacatttgcttgtggaatgagagagactggagaaatgtacaaatggaaggttagcagggtaaactatatgtagctcatgctgccacagctggtcttgaagttgcagctgactcccattgacttccttctctcctactcattctagattcccctcgcccttagagaagacctctaggtggcttacctggtggggtgacacagacatcatccctgatgggtccaggctcctgggtgccattctaaagccatgactactgaatgatttgctatcaacattgggcaggggaggaccaagagatgccacagtgaaccacctgggtgccaaatgcattcttcccatttaaataccccattctataactgcagccctgcctgctcctgagagtcagttaccccttccaggatggcaactccctttctagcctgctaatcccttggcaatgcaacataaagtgaccagaactcttgctgtgttctctggcaaaagtactctcttgctggaagccagggcccctatatatgcaaggccaggttgcacagatggagagcataaactccaagtggaccactgggagtgagaagtggggccgtccctacttccaccccttgattcctgaaccattgcgttctacctgctggagacacaccctgcaccatggtagttgttgattcagagtgtaaatctcaccttagaggatagcgcccacatcacagtgcagctccagcggcatcgtgcaagcctggtccatccgtctcatcaggtcaacagcttctgggcagtaggatgtgtgacaggaccagtgttcccatgggtatgcacccactgggacacaatgcagtgccatgcagggtgccggcagcctgcagatgctagtgctggctgaggctctgttgccaagaaaggcaaacccacacccagaaaaggagtcacttcctgtcaagatggagtgtcttcatcttccctggtgtcactgtgatccacctgacacccactggccagttagttggtctcctcgaggagtggaggacacacaggactccgtgccgctctttgttgccggcaggttgaatgttggcggtgtggcagatggggggatgcccgagctggggggcctggcagggcttcacctcaccaccacgcttcctccacacgggagtgccctggcccaggactgctgtggccagtggcggaggctggcagtggtccactggccggatccctccatctgcttgttgaagtgctctcctgtgagctctgccatgctgtgcaaacatgcggacatgtcctgcccctcccatgggtctgtccacgtgcctgctctgcagagctccttgtcttacctgtcctcagtcttccagattttctctgtccctgcccttaaagaggctgccaagacgtttgccactgcttaggagcttgtatctcttcctaactcaggactctttcctttccacacacagtccactgtcagctgctgcctcatctgtttgggctgctgtcactcaataccgtagactggctggcttataaacaacacacatttattccttccagttctggaggctcagaagtcaaagatgaatgcactagcagatttggggtctcatgagggaccactttttggtttgtagatgacgtcttctagctataccctcacatggtagaaggggcaagacagctctctggggcctcacaggatgagaggtgactggttaatgccctctctttataagggcactaatcccattcccgagggctctgacttatgacccaatcaccttgcaaaggcctcacctcctaatcccaccgccttggtgattaggtttcgacataggaatctggggagacacaaacactcggaccatagcagttgcgttgcccaaggctctgcttattgacagggtctcccctcaccactctttcaaccctaaagaggattacaggatagcgacagtgcatttttggcttgcagccgtatgttaagctaactcaattgtgaaccaagcttggatccctcagtgtgtcataaggaatctccccagcccggccactaccaccgtggggccatggttgtgagcccaaggagaggcagtcatgccacggtgtggatggcacgggggtctgaggacctgcttgtgcagctcgctcacgccccgtgggcctgcttgggcctgggcctagatgccccacttctgtcttatgacaattgctgcacagatgctccaactccacagggctcggtagcgtgccaggggctctctttcaaatggtccatcgttctcagctgctgaacccccaaaatctttgctgggatgctcttattggcccgcaggtagccccacgtgacctcttttccctccacagacacctggaatccacagggtctgcctgcgtgcacagccgcagagacagggcgcttgcatgccgcctgaccctgccctttgctcctcggggccccactcagagcttccagcactttcttccaacagtgacaggctcctctttggccactggcgggagggattccagctctaactccattttagagtttgcttcctaggactatccaggcaccaagtgccacaggttataggttcccaggagaacaggctctgagacttgcaggcagggagtgtcttggggtgctctcaacagcaccttcaggaagagaaggaagcagggttgggcagaggtggagtcccactgcagtgcggttgccacagaagactgaggggagccagaggtaggaggctagaggtgagcccttcgcatccaccctccaccactgggcgtgagctgccctatcgccgtgatgtgacggtgtgacctcagtcccaaggtggtgggactgggagcagagcagagcaccccctaaaagggccaaaccagagacacaccaggcaccaggaatccggccagggaatacagaggaggggatgggcttgaggtcggatctgcagaacttggcagtggattagaagacaggatgagaggagacgggttaatgttgatgcatgaatgtctagcttagaacgatggtggtgccattggctggaagaggagacagaaacaaaagcaggttgttcggggagacacacattcattgtggacatctcagctaggggttcagtggggaaaggagtggatgcctagaccacctcagaggagaatccaggctggagccagcgatcaagatgcaagactgacaatctccaacgaactgccccttatccatgctccccacacccacacccaccccttcagagttacagtccaggagaggctaggaggtgcacctccctcagtggaggacactgaagcagcagtggctccagggagctgagatcttttttgatctattttgccccagcatctcaccgcagagccgtctctcagccattgactgccttcacacacaaatgcagtcccagtattgggagatgggtgtaatttattattcccggagatctagatccccggttatttgggagtgtattttctgaactgcttgttggtttaagtaaagcaggtttgatgccacttctcttgaatccatgaccctggacccgccgcctaagtggatgtgcagatgggatggaacggctgcgacagatctccattaaagccagcgcgtcgttcgggctcggccttgcgctgtgaaaagctgagtcagtgccaggacagcacccgcccctctgcagtgcgtttccaaggcactcagcttgtgtgcgaaggtttgctctggggcagcagaaatggcccttggcaggtcgtcaaaggcccggtttcatttcctcctcttccaggcaagttgctcaaaggctcacagccttttcgtcgcctgccacacagagccagtaagatctaccaagctataaataatgaaatgagtgtgtgtttcgccgtttgtaagttgcaaagtattacaaaatggtgaaacttgggggtttgggtttttaaggctgaatgctaaaactgtcaggcactgtggagagaggaaaggaaagataagattgactgggattgaaagacaagtgaaggcatgcttgcgtgggtacacacacagtgacaccacacgcctgcccctggaggccgatcctgaccatgcagacctggggctggggctctccaagcgctctcctgcactgcagaaacccttcttctcttctggactgtcactccagcacggcagagcaccaaggctctgcaacgcacttccctggggtgcagcttccggccaggggcgtcctccctctgcaggagcctcagcacccccggggggttccctccacccccaggagttctgccttgaggggcatggcctgcgggtcccctgagctcgctcacctgtgggggtcacggcctgcgggtcccctgagctcactcacctgtaggggtcacagcctgcgggtcccctgagtcttcctctgcacggccacagtgcagcctccaccagatgcctgcctggcctgacacatgggaccctcctctgaaaatgatgctgtcctgaaggcttttggattccagaggggtttcaggatcccagcagagttggtaaaaaaggtctgaatgtaaattctgaaccgactttgcaagtctataccctgtataccctgtgtactagactccataaacaagcagctagaacaagttcgcaatgtggaaaatatttttatagaaacttattgtcacagctacacaccacacacacacacacaccacacatatgtcacacatgccacacacataaacataacgcacacatcacacatacacaccacacatatataacacacatcacacatacacacacaccacacatacatcacacatgccacacacatacacacatacacacaccacacacatgcaccacacacccattacacacaccacacacacatcacacaccacacacatgcaccacacacccattacacacaccacacatacatcacacacaccacacacaccacacacccatcacacacaccacccatatgcaccacacacccatcacacacaccacacatatgcaccacacacacataaacatacacaccacatccacatacaccacacatacacaacacacacggcgcacacatatacataacatgcacaccatgcgttacacacacaacacacgcgcaccacatataccacacacacatacatacacaccacacacactgcacatacagcatacgcatatacacaacacacatacacacagaacacacaccacacacagatacataacactgcacacactcgccactcacatacacaccgcataccccacgggcatttggagctcctcaaaggaaagcgcccctggcaattctctgcacaccccactcagtatcaggagggaagcagctgcagtgcgcctctgatgcaccagatggcgctaaacccttaaggaaaatgctggatttgtccagaaacaaaaataaaatgacctgggggaaaagggagtgaacgccactttgaaaggcaccccagccacgcctgcatagtggcccagccgacaacaggcaagagggaatcgaaggactgtgtccccaggaggagcatttctgagaggtgtgcagatttgaaaagctaacagctggatcctggcccccataattccttcattaaaaacggggctggcaggggggacaaaatattgtcactccacagaaaagcatgttgaccatgtgtgaggaaaacggttcacctgctctacacttgttccttgcaagcacagaggcatagcccgtttaaactcagcaccccgcaagcacagaggtgtagcccatttaactcatcacccctgcaagcacagaggcatggccatttaactcatcacccctgcaaagcacagaggtatagcacatttaaactcagcacccctgcaaacacagaggcatagctcgtttaaactcagcacccctgtaagcacagaggcatagcccatttaggctcagcactgctgttctccagggttgcatttaccttctttcagcaaggactaggtgttcccacccgtgtctgaggaatccaagacaagcagagggggcttgaagtcaaacagatctagtcttaaacatgagtttcagcctagctgtgatgggtaattttctgtgtcaatgtagctgggccacacagcccagttgttggaaccagcagtagtcaaggtgtcgctgtgaaggtatttttgtagacgtggttaacatctatactcagttaactttgaggtcaaggagatgaccctctataatgtgggtgggcctcacccagtccatggaaggcctgacgagcaaagacctcggtttcccagagaagagaaaaattctgccctaccgagtgtggtggttcacaccggcagccccacactttgggaggccagggtgggaggatcacttgaagctaagaattcgaaaccagcctgggcaacaaagtgagaccccatctctacaaaaaatattttttaaagatcagcagaggacagaagcatgtgcctgtagtcccagctactcgagagcccaggatttccaggctagagtgagctatgatcttgccacagcactccagcctgggcaacagagtgagaccctgtctcaaaaaaaaaaaaaaaaaaaaaatagggtctctctgtctttgttgaccacagtgtatgtagaccttctgcgagcagtagttctccgaagctctgcaggctagcgacatcggcatcacctaggaatttgttgaactgccagtccttgagcgcaatcccagacctatggattcagacccagaggggtagtgggggagccacagcacaagcgcttccggtgccgctggtctgagagccgccgttctgctaatggggaagctccacaaggcagggattgttggcttgctatttgtcatctctcttgtttactgggatgtatccccagggtccaggacagtgcctggcacatcttagacacccaacacatgtttcttgaatgaaaatatttctgcattcactctagcaaaaataatagtctactttgtgccagaataactatactttgcacaaaaggtaggctctgtggtcggctttgacccctctcacatcctattagtgatgattccgcattcagaatcccatctatgtggataattttggtcactgctgacctaagccaaccaaaaactagagaatgtcattatcaaaaatacaaatcagcatattttctagctcaagtgtagatttttcccatatgtcaacttgtaacaatagttgaacacaaagcacttttaaaataaccaataaatggtacctattaataattctgctacttaatatttatgttgttccatttcccccattaatctcaaaataggttgatagatattattttaattcacttcccctttaggaagcatttagggccccatggggcaagactctgtaagatctcgtctgtggcacttggcacacattccactcctagcagaaatcaccactgttagaatcattgtcaaaaatgcccttctgggccaggcatggtggctcatgcctgtaatcccagcactttgggaggccgaggcaggcagatcacctgaggtcaagaattcgagatcagcctggccaaagtgatgaaatcccatctctactaaaaatacaaaaattagcgaggtggggtggtgcatgcctgtaatcccagctactcaggaggctgaggcatgagaatcgcttgaacccaggaggtggaggttgtagtgagccgagattgtgtcattgcactccagcctaggtgacagagcaaaactccgtctcaaaaatagataaataaataaaaacaaatgcccttctgaattgcattctaaagcatggcttggggagtttggagcttagtggagtagccttgtattgcttacagtgtagccttgtattccccggagcccttggctagacaccccattaaatcccaacactctgatgatttctcttaaaaaaaataacaaaataggccgggcgcagtggctcacacctgtaatccaagcactttgggagacggaggcgggcagatcacctgaggtcaggagttcaaaactagcctggccaacatggtgaaactccgtctcctccctcagcctcccaagtagccgggtgtggtagcaggcacctgtaaccccagctacttgagaggccgaggcagcagaatcatttgaacccaggaggtggaggttgcagtgagcggagatttcaccattgcactccagcctgggcaacaggagcgaaacaacgtctcaaaaaaaaaaataacaaaatacatttaaatatatacatatatacatattctccaaaaagagatagtcataagacaatgtgagaacaacaaaacatgttttggtgacacccgttgccaagcagtaacgttgactagctcaaggcccctgaaaagtgatgccattttcttactcaccagcaggaggcgggctgctcacacgcagcagtgctcaactggcccacctgcttgactgagccaggaaggctgctgtctgcaaaggtggaaggtttcagtgtttgtgagaagagaggcgagcgttgatgagaaagctgacatttaaaagctgtcattcacctgaaagcattcatagctgaattaagccaactctgttttcatgattaatgacaactgctcttttttggaaaacaggcttaaatggatttttaggattagaatagacttgtctaattattggctacacaggtgtcacaaatgagtttctcttaaagcaggaaagataacacatatgcagttccttaagttattctagcttcaatgtatatcaatgtgtctcctaggcgctaattcggcttttttttttttttttttttgacacagagtcttgctctgtcgcccaggctggagtgcagtggcgcgatctcggctcactgcaagctctgcctcccaggttcacgtcattctcccatctcagcctcccaagtaggtgggactacaggtgcctgccaccacgcccggctaattttttttttttttttttgtattttgagtagagatggggtttcatcgtgttagccaggatggtttgatctgacctcgtgatccacccgcctcggcctcccaaagtgctgggattacaggtgtgagccaccgtgcccagcctaattcagcttttaaaacctatataagtacattttgatttaccagtggagttttgtgtgtgtgtgtgtgtttatagagacagggtctcattatattgaccagtctggccttgaactcctagactcaagtgttcctcctgcctcggcctcccatacttgtgtttttaaaggagatttaaggccaatccaggccttcagtggtcttttccatgtgtacaaactcccacagggtcatattcccatctctttagagatgatcgtgatgattacaataacaaagtaataatggtggtgatcatagaaaacacacggttagcattcagggtgcacctggctctgtgctaagccgtttgtgtgttgatcttactcacgatgacccttgtgaggttattcctcttgagccacagatggacgatcatgcctttacctttctgagggaattttgattctctctgtctctctctatatgtatatgaaatatatttcctataatcatatgaaatatatatatgaaacatctatatataagtatattatagatgtttcatatatatatttatgaaatcgctattttcagccatgaagtatattaggagagagacttgtcctgttccacccccacctccaccacgcgtgcgtacacacatgcatgcatgcaattcctcctgccacgggtgagcagtagacaggcacagaattctatgcaattacctaacagttacactgccccgtgagagccacactttattgcacaatcgggcggtgatgctgaatcacaacaaaaccttcccctcctggcaacacaataagcaggcattgctttagagcttgatgactaaggcgggaacagagggtaagttacccagctcaccatgttcctcttcaggcgcaaagggagaatcgccctccagaggatgaatggttcccaaacctcccgcccctcgcaaccccttagggcatttttagggattctaatttctgtaccccgccacagacctactgaatcccaatctccagagtctggacacaagccttgggatcatttttagaatcgctttggtgatcttgaacctgtgggcacccagccactgcttgagatcactccagaaggatttaaacatcagcattaagacactcatgaaggatgcaaagcaaagatgtgctcctcctggtagaaatcccctctcggaagtggcagtcaaaggtctaaaccagtggcctgggcaccgcccactcccggggtgtcatagagctgcttctcctgccccccaggtccctggggctggcagcagtggcagcagtcactgggtctgggactcccctccctccccgtggatccgctgggtgaggataggaagcacaggaagagctgtgatgctgagaagggcaggaactccaagggccttcttggtgaccctttcccacatgttaggtgcagtgggacagttggagacaatgacaaagaaagggcatgagctttggcagccgtggcctcctggtgtccttcttgaaagcactttcggcaggttggggaagggagaaccggccaggcagcagcgatggcccagggcagaagggcgggtgggcagctgggagtggagttgcagtgctggtgccaggggaagcaggcaagtggagggcaggtgagccactgcagtgaggggaggggggctgggtggcttctcccactgtctttaccacaagctgggtgctggtggtggtggtagttgctttcgttgttgttgttttgagacagattcttgccctgtcgcctagtctggattgcagtggcaccagctcggctcggtgcaatctccaccttctggattcaagtgattctcatgcctcaacctcctgagtagctgggactatatgtgtgcgccaccaggcccagcatatatatatatatatatatatatatcaagactgaggttgctatatatatacacaaatatatatacaaatatatatacaaatatatataaatatatatacaaatatatataaatatatataaatatatacatatatataaatattatatgtatttttagtagagacagggtttcaccatgtttcgcaggctggtcttgaactcctgaccgtcgcactggcctcccagagtgctgggattacaggtgtgagccactgcgcctggccacaagctgtttgaaaactgtgctctcaaaagtccccggggacttccagatctccatgacagcatcttagccttagtcccttagccctctttgtagcatgtgacttgataatgacaggaagaaatcaaggctgcaggggcctggagtatgaacccaggcagctcggggctccgattctgaaccgactgctcgcaggccaggcggcctgggtctgaagttatttagttttctgagactgatctctccagctgaaatagttaatgacaagctccgtccttcagggatgcgcagttactacattctgtgatgtgggcagagcccctgccgcacagtgcccttcctcatgtaacagaagcgtccttacttcttcaaagccttcccctcctgggcagcagggtctcggacccgccggccgcccctccctctaacaccctgcagctgtcccagcgccatgcctacacagctctgtgttagcccgtgccgaggtctgagtcatcagattaatgggaaaatcagcacaagtagcgtttgaggaacagaatgccatgtcgttcattgggaaaggaatgctgaactttgacttctaagttagataacagaactgcttcatgccctatggaggaataaaaccataacctttgagcacatactgtctaccagaaaaaaaaaaaaaagaaaagacacatcttattagttttctacaccgtaacccctaactctccaatcaaggccaagatctgcctgggcccttgacagtcccaggaggtcagcgtgaaccccacccccactgcaaaagaaagtgggtagctgtcctgccggctaaaacaccctcccctagcttggtactgttaaaacttcagacacggccgggcgcggtggctcacgcctgtaatcccagcactttgggaggccgaggcgggtggatcacaaggtcaggagatcgagaccatcccggctaacatggtgaaaccccgtctctactaaaaattagccgggcgtggtggcgggcgcctgtagtcccagctactcgggaggctgaggcaggagaatggcgtgaacccgggaggcggagcttgcagtgagccgagatcacgccactgcagtccagcctgggcgacagagccacactctgtctcaaaaaaaaaaaaaaaaaaaaaaaaaaggaaacaaaaaaaccccaaaaaacttcagacacattaaatctagcagagtttaattgagcaagaaaaaaaacaaaaaagcgattcgtaaattgggtagccttcacaattacagcagattcagagagactccaagggtgcctcggggtcagaacaaatttatagacaaaaagggaagtgatggacagaaatcggaagtcaggtacagaaacacccgggctggttacaagttggtgtcggcctcatttgaacacagtttgaacactcagcagtgtatgagtggctgaagcatggctgctgggattggccaagacccagctgttgttacagttgcatactctagagttagactttcaatcttgtctacatattaagtcagacacactcctaagttgggttttcaatcttggctaagttcgaccacaaggactcaaatacagaagtacggagtccttcttaggccatacttagtttgctttaacagtattaaaaaccattttgcgacatcagcattttggtcttttcctagggtttggggtattttctcttccctaggctttcttctctgtctctgaccttcagtgtgggcatctccatgagggggtccttgactccttggctcacgtgtgcctcggcccctcagcagctctggtgtcctgtggacatgagggtgcctcttaacccacgctgctgcccatggcttacaggaaccaaagctcagcccaggaagcctcaacctcaggctctagatctggggaggtctctcttcctgcaaactgctggcatctcactgcatcttctcacagtggaagaggcaagagagctctctggggttgctttaataagggcacgaatcccttcataagagctccaccctcatgacctaatcacctcccaaaggccccaccttccagtagcatcaccttggtgggtaggatttcaacatatcgatccggggaagaagtaacattggcccagttgcagagtctgtgaaggaaatgataagggtacatatccttgcaggtgaaaacagaaattgctgctctcaattttccctcttccagtctaaggatcaaaccctcctagctacctccctctcccctgagtgaactggcccatccagtagctcagtgcacactagtgtggaaatgtttacacgggtagtcttttgtaatcactcctaggtattaaacttgcagtgtcctgatttgaaggacgcttgctgctggaggtgttacatccagagccgtttggggaaatcctagtggctttctggtgggcctgcaagttatacccactctgccttgtgtgctcgggggatcggaagtcagagaaaattggtattttgaaaagtaattatttctcttcttttgctgtaactttaatctttcttcctggacagaacaaagcatattaatataaatttgcaattttccagtttgtaattcctctccagtaatgtgctattgacaggcaggaggtttcttcaagttgagctctgaatctttctcttgggctgagtataacatcctttgttagaataaacattgtattcgcccagttgaaaatgctcttaacttggcaacatgtaacaaaggctttaggtgtgcacacacctgagccagaaacttcagcccctgagtgctcctcttgcagacaaggcctcccagataagtgctaagactctagagtttagcaagacctgccctcaatgataatctgtccacacgggttgggagtgctgggatatttgcagtcatttctgccattttattttatactttctattacattctacatttctatagttttacttcttgcctttcttttgactcttttgtttgccatttccactgtatttttccttgtttagaagcaaattgctttctcttgtattgattaccctagaatgtaaacatatattaatgtaaaaaaatctaaggaccctctgcctgaatcatgccagcacattagaatcatccaattctcacacttctgtgctattcttgtccggcatctagttctactctgattttttttttttttgagacaaagtctcactccgttgcccaggctggagtgtactggcaccatctcggctcactgcaacctccacctcccaggttcaagcaattctcctgcctcagcctttcgagtagtgtaggcaccacacccagctactttttgtatttttagtagagacggtttcgctgtgttggccaggctgatcttgaactcctgacctcagatgatccacccgccttggcctcgcaaagtgctaggattacaggcgtgagccaccacacacagcctacttggattttttttttttaaccagcaaattaagcatcgtttacagttttagacaatcagtatttcctgtgatttaccatacgttacccattttctttttcttttctcacagtttcttcttgcagctcctggctccttctggacttttcctatttccatgtttcttttttttttttttttttttttttttgcggggcgggtggtggcagatggagtctcgttctgttgcccaggctggagtgtagtggtatgatctcggctcactgcaacctccgcctcccggttcaaatgattctcctgcctcagcctcctgagtagctgggactacaggcacccaccaccgcgcccagctaatttttgtatttttagtagagacggggtttcaccatgttggtcaggacggtctcaaactcctgacttggtgatctgcctgccttggcctcccacatccatgtttgtttgtttgttttcttttctttttttttttttttttttgagacggagtctccctctgctgcccaggctggagtgcagtggcgtgatctcggctcactgcaagctcagcctcccgggttcacgccattcttctgcctcagcctcctgagtagctgggactacaggcgcccaccaccatgcccagctaattttttgtaattttttgtatttttagtagagatggggtttcagcatgttagccaggatggtctcaatctcctgacctcatgatccgcctgccttggcctcccaaagtgcttggattacaggcgtgaaccaccacatccggccccaaatcatgtttctttaatgaacttctgttgatgggaaatgctgttttttattactgtgtttttatttatgctcattcttaaaaattaattttgcttggatagaattctaagtgggctggtattttctgtcagtgctttgaagataccatcactgtctgccagcacccatgcattaagaaatcagctggggggaataattgtaacttctttgtagataatttgtgtgtttttttgccactctctccaaacactgtttctctctcatgctctttgttatctccttccagaactctacttagaaaaacactggaccttctcaccttatccccccatctcttaatctccttttcatattttttacttcttggcattttatgtaatttcttcagctccatctttcagttcacaaattctctcttcatttgtatctaatttgttatgtaactcatcaactgagtttctaattttaattattagtgtttcatgtccagaaaaatggacaaaacaaagaaatttgtttcttttttacatctccctggttaattgtgacagtctcttattccattatcatcacctttatttatttatttaaatataacaaacatatttagtttatactcagttaagtttttttgagacagagtcccactccatcaccgggactggaatgcagtggcaaaatctcggctcactgcaacctctgccccccaggttcaggtacttctcctgcctcagcctcccaagtacctgggactacaggtgcacaccaccacgcttggctaatcgttgtgtttttagcagagacgaggtttcaccatgttggccaggctggtcttgaacacccggcctcaagtgatccacctgcctcagcctcccaaagtgctgggattacaggtgtgagccaccatgcctggccagtactctgtctctggccattccaatatctacaacctttgctggttagattctgtagtttctgtaattctgtgactttcactcatgtagctagttttctcctgtattaggtgactttttaacttttttattatgatcccagatttcttagaattttatttgtgtaatttccttgaggtttggctttttaaagtgctgtgctccacaaaagatatttttgcttccgcctggttccagggtatatgccaatctggtaatatttcaaattaatttttgacttgaggttttttaaagctaatcagataggatgaattcttttcaccaaccctcgtgtccgaggcctgatggttaggaatgttcagaaaaatgttttccaaacctgctgcctcacagaacccagcctgagaccagcacatatctgtcaattatctcttcagggcgggcttttgccctggcttcctccactgagaacgtcaccctcaggagtccaggtcctctgtgtgtagtaaaactggattccacctcccacctggctctggctggaggctttgtctcctgcctgtgcccttagggcctgggaagacccagatgatgggcagcgcgggactaagaagatagccccacagcaaatgccaggttccttcctcccgaaccaggaggatttgctgtctttaagggtttcctttgccttcccaccctatcagccgtacgtttaaaaaagatttttttccatatttgatccagcatttttaggtgtgtggacctgggagaaattgcccttcacatgcagtatgccatgttgctaaaaaatggcattttgaaattattttctgataagtaaaattgtatttttctccaatttgtatgacttaccaacttgccaccaacaagcaatctaaaccattgctgcagagctacagagccctagacctgaaaaagaacagcgtggaacatgaggccggggtggcgttggggtgcaggtcggtggggggatgggtgtttgccacgtgtcactgacggttaggaccacccaagactctgtggtgactggaaggcgtgccatgaagatgcatacctagttaccaagttgtgaaatggccctcactaaccacagcgccctcactgggcctctgccgtgagtggatcttagcaaaggaagcactcattgacctaccgttgcctccgagcagctgactccacgttattctagcaaagtattcacaaatcacgtgacaccctggcagttctcaagggtgtttcctttgtgcccatgatggctcattaacagaaacgaaattggcttcacccagtgaccagccctaggcaaagcttgtctgtggtgcccccaccactgtcagggataccacccatgtgccctgcccatttcacggggtcctattttggatgtttggtaacccctgaaagtttagtggtaacccctgaaagtttggtaacccctgaaatttggtaacccctgaaagtttagtgccttcctgggctgcgtcattcattcattcacttgcctgaaatgtactgatcgcctgctgtgtaccagattctatgccagaaactggggatatgaggatgtctcaaatgtgatcttggctctggaagaattgactttccacagaaataacagaaacatgaacactaattcctaaagaaactattaaatgcagtacagttattttcctcataatacttcatctataaagactcaaaaactttaacatttcaaaaaggcttggaattcgaaagtgaaatgacaaagtttggattcatgtttttggtgatgctgcatcttatctggggataatcagcgaatggctggtccttaaggtcacagatgtcaagcacagctagcccaggacctcttgcttccacccccaccagaaaacctccttatacatgatggtgcaggcagcacccagctctcggtgacatgaataatgtcagcaaatgtattaaaagcttgccacactggagtcattctgagtctttgaagaaattaactcatagaatcctccatacccccaatgcacaaggtgtttcatctgagagataaagactgtcagagagcttagggaatgtttccagagtcacccgtctgggtagagctgggatttgaaccagacagctggttccagggccacagtcttcactcacagctcccactgccctctctggcacatcgacttcatttcctgttcttgctcctgtcccttctgtgacaacatttggagttccccatttgccaggtgcaaggaaggataacaagatgtagagcaaagtttaaaagcaaagattccagagtcacactgatactcccacttaccagctttgggccatgttttcacccatcgaatcctcaatgtggaataaaaactagatcctcacttcacatctgatgaagtgtctaatgagaagtgtatttgagcattgatcaccttgcctgcattttaagcacctgataggtgttatttattacaattatgcaaaacaacagaatagaggagctcacactacaaaaccaaacaatctcttccccgctcctacgcatacgccacatgccagggagagtgtccccatccgcctagtagctgtctagcatttgtcaagtgcattgatatttaggcttcttgcccgaaggcactcctgtcttcaagaatttcctgtaccgacgtacagggaacataaactctgatcccagtaatagaaagctgagattaaacgcctttcctctttgtttccccaggcctacagagtcgatgaaagagccgccgagcaggctcgttgggaagcagcctccaaagaaaccatcaagaaaaccaccaagccctgtccccgctgccatgtaccagtggaaaaaaatggtgagtctgtgctgagcagagaatgaggatgtcgtgtgctctttgggggagaatcatacccatcagggattccaggattaaaggagatgctgtctgaaggtgcctggtgtgttgggtaacccctcgattaatgttacccattatcactattattattgtttttgttacacagaaatatttaatgagtgagtagttccatggctatgtgaggcacacagttagcatttatgtggttggaaagggaataaatatagaaactagaaccaagatatggaaagtggttgaggataagtggcagtcaggaggcagctgtggtttttctgtcctccctggtgaccttccccagcgctgatggctgcaccgtatgaccctgttgtctgccggccgtcagtctgtagccttccccagctttgcaacattattcaaaattaaaccctcgtctatatttaaagatccctgtggcctgcccctgatgactcacagtaccagtgggggacttcctgctgtctatcctggacatgccactcagggcaaagccatcacaaccagtggtccgagagccctttctcaatgtgatgcacttgtacgtgtgcaaggcagagtcagcggcaccatcacagatgagcaatgacacgaagccaggcgcagcctctcccagcttctccttaatgagcatcagctacgccctggctggcaggttgcccagagctgacttgcgggagggaagcccggccatcccaggatgggcactcaagcctctctcttttcagttatgtccttcaggaagttttcattaatacaaacaagacggtgcttgaacacatcccagagccgcaggtgctggcttagctcagtacaagtccttagtgctgtatcagtggcttcctgcagagaaaataaataatttacccagcgtgtccttattactccattgcatgcagcagtgctcctagaaaatgaagggattggcatgcacctataaagagcagaaggcggccgggcgcggtggctcacgcctgtaatcccagcactttgggaggcggaggcgggtggatcacaaggtcaggaggtcgagaccatcctggctaacacagtgaaaccccgtctctactaaaaatacaaaaaattagccgggtgtggtggcgggcgcctgtagtcccagctactctggaggctgaggcaggagaatggtgtgaacccgggaggcagagcttgcagtgagccgagattgcaccactgcactccagcctgggcgacagagtgagactccatctcaaaaaaaaaaaaaaaaaaaaaaaagagcagaaggcactgatgggatggaaggaaagagcttctctagtctccaccaccactgggtgcactgggaagtgggagggaaagaacacggaagggcccttcccaggagaagatatgtgatggtttgggataaacaggcctggtatttcgctgacaagggtgtaaagcacagagattagacagtcttgatctgtagcccaggctggggtgcaatggcgtaatctcggttcactgcaacctccacctcccgagttcaagagattctcctgcctcagcttcccaagtagctgggactacaggtgtacgcaacacacccagctaatttttatattttttagtagagacgggatttcactatatgtcggccaggctggtctcgaactcctgacctcaggtgatctacccgccttggcctcccaaagccaagctgggattacgggtgtgagccactgtgcccggccttaatttttgtttgttttgttttttaataataattctcaaggttggtgaggacatcataagttagcgtaacttttctggaaaccactttggcaatacctatataaagactttatattatttgacccaataattctacctttgaaaatctatcctaaaggactaacctgaaatatataataggcaaacacacccacacccccacacacattttaggaaaaaaggtgccaactgcagcattatttatattagcgtaaactgaaaatcatcgaagtgtctaaaggcctcagtatgagaaagattggtttattttgtgataaatcggtggtaaagcttcacacagcccggcactgcagtgttgcaggagttaggactctgccatggactgtggctgtgtgagcaccagtttgctcgttcataagatgggtttcaatgggacttcctcacagcatgggcaggaggagtaacagagacggtgcatcaaacacgctccgtgagacgtgctctgattcgtgtggatgaaggttatgaaggcatggcggaaaggtttacatccatcctcagtgagaaatcagaatttcaaagcaagtggcacatatgtctgttttgaaacaaatgtgtgtgtgggaaaaaatagaatcagaagaaaaagactggaaacaagatgttaccatgtcatagtgagtagctctaggcataacaggaccaaagaggactttatttctttttatgcttttctgtaataaacatgtgtgacgtataaccttagaaaattagtaaaaatcagccaggtctctgtctgcagtggggagggaaaggggatccttaaacacccacccatgttcccacttctggcaggcgtcacaggcacggcaggtggagaatttacccagcaggtctggggtccatgccttagtggcctcctcggtagcccagactctggtggtggcagtttgcaagataagaagtggtcagcgaggctgggagtggtggctcacaccggtaatcccagcactttgggaggccaaggcaggcggatcacctgaggtcaggagttcgagaccagcctggccaacatggcgaaaccccgtctccactaaaaatagaaaagttagctgggcatggtggtacatgcctgtagtcccaactgcttgggaacctgaggcaggagaattacttgaacctgggaggcggaatttgcagtgagctgagatcatgccattgcactccagcctgagtgacagagcaagactctgtctcaaaaaaaaaaaaaaaaaaaaaggaagtggtcagcgaacctggacctgttgctttctgtttctctcctccgtggttgtttggttcagcacttactgtcggcttgtggggacacctgagacacttcacctttgtgacacataacatacagcccagtcttgtggccttaaatactatccacatactgatggctcccaaatctacaccccaccctcatctcgcccctcggtccgactccaatagccagctgcttccttagtgtctccactgattgttcaatggacagctcaaatttcacaaagcagagtgctagctgctcctagaaaaccttttcctctagggtgcaccccacctcagtcaacagcaccgcccagttcctcaagccgctaagctaaagctcatccttcattccatgctcttcctcaccctgcattcaatccccggtcaccacggccttccccgtgctctgatccagcgtctgcccacctctgactccacgtccccagccagtgccctgcttgcccgcctcctcttccaagcacagcttcccaaaagggctctcgcctccactctcgcatatttatgatccgtcctctacatagacgtgtagacttctcaaaggccatgtcagtcctgcccttccccccgggggtccccactgacattgcaaccacacagtcccgctcctctccccaggacgcttctgtgtcgtcactgcccatggctggctccttcctgtccttcagatcttaccccagctgacctcttctcagtcagaccgccccttaccaccctgccaaagacccctgccctcctgttggggggcactgtcaacaccatcccatctctcgagggggaggcactgccattccctctgcagggggcctgcctgtggatggccttgagccctctgggaaatcacctctgccaagacaattagttctggctccctccccttccccggagagctcatgtcccatgactactggttggtcataatacccaacccactaacgaaattcaggaccaccctgagagctgccccatccccagagctcctggacgtcagctcaggcctcttaggctgtgcccgagctgggcttctcctctgcccagtctgccctcctccctttccatctcagtgtctgcttccccctttacccaacgagtcccacccaccagtttaataataatttcatagcaccacttccttcccagatcattgcttaatttgttcatttacatgttccccatctgtcgctctttagaacataagccggtgagatcagggaccttgaccgtctaggctccaatcccagaagagagcccggacaaaaaatatttgctgaattaaaacttagcttgtaggccgggcgtggtgactcacgcctgtaatcccagcactttgggaggccgaggctggcagatcgcttgagttcaagaattcaggaccagcctgactaacatggtgaaaccctgtctctagtaaaaatacaaaaaaaaaatagctaggtgtggtggcaggcacctgtgatcccagctactcgggaggccgagacacaagaattggttgaacccaggaggtggaggttgcagtgagccaagattgcaccattgcacttcggcctgggtgacacagtgagactccgtctcaaaaagaataaataaaacacaaacacacaaaaacttagcttgtaaagtttagagatatacacataaaccgatctttttaataaaataacatagaggaagcaagctatcagggcacacagacccggaggaggaggcttcctggaagagatgataccagccaagaattgaagaatgagcagatatgagcaaggcaaggaagagcaggaggaggcgtcctaggccccaggactgcatgagcaaagacaccgggtgtgcgcgcgccggtgtgcggaggcagcccctgctgctcgtgttccaggcaccgcacgcaggagcctcagctgaagcagtaggtaggatgcagaattgaggtccctgaatggcaggtttggggcttggacttgatcctgtgaggcaggcagatattctaggatgagaagcaggaaaattattcatcggatctgccctggactcagaacatgctggcagcctccaaagatggagttgtaggagtcaaatggttcgtgactgtaggaaagtttctccctgtcgggctatttcttggaaatattgtgatgtactataaatgaaagcactaattttttacctccaaatttttaacttacaaacagaaaagctgagacttgaagcttattagcgatggcctaaactgtttaaaagtgcatcactgtaaccgaaaccgacatagcctctatgaccaaggatgttacctggttgtcaccaaggttcgtggcctgttacatactcagctgtgtttcaggaatgcccttcctccctcagagaagctgaaatgagaatgcgaggaatttccattttaagcacaggctaaaccctggtactttctcctataatccactccagtctccagaaatttcttcacttccatctcaagcagatgaaattctggctccattccctgactgagtgtgtgcttctcctcaaatgtgccttcaggttgttcagggacttccacgctctcattaaatctagtggaagaattgctggccggagccacgatgtcgactgcccggcgtaggctgagcttttcatggtttgagtgtccatctgcagacagaactcactacaaaggaagccatattcccttcatgtctatatccacaaatctgcgtgaagtttcagctgcttcctggatgcacttacttttaagctggcaaagcttttagaattgcggtcctccatgctcctccatggcctgggtctagctctatggccttgtgtatattaagccctagggagaaaagaaagctaatgacgtgaatatcttctcttcccatttccattcttactgtaccaggccattgtaattctagcttctgtaccaagatatcatttacaatgctagtatcccagattcattaaatgcttggtattaatttttggcattcggtctaagtgtagaacaaacaacatgcttcttctattctctcattcaataacaacagtcagcacagaagacttctgtgacggaatgtgcgggggtttttccccacgcaccaagcaagcaatcagttctgcagtggacaccggctgagtgtcctgctcttcaaccctggcgctgtctaccaggaaatagtgtctgatccctcaggctgggggctcagtcccacaggactgccactcaccggtctcaagtctgggcttccggaagttctgatcgactggcttcaagttgagattcccatgactccctctttgggttctgttatttgctacagtggctcacagaactcagggaaacacatttaccagtttattataaaggatattacaaaagatacagatgaagagatgcagagggcgaggtatgggggaagggtcgcggagcttccaagccttccctgggtgctccgcccatcagaaacctccatgtgttcagcaacctggaagctccccaaaccctgtcctctggggccctctatggagacttcctgggataggcacgatggaagcatggacagccgtgttgaaatgcggtgggacagaaaggctttgatctcacgctaaaagatggagtggggagaccctgcaaggcctgccggtctagattcttcttggcctccctgtgcagcattccttcctccaggggatggacaggactctttctgaaatccgggtcttataacccacagtcagaacagctgcggatggttccagtcctgccctgggctggtaaaaggagggcaaggaaaggtcggagggagagattctcttttctggcgcctgtttctgaggcctgaattgccccaacattatgacaaaagactgtaacaagagctatgggagttataagccagggactgtgtatgaaaaacacatctatcagccaggcgcggtggctcatgcctgtaatcccagcactttgggaggccaaggcaggcagatcacgaggtcaggagtttgagaccagcctggtcaacatggtgaaaccccgtctctactaaaaatacaaaatttagccaggcgtggtggcaggtgcctgtaattccaactactcgagaggctgaggcaggagaattgcttgaacccgggaggcagaggtggcagtgagcccagatcgcgccctgtactccagcctgggcgacagagcgagactccatctcaaaaaaataaaataaaataaaataaaatatatatatatatatacacacacacacacacacacacacacacactcttcatacatatttgtgtttatatatgcttatatatattaaatatcacaataggaaagtttcttaccctttcatttagaattgctttaatagttcattaagttttaatgtattgctcaataattttgattgaatatattttacgatacatgatataataatgatatatttatgatatgataaaatatttatgatattttagagaaacaagtggttttataatgtcacaccatataacatattatttacatcataaatatacaaccatgcaatatgtgctgaaaatggcacaaacctaagtggaaagtatgaagataaaagtgttgtaagttttctcctttattttccacagatctgtaatttatgatctttaaaacaagccagaaaggattaggaaaacaggagattttgcatgtcggcaagttatcttaaaacaaatgcctattcctatatattcataaatattttaaattagtgaaagttctcatgccaggtttctaataataaaagtgagacagcaccgaaccaattacttggaaaatttggcaggaaaaatcaattaacaagataattggtaagagtgagtaatggagcaccttcaacgctaggtgggattcaagcaaagaaactgcgtttgccggggttttccaggaaatttggacagaaacagttctctgtacatcctcatacaaatcacttcctcctcccttcagttcccccacagcgactgaagcagggctgtgtgcactccagaaactcatggagtctatgtttaacaagtgagggaggtgaataattccaaaataagttccaagataagggacttttcctcttatgctgaaaataacctgttctgtgaatgacaggacattggaatcacacagaccttggtgagatcattgtcttcaccatttaaaagtgcttcaccttggggaaattctatagcagagtgatgctcttatctcaaagtgctttgggaagcaaatgagataatatacatagaacacctagcattattaattacttcctttctatccctctcatcttaattaaaattttggatagcattaaggaacatattccctattaaaaataatatgctggctgggtgcggtagctcacgcctgtaatcccagcactttgggaggccgaggcgggaggatgacttgaggtcaggagtttgagaccagcctggccaacatggcaaaaccctgtctctacgaaaaattcaaaaattagctgggcatgttggtgggcgcctgtaatcccagctactcgggaggctgaggccagagaatcacttgaacctgggaggtgggggttgcagtgagccaagatctcgccactgcactccagcctggacgacaagagcaaaactccatctcaaaaaaaaaaatagaaataataataattacaatatgctatcccagttcctgttttatgaatttggccaagccaagtaagtggcactatagaaagagcaaaaataaatcaaaatatatttaaattattatacattatattaggttatatcatcaaattttatcaatatatttaaatataaatatatttatatatattttaaatataaatatataaaaatatatttatatatattttaaatataaatatataaaaatatatttatatatattttaaatataaatatataaaatatatttatatatattttaaatataaatatataaaatatatttatatatattttaaatataaatatataaaatatatttatatatattttaaatataaatatataaaatatatttatatatattttaaatataaatatataaaatatatttatatatattttaaatataaatatataaaaatatatatattttaaatataaatatataaaaatatatatattttaaatataaatatataaaaatatatatattttaaatataaatatataaaaatatatatattttaaatataaatatataaaaatatatatattttaaatataaatatataaaaatatatatattttaaatataaatatataaaaatatatatattttaaatataaatatataaaaatatatatattttaaatataaatatataaaaatatatatattttaaatataaatatataaaaatatatttatatattttaaatataaatatattaatatttgaatatatttaaatgaggaattgacccctatctatgaaacatgaagtgtttgtctctaaatcccctttcaggagaataaagtcagatttacaaataaaatttgttcccgacaaaagtgacatgcttcaatttcattcatttcttaatgaatatcatcactttagagctgccctattgtgctttatgaagtttttcccctcagttaagtttctctctgcccttgtattgcttgtgattattcgctcagaaagtgatgtctaggctagcgtgctggtttgggaatgcgtgttttccaggtacttgctgcgaacccaccacacctttgttttctgcccccaacaggaggctgcatgcacatgaagtgtccgcagccccagtgcaggctcgagtggtgctggaactgtggctgcgagtggaaccgcgtctgcatgggggaccactggttcgacgtgtagccagggcggccgggcgccccatcgccacatcctgggggagcatacccagtgtctaccttcattttctaattctcttttcaaacacacacacacacgcgcgcgcgcgcacacacactcttcaagtttttttcaaagtccaactacagccaaattgcagaagaaactcctggatccctttcactatgtccatgaaaaacagcagagtaaaattacagaagaagctcctgaatccctttcagtttgtccacacaagacagcagagccatctgcgacaccaccaacaggcgttctcagcctccggatgacacaaataccagagcacagattcaagtgcaatccatgtatctgtatgggtcattctcacctgaattcgagacaggcagaatcagtagctggagagagagttctcacatttaatatcctgccttttaccttcagtaaacaccatgaagatgccattgacaaggtgtttctctgtaaaatgaactgcagtgggttctccaaactagattcatggctttaacagtaatgttcttatttaaattttcagaaagcatctattcccaaagaaccccaggcaatagtcaaaaacatttgtttatccttaagaattccatctatataaatcgcattaatgaaataccaactatgcgtaaatcaacttgtcacaaagtgagaaattatgaaagttaatttgaatgttgaatgtttgaattacagggaagaaatcaagttaatgtactttcattccctttcatgatttgcaactttagaaagaaattgtttttctgaaagtatcaccaaaaaatctatagtttgattctgagtattcattttgcaacttggagattttgctaatacatttggctccactgtaaatttaatagataaagtgcctataaaggaaacacgtttagaaatgatttcaaaatgatattcaatcttaacaaaagtgaacattattaaatcagaatctttaaagaggagcctttccagaactaccaaaatgaagacacgcccgactctctccatcagaagggtttatacccctttggcacaccctctctgtccaatctgcaagtcccagggagctctgcataccaggggttccccaggagagaccttctcttaggacagtaaactcactagaatattccttatgttgacatggattggatttcagttcaatcaaactttcagcttttttttcagccattcacaacacaatcaaaagattaacaacactgcatgcggcaaaccgcatgctcttacccacactacgcagaagagaaagtacaaccactatcttttgttctacctgtattgtctgacttctcaggaagatcgtgaacataactgagggcatgagtctcactagcacatggaggcccttttggatttagagactgtaaattattaaatcggcaacagggcttctctttttagatgtagcactgaaatccttgctggagggaagagaggggatgaactcaagttttccacatcctgggacacctgtccctcttttcctaactgcctaagataacccatttcttccaaccatctgaggacagtcccgtcgtctcagaggccctgcaccggggagagactgggctctgcagcagccacatcagcattcacagcttcatgtggcttcactgtctgaaaatctaccgactccaacatggccccacggtgacaacagacctgtgacaggaagcccaaagctcacatagaaatggtggacagatcaaagtctctatagtaagggaaaaaaagagaggtggcaggcatgagccccctgcacccagtggctcgtgtccatactgagtccagaccctgatcaaggcctgacttagtgtcactggcagtcccactaaattacacttccttacactggcccgatgcgacaaatcaggtggctcccttctgtcacgtggagcacacagtgttttccatcatccatagctttcttcctgatggtgtttgcattattgcgccttcccaatctgcatgctgcgttgggcttgcggtgcctgaacaaggtttgctcccatgagctcaggcaccctaggatcccctgttagactattaggctgtccagcatggtctcctttcccttcttggtggtggtcttttccctttccagaatagaacagtgattcttaaaataagttagagcaggccgggcgcggtggctcatgcctgtaatcccagcactttgggaggccgaggtgggtggatcacgaggtcaggagttcaagaccagcctggccaagatgatgaaaccccgtctctattaaaaatacaaaaattagctgggcgtggtggcaggcacctgtaatcccagcttcctgggaggctgaggcaggagaatcacttgaacccggggggcagaggttgcagtgagccgagatcacgccactgaactccagcctgggcaacagagtgagactctgtctcaaaaaaaaaaaaaaaacaaaaacaaaaaagcaagatcatccactacacatgaacatgaatcacagtattatttgcacaggaagggtgtaacaaaatatgaatgtatcaaaaaatagaaataaagtctttgcagaaaaagtctgtttttctctgaagtgtgttgagattatctgacaactctaagattgtacttaaattgtcaataaagcatcaaaagagcttctgagtctgtctttgaagatacattttcaatcaatgtgaagggtgacggagggaatcacaggctgtattactccatgggcctcacttgtggcctggaggaattacctggtgatgaaatagccattcagtgacctggaggaattacctggtgatgaaatagccattctcatatcaactccaagctccagattaccgctggctgtttctctttgttaaataagagtagttttttaaggctatcaaaatttgaaagggttccaaaaagcaaaccctcattcataaaaatctaaaagttactttcctgccttactagcaaacttttctaataaaagtgtttaaaagagaagtttgcattggaaaagactatctataaggattttttctcatgtcattctagaaaatttcagtgactttgcattgctgtcaatgtgggtgtgttgacgctgcattttcaaagaactgctttagtggccatgcattgtttatttcacaatgagcccatggtggagggatctggaatggaacattccgagatagggcctgcacaacattaggcaaagaagtacacactgaggtcctctgggtgccagtagccacaggaaacactccgaggatatgcaaaggtcatgggaatggtggcccaggtgatgatagagcaaaagggggcagagaaagtgggtgagctctgggtgccagggtgggaaccccacctccaaaacgcacctgtgtaagagcttcggggacaataatagcatgcaccacgttaggttgttgtc

SEQ ID NO: 15852 - DNA, 205044 bp, Human; identical to SEQ ID NO: 15851
  misc_feature (1)...(205044): n = A,T,C or G

SEQ ID NO: 15853 - DNA, 205044 bp, Human; identical to SEQ ID NO: 15851
  misc_feature (1)...(205044): n = A,T,C or G

SEQ ID NO: 15854 - DNA, 55195 bp, Human
ataagaatacataaatcccagaatatgtgcaacctgatcatagtacacagagatctctctatatatctcttttcttagttcatgctgttctttcaggtagaaagcgccttattttgaattagttgtctttagagcaaaaatccctccaagagtgctgtgtggtttcctatgcacaacctggaatagtccattgcttcatgcctaccctggacatgaagggccatgccacagcggaagtctctatgcacccacccccgtctatacctgagcaacacattcctctttgctgctctcttacaggctacagagtgcggtggcgccagcacagagctctgctcaacgtccctctgtgctttcacgatgctgatggattatgaaggtagggaagaatgtacagccaggaggccattgaggagggcaactaatttataaaatcacatttgtagaatttagtgcatccaacaactaccagggggaaaggtgggcaaaagctataccaacaccacccaagtcaaaaccaaaacaacaggaaaagaaaattatgtggatgtagaatttctgataacatcattcccaaggtgccttatccaagaggaactgctacaataatattttaagtggaaataaatacatgctggaagcattatatattagtagagtatttttttttccccaaagtactttctcaagcacatcaacataagccccctaagagacatttcacattaaaaataaaacgtctgcccactgctggtttctcaatttgcctccaccttctgtcccctttaatgaactgggccacgaggtgagtcagagaggataaagggagtggtaagaatttgaggagagaagagagtgaggctaaaataggaaatcaggaaaagcgattcggtccccctgtccctcacatggggccaccctcttgttgcccagtgtggtttcttcttgagggttctgcatggttcctcaatcccagggaattccgcaggacgttccacccaagaccattgggctcccacctctactcttttgccagttaatgaataggcaggaatttcactgcctggaaagaggaacaatgctttctggtccttatttcacatctaaaatagagaggtcaattgatttattcctaaatatctttgaacactaaaatagaagttttacagcatatatactacctggttgctctagacttaagccagggaaaagtacagattcaacatttaaaattgagatagacgctttccacttaatgctaccagtcttgctttatttcatgagaatgagaatataataatatggcatacgttcatttgggggaaagattgatgtcttataacataatttataattacagaaaacatgtgagttcactgggaataaataaattttgaagataataagatactttcacttatgtcgtaatttctatgtcatttggtgtaggatgtagagatattaacgtttacacctaacttaagtttgtcatctaagacctgaaggggttttgtctatcagctgcacccctgggtagagacacaaccttggggaaggcctcagccccatccctcgtacagcaggaatgagaacagccctgcctgttgggaagcttgagggaggctatggacgtgcagcgcttggcagagggtctcgtcatggaaggttccagcaaatgtgagatacttttatgatttcattttctccaaaagaaagggaataagagaagaggggaggaaataagactaattgcgagagataaagtacaagggtgagggaaggaataaggagacatgacggcagcgtggagcagccgaggggggagattgctttcaccacttcccagcatctattgcagattccaccctcaaacattttgtaaggaccctttattcaaggtaatgtttgaaccctgctgagccagtggcatgggtgtctgagagaatcattaacttaatttgactatctggtttgtggatgcgtttactctcatgtaagtcaacaacatcctgggattgggacccactttctgggcactgctggccagtcccaaaatggaacataaggaagtggttcttctacttcttttatttctgaaatcaggtaagacatagtttttttaaattataataattattttttctcccacaatgtagtaaaaatacatatgccatggctttatgtgcaattcatttaatttttgattcatgaaactcccagttgaaaatcttgtataagattgaggaattcttcaagaaataagtttaagttttcctgtgaagattgtcagggtgctggaatgaatgcgcagagaaaataatgggtgatttttcaaatctaaatgagtgcacccacataatggccagtctaattgaaaaagagccaatgtagctaactatgcaaaggacggctaagctcttcgcctggttctcagtttgactaatttatataatctctgttacggtgtcatgctcccctcacttgcaagttaaaacagtgaaatatctctttgaatatattccgttctctcaccagttcatggtggcggcagggtcggggactcagcatttctccctttgttatggcctgaggaaggctttccatcagtatacgtttgcctcttatccccggaaaaatcacacgcatccatttgccagatgctgtgtgcagatagtgatcaacaaatactcagttgcttgggttaggtccctacatttttacacatacatacatacctgtgtgtgaatgtgagtgtgagtgtgtatcctttacaaatactagcttatttagctcgtggtataggtagggtagcatattcatcctcattttataaacaaagaaatcagacttaggaatatcatgttatttgctcagtgaccaaattctcagatctgggaaataaagaaaactggatttaagccaggtttcccagaaggaatctagggctcttctcacttttcagctttgtttaagcctttgaaagaatattctaaacatgtcctagtacttctttttctttaaaaaaaaaaaagctttattgagatataattaacatatagaattcacccatttaggcatacaatccaatggatttcaagatattgagagttgtgcagccaccatcagaataaattttaaaactattcatacccccaaaaacgcactccactctccttagctgttacccccaatctgcagcttctggcaaccactaatctactttctgtatttatatctttgccattttgaacatttcatacaaacggaatcatacgatttgctagtagttcttcatgtaaataatgtacacttgaaattcaatctataaattaccagataaaattttacaagttgcactttagagtcaaatacatttgaatttagtggaagccattcaaggagctatcaaacaaaatacagagcaggagaaaattaaagaaatttttgtaagaaattggtgtatgttggggggtatgaatattatatttcaatgcatggaaactaggacatagatcactatgaacttattcagtgggctacacccaaaggctagatcaaacttctctgccacaggattaacatatgttttaacccacctggggggaacattctctcataagctcttttggaaagccaggctttctgtggatgtatcatctttccagtgtgctgcaatgcccggggagagggaaaagtttcttttacagccatgcttagtgggaagtggagaaacatcttccatttcacaaattaagtcttttacacatgcaaatatgcatacacattcacacaccacagtgaggaagaaattctcacaccattaataaaatacatttgcatcagtagcaatatacatctgcattttgcctataatataaatgtatttttccactaaaagagtttgatgtttccttgccagcaaataagccctatcaaatcctattgccatatgagtcctagaggtgaataagagaaaaaaaaatgggggaaaattatttcaaattgaaaagaaaaaagtttgattctgttttgggatatttcctagggacaggagctggggaggggatctcagcagcgatgcgctatgaagcataataacatgacacagagaacttaattgaagggggaaataaatggaagttttctttttttgaatatcagttgtagcctgctctgctatacttcaaaaaaactcttcagaaagtttaactgaactcactgtaggacacactttgtggatttattgtgtgttttgaagtcacactgtgagctatatagaattaaccaaaacacaactcttcttgaaaatgagagttcaagttggcagaaagtgcggggtaaagacatggatatgggcctaaagcatctatttctttgtgatcttttgatatatctctcaagtgctttttagtggattagctttagaatgcatcagccaactcctgctcaataatccatttttccagcccggaatgtcttaaattgaggaaggacaaagtcccagaggtggggagcagggggactttggccgaggactttgcatgaatcgatgagcatgcatccacctccctgtcctgccccttgtgctctgtgtaccctcaggaggtcaggacaggcctttctgagaatgaaaatctgttcatttgctttcctactggatacttgtcatcagcatacaaaccaatgcgctctgcagtgtgtcatctttcagaacctcccctgaccgcatgttccctggagggctcgctgtcttcagagccaggcttgtctcctgctgcagcctccactgttctcctagtcactctgtaacccaccccctctgcctgcggcccccaccacgcccctcaaagtggtcaaggttgtcctgttgtctaattccatggagcttgcctgtcttcattttattagcctcttttggcctctcacccttgtgcaaatcactagcattctgtgccaaggacggagctggcatctccaggcttggaatagagctaccaaagctcagccagatgtctggaagagcctcaggacaaggggacaccctgtagccttgtggtgggagcacagctgaggcccccttggccaccctctgccacgaccaggcagaaagcagctttcggacagattcgttgtctcagatttgatctcaaagaaaaaccaagaccagtatttgtcccaggtcctgcttttttacaatttcctccgaaatccagatacctgtcaacaccttggaaaaactgacttctccccaattagtagtgttgtgtgactgtcataagcccagtacaaaaatggccttctttgttggggagcttcttaccctccagtgttttgcccaatttttgtccaaggtggcaacataatttagttcagttcttgtttatttccaccatcatctatgcaccaaaatttatgtttctcaaggagggaccattcagaggatgcttcccaccggttcaagtgacagtgccagaaccaaagcgcatattgtaggaaatcaaacaatggcctccaagttccatttctacccagggatgaacaaatcaacatcaatcttggtaacacaactgccactgatggtgccttactcttctctcatgacatggcacaatcaatagcaaacataaaatttgttcttgtttaaggatttatatccactaatatggtaacatagtagtggttccatagttctaacctgtttgtcaatccagttaatcttttactatcttgcaatctgctaatgaaactgtttttctttgttttataatttcaacttttagagtcaggggtacatgtgcaggtgtgttacataactaaattgcgtgacactgagctttggggtacaaatgatcccatcacccaggtagtgagctaaatacctactaaataggtagtttttcagcccttgccttgctccctctctcccttctctggtagtccccagtgtctttagttgccatctttatttatgtccaaatgcccgactgtgtgttcttaactaaacattttgattcatagctacccattctacttccagtaaacagaaagttttatttggttaatgctaaccaaatagattaaaaggaagtcatgacaattagacattgacattgatttactgaccatttattccacttggatctcccacctctaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcaggtatttccattgtcgttgcacctacgcaggaatctgtaattcagatggcaagtaatttactcacaaatttattaatgatttaagaggaaagagaaatttatggagccagagtttggaactatatttgctcacagtatgtgaagccatactaacagcttcttgttaaggtttattggagtctttgttagaaaaataccctcaaaggaagttatttgtttttacaccggacacaaacattagcagttattgttctgagctccagttttcaacatcatcatcagtaaatgtttgttgaggatcaggtgaatgaaagtgtcctagatagatctgagcaatgacttatagctacaagatccagtgcctgccctttagtatttaaggtgtagtcaaagaaactggatataatgttaaaaaaaaaaaaaagacagcccaagtgaggtacaggcataatcaatgcatgctctacccagatccagaagaaagaacagtgcctaaggttgaggcagctagagaaggctcagggaggaggtgggaactgagctgggtttggagttgagagagctcttgacaagcaccaggaaggcaggggaagatgcggccctgcaccttctgagggggaccattaagagatgaagttgactaaagcagagactttgtgtaggtgacgggcctgggaaggtagctatggatgccagactgagcacccatagcaggaccacgggatggagatgggaggggtcaggggccagggtggggtggaatgtggagcagaggttcaggggaactgatcagagttgggaggtcatggagacggactatcttggggaatgggttcaaagcaaccagagttgcttctttccaacccaaaaacaaaaattaagaagatgagtgaagaagaagtaaagcagttgaaacagaaagaaagagaaaattatgagggagggaaggtaagggcagataagatttgctgccacgttggtgtattttgttcagtacttcatcaatgccatgcccaaataactgaaagaggcagcaattctgagctctctggtccctcaagatattcaatgatctttagcatgtctcacttattaataaacatttgttttctttaaataaagaaaaatacttattggatttcctgcttcgttctgcagggcattccaatatcacagtaaagagcaacaatgtgtgataatggctgaaaacaggaagtcctccataatcattaggatgagagatgtagttttatttgaaaagtaaagtgagtacattttcttcctcctcctcctactgtcctccccatcctcccactcttcctctttctctattctatctttaatttatgagaccagaggaggaaggcgctatggtgttgtaaaattgaattctgagttaggacaggatttgattactaactaaccatgtcagcttgagtatattacttcacctcctagatttaatttttttttgttcaaaaaatgaaaggattagatttacaaaatcacttctacctctatgaccctgaaaataagatttttaaaatattattttatatttaacaaggagatgggaagtctaagcattccttttggtcttggcttcttattctgcagggtgaccatggtccttgggccctaacatctggatgaagccttgtaaaacagaaatactgaggtgttttaatcctcagaaacatttagattgggacacaaatcttatttttactcttaaatttttcacattttgggggacatggtctatatttttctcagatttctgaaatgttgtcttttaaaaatgtgtaaaagttacagttccttttctatagtttattttaaaatgtgggtcaatagtcccactgcttagaataagaggcagacaggatttcaatagaaattgcatgcctttttagatgtgcaaatgtttcattaagcatttcccatcaagtatatcccatcaagtatgctcccattaagcatatcccatcaagtataaatatttgaagggatgcatgacactttaaaaactgtttcctctactgtgttggtagccaggtattaagactgttaatagtaacaatttagctctccaaacattctgcatcccaggtgttaaagaggactggaaacaccttagttcttgtattcttgaggatgatttgccatattgtgtctagtattacggcaaaactctaagtagcattttaaatagtatttatttgggttggaattatttctatgcattgactcatcttcctgggtttcattagctgtacgcattgtacttccttccttaccactatttatctcgaattcttgagattaaagtgcagattaaatctaaactttatctggtgaagttattagttcttacaagtagcaagcaaacggtaaactaaataggatcacctaattgtaccagattttaaaaaaaaaaaaccctgattctcctgattctctctacaaaatgctaacatttaaatatgtcatttgtaaattgttaaccagaaggaacatgggaatgactgtaggttgagtttgaagtctgaagtttgaaggcttagtttgcttgttttcaaagtgacagaagggagcaaaaggttatataaactctgatgggtacatacaaaaaaaaaagaagtgaaaagtcaaaagtcagtcattttttggtccttgtttctttgctgtgggatattgacctgctactaacttacctgccagggttttgccaggaacagtcagtgttagatcacatttacttctgccacttgccaccagccacactgccttcaccaagtccaagaccctatcaccactggttggggctacttgtagctgtacacatgatctctaagaaatgtaacttccctgtttaaagcccttcctagtgcccttaaaataagacccaaagacttcccaaatgtgctagggcccagcattatttaagtaacccccagctgctgtttgcttggcttgctaaacttttctacactggccttacttctgttccttcaccaccccaagcacacaccctcctgcctgggaccctcttcacctttgtcctgctgtgccagctccttcttatctcctaggtgtcagctcaatcatcatgtcctttgcaaatcttccttgacccctagacctccctttcacaaagtaccttgagtttacacttttgatgagtgtcttatgtctactgtaatactatgtcccaatgaagatgtacttgcaatcataatacgcagtattgggttaaaagcattagtttgctgtaggtatgttaggagcactttccccatgtgattgatcaattaattaaaaaatggctaaagtgggtaaccttaaatgatggtgcaaatataccttaaacattttatattttcattgaaaacacaagtgtacttgacaccttttgacgtagagcagaggcttttcttcttcgaatatggggtcaccagtagaaggtctctggtgtatttcctgcataaactatgctccagtgcaacatctacaataattactttccttatttttgaagtggaccatatctcgacatttattaatcaatctgaatgtgtaaaacctttagatttttatgaattcctcctcaagctttatagtcaactatatgagtggattgccctctgtggatttgatagcaattttttaaatgattcatgtttcaacttgttaaaaacatttaatttagttaaaaaccaaacaaaaaagagctttgtttcttttcacattcatttctcagtttagatcatctttaattaaatataaatgtaagaaagttggaaaatgcaaagaaatgactcgttgtaagcacataactcacgtggggggaacagacatgggtgggcacactagcaaacacctgccagctgcatgtggacccaggtgggcaccggactgttttaaacacaggagagggcccgttgtctaactggtgagttggttgagtggaagctggttgagaacttttactgcaaaccatttacagtagaccacaattttatagccctgtttggcactttttcatatcactgggagcctgaagaaatagaagtgggttggatctctttcagcctctgaaaagcctgccattcccccatctaaaaagccctttccccattctctcactctgtctcatcatgtatgtaatatgtatcatcattaagtgatctcattttatattgtttccttgaatatttcctgtaacccccctgcctgattccactagaatgtaagctccatgacggccaagcctctggctgcactgtgccccgtgtgtccccagcatcctggtggggctcgatacacagagagctcataagtagcatttgaatacatgaatcaaagaatggctcagtttactgcagcctttttgcagatgcaaaagatgatcttttagaaagcagaaacagggggtctggtgcatgagatctttttctcaacgtgactatgctgtgcagaccttcacgtggtgtcttgtgaaagactttgaccactgtgtggactttcccttcagtgtatctctcagagtgcaagactgggaatggaaagaactacagagggacgatgtccaaaacaaaaaatggcatcacctgtcaaaaatggagttccacttctccccacagacctaggtaagacattccctttcatctttgtgttcatctactgtaaagttgtccctctgtgtctgtgagggattggttccaggacccctgtggctaccaaaatccatgcttctcaagtcccttatataaaatggtgcagtatttgcatataacctacataccttctcttgtataatccctaatataatgtaaatgctatttaatcgttgttatactgtattgtttttatttgtattatgttttattgtcatattgttattttctgtcatctttttcaagtcttttccatccacagttggttgaatttgtggatctggaacccatggatacagagggccaactgtatttaggataatttcatcacttttaattcaaaccacaatatgtgaataagcagatagaaagaatctttttgatgtcgatgttcaactatttttggcaccatagtagaacatggttgctttctattttttcttggatatggaggtttcttgaagacctagaacatagaagaatgcctagtttaaaaaaaatcaatgaaactatgagttttaggccaaatctgagaaaagatcaaagatgactatgtttgggactgaagtaagcatatcaagttagaactctcatcacatgttcgactcaaattgtggagcaaaagagtaaataagatataaaaatgaaaatgaagatacgtgaaattcaaatgttgcaacttgcctattatttattttagtgcatttttttgtacttttcccagtttggtgttaggtggcattaagttctcagtaatgacgcttatcaaataggaacttagtgcttgttactcacctttatccattcccccaacactcaacaaattgcctttgctatatccctatgagatgagcagatcaaatattccccgtgagttaatgaaaactgattcaaccaaatggcaaagtcagagactatcgggggccatggagacactctgggccatttttatgaggtagtctaggctcatctttatgagggaactgaggtctcggggggtgggggttatcccaaataggttcacagaagaaccagaaataaaacctgcctttctagactgtaagtcttgtgattttcatctaaatggttgtctctatacagcaactcatctctagaactgaaaataagcttaaatccctcctccatccccaataattcaagctgcatttcagagaaaaccaggactttggaatcagacagatcaactttgaattcttgatctgcttcttcatagctatttacacttaggcaagttttgttttgttttgttttacgttgccactcagttttctcatctgtaaaatagggataataacaccttcctcaaatggttttattaggactaaaagagagaatgtgtggaaagatgttagtggaattcctggcagatagttcacatggacaaaatggtattaactacaaaaatttttacagagaaaacggtaactgacaaaagcaggtgtttggaatgaattaagaccatggcagccttttgaggcctttatatttctcctgactgtgcaataaaaatattttggctctctaagacttggctgtcacagtagcaatggtaatattagctactgtgccagaagcagcctatcaatagagaaattgaaaatctgaccacacaaatgctgcagcacccagctgaaatgcatttggatgacaatctcagatgggaatcgagagcatctccttctgccttgctaatagcaagctgatttttagaatatagtctaagtgcttcttttccatcctccccagattctcacctgctacacacccctcagagggactggaggagaactactgcaggaatccagacaacgatccgcaggggccctggtgctatactactgatccagaaaagagatatgactactgcgacattcttgagtgtgaaggtcaggagtggttctagaaaatgttttcatttctgcccttcacctgtaaaataatttgttgtaaagccccttcccacagggatgttattaataattgagtaacgtattcacctctcggaaagaagcaaaaccccagaattaacctgaattttttttttttctgagacagagttttgctctcgttgcccaggctagagtgcaaccgtgcaatctcggctcaccacaacctccgcctccgggttcaagagattctgctacctcagcctcccaagtagctgggattacaggcatgtgccaccatgcctggctaattttatatttttagtagagacagggtttctccatgttggtcaggctggtcttgaactctcgacctcaggtgagccgcccgcctcagcctcccaaagtgctgggattacaggcatgagccaccatgcccagcagacctgaattattattattaaaatgttacatcaacatgtacaaatataaaactacatctaaactctaagtacaaacttcttatgcttaaaactcttacacagtgttaaccccaagacagatttgcaattaagtagttaaaataaaacaacaaagtcaataaaaatcaaataaacaatatacatttaatgtggtagactttgctgttttgctgaagctaagcaaggaaccagtttttaaatcagcaatccgttattttaatggactgagcaatttaatagtgcacctcaaaggtcaatgataaaaactaaaaaaaaaaaattcctactgaaaaaactgtcatcgtttcacatttctggctacgttagtgcaaaagggaataaataaaggtgagatttgtgtgacagtgtggatatggtactgtgtgacaactcagttctcccatcacttccacctgtttgaatcatcgggatcctttatttgtacaccatgttatcggtatttgcccttaagcaccaccaatgcatcactgttatattaagtctgcccgttttccttagtactccataaaatttaagtcacatattactctgcctcaccatgttacttcaataattctgaatcaaagtttaagtttgtgaataattttgcaaaaaaagagccaatcatgcttctcaacaacataaaaagagaagcgctgtcacttcaggtgaatattgttctccctgaggccatgagcataaacaaaaactccagactaaaaccctgagacggtgccaggtcattcagcagtcagcggaatgatcagaataatttcatacaaagttttaaagatcattattgaaatgaagatgccaaatattgaaaactcctaatggagaacgtagactcctgggaatatatgcacccttggctccccactggcctgtgcatcccggtctaaggacatggcatcatggaaattctgaacttggtcatgactacaatagttgagggagtattgactaaaatatgtgaatgttacggtttaaaaggaaaatgacatttggattatgctagaaaatcctgagtccttattgccaattttattgccaagtgcctgttgtgaattacatcggaatgagaggcaagtcgcacttaagtgagtaggattctggtttttactctctattttgcttcatccatttcagttttcttcttcctctctgtccttccttcccactctgtccagaggaatgtatgcattgcagtggagaaaactatgacggcaaaatttccaagaccatgtctggactggaatgccaggcctgggactctcagagcccacacgctcatggatacattccttccaagtaagtctcactgggaaaaacattccatgtttaattaaggctctgcagctctatcagacatttgctgtcatttagatattttagcattcctcaagaagtgaacgcctgatgtttttaatttcaaagctaacctcctcccacaatattgcaagtgaaatacgcattcttgctgctcaaaatatggtccacgggtcagcagcagggatgttttctgagagtttgttagaaatccagaatgtcacaccctctgaatctgatttgaataataaccagatcctcagctgatgtgcacacacattcaaacactaatgtcagtaatgaatacattaacatctgtcttcagaaatgcacacacacatgttgctggtgtattttccaaatattttccttttctctttactccttgtctttcttttccctttgtaccaatgagattcaagtctcctaacctttgacctatgagcagacgtcatggatttttgaatccctgatgttttatgtatatttacatcaatgtgtttttctggaatgaggattcgtaacttccatcagattctctaaggggaccacgaatttaaaataagaataagcttcttgctctagaaagtcatgatggttcctagaataaggtttcgtgagtattctatttcacattaattgtgctggaaaacacctcccattccacagtcgcttctggtcttcctcttcattctatgatgactacagggccataccagggctttcaagaatgcagaagtgaggctgagccacagattccacggtggaaagcagctctattgaatttgtacacctcccattccaaatagctagcttaaaacacagcagctgccattttccttcaaaggagaaatacaggaaagacctaagggtccaaaactgggtaaaggcacttccaggaaaccagaaggagaagaggattgcttaagccgctgctggctcctctttccatcctggtaagcatttacaatcagagagggaatgaataaacgcagagggccaccaggcatggagtgcatccaacagccctggccactgggccccactgaggaaggatccagccccatactgcatggtgagacccttgcaagagcacagcttctcctcttggtttttctaagcttcaaggctggtgggagcagagcctggtagaccagaaggaccattcctttaagctatgaagatgcacatttcttggctctgttaggtactagatgagtatctttaggcagggagcactttacattttaaagactgctatcatttgtggttgaataactggaatttgcttacatcaattttccagatggccaaaatgataaggtcactgattctgttgagtgatttttacacatgtaaactgttagaaaaacagtgcttggcagccgggcatggtggcacatgcctgtagtcctagttacctaaagggctgaagcgggaggattgcttgagtgagttcaaggagttcaaggcaagcctgggcaataagtgggaccctgtctctaaaaacaaacaaaaaaaagaaagtccttggaatacagggccaaccttgtttccttgttgccatctctgaacacagccttcatctgattacctcctccatgcccgactgtgcctagcacacagcaggtgctcaatgtttgctcttgaaaaagagtcttatccatgaatgtaaatgttcagtgctactaaaatctttcttgtccattcagatttccaaacaagaacctgaagaagaattactgtcgtaaccccgatagggagctgcggccttggtgtttcaccaccgaccccaacaagcgctgggaactttgtgacatcccccgctgcagtgagtatgatgcacacccagattccaggatttggacctgccctgttcttgaaatcaaaagaaaacatgtgtcagtgcctgagtgcagcctctgaaaagtgacctacaagtcctatgggatgttattggtctttattttattgctggtttaaaacagttatggttattggttactgtgggtgattgatcagagcatccatttatcatgtttttctttctttgcaactgaaacttctgcctcaggagttcactgaaatgtaggctttaggtgttgttcatcctattctctctgtgctaaagggaaatcagacccatgctctctgacacatggatttcattttcaaccagagttctaatagttgttttgtaaacaaagagtgtctttgtttacaatgttcaggtctgtgggtgtccagtttttccaccttggggagcagagggtgagtggtgggggtggggaagagttcaagaggagaagatgaaatggcagacctagtagaaatgatgtggagtaaacaattttatcatattttcctctctgagaatttgaagcaaaggattacacactaagagaaatacaggcatgaaaggttaaaaaggattcagtgagggttggcctcccctcctttcctctgacatgtgtcctttgaaagcggaagttcctcaggcattctccctttttatgaatattaatttctctttttttttcagtttctctttttgtcatcttttttcctcaagaatatcttgatttctggatgcacacacttttccttggaggtgttttttgccttctttccatggactctttccctgttgtttggcttttatggcatgttgggtgccattcagtcatgtctactcagtgaataatttattcttcaggaaagagagtggacctttggtgtatgtgagaattcggggtgtgaggtgacacgtgttgatacttaccaggtaggaagaactgagcaaagagaacatagaaagaagcacctacccaagggtctttctctgaaggagttccttgtgaaagggtctcacaggcatagatgctactaaattgatttcatctgaaaacatgaaacaattctcaagtgccaaattccaagagaggctgagcaaaagccaagacaggccagaacaccctgcagccatcctccttaacatccatctgtgcattctctattttaaaattattcattgtagggctgggcacggtggctcacgcctgtaatcccagcacttccggaggccgaggtgggcggatcacgaggtcaggagttcaagaccaacctggccaatatgatgaaaccccacctctactaaaaatacaaaaaaattagccagttgtggtgacacgcacctgtagtctgagctactcgggaggctgaggcaggagaatgacttgaacccaggaggcagaggttgcagtgagctgagatcgtgccactgactccagcctgggcgacagagcgagactccgtctcaaaaaatatatatattcattgtaacttattttgcccattcaagcaacacctccaccatcttctggtcccacctaccagtgtctgaagggaacaggtgaaaactatcgcgggaatgtggctgttaccgtgtccgggcacacctgtcagcactggagtgcacagacccctcacacacataacaggacaccagaaaacttcccctgcaagtaagtcccctccggtctcattctgctgctatggaatgtgaaatcccattgactttgccttagttttagttactgtaggaacgcaggataaagtattctggaagaaaaactgatctagtcataagtaaaggaaatgaactttagcacgttttttcccgtaacggttgttctcaaagcgtggttccctagacttttttctttttggaaagctaaactcacaatcacttctttttcagaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacaggtaagcaagggtatgggagcttactgagggcccaagttttctccttatttttgtataccagtggcatcatcacaatatacagtagctttgtaagtttaatgctattgtggtcagaaagcctgcccttatgatttcagtttttttagatttgttgaggtttgttttatggttcagaatatagccatcttggtgaatgtttcatgtgctcttgaaaagaatgtgtcttctgcggttgttgggtggggtgttccctcaaggtcatttaggtgaagttggttgctggtgttcttctgtatccttactgattgtctgtctcctccttcattgactactgtggatgaatggtgatgtgtccaactttaactgtaaattagtctatttctcttttagatcgtaactcttttgtatattttgaagctcttttgttaggcacatatgtatttaggatggttatgtcttctagatgaaaggacccctttatctttatgtaatgtttcttcttatctctgggaatatttcttcttctgaagttctgaactctctttatggtgatataaatacagtctcacagctctattttcactagtatttgtgtgatatatcttttaaatttgtatgatatatcttttaaatttatctgagcttttaaattgagatgttcaaaccatttgcattcatgcaattgttaatagagttgaatttacatctaccatcaagttagttatttctctttgtcccatttaaactttgttccttttttcatctttttctgccttcatttagattgagtttatctccactactcacttagtaaattaatttttaatggttttagtattttccacaatgtttataatatacatttttgacttttcacattccaccttcaaatgatatcattctacttgacatatgaatccttacatcattgcagttctacttcctccctcccaaaatgctatactattactctttgtaatagaagcttacttctactatgtcacagatctcacaatacattgacactatttttgccctaatagttgtgttttaaagtgatcaagaataaaactattttaaatattttctttatttatttattttaccatttctggtgcttctcatctactggggtagatctcaatttccatctggtgtcagtttctttctgtgaaaaacaacttttagcattttttgtagcacaggtctgctactgctgaagtctttcagattttgagtgtctgaaaaagtattttgccttcagtttttaaaagtaattttgctgaatgtagatactgggttgagagtttcatcacttgcaacactttaatgatgatgttccattatcttctgttttaaatagtttgactagtaatctgatctttgttcctatgttttcaataggtcatttttctctgactacctttaagattttctcatctttgtttttcaacagttcgactatgatgtgtttattattaatttctttgtgtttaatctgcttgaggtattctgagttcctagatttgtagattgttgatttttttcttttctcttttttcttttcttttcttttttttttttttttttttttgagatggagcctcactctgtcacccaggctggagtgcagtggcgcaatctcggctcactgcaaactccacctcccaggttcaagtgattctcctgcttcagcctcctgaggagctgggactacaagcatgtgccaccaggcccagctaatttttgtatttttggtagagacagagtttcgccatgttggccagactggtctcaaacttctgacctcagacggtccatcaccttggccttccaaagtgctgacagtacaggtgtgagcaaccgtgcccagcctagattgttgattttcattgtccttgtaaaattcatagccattatctgttcaaacgtttctttttgcacttttctctctctgtattttccttttgggactctaagtaccacgtgtttgggattctaagtacccacaacattcatgttgtttcataaatcttgtaagcttgttctctttttttttcagtaactctttttcattctttgtgttggtttggataagttctggtaacctatttccaagtttatggattattttttcagttgtttctagtcatctcctcagcccattgagagaattcttcatctctgatattatgactttttttctagcattttcatgttactcttttctatagtttccatctttgctgaaattctctacctatctatgcatactgtccaccgttacaacaagatcctttaacatactaatgtaggtatcacacaatcccaatctgatagtttccagatggcgtcttctctaagtctggctctctggattgctttattattcaacagtggctttttgttcccccttgggttttttggtgtgtcttataattctttaatcaaacactagacattataaatagaagaacagtagaggttacagtaaatattatttatactttgaaatggacacccttgtcttgcaaatatatatcgtggataattgagtcaatgtagtcactagtttaactgaattgggatttgtgattgctagttttaccttaagtgcaccacagatataaattcctccagtgatgtgctgctgctatcttttacttagagtggggcctggggtgctaaagagttttctccgtgttcctatccattcccagatttcagcagtcactgcatgcctgcactacagaggagatatcttcatacacataatctaaccccattgacactcggctgtttcttgttactgaatgctcactttttggtggacgtaggagaatacttatctccctggtctacctccctcttaggccagttgagcacagctcggctttgaaagtagtgatttttcagtgttcttgtgcctccttctgatggaacttgtacctgtggtgggtttggaaagaaagagtagtaggcttctgcttcattgcaatgcaggatgttgggcacaagaggattccctgtaacttctccaagggaataagatttttgcctccaccactctctgagaagctgtggatctttgcctgcagtcctagatgcaggaccatctcctgccctatcacccagaagctttggtctttggctttgtttgaggaaggagctagagaaatgtgcaaagctttcatgtctgccccccactgacagccactcaccacccacagcctgcactgccgaatgcatcctcctctcatctgccctcgtgttctcatgaacactcagtagggacccataaaaaagagcttgcatgtaagtgcaatttccaattataagtactctatctgttctttcacacccaggttttaaatgaaatattactaggaacttattaatgttctaaaatgctataaatctatttttatgttaatctgtctgctaatacagaaaagagaacagtcataattctcagaggctaccgtactgtttttgtcataaattgcttcatgcttcttttttttcagtaattgttaagcttgatttcttttattttaatttcagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgcgtatgtctttgatttttactgtaagaggggcatcagccaactgaaatttctgttaaaagagccatgcttcatgcttcaagccaacttcctaggaccaaatttctcttagacccagaatgtgtagaaaaatgtctcaagaatcttgcttttgaagaaagggcctgcgagaagagaaattttaggctggctatttttcctgagtagttttatggatgcaggaggacatctggaggtgatgaggtcacattaattgaaagctcaggagtacatatgagcaaatgcttagaaacagtaccattccacaatgcccactaaatatcagtgcaatatttctaccatagaaatctatcattttaacctccaacccctgaaatgaaggttgaatttgctatttttgtcttgggtcacaagtaaatatactttatatatataagtatgaatatatatacacacatatatatgtatacatatgtgtgcatatataaatacacacatatatgagatatacaagtatacatatatagtgtgtatatatatgtacacatatatgtgtgtatatatatgtacacatatatgtgtgtatattagaatatatataacataaatatgtatatatatatattctgacctgtataaacacagtggatcctgagcaccagtggcctgaaaggatatgggttgctgggacatgaagaacaaaagcaggatacgcagatgctgaacagcgaaagaggccattagatgaacagaaaaccaggtctaacaaggacagcttttcttccataaatgagtacacaatatatggaaaaaactatttttacatattggagaacagataaactgagataatttagaaagggaatcaaatgagatcaacccaataactaccttggctttgttcctggagacttcctgggctgaagaacaaggagatggagcccaagccgaccacagcagtcttgctgaactgaggaaggagactggagttgggattactaaaacagctgagattttctaggctaggtaataacatgaaaggaaacattgtggaggaaagcagctccaggaatgtccatagaaaagtcctcaagtctttggctaaatagaaagctgcatatgcacagggagaggttccagagagaaaataggataaagaacagctactggggaaagaaaaactgcaggggaacagtgagctcaatggagatgccagagctcacatagcactgggggatatttgagttctgaccagcctgaggagagacctcgctgaacatcttgggcattcagtagtcaccacataaagccaaactttgggagtaggattagtgtattcctataataaaggccactccagaaacagcatagtaaagctgaaaagcaagtctaaaaaaatcaacacgatctccaagtaaattaactgattgccagaagaaaattcaaccctttagaggcaaacaacaaaatcaagttgctcagttatgtggcatccacaatgtgtgacctaaatttataactttaccagacatacaaaaagcatttactgtgatccataaccaggagaaaaagcactcaaaacaaataaaccccaaaatgaagaaattggcaagaagatttgaaatatatatatatcataattgtgttcaaggatttaaataaaacatgaacatggaagaaacaaatggataatatcaaaaaagaaaaattataaaataaccaaatagaaattaaataactaaaaaagtgcatgtttaatgaaaaatgtactggctacccttaccatcaggttagacattacagaagaaaaagttaactagaaaataattcaatagaagtgatacaaactgcagcacacacatacaaagactgaaaagataaagaaacagagcctcaagaatatctatgaaaatatcaaaagatttcatatatgtgtaaagcaagtcacaagagaggaaagagatattgggacagaaaaaaatacttgaagcaacaagaaaaatcttattagaagccagaagaagaaaatatatgtttacacagaagaatagtggtaaaaatgactgatgccttctcgtcagaaactatgctggtcagaaacaatgaaataacacctttaaagtgatagaaaaaaataaaaaagattaacatagaatgttatatccagcaaaaatatcccttgaaagtgaatgttatataaatacatattctgcctcccccaaaataaataaaacactaagagaatatttcattactaggcttatataataaaagatgttctagaaatctattttggtagaagaaaaatagtgccagatgggaactttatactaagtaatgaagaaccctggaaatggcaaatgtaaaagattcatatttaatgccttaatttctttaaaagataattgatgggaggctgagtcgggcagatcatggggtcaggagtttgagaccagcctgaccaacatggtgaaaccccatctctactaaaaatacaaaaattagctgggcatggtggcacgtgcctgtaatcccagcaactcaggaggctgaggcaggagaatcacttgaacccaggaggtggaggttgcagtgagctgagatcgtgccattacggtccaacctgggtgacagagcgagactcaaaacaaacaaacaaacaaacaaacaaaaagataataatttactacttgaagcaaaatgatagcaatgtattgctactttaacatatgtaaaagtaaaaatttctaaataataataatcacataaataatgtaggaaataaatggtagtatactgttctaagtttcttgcattatccatgaagttatataatacacatggttgaaggtggtaagttaaagagggttattgcaaatcctagaacaactgaaaaaatttaaacttagaggaatagataataataagaatgttccatttatccaaaagaaggaaagaaaggaagaaaaaagaatgaagaagatatggcaaagagagaaaatacacagcattatggtacacttaaactgaactgaaaatatatttaatatactcctaagcatattaaatataaagggattaaacattgcacagaaaaggcagagattattaagctgaataaaaatcaaagcccaattatgttctttttactatacatgctctttaattgtaaagagctagtccaaaaaccaagtgtggaaaatgacatatcatgaaaataagaatcagaagaaagctggagtggtaatgttaatcccaaagtaatctacaagaaataataccacgatgaaaaagttatttcttaagtaaaaaaagtttattcatcaagacttaacaatgctaaatgggttgcaccctcataagagcccttctgatatatgaagcaaacactgacagaactgaagagacaaacagataagcccacaattagagtgggagatatcctaatgtctctctccgtatggttatacatcttcccaaacaaaatataatagaaaaaatacacaaaaaaatcagaaagaatatatatgttttaaaggaaattgtcaacctatttaacactatgccaaactgcagaatacacattcaagtatgcatggagcattccccaacatataccatatgtgtgggcctacagcaagtcttaatagattgaaaagaattaaaatgatacagagtctgtttttgagcaaaacagaattaaatgagatataaataacaaaaaaattgggaaattatcaaatatctgaaaatgaaacaacacatttccaaatacttcataagtcaaagaaggaatttagaaaagttttgaactgaataatagtaaaaatacaacatatcaaagttcgtatgatgcagcgaatgtttttagggttttataactttaaatgctttcagtagaaaatagaaacatgtaaaaatcaatgacttaagatggcatttctcaaagtatgctctggagaaacctgaagtctcttgagatcccttcagagacagtctatgaggttaaaacacctttaaatttaaaaaaaaaagattttatttgctatttcacttttatttcctgataagtgtacagtggagttttccagaggctacataatgtttgatcacattatctctctgatggctaataaaatgtgtgattgtctattatgtttaaaaacattctcagttttggatgcaataaatattcatagtatatattacaaaatgaaagctctttagggtccccaatactttttaagagttaaaggggtcttaagaccaaaaactttgagaactgttgatttaagataacttaaacatctagaaaaggagaagcaaataagatccaaggtaagtggaaggaaggaaagaatgaaaatctgtgaaatccagtgtataagaatatagacaaacaattgagtaaatctgtgaaacagaaagttggttcttttgaaagattcatgtaattgataaacctctgcctaaactgacgacaaaggagggagcaccaccgtcaacatcaggagtaaaaaaagggaagagtcattgctataggatctttttgatattaaagctaataaacaaatattgagagcaactttacgttaacaaattcaataacctagataatatggactaattccttagaaaaaaacaaataagcaaattggacactgaataaactgaatttctaaccaatctgatatctattaaagacaacatgtgtatataatctttaatatgttaatatatattaataaatcaataaacttcccacagagaacactctaagttcagatggcatcattagaaattttattatttaaaaaaaatccaattcttcacgatctgttacagaaaatagaggagaagggaaatatttcttgactcaatttgtgagaaaaaaaaaaaaccctagttgtaaaaaagtagacaaggatattgtgagaaactatagcacattatgtattgtgaacataaatataaaaagatgtaacaaaattttaatcattaacatgatgaatatcccaaacaagtgaagcttctcttcaagaatgcaaggctggcttaacatttacaaaacaatccatgtaatccaacatgttaacagaataaaagtgataaatcatatgattatgtcaatagatgcagaagaaaatgtgacaaaatttaacacttatccatgataaaatgtcttagcaaactatgaatagactggaacttctttaacttgatcaaaggcatctacaaaagacctccagataacatcaacttaatggtgaaagattaatgttttctctctaagattgggaataagaaaaatatgtttgctctcagtacttctaatcagcattttactacattggtcacaaccattgccataagacctgaaaacaaaacaaaaagagaggaaaaaaaggaaggaaagaaagaaagggcctaaagtttggagaggaagaattaaaactgcctgtattcacagaaagcttaattaacggatgcagaaagtcctaaagattaataattaaattttgcaagattggagaacacataagtatatacatgatcaatataataaaagtagttgtatttttatacactgccaatgatcaactggaaaataaaaatgtcagagcaataccactgacaatagtatcaaaaccacaagatatttagtgatacatttaacacaatatgcacaagaattatgtactgcatactaaaaaacattgttaaggaaggaatcaaaagatctaaataaagatatatcacgcttatatattaagagtcaatatcacttctcaccaaattgatctttggattcagcccatacccaattgttaaggaagaaattacaagatctaaataaagatatatcatgtttatatattaaaagagtcaatatcacttctcaccaaattgatctttggattcagcccatacccaaccagaatctcagcagtcgttttttttaaaaaatgtgaaaaaatgtatatgctagaatcacaaggacaatatttaaagagaagaaaaaagttggaggacttacttacccaaaggtaaagacctataaaggtacagtaaacaagatatgtggtattgggaaaaaaaagtatacagatatagaaatggatggtccagaaacagatccacatatacatgatcaatttagtttctaggtaggtgacaaggaaattcaacagggaaaaacatcttttccaaaatcattgtgaaacaatcggatatccatctagaaaacaaaaataaaaacaaattttgacttctactttccatcccaaattaatgtgcaaaagctcctagatctaaatgtaagagctaaaacttaagctgaaataaaacaattccaggaaaatatataatattttcacaaacttgaggaaggcaaaatttttttcaggcaggacccagaaaacactagctttaaaagaaaataaattataatttgggctttcataaaatgaaaattatgttcatcaaaagtcattgttaagaaatcagtaggtaagtaacagactggaataaaaattctctccatccatatatctgacaaatggtttgtatctagagtataaacgtttctcccactcactaatcagaggacaaacaacctaattaaaatgggcaacagaattgaataggaaatttctcagggaacgatggacagatggacaataagcacctgaaaaaatgctcaacattttagccatcaaagatataagaattataaccatcacaagatgtcaccaacacttaatgggcatgggtatcattaagaagacacaacaataagtgctgtcactgatgtggagcgaggatgtgcagctctcgcatacgctggttaaagtacagtatgctggttttccataaagttaaataactatgagtctaccccaaaaaactgcaattctattcctgaatatttaccccatggaaatgaaaacagaagtccacaaagagatctacaagaatattcacagcagctctagttattataaccccaaactgtaaacaactacaaggtcaatcaatgagaaaatgaatcgataatttgtgatctattcatataatggaatattattaagcaattaaaatgaagaagtgactgatcctctcaaataggatggatggaactcaaaaatatattaaggaaaggaggcagatacataagtgtacattctgtatgagcccatttatatcaggtttgaggagaggtaaaactaatctttagtgaaggaaaccaatagtatttccctctggcagtgggaagagggtagcaggaattgaatgagcagtgacacagggtgtttctagagtaatggaagtgttctgtatcatatgggagtgtggtttacacaagtataggtgatcatcaaaactcaccaaacaacatttaagatctgtgcatttcacactatgtaaaagtatacctcaactgaagagagtggaaatctgtttcaaatgctcagccttttaacacatccagttgcttagactatgaacttcctcaaatggggtgtctgggcttgagattagatcacatgtgtagagtcgctagagagacaatgttgcattcccatggtacataatacatttcccgttttctcagacagccacaggtcatgaatgtgaggattctgagaggttggagcaacattcttgggaggcatgagggggagcacattctccaagatcccccccagcccggggtcctcgcctgctttgactattactccgttgttttcggactcctccgtagctgcccgacctcttcagatcccatagtctccctttatatcttgagtcccactgttcttccaactcatcccccattccctcagacctggagtggcagtggccagcagaggatggattgagagcaggagaggatgtcctgcccaggaacccatcctagagaaatggcatcctgcctgggagctagtttcccagggtggctttgatacgtcttgcagaaacaaacccacttgacacacctgatacggtattgacagtaacactatttttcgtggttgtttttcatagtaaaagtagatccctttagttacactgtgagtacttagagtaaggtgactggcctgggaatgataccatcttggatgtcattttctccttggagaaatgtattttagttccaatgcacatttcacaatacagtcctatagagagaaatacagagagctagacagttagagatatacttttatgtgcataaaaatataaaatatgcactttaaaatctgtacctgttattcctgagaaatgtatttggcagaaggtgggagggggatattctgatccttttatttacatgtttatgtatgatctgagtttttatatggagcatatactacttttgattttttaaagaaaaattaaaatctgtctttgaaatgtacacagttgtttagaagttgaggaccatttttgtttgttacaacattattgtacctataatgggaatatttcaaagccacttgttaacactttgttagaacaaaatgtagagggtgctgggtgcccctgaatattctcccacctcttgtgacctgtattgttttggaatttccagtggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaaggtaagaaatctgtggctggacatctacacacttggacgctgggatgaaaagccatggaaaatctcactgatgcagaaaccttccatgctacacgagaaatcaagtgtttttagagggtctgccatgtggaaggaagcctcagtgcactctctcaaggaggcagaggtgtgacttttggcacaacatgagtgggctgtgcctttaggacaggtgcaaaccctccaaggtgctcaacttaaccactcaccttgttctaaaatgggttatctcagtatcccagtccaaattcgtattctatcatgctgccatatgtgtgattctttccaagccagtaagcatctccagtaatttcttaaggtaggcagcgttcattgcagtcttcagcattgcagtttctgaggaatgtggcccctgattctgtcatcctagagaaacctgacatgactgtattgattccatatcatcctgggtctctgtggctcttcataatcatccattttttccctgtacagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaatgtaagccactttgatttggactctttggccttttgctcaccaatctttgcaaacagaattggttctgtgttacagaaaatctgacctggactgctcttttttgtaatgggggagaggggacagaagaaaatattggaaaggcatcagggggctaagctagaatataattggccttagtatggaaagtacaagcagcacaggccaggaaacctccacacatgtgagggttctcaggcctcttccctttagtgacatttctttaaagtttccattattggggactgtctctagtttctagtgtttgtatgctaggttccagtaatcaaagatgccctttatgaaatttaagtcagatttttcgagaaaaaatttggatgggccatcaggtcaccatgggacttcccttagcctcatgcattctctgcgatggtttactttggggcctatgaatagggaagactgagatataggaaaaaccaaagtgtctgtgttcccccactctcacacccatgcagcataacacttctcacaccagatgtggggggatttctcctcacaccccaagcgagtctccagcagataccagctgggtgtcctacaatgtaactcagtgctgacactctatctggagacagtgtcagatcccataagttaaggctcagtcccacaagaccgccccactgcagatgccaatcccaagttccaggcggtgacctgtacttctgcccaactggacaaaaatctgtttttctacttgattactttgctagagtggctcacagaactcaggggaacacgttacttttatttacccatttgttataaaagatattacaaaggatcctggtgaacagccagacagaagagatgcacggggcaaggcatgtgagaaggggctcagagtttccatgccctctccagtgcaccagcccccggtaccccaagtgttcagcaacccagaagctctccaagtgcagtcttgctgggtttttatggaggcttcattacagaggcacagttgaatacatcgttggccattggagaccagctcaccttcagctcctgttccctccctggaagttggacgtggggggctgaacagttccaaccctgcaatcacatggttggttcctttggcaaccagccccatcctgagactatccaagaacccaccaagagttgcttcattcaaacaaaagatgctcccttcactcaggaacccccaagggatttaggagctccgtgtcaggaactggggggcagagaccaaatatacgtttcttattctaccacagtgtcatatgaaggggaggacaacactgcctttctgtgtcttgccccatagagggcgcacaatgcatggaaataaatgtttctgaatcaacagcaaacaggcttcatcgggtaggagagcgctgagccctccagggacaatgcacatcaatgatgtcccactgtcctttggtgctggggctctaaggcctccactgggtcaggctcctgaagggagacccattctccaaagacccccgagggtcaccactccctgtccaggggtgtggcctcatagctccttttgaacaggggcacaggaaggacggctttagagcattcaaaaaataactttgccaaaataataataataataatagaaaggaagaagaggctgagcatggtggctcacacctgtaatccctacactttgggaggctgagacaagcagatcacctgaggtcaggagttcgagactagcctggccaaaatggtgaaacctcatctctactgaaaatagaaaaaaaaattagccaggtgtggtggcgtgcacctgcagttgcagctactcaggaggctgaagcaggagaatcgcttgaacccaggagatggaggttgcagtgagctgagatcatgccactgcactccagcctgggcgacaagagcaaaactccacctcagaaaaaaaaaaaaaaaaaaagaaggaaggaaaaagaaacactcctttatgtcttctaaggatagacatgaaatgcgtgagccttggaacaccttctccctctcctgccccacgtgagctggagcttacatgccttcttgttttcagtactgccgtaaccctgatggtgatgtaggtggtccctggtgctacacgacaaatccaagaaaactttacgactactgtgatgtccctcagtgtggtaggttgccttctttttggtaaggaaactgcttacttaatatggatttgcaacaaaaaaggaaaagggcttctgagcagactgcttctggggaggagatagctgccctctccatcagaccccactcttcatcatgggcatcttgaatctgccctactattggccacatttgttagaggaacacctgcccatcgccccaggcacacataaataaaataaatgtaaaattcccaaagagcaagcttagaggtaatctagtcagccccaggatggtcccactgaatgctgccatgtctagcgtgggatgcatgaaaaatttagagtcattcggatgaaaaactttccctttccacagctgagaagtaagaaagaaaatacaaacagcaggaaacaggtaagcatgtaacgcacattgtaaacctcagatggccatcctaggaattcaatgaaaggtagtgcagctctttagccccagatggcctttcttataagtttactactcacaagtcacattagtgacatagcttagagactgcttgttgggttccatcctcattgctctgagactcttgttgggagtatgaggcttggatcaggggaaggggagttgacattagttcttaaagaattggaataacaaatccatgggtatttctgaaaaaaaaaaaaaaaaaaagaaaggaagctacttggaattgtcccatatttaacattctgctgaccaatcaatttgtcctagttacagaaaaccaccctggacttctcctatgcataatttggttgcttgtggttgggtctgccatgtggagggaccttgagctgggggaaggagcttggcctccaagtccactgaagaccagcatcctgagattgcctgggaaggtggtacagggcagtgatgaagatcatgggagccacactgcccagcttcgcatttgggcttctcctagggacaccaagagggaggaaggaggggttaggatggtatgaaagattctacttggccaatattattgtaatgcggcattgtgatctctggatttagcatgagttgatagctgactttttctgcagaagcatcttggtggcacctctaactcaaagtccctcgatggagtcagttccagttctccacttctggccccatctggtacacaccactgcctctcactgcccgggctctctatccttgacaggctgccttgaagttgagcccagactgattttcttgcctcagaccccactaccgtgcctgggactcatgcacctttgactcccatggaagggaagtgcagtagtttcccaggtgcaattctggtgtcctcacccacattgaggatgtacaagaatcaggttcttagagattggagaaagaaggaagaatgggaacaagatttttcccaaaggactgtgaggtcccccacctaaccttgatgtgagacaagtgaggttaaccccaagcctggtgagaagcgttcccatcagacacttggaaatcctgaggactgtttcatgcagaaggatatggtttattcaggtttgactcgtgcttgagaaagctagagcctctggtggtgaatgattttaataactatttcctttccaccaacatatacagtacaaataataataagcaaaaataaatagaaacattcagttttgttttgaatagtaggagcagggtaccatcatttctgtagttactcttttagtacaacgatgcatgtctactgtatgtaaggcatactagcagaaattgagctcagcactagagaagatgattgcattctatgccttgcttctttttttaaaaaaaggcttccatagatagattctcagaacagcccatggcaaatgtaaagttatttggaaaacccaggttccagattcactagagcatagaatctctggttggttgggaaggaatttcctcttacagttgttactaataattgtatgaacaattatttaaaatattaacatttacatttgtgaagaccttgaagggctggagacaacagagaagcatttttgaataccctctgcagcccctgcactgttgtaggcattggtggatggtaccaaagatgggacactgtccctacctccagagaccctgtgggctggctacagagagaaggcagggaggaggaaaagaagaataaagtcatatgtttaagtcacccccacggccgttggttagtcatgggaggctccccagaggagctgtcctgaagctggctgacagaaggcaacatttcaacttaggacagtaatccttgctacatacaatcacatacacacacacacacacgtgcacacacagagactcacatggaaaaataaacctttgtgcctttcagcagtgatgacaattatggttttcagtaaactttacatggtttagatggtgatggtgatgatgatgattatgggaaggatggcatcatgttctaaacatactgcatggagtcagaataacaatgacaaataaccatttgtcccaatcaaggttttctcagaaaatatctcattctgatgctaaactataccagtctgtttgatcacttctccaacaaaataattacaaagtgcttatattttcttgaaaagagagggtcctgtgttgtctactaccacttttgaaacttagagaaaatgttccaaaagatgatgattttactatttagttcggcctttaagatgtcaaaaactcagtgcttggaatttgtctcgaattacaccacaaaattgctaccttgtctcaaatgggatttctttcccaccttgtgccacagcggccccttcatttgattgtgggaagcctcaagtggagccgaagaaatgtcctggaagggttgtaggggggtgtgtggcccacccacattcctggccctggcaagtcagtcttagaacaaggtaagaacaggcccagaaacgatttatactgtccctccacgtaagccctgcaaaacccttctacatttacataaaatccacacagctgaggcatcagcacctgcctctaagttttctgaaggaggaaaaaagctacaaaaattaatatatgtatatatacatatatatttttataggttctctactgtgaaaatgacaaaaattgctgtctttttcttgatctgggcagctccatcaaaatctgtaggcacagtgatttgcaccaagttccaatattgctggaaaatactgaagatgctctgaggatttctatggatatccattgtctcattgtcagatgaaaagagggggaagtttttagaaatgtgacactttctgggttgggagagcaaggacaaaattatctccagtctatcacaggcacagattctttttctttggacactttcgtgaatcattgaattcaatgcagaggctactcatccattcgcaaacaaaaaaattctaggtcatgatccccataaatgaagagtgatcagtccaatcccagggaacctggacattttgggtattgtttcagtggaacatgcctttcataagttccattttcttgggtatctcttaggaagcaagcataggaaacaggcccatccgtctgcctgttttgcttcctcatctcacttctacacgagggtgcctgtgctcaattgctgttttcccctaaagagactcttttccataagtttgtgaaatgccatcgacaaacctgatcgcattgcatttcactctgctgttgagtcgatttttctttattttatcatttagtaactccttgctctacagagctttcaccttccacatatttcagattcattctttcctaaactatgtggtggtctacgtcctcactgacttatcaacatgctaccatcatgcacttcctatctctattcctcttctttaaatttggttccaaatggctcacaccattattctgagctattacctgcctacgcagtcctagaaagtaagtgattcaggaaacattccccaaaagtaaagtttctcaggtaagatcagaagactcccatgagtcactgctgctcaggatcacatctggctccttgaagagtgattcatcagaccttacatagatcttgtcataaaaatgaaagaggcctcgggggaaggtcttgggctggtggcttctgttggagtcctgggctgtggggtgaaagccgtggctgtagagcttcatgcggagttacttagctttgctctcctgtggacaggccatgcctgtgcctcccccaagcatcggaaaaattggcatagatgggcccttctcaaaaatcccactcctggagcactggccaaaattactaccatcctgatgctgggcttgcagtcctttcctttgggaatatgaacatggtcaaaattaagtgaacgtgtctttctggctttctgtacaatggagcagaacaaagtatcaatttaactaaaatttgaactaaatcctctttccaggtttggaatgcacttctgtggaggcaccttgatatccccagagtgggtgttgactgctgcccactgcttggagaagtatgtttaggggacaattgacatgaagtcttgtcttaaatactttttctgtccttcttttcctcctttcctcctttcctttctcactcttcctcccttccttctctggctgtgacactagggaccaggccagggcaattggataagagagaagggaagggtttctagaaagaaactgcagaggaaagacacagtacagatgattttgtgggcctgaataaactgcagaacagagctgttcactaccataggctgtatcagtctctgcccaaacagcccaagaacattccttaactgcctgtttcaagcaaatcatgaattttgcttcttgccactcagaagtcactaattctgagtggccaagggtgtcagggagacagcaccaatttcatggcacagaggttacctgaaggggctggaccatattttcctcttgacgtcctcatcttttctaggtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcaggtactcgttcacctgtggtcttcaccccacgctggtgaagatatttgctttatgtctgggttttatgggccatggccactgcatggcagtggggaggaactgtctatcacatgaaaggctcaagggctttggggacagcatcaatcttcaaccctagccctgccacatgctagctgtgctcttgagaaaggcagcaggactccgttttctcatgtggaaaaagagttgaaatgaggtactctgttactcctagaactcacttaatgttcaccagttcatacacattcatgatcagagaacgattcagttattccaggctgacaattcccccttcatcataatatgtttaagagaatcatataagactatatttgtttcaaagcactttaaaaaccacaagatcgagttgggtgtctggtgtgggtgcctgtaatcccagctacttgggaggctgaggcaggagggtcacttgagtcccggagtttgaggctgcagtgagttatgatcgtgtcactgcattccagcctgggcgacagagtaagacactgtaccaaaaaaaaaaacaccaaaaaaacaaaaaacaaacaaaaaaaaaacaacttcacaatgtcaaaaaaatcacaaatacagtttataaatgtaaattatattattattattgtcttctttgatttgattttctctttcctgttgaaatgttgtttcactaagcctgacaaagtgaaacatttgcttatgtcactcatttagtgctgtttggagccagatactagttgagtcagctaagaaacagctatttgtaggagaagcaggtttgggacaggtgacaaggcacgcagggcgctcgctgtgctggtggttctggaagacagggtgtcagtgtggacagggatgagcatggcctggatgagaaggcacggggcaggagcctgagctgctctcctgggcctggccacaagcccagggcagcttctctgggtctgtgaactgaggggtgatgtcctgggatgctctgacactctagaaggagagaagagcctttccagctcagcctttataaacagtagctgatctccctcctgctccccagtgtcctccccgccatcccagcaaatgtgcaaatagaaggtccccgttcctcatgatcctcagagagctggggtgttctgatggcttgaacaagtaatttggaaattttgggttttggaggagttctctgataggctgatacatttcgagtttagagttcccaccccacatccccacaccccgagtctagggcatttagtgctccaccagggaacctgtagagtgaggacgtctgcatgacaggctgggccttctgatgatgctcagaagcagaaagtgtgcctgcttcaaagttggtgacgatgatgtttcttgatcagaatagggcatttcttatttccaatcctttatcctcttgaacttactaaagtagaatcaggtctaaaaaccggagttctaatgtttgagagtccctgggactctaaagtatatgaatgttctttgaaaacaaataccattttgttcaagcaaaaggcttatttccaatcctctttcatttggtatcaagtattttactggattcttacaactatggcgtagtaacattcactgaggaggaaatggaggatccaaggatggagcaagttgctctgggcacacaacacatttgcaattttacagcctcttggtggcatctcagtcagacattccatgcactgatcaatgccctattcgattaatgtaaaaggacacactcagcatgagattccagttgtgcacagaatatacatgagaagtgcgcctttgtcatccctactttcaaaggtgaaggccaccagcagtatcttgcatgcaactgatgcctttcaaatgaaaccttacatctgcatagtccatagacaaccacaggcaaatgtgagggtgaaactctgtgttctacgttgctctgtgtcagtgaagcaaggcagtgccagttcagagggctctggggcctcaagacagggatgactggttgtgggtactgcagctgcgagcagagcagtcaaacataactgctgatgcttttctttcagtcctgccgtcatcactgacaaagtaatcccagcttgtctgccatccccaaattatgtggtcgctgaccggaccgaatgtttcatcactggctggggagaaacccaaggtgagataaattccattgcccacataacgaattggttttgacctacagtccatgtgacaaaatgatcattttggagaaagctgtgcaaattcctatccatgaatgtggtccaccccactcctgattttgcctgggcacctgtctatgtcttaatcagtcttcaaggcacatgatcaaagggaggaaaactgtgtctttgagtctctctctctctctctgttttcagaacatttttatttcaattaattaatttttaacttttattttaggttcaggggtacatgtgcaagtttcttgtatatgtaaacagtggtttgtcatgcagattattttgtcacctaggtactaaccctagtacccaattcttagtatttcctgctcctctccctcctcccactcttctccctcaagtaggccccagtgtctgttgctctcttctttgtgtccatgagttctcatcacttagctcccacttataactgtgaacatgtggtatttggttttctgttcctgtgttagttttctaagaataacggcctccagctccattcatgttcctgtaaaagatattacctcattctttcttatggctaaacagtattccatggtgtatatgtaccacatattcttcatccaatgtgtcattgatggtcatataggtgattccatgtctttgctactgtgaatagtgctgcaatgaacattcatgtgcatgtgtctttagggtagaatgatttatattcctctaggtatatcgccagtagtaggattgctgggttgaaagttagttctgcttttagctctttgagaatcaccatactgctttctacagtggatgaactaatttacagtcccaccagctgttagtgttctcttttctctgcaaccttgccagcatctgttattttttgactttttaggaagccattctggctggtgtgagatgatttttcattgtggttttgatttgcatttctctaacgatcagtgatattgagctttttttcatatgtttgttggccacaggcatgtcttctttagaaaagtgtgttagtgtcccctgtccattttttaatggggttttttttttcttgtaaatttgtttaagttcctcatagatgctggatattagacctttttcaggtgcatagtttgcaaatattttctcctgttctctaggttttccctttactcccttgagagtttctttttctgtccagaagctcttaagtttaattagatcccatttgtcaatttttgcctttgttgagattgcttttggcatcttcatgaaatttttgcccgttcctatgtccaggatggtgttgcctaggttgtcttccaggatttttgtacttttggattttacatttaagtctttaatccatcttgagttgatttctgtatatggtgtaaggaaaggggtccagtttccatcttctacatatggctagccagttaccccagcaccatttattgaatagggagttattttcccattgcttgtttttgtcagctttgttaaaaatcagatgtctgtaggtgtgtggccttatttctgggctctctattctgttccactggtctacgtgtcttttttttttttttttaccagtaccatgctgtttttgttactgtagccctgaagtatagtttgaagccaggtaatgtgatgtctccagctttgttctttttgtttaggattgccttggctattctggctcctttttggttatatataaatttttgaagtagttttttaatagtgctgtgaagaatatcattggcagtttgataggaatagcaatgaatctgtaaattactttgggcagtatggccattttaatgatattgattcttccaatccatgagcatgggatgtttttccattcatttgtgtcatctctgatttctttgagcagtgttttgtaattcttattgtagagatctttacctctctggttagctgtattcttacatattttattctttttgtggcatttgtgaatgggactgtgttcctgatttgcctctgggcttggctgttgttggtgtaaagggatgctagtgatttttgtacattgattttatatcctgaaactttgctggagttgattatcagctgaaggagcttttgggctgagactatggggttttctagacatagagtcatgtcatctgccaacagggatcgtttgatttcctctcttcctatctggatgccctttatttctttctcttgcctgattgctctgaccagggcttccaatactatgttgaataggagtggtgaaagagggcatccttatcttgtgccagttttcaaggggaatgcttccagcttttgcccatttagtatgatgttggctgtggacttgtcatagctgtctcttattattttgagatatattccttcagtacctagtttattgagagttttcaatataaaggatggtaaattttatcaaaatccttttctgcatctattgagataatcatgtgggttttctctttagttatatttatgtgatgaatcacatttattgatttatgtatgttgaaccaagcttacattctggggataaagcctacttgatcacgatggattggcttttttatgtgctgctggatttggtttgcaagtattttgtaaaggatttttgcatcagtgttcatcaaggatattggcctgaagttttttgttgtttttgtgtctctgccaggttttggtatcaggatgatgctgacctcatagaatgaattggagaggagaccctcctcctcagtttttttgaacggtttcagtaggaatggtcatagctcttctttgtacatctggtggaattcagctgtgaatctatctggtcctgggcttttgttggttagtaggctatttattactgattcaattttggagctcattattgttctgttcagggaatcaatttcttcctggttcagtcttgggagggtgtatgtgtccaggaatttatccatctcttttaggttttctagtttgtgtgcatggagctgtttgtagtagtttctgatggttatttttatttttgtggcatcagtgctaacatcccctttgtcatttctaattgtgtttattttggtcttatcttccttttcttcattagcctagctagcagcctacctatcttattactgttttcaaaaaaccaactactggacttgttgatcttttgaatgaattttcatgtcttgactttcttcagttcagctctgattttggttatttcttgccatctgctagctttggggttgatttgctcttgtttctctaattttttccattgtgatgttaggttcttaatttgagatctttcttcttgatgctagcatttggtgctatgaatttctctcttaacactaccttagctctgtccaagagattctggtatgttgtatctttattctcattagttcaaagaacttcctgatttctgccataatttcattattcacccaaaagtcattcaggagcatgttgtttgatttccatgtaattgtacggttttgagttattttcttagtcttgactggtatttcattgtgctgtggtctgagagtgtgtttggtatgattttggttctttggcacttgctgaagattgttttatgtccaattatgtggttgatttttagagtatgtgccacatggtgatgaaaatgtacattcagttgttttgggaaagagagttgtgtagaggtctatcagatccatttggtccaatgctgagttcaggtcctgaatatctttgttaattttgtgcctcgatgatctgtctaatactgtcagtggagtactgaagtctcccactattattttgtgggcgtctaagtctctttgtaggtctctaagaactttatgaagctgggtgctcttgtgttgggttcacatgtatttaggatagtagatcttctttttgaattgaaccctttaccattatgtaatgcccttctttgtcttttttggtctttgttggtttaaagtctgttttgtctgaaattaggatggcaacccttgcttttttgtctgatttccatttgcttggtaggttctcctccatccctttattctgagcctatgggtgtcattacatgtgagatgggtctcttgaaggtagcataccagtgggtcttgctttttatccagcttgccactctgtgcctcttaagttgggcatttagcccatttacattcaaggttagtattgctatgtgtgaatttgatgccctcattgtgttgttatgctggcttgtttgtgtgatggttttatagtgtcattggtctgcgtatttaagtatatttttgtattggctggtagccatcttgctatagttagtgcttctttcaagatctcttgtaaggcagttctggtggtaaccaactccctcaacatttgcttagctgaaaatgatcttatttctctgttgcttaggaagcttagtttggctggatatgaaattcttgggtggatattttttaagaatattgaatataggccccaatatcttctagcttgtacgggttcagttgagaggtatgctgttagattgatggggttccctttgtagacgacctgtcctttctctctagctgcctttaacattctgtctttcattttgaccttggaaaatctgatgattatgtgtcttgaggatgatcttcttgtatagaatctcacaggggttctctgtattttctaaatttgactattggcctctctagcaaggttgaagaagttttcatggacaatatcctgaaatgttttctaaattgtttactttctccccatccctttcagaaatgccagtgatttgtagatttggcctttttacataatcccatgtttcttggaggctttgttcattccttttcattcttttttcttaatttttgtcaactgtcttatttcagaaagccagtcttccatttctgagattctttcctcagcttggtttattttgctgttaatacttggattgctttgtgaaattcttacagtttgtttctcagctctcagctctgtcagatccattaggttcttttttaaaccagtgattttgtctttcagcttctatatcattttattgtgatcctcaatttccttggattggattttgccatcctcctggatcttgatgatcttcattcctatccatagtctgaattccagttctatcatttcagccagctcagccttgttaagaacccttgttagagaactagtgtggttgtttggaggacatatggcactccggcctttatgttcctttaactgcagtgtaggttgaatacagccaatagacttgttctttggatgtttttacagggccaaagccttgtgcagggtctttatttgtagttgatttcttgtctttggtttcatagtgtggtatgttagcaaggtatttttggtgttgaagctttggggtgtgatccattttttatttgtatatttccctacacctaaaacaagcaaaaaaacagtaaaggtctttgagtctcttaatccataatttcagcattcctgagtatgcttccctgggtaagtggggttttcacccagccctcaagttaagagtgttagattatttttcatgtgaaattagccagactggctttcttaacacaatgtaaaacaataacaacaaaagttataattagactagtcttcttcccaaatacccacatgtctaatgtaagtgggatggtgttaaacaggggacctacaactgggggagaggcggacaggtcccatggccccaggtctaggatggcatttggtattggttgatgggtgtggatgagaacaagagagggaacacttgtgcaggatatggtatcagcacctgtaatacattttagggattctttcttctctttgcagtatgccctgacaataattatatccatcagcctagtccccttggccattgaaacactaagactgtcttaggatccctgctgcagtttctcagaggtgctaggagggcattaggagtctgaagccctggaagtgtgttctgactttgccactagctagatagacctggactaggcacattacctctttgtaccactcagctctaacccctcattcaaaaacccagcattttcaagtggtgtttttcacatcagcctttgcataagttttcatttgaagaaaggtttttttgtttttgttttcttggtttaatcaaacatttaaaaacgaatggtctagatgatttcaaagtggctttccttttcctgtgcttttcctactatttaaaaacttcacctccttgatttcttgatctccctttctgcactgctgggtctgggagcattgaggccaagtaaaaggaaccttggcaaaggaggaacacctatgggtgtgccaggctgctcccagtgttttgcatttttaaaaatttaaatgctgcaaacctctatgaattacatattattgttcctagtttacaaatgaggagcctgagtctcagagaatgtgtgggatggtacagactaacctgaattagaaccctggctcccatttactggctgtcaggacttagaaaagtcataaactctctggctgggtgcagtggctcacgcctgtaatcccagcactttgggaggccgaggcaggcagaccacgaggtcaggagcttgagacgagcctgaccaacacggtgaaaccccgtctctactaaaaatacaaaaattagccgggtgtggtagcacacccctgtaatcccagctactcaggaggctgaggcaggagaatcgcttcaacctgggaggtggaggttgcagtgagccaagattgtgccactgcactccagcctgggtgacagagtgagactctatgtgagaaagaaagaaagaaggaaagaaggaaagaaggaagaaaagaaagagaaagaaagaaagaaagaaagaaagagagagagagagagagaaagaaagaaagaaagaaagaaagaaagaaagaaagaaagaaagaaagaaagaaagaaagggaaagaaagaaagagaacgaaagaaagaagggagggagggagggagggagggaggaagggtgggtgggttgtgaactcttgttgattgtttcctcagctgaaatgtgggctgcagggctattgggggagaaacaataagaaagtgcaccaagcaccaagcacatgctaagaagtccatcatggcagctcctgataataatatggaatagagttgtatctaacatgactctttcttgcaagtgacagaaaatgcaacttaagttggattaagcaaaaaagagaaattattagtgaactgaaaattctgcaggctcacatcatggccccagaccctgtccattattcttgggcacaaatgtgatattctcgtggctgcagatgctgtggtggctctggctctgccaggaaaagaaataaggaaggccactctccccattacacaaacaatagtcttccagctctgagaggtcgaacttgtgtcaccagcctgcccctaaacccgtcactgattaactccaacctgcatcagctgttccatgctggaggtggacgcaggaccacactcataccaagatgggggcaaagtgtagttccctcaacaggattataggatatagtgtgataggctgctgggcagccaaaaagcaaacagatcctctacaattcctcaactgatgaaagcacgaagctaaaatcataaagatctgtgtgtgagttctggctctcccatcttccttgtgagattgagcagttagttaatctcttttagcctcagctttctcacctgtaccaacatataaggtcattgtgaggattaagattatgcctcatgatcatcattatcatcatcaccatccacattgcaaccacaactaccatcatcatccccaccaacatcatcaccaccaccaccatcacaattatcattaccaccaccaccattgtcaccctcaacatcaccatcatcactatcaccaccaccatcatcatcactaccactaccaacaccatcactctcatcattccaccaccatcaccattaacattaccatcactatcatcaccaccaccaccaccaccacccccatcattactgccatcaacatcaccatcaccatcatcaccaccatcaccatcattatcaaccatcatcaccaccattccaccaccatcaccattatcatcactaccattatcaccaccaccatcatcaccaccaccactaccaccaccatcaccaccatcatcaccataaccatcatcaccactatcaacatgatagtaattatgattaccaccaccattagcattatcattaccaccaccagtaccatcaccatcaccaccgccaccacctccatgatcattactacccaccaccatcaccgtcaccatcatttcactaccagcacaattatcattaccaccaccatcactaccacccttatcacaaccctcatcatcaccaccattccaccactgccaccaccaccaccaccatcactatcattaacaatagacatcacataaccagtttgtagctggaccttgagcccagagcccactcactgtttcttcagtcccaccgccaaccaccaggatgagtcacaaaacataactcaggcctgctcctcaattttctacatgtcaataatgacattgaagcaatgggtgttctctgcttctcagagggaagttgaaattctcctgctcttcccttcatgtttccagatgttccctgacttggatattccaaacgcagagtttggaggtgttgaggccaaggggtttttccaggtcagccatcatctgcaatcactgagctgatcctgctgctggactttccctgttgccctctccccaacgccccatcggggagggcttcaatcctcaggtcacctgtggcctttctgccctcagaggtgccatctctacatctaccactggaaggcagcacctactcacagattgcatcaatttcccagcaactcatggtgggttttcccccttatcagcgtgtttgccttgctcagagagcagatcccagagcagtgacacctaacttaattttcagcaaaacattttgagaagggtgctccctcacacaactacacagtccaggtgatgcacccactgcccaatgcttggtagtcaagaggagcttcctccctgcagctctgcccagatagggctgagctgggctctggagcgaggcgctgggatgagcctcttccatgctgctcatgtaaactccagattcagtgtcggttttctgaacccgagacaatgatctaaatgcagtcgaaggctttggggaaagagagagtgcctcggttcttacctgtgtcatgctcgcaaagcaaagagttttgcaaaattttaatgaaacctgggcttgcaaaattggaaaactagattatttgtgacgacactgagacatccctgggcatgtctatctggaaaaatggcattttctctggcaattttgcagacattctatttcaatttggcaaagaaaataaagcagtttttcacaaaggcagaaatacaactagaatgttcactctccctaattgtcaaagaagtgtaaattagaaaatgaatcaggacaatttcaacctattagattagctaatattttaaaaattgaagactcatacaagtgaggtgaagtgattgttttctagtggcacggtacactgtcacacccttttagaaaataatttggcaacgttattgggagacagaaatatgtctatgtaatttatgggaacttagactcagaaaatgttaaggaataagaatgaactttatgaacaaagatgtggaaagctggaagcaagagtggggccaacacgcatggggaggaagcatttgggcagtgactccacagacccaggctcaggctgaactacacaacctccttacgcctcagtttccttaacagtagaacagaaatgataaaagtgcctgtttcacaggactattgcgaggattaagtgagatacatcgcattataagcttgtgtctggaaaggttaattcttggtaaatgatgactattcttttttattgcaataaaatatacaaaacataaggtttactattttaaccattttggaaggtaccactgagtggcatttagtacattcacaatcatgtgcaaccatcatcatatttccagaacattttcctcattcccaaaggaaacctcatgttcattaagcagtagctccccttaacatattagttatgaagatcatagcattatacaaaactcatgacacaatgatgagtgaaaaaatcaagatgtgaaattttgtgttatgatgtaattagtaaaagaagcatattaaaacatctgaaaaaagagtatataaaaatagcaattgcatttttcagactctacattttaaacattattctttatagttttaaaagcaaaaagtaaagaaacaacaaccaaccccaaaccaacacgacaaagccgagattgttaattccagggctcaggaacacagaatcatatatgatgtttacactctgcagggtcagagactccagcggcattgggagctgcctcgtgttctgcagcctcacagacaggaggtccagtgccgctgctctgttctggaatatcctcctgaatgtgttttgggtgcagttgccatttctttcatctttttaaacacaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccaggtaagcaaagatcaagagaccaaagttagtcttgtgctctcttgtctcagtctcagcccctcagacttcattccccaggtggcaaattcaaggattttcaaccgaagaccccagtctaagtgttgtttagaaacttcctagatctgtccctgaatgcgtattcagatcatctaaggggatgtcttggggcttgagttccaaatcagtagcaagcgagttttaagtgccataactacctcaggccactcaccctcctggggtgtgctggtggccagggactaaagtggtgacttttccggtagggaaggaggtagaggatacaggacagagaccaactgcacacactttacactgatgcccaggctagcccagtctaaaggaaacaccaacataggaagggatgtgtgcaggattcacaaaagatcttttctaccccccggaaaaactaagtggtgtggtttcgctaaacagattttgctaagtacttaagcactgcagatgcttgagtaatatgctcataagttcctttctgatttcaattactgggaaaatgtatatatggatagtagaaggatggcatcccataataaaaggcaggcagcctaaccctcacatgcatttttctctccctctgtatagggtgacagtggagggcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggttttggtcttcaacattttcatgctctttgttcaccccaccaattttaaatgggcagatggggggatttagctgcttttgataaggaacagctgcacaaaggactgagcaggctgcaaggtcacagaggggagagccaagaagttgtccacgcatttacctcatcagctaacgagggcttgacatgcatttttactgtctttattcctgacactgagatgaatgttttcaaagctgcaacatgcatggggagtcatgcgaaccgattctgttattgggaatgaaatctgtcaccgactgcttgacttgagcccaggggacacagagcagagagctgtatatgatggagtgaaccggtccatggatgtgtaacacaagaccaactgagagtctgaatgttattctggggcacacgtgagtctaggattggtgccaagagcatgtaaatgaacaacaagcaaatattgaaggtggaccacttatttcccattgctaattgcctgcccggttttgaaacagtctgcagtacacacggtgacaggagaatgacctgtgggagagatacatgtttagaaggaagagaaaggacaaaggcacacgttttaccatttaaaatattgttaccaaacaaaaatatccattcaaaatacaatttaacaatgcaacagtcatcttacagcagagaaatgcagagaaaagcaaaactgcaagtgactgtgaataaagggtgaatgtagtctcaaatcctcaaagagctgtgtttatttcattgacaaatagattatttgtattcaattctgatgtgctttaaggatgaagtttctcattttacaattagcacacacttcgtatatgttgtcacctgttctccttacacaaatgttgttccccattttgaaggattccctttggtaccagttttgcctgtccacataaagtatttcatttaaaaagctcagcataaaatatagactgcatctgaaaagatattgaatataatatacatagcagaacacacacgttccacatttcaaaagcctcgataacaaaaaagaaagatcaaagcccttattagtcgctgtaaagccatttataaagctcctgctgatcctgttaagcatggatataattgacctttcttttaaattaaaatgtaagcttttccccaagacaactcaaagtgccaagactgaatgggaactgtccatgtttctaactcttggccacgggcaccatcagaactgaacttaacaaatatatgaaaaatatctcttcatttttaaaatcctaagacccagaaatcataatccatgggatttgtttagtaaagaagaaaatctgtggctctaggtgtccactaaaggagagccaaaaatgtcccgaataatctcaggaccacagcatcattttatgaataacagaaccaagacctcagattgtacaacagattggttcttattgctggaatggggcataaaccatgcctggaaccccagatgctacagagaaggtagatgggagagacttctgacctgttcatgttgcaaaggcgtgcggagaccaaggtgagcagaggacacgaatgctcacattctgtggcccaggaacctgtgattcaatctcctcattaacaggattcccaaattttcatcctccctgcaatttttcaaatgctcggttatgggcttagtcccttgactgatcagatttgatgaacatttctgcacaaatttcccaaatccttggttttcaaatcctgcattcttgatggagctgttatgagaatcgggtggggggcttctctcgtctctctttagcctaatgaatcagagaccaggaagagccatgcacctgagaggctcttttttaagccagctacatattatgtgttcccagaaacttcaacagcactacaaataatcctaactcatccaacattatataaaaatactctggatagattgaggtctttatacagtattacaacagtgtggcataatgtagc

SEQ ID NO: 15855 - DNA, 24415 bp, Human
atgtgcttgtccatactctcttattcagatgacccaatgtgttctcttatcaatgcttttatccctcctgtgggttaaccatgaatgaaacaaagcaagggggttgggatgggaggcagttgaaacaaacaagaaatttaaaaagagttctttaattccttctttctagtccctcccacactctaatgtttttttccaatttggaactctggcctgactggttccaccctcagctcacacaccaactttccctgcccatgcctattctgtatttttgagattgggtcagtctctcctcactagcgagtacatacattcctttgaggtgagggacatcaccttcagtgtcaaggtttggacaatatcatcaaagggtcaccaagacatgcccaagaattctgaaatttcagaaccaggcttgttagaatcagttgtttaacacagtctcccacactgatctgccagccacgagaacaaagccacatggaagctaaagacacaggggcagtgtccagttgctggctggacattcctacacctcctcctctgattctcaatgctccctgggcccatccccttccaactcctcccccactagcccggcactgaaatgcccttgttcactttattttaaatgggcaccattcggaggctacattctcacagtccattctttgcttcccgttcctcccttgctccatgacctgggatcatgatccctttcttcctaaaactttcacccctagtttcagatagttgacagttttgcacaaatagtaacatttccccgtaattactgttttttttttccttccttatcaaaaggggctggtcaaagccaaccttgttcagtttatgaacccaactccttcctccctcaagactgacacagagattgacgtaaagagtacgctcggcccggttaaatttataagcacagaaccaggtatcgcatgcttgtccatgtgactcttttttttcttttctttctttcttttttttttttttttttttgagacggagtcttgctatgtcacccaggctggatggagtgcagtggcgcgatctcagctcactacaagctccgcctcccgggttcacgccattctcctgccttagcctcccgagtagctgggactacaggcgcccaccaccacgccggcctaattttttgtatttttaatagaggcagggtttcaccgtgttaaccaggatggtctcgaactcctgacctcgtgatctgcccgcctcggcctcccaaagtgctgggattacaggcgtgagccactgtgccaggcccatgtacaaaataaagcacccggaactttgcacctggacttatctacactcgacaatctttgtcctaggaactcagggagtccacaccaggcttttaacacccttgagactgaaggagggaaaaggctgtaactggcagcgacaactgggcctagtataacgcgaactccagttttggccaaacctcctccaacacacatgtgcaaagccacattctcatgaagagggggcaaaacatttgctttctgggtttaaccttctaccatctcaaaccaactgtgccaaaaatttccctgttcaccaggattcatcaaaaaacgtacatttctattttcaccgattttaagagaataattaactgctctatttttacaaaaaatacacaaagtgatacaatctaaagactaatcctcagacaaaatcaattgctaaacattggaggggcaaaaggggagaccacgccgcaaaagcacggagaggcaactttcggcaccgcgggaaggccccgaccacgctgcggctccgcctctcctcccgcccctcgttcggtagtccggtagccccgcggctccccgaattccccgccctcggcccctgcgggcgcaccctgcaggccccgccccggccccgcctcatcgcgacgtcagttgttatgtctcggctccggccgcggccgccgctgatacacggttgtggagggtacggccgcggtctccggaggtggcgggggtgttggggacgggtgctgcgaccggcactgcccatccgagcgggacgggcgctgagtggccgggaggcagccgggtagccgcctggaggagcagtctcggggcctattattggttttttccctccgagaccgattccatctgcagagaccgcgacgccccatcctgggccgggccgcagtgcccgcccgcctgagaggcgccgcccgccagccggcccgagcgaacctggagccgccgccgtgcccgccgctcttctcgcggagcctgggcggtcggcggggcctggggcctgggcttcgggcgcggcgttgcggcggccgctcctccccgcgcagaacacgctgggccccgggcctggcccggccgagcgccgcgccctcctgacccgcggccgcgggagtccggcccccacggcccctcgggccccggcctgccgcccggatccccgcctcctgggcggatctgagttattttttggtctccccctcccccttgagatcgcggcaccggagggccgaccccgccacctgggtcagtgcccgccccgggggaagcgtccctcgttttgttcttccccgcgagctctccccgcgcccctctcctttctgtgcttaatggatgggggttttgagtttttcccctttatttttgtcggctcttgactgggaggcccggcgcgaggctctgcgtctctgcgtccctcgtcgccgcctcgcgcccgcgcggatcccgtcacctgcttccccgccggggatggccggccagtgacggcgccgggtggcccgcgcgtggacacggggccctcgcccaagctgccaccgagccgcggcccccgccctcgacccttctctctcccgtattccgagctctctggaaagagaggagactccagggaagatgtggctgaagctttttttcttgctcctctatttcctggtcctgttcgtcctggccaggttttttgaggccattgtgtggtatgaaactggcatctttgccacccagctggtggatccggtggcgctgagcttcaagaagctgaagaccattttggagtgccgggggttgggctactcagggttgcccgagaagaaggatgtccgggagctggtggaaaagtcaggcgagtatcgggcttcccctagggtcccctccacctgggagaggggacgacctgtacctcctggtacctggctgttcccccagagtgaggcctttcctggaagcgttaaagctgcccaggtttcttcgtccaagcttcctacaatcaagtatgcggatcccagctttgaggaggagtctgaaattatttggaggagtgttggtgtatccttttaaggttatcgtaaaatgacagtttaaagtgtggcttcttagcgttgtttactaagttgagtgattttctcaaaattcgggaatatcaactagttacaaactggaaagcattatttgtcagttgaagttcataaaaacgtaagaaaaactccaaaacgttgtctgtcaatagcaatatttgtcacgatagtaataataagatacccagagtggggacacatctttggaatacttactatcagaggcacttgggcctaggatttaaatgttaaatcatgagtttgaatatagacagtatacaccgtacagtattagcttttcagactttaagtttggtgaaaataaggcgagcattttgtataaatgcctgccatgttcgagtttatattatattttctgttaggatttttaaaaatttgcatcttggatgtgtaaaagaaaaattttttttgtcttctgtgtcacaggtacccttgcattgtttaatgggttgagaaatatacgtgaaatagtgctgagagaatattcaatgtcttaaagaatgtgtttttagtaattgttggttttggtaggattgggtgagaaatatggttaatttttttcactgctgcacaaagtatatctttggatatacttcctgaaagtggaatgtaatttgagaaaggctttctgcgttgctgtgggaagcagctgaaactgatggttatcttttttgttgtttcaagtatttttgtcagctgtatcttttacaagacaaatcttttccttctttagtaccttatagacatgtagcgtgatagacaagagtatgagctcgctagcagtttaacacttggatatttgtaggttgcgggttataaaactcatatctcactattagggtagaggagaggaacacactctgcagaagtgataaatgtttctttagagaaaatataaaatcgtatattattcttgccccttgtttgctgactggtttatggcgattcttatttctaccatagggggaagaagtggagtaactagggtaaaagatctctaataaataaactctcttggtttagagatgagaagtgtctcaactgccaaagccatcatttttttatggaaaataatttggtcacacatttttttttcttttgactgttatttattattgccttcttttgggcctaaaaatacttggcacattgaatgtactagaagtccacatttaactttaagacgcacagcccagtatgactcaaatcacacgttttatggcagaaaagtcatggtatagcagtttaaaatttaagtgtttattgtgaatggttttgctgctatcatggtgcagtacttggtttctcactgtttaatatttaaggcgaaagttaaaataatttgactttagtgttttcctttcctttttgtttaatgatacaagctctaaatttataatataaatttgtatatgaatatggagtttgttctgtctaacaggtaaagttctaacctccaagtcatacaaaccctgttgctcttttaagcagggctgatggcaaattctgtgaacccaattctacatcttttaagtaagaagcatataagccatactgtttaaaaatgtatatgaagcctgtatgtgtcattcataaaactaaataattaagaaagttgtgcctttttggagtggtacaaatttggtaagttcctaataattatgtgataaccccactaaaatataagccctgttctataagagatggatttttgtctattttgttcacttttccctgatgcataggaagttcttactacatatttattgaatgtatgactcctaagtgggtatatccaggttcttctagtagttcttgtctataaaatacaatgaaagtacaatatcatgattcttaacagtgtaaaaaatagaattactgaaattgggaatctaggattcttgcaaccttattagtgttattcttttcctttcttcaggtgacttgatggagggtgagctctattctgctctcaaggaagaagaagcatccgaatcggtttctagtaccaatttcagtggtgaaatgcacttctatgagcttgtggaagacacaaaagatggcatctggctggttcaggtatgaaaagcagtaataatttgataattcgagagccctaaaaaaattatttttaccaaaatagtatgtaccagccagtgacacttccgtgtccttgtgtcttgtttctcacacataactcagttctcttagggaggctccagtatcttcttaaaaaggttttggagactgaggaagatgaaagttgagtagtgggaaagagaaagatgggggatgggggtcaactttttgtttagaatccccagaagcaaatctattttagttattggacctttgttgaattgagaaatacacatatatatcccttttatttagtgatttgcactgtttctcttagtttttattatctccagtttttaattcagtggcctgagtaatttttatatataagtaagaaccctaaagtaaaagtaaaggaatcattgtattagggaaatagccaactttgtgactatagaggagctgttgtggaaaatggtgggggtgctcattacgtaactcaggatgatgagattataatttttaacccttgtttttatgatagcaaaactgtgagacttaattagcatattagaattttagagctatgaaggaccttaaaaatattttatgctttccaagatgtaatttatggtgagtgggcatgcattatcatttacatattttaatgtaaattagaaaaattatattaacataaatttcataaattttgcttaggacaggactaaagttatttacattttaaaactgtacattcaaagtgacatatcaagtaaattaacagcgtgaatgtggctaaaattattaatgtagtctgtgaatggctgaagcttggaaattatatcagactaaccctttctgagactctgagaggtgaagtagcttgcccaaggtcatggaactagttggtagtattgaaccaggatgaaacccaggtcttctgatttcttgactggtactcttgtcatttcacactggagtgggcaaagtttgattcagggcatgaaaattaaaacagtttcttcatatttctttctgagagtaaagactgcaaaatatggtaggaaaagctatgagttcagagacattagttgcaggtctggtactgtcgctgttacaggtctggtactgtcactgactagcagtatgattgtaaataggtatatttttctgttgcacgtggcctcaaataaatacatatacatctaaaaaggataaaatggtactgtagtccactgtgctaaagggttgaggtttgggaattcttccagagatttacattgttcatccatggcctttctttattgtatccttcctattgcatttgtccttttaccttccggataatctaattcagtaatttttaagttcagcaatgggagagaatgtgagagtatgagtgtagtctatacattatctatttaaattttagtttatttctgtgtcagttggagttgaaaaataaggtggagcttttttaaagctttaatgtataagtatattgttattctgtttcttttctctggtacttatttctaatagtctgattgagaaagacactggttttgataattttagattttattactgaggatgaattgaatagccagtcccactgccctgctttcagtgtctaaatgtcacccacattgaatgatcccatggaaataaatggtgaagatgttgcacacctttgaaacttggaagggctatgtcaaaagtcttgagttcttttgctatataggctgctgcctatagacaacaaatacattctggttcaatagttagcagtatgttcttggcttgtaaatgatctactgtttttgatgtcctgttaaagatatccatgaattaagctcctgtaataaatatgtgacagaattcatcaaaagtttattcagttgtgggtgtgccaggccctgttctgggccctgaagatataccagaaacacacaccaagctaaggccttgctctgtcaggcagctcacattctagttgggagaggcagacaccaaataaataaatatttaatataacatcagttagtggaaagtagtaagaagaaaaataagcagattaaggagatgagagtggcaaggaattctctggtaaggtgacaaatgaagtgaaggacaaataatgatagtaaatggtagcattataaattctagttgctaaattttttttctctgaaaatatttttaaaccttataggtattaatagttgaaaaacaactctttaaaaatagaatgtatttctgtggtttttctatgtatggaaataatgcagtaggacacctgcttaatttttccagtgatgctcaaggtttgcattgaccaccactgtctggcttgtgttccttgaggccagtggcttacatctgtcaaatggctggcctggtctgaaagaacaatctctggcaggacaactgagaagaatgagattgaaaccctgtccttggcactgtgaactagccagctaagccaatcagcacagccaccttggtttaagcccttaaaagagggttgtactttttaaaactatgcttaaaattgaaaatatctactagaaacagaagagaaatattgtctccattgcttgccattctttcagctcagatcatatatattaatctattgtaaaggataactttcaagaattgtttttaacaatttgaattgttgttattttctgtttacagtagtccccccttatctgagggggatgcgttccaagacccccagtggatgcctgaaaccgtggatagtaccaaatcctatatagtctatgttttttcctatacatacatacctgtgataaagtttaatgtgtaagttaggcacagtaacaacaacaactaataaaaatagaacaattataacagtatactgaaataacatttatgtaaatgtggtgtctctctctccgaatatctaattgtatgtagtattttcggactgcagttgactgcagaaagtgaaactgagggtaaggggagaccactgtattttagaagaagctgactaatttgttctctgtcatttgttttaagtctatgaggagtgttttcataaatgaagatgcacagatggcagccagttcaatcctcttcatatttttaagcttttccaggtccatgttacgtatagtctctgtaatgtgaacagaatttattttagttttcaaggtagcaacatacatatgacatctttaccaatgacacactatgaaatacatgtagaaccaagtgctcttttttctaagttattcctaacattgtttttctcctttgtccctaacccaagctcatatctttcattagctattcatttaacagttttgtggattctttggccccagtcttcatagcattacaaatagaagatggttacttttctttcaaaagacccttggtcagagaggcagatggcacagtggataggcttctgaagtggagaagttagcataatttatgggttttatggatttatcctcctcctaacatttctgtttctccgttttgacttttgtcatagttcaaagaaggacatatttgttccctactggctgtgttacatcatatggaatttaaagtcactggaattgaggtagcagtgagaagcatcatatgatttaaaataaagctttgggtcaatatttactgaagtattacatcaatatatttcctgtttggctgacaagagttaatagctgattttaaacttgtttatctttgctcctagacaaaagttttgttcgaggagattctaaattacgtatttctttcttgatactgctatggaggtgaagcacatagcaagccactttatcttatattttgtattggtaaaaaattttataaattctatgtaagaatacaaaaaaattaaaagaccactgttttttgtcaatcacttgtccttactcttaatggttttatatagtttgcatgtatatactaggttggcttatgattttgaaagtagagactccctattataatgaaatactgagaatgcagaaaatatcatagcacaatactctcattgttccagggagttatgttacttaactaaacctggatgtcgttgtatggagattaacagtattaaaaggggtatgccacatggtttgatcagtaataaacctcacctctaaataatgggcattttaaaatgcactgaattaaacatctttatgtctgactgaggtcaagaacattaatatgcagttgcttagcagggtaccatttatgccactgtttgtccagaaaacatcttggtacaggttgctggggaagggactttgattataacagaaatcaaaagcttaagagtttcctttagagactctgtgtaatcagaactagaagaatgagttattaaactgtaagaagctgaaattgtttggtttgacataaatacttattgagcacccatatgagttgggcactgtattagctgcagggactacagtggtgagcaagtgtggggatgccagaggcagataccctgggaaagggaatggaaagattgcttcacttctagcctgtattgccaggtctgttccacacctggaactcaagctgtactttgtccagtttttttgtagtctttgaaaatgttccccacatacagtgttccttcctgagctgctgaggaaaatgtctccccttttaatgagaccagccatatgaatgccactcagaatcatcatgcatccttctaggatatgagctataaattggggactcttactggtatgacatagtgtgtgtgtgtatatatattatatatatatatatataaggcatatgtatatatatatattaggctgagaatattttgttgtgctgtgtgactcaaccagatgagttattttgtgaaaatattagcatttttatagtggttggttaatttaaactccaccaaatttaatttatgctaaaccttcagttgaattatataactatgtaggacattggacacatttttaattgcataaatataactataaagtaatataaaatgctttcatgcaatgcctacaagatttttcatttttgtgtagctctgtcagtcagggatccttaaactcttcaaaaccaaatgctagaacacgttgctgaataaataaggccctggcattgaacattgtcttgtacctgccccaggtatgttcccaactcttttcactcacttctactatctctgctataaccaagaggtacctgggaagaacccctctcattcctccttcttttcctaacattggagctcttatcacatgtctcaaagatacctgtgcagtgaacaagatcttcactgaaagatgcctccagacttaggaactaaatatttacactggcgaggcaacctctaaactccttggagcagtgtcattctgcacacagacctgaaatgtttgggttatttgcaaccttgatcaagaaatgggataatgcctgaaaagtgagttatttttaaaagagggcaaagagtagagagtatggtagtatgattgcacagatacttcttaatcttcctaaggaatctgaaaaataagttaaacttgtctttgattatttgaccaaaagaactaccagattgactcttgagtggtagcaataaaaataaaataaaataaagaacaagaggcaataggcgcctgctttgcttgatcttcctaattttctaggtacaacttttttttctctcttttttttgagatggagtcttgctctgttacccaggctggagtgcagtggcataatctcggctcactgcaacctctgcttcccaggttcaagcgattctgctgcctcagcctcccaagtagctaggattacaggtgtgcaccaccacgcccggcaaatttttgttttttttaatagaggcggggtttcgccatgttggccaggctggtcttgaactcctgacctcaaatgatccaccagcctcagcctccaaaagtgctgggattaaaggcatgagccactgtacctggccttctaggtaaaacttataaagtacttttggaccagagaaaaatgtaaagctagggacttactgggtagggaaacgtgtgagcatccttcaaaagagctttcacctattaagtgcatgtccccagattgccttcttcctggttacttcagctgtctgagtatttgaataaattgtatctgcctcaataagaccacttattttcattaaaaagtactatcaaaaccatggttgggtgcagtggttcatgcctgtaattccaacacttgggaggccgaggcagaaggaaccctgaggccaggtatttgaggctgcagtgagccatgattgagccattgcacttcagcctggggaacagagtgagaccctgtcccttaaaaaaaaatgtaatatcaaaaccatttgcttaatgccctaaattgtgtatatgtattcattaagcttcaaacttatgtgataagatgttatgtatgcacgtgtgtctcggtaagtatgaggatggtagtggagtgtcacagaggttatttggcacataaagtgaacttcaagtcacttgtcatcacaatgtgctgtttcttctgctgccctctgacatttgttagacgttctagcacagaggccacagatgaggtggctgcaccacctcttgcgtctcccaaggagttgactgtcagcactcattttacacacccacctgcaacttcacttcctggaggctttgtgagtgtgaaaatggtccttcctcccagaaagagtagaggcccccagagtattatgttgtaattttgaattgtatagtatcagaaatataacatttatgaaaataaacttggcctatataccctggacttaaacagatggtttcatgatgactttagacatttttggctttcctttaacttcccatttagttatttttatggtcttgtttttaatgttttttggtttttactggtatctgcattgaaattctgccttcattaaaggcaggaagattaggagataaagggaaaaggtggtaatgattagaaaggctgacacttataagagaagtcttgacatattttgaaggtcttgctctgtcacccaggctgtattgcagtggtgcaacctctactcactgcaacctccacctcacaggttcaagtgatactcatgcctcagccttctgagcagctgggactataggtgcctgccaccatgcctggctaatttttgtatttctagtagagacggggttttgccatgttggccaggctggtcttgaactcttcgactcaagtgatgcatctgcctcggcctcccaacatgttgggattacaggcgtgagccaccacacctggcctctttttcttttcttaagaatcttttgcttttcctaatcctaattgtgtttgaaagctcttgcaaatttgaagtacaagttcaataatgtaaaattcattacattaaagaatgaataagaagaatggtaattcttattgtatgttagagccgttcatgattaagcaaaaagccatagaactagtagtatttattgatttagtcaaagcaccctttaatagaaaacatgtgtttgactcttggctccataattatactttttaaaaagtgaaatttgaacttgttgaacctacatgtgataatttttagtaagctctatttggattattgtttaaaattttcttttcagagcaaagagaaattattccaagggccattttcttcctgtgtaacttaattagagagaagaggccacatggtggagaatgtggctagccttttaatacagttttgactccctccctctctttgtaactgccacagagtgtgggagagtttaatttacgtttcagtgtttcaagtctttttcctattggatagttgctccttctataagaattgtaatgataatgtgatgatacagtaaacaagaactgggaacagaatatctttttttttaagtgaaattatattgttgatgtaaacggttggcttgactccattttaggtaattcaagtttctttttctctatttttgggaataggtcatagcaaatgacagaagtcccttggtgggcaaaattcactgggagaaaatggttaaaaaggtgtcaagatttggaatacgtacaggcacatttaactgttccagtgatcccaggtaagttgattaggcaattcttagaatttgagtcctgaccaggatctttcttatttaaaaagggcaatgatactagaagcctgcttgaactgaaagcttattataatgtgtagcacactcttagttacataggtgcttgattaatggtttttgataaactggcagctaatgactttcactctaagatctctctctgtctcctctatctccctctctctccccgtccctttctctggctcttctgtgttttttctattgaagatatctcttaagattgtgtctttagtccttttcatttcacctttcttttccaaagagatctcagcacattcatggctttaggtgacacctctgtgctgatataaatcttctatcattctgacctctagtttgcatttctttgcttatttccatttgctctgcaactatccctagatatattcttttccctgaaacctagtatctgaaatcagattcatcctctttttctttaatcatccatgtatccttctacctttcttttttctgtccttcgccggttttcccccccattttctcaaataagaatcctcagaggtgtttttgtttatgttttgtttttttgtcatcatttccagtattcagtctgtcacattatttcttgttttattattccattatttcttctttgaaatgcctttttttccatttctcttgctaccaagttataacttagtctcattcattgattgtagaaaactctcctaaaccattactatacctcctttccttagccttacatttacttctcttctgcttagaacccttgttttgcccactagtaatatagggtgagatggatggtagagttcctctaagagttgggaataggagggaagttcctgtatctcttaactcacatttagtctccttatctacctgcaaagctgtcatgctcatcttcaccacaaagtctttttttctgattttttttttttttgagacaggatttggctctgtgactcaggctgtagtgcagtggtgtgatcatagctcactgcaacctccagctgatggatgggctcaagtgatcttcccacctcagcattccaagtagctgggactacatgcatgcatcaccacacctggctaatttttttttttttttttgtagagatggagtcttgctatgttgcccaggctggtaaccacagaatcttagtcacatcccaatgtcttttgttgaaatgtctgagatagcttaagtcttaatgttcttttgaaaaggaaatcattctgatctccattcgtcatttaccaaagacttaggatttgatctgattccatcatttccaaatagagtcaaagtgaaaggtctttttcttcctcactgatttttacaatactagaacaaatgataatgctgatattttgatttttttagttatgccaaaagtcagtattcatatcactattttcttttaaaatacccaatgtattttttaaaaatcagtggaactaaataatacatttcaaacattatagtttataaatatattagaaaacatcaaataaaaacacattttaaaaatatataaagttgaatgcattaattaaagtctaatgttattagataataaagaattcaaaaacaaaataaaaataatctgttaaacgtgaaaaactgaaagaatgatttggtgggggcagacaaaccataatcttataatcttataaatcagagtgcatcagaagtatcataattcagtccagtggattttagtgcaaatttatttagctcttcttttgaaaagctctgattctgtattagctgagaaatggtgaagagatacatacaagctagctccagatgttttcctctaaatccttcatcttcaaataatcctacctcttatttacaattgaagcaatgtttttttggataactttttgcttttttgttgattgtagctatagtttttgttatttaaaaaagtacttctactcagcttcatcagaaaatgattttgttgcacagtgacttgtaccagttccaataatgtgcccatgactcctcatttggaaagtcctccaactggaataagaattgttcttgccatagaagctatgcttagtcagggtcatttttcttttcttttgatgactatggagatatagaagaacaaaatttagagatatagagaagagtgttcagaatttcaatgcagggtgtaagtgggcagagaatagtgttattcaggaagtgttttaatcacatattttgaataattgagtcatcatcttgattttggagttttaaaaataccaaaactctgtgccccactgtctatgctgcattctttgactgtagtcccttctctggggtggcctctgggcagctgacttcagtgtgctggtcccactgtacagctgtactttcctgacctgtttagctcctgccttagtctgttttgtgttgctgtataagaatacctgaggctgagtggtggctcacgcctgtaatcccagcactttgggaggctgaggcaggtagatcaccggaggtaaggagttggagaccagcctggccaacatggtgaaacctgtctctactaaaaatacaaaaattagccaggcgtggtggcgggtgcctgtaatcccagctactcgggagactgaggcaagagaatcacctgaacccaggaggtggaggttgcagtgagccgagattgcaccactgcactccaagcctgggtgacaagagcgagactctgtctcaaaaaaaaaaaaaaaaaatacctgaggctgagtaatttatgaagaaaatagatttatttagctcactgttctgcaggctgtataagaaccatggtgccagcatctgctcagcttctggtgaggcttctgtgctgccagaacatggtagagaaggtcaaaggggaagtggacacatgtgaagggcatgtggctttatgtcagcccactctcgaggaaactactccatttccacaagaactaattcagtcttgccaaagctagaactcactaacttgagagcagcactaagtgttcatgagggatccacctccatgacccagacacctcccactaggcctcacctctcaacactgccacactgggaagaaaatgtcaacatgaggtttggtggggacagacaaaccataaccaaaccagagtagctcccttaagaacatttaggactaccacttctgagcaacttctgactgtctagttgtagcagctttaatttctttccctatgtacccagaaggagtggccttgcctggctctacctcttctcattccctaaccagcagatcgatttcagagggcttttcctgtgaggttcatactctgtactttttttgacaaagtaggagatgaggtggtaatgatgtgtagagagggttggggagatggggattagtaaagagaagatagaggacatggaaattgcaggagctgagtggtaaacaggaagccttatggcaagagtgtcagggatggtggcctgtggaaaaaacggggaaggagaagagaaggggggattgcagagagagcgaggaaaaccaaggaggccaatgaccttgtctgaaaaaacagcatatataaacagaaatgttaaggtttctctctcttcctttcttccttttttttttttttttttttttttgagatggagtctcactctattgcccaggctggagtacagtggcacgatctcaactcactgcaacctcagcctactgggttcaggcgattcttgtgtctcagccccccaagtagctgggattacaggtgcgtgccaccatgcccagctaatttttgtattttcagtagagacagcgtttcaccatgttggccagactgttctcaaactcctggcctcaagtgatccacccaccttggcctcccaaagtgctgggattacaggtgtgagccactgagccctgcttcttcttaaatatagcatgccacatcagcaactggaagaccaaaactcacaaggcatatttcctatcgtttttagtcttaaaattctctaagagaactcaaaaggtttagtttaaaaactagaggatattttcatggtattgtcattgaatttgttcagatcataaaaaaattttttttgaattggcaataaaagtttttatattgatgtaaggtaatacaaccttattctatctggaatgataaaattattacttagctctgagctgaaaagaaagcacataatatgtttgttttcttatgtgaagaaatgtctgcacttagaacttgttcattttacaaagtaagttttctgtcagaaaggctgtcatttaatttatgacacaaatcagaggccatagtaggaagataaaatagatggccaagagttgaaatgtgtcatcacaaatatcaagtgcaatgaaaacattaaagatacttgaagatatttaagatataaataagacagttgtccatatgcatttgacttgttacttttttgggatacggtaaaaatagaattcatgtcaatcaatgaattattattttgcattgagtagaagatatttattttgtaggaatatatacttttcagaccatttcagttaaaacagtaatgatattaatggaatctgtcttattaaggtagtgaatcaactcaacaagaagctaagagtcacagtctgtgattttgagtcacctagacagttttccagagtcatcactaaccttgtcttaagacatagcgtgttgtcttcatttatcttaaactatatcacagaatccctgagataaaattagtcatattatcattatacagccatatgctacctacgtcaagactcttctcttcatctgatcatatgatgtgtaatatgtttatttaataaaatataatccatgctaagtaaagcataacatctatgacttttacatcaatattctgagtagcaaaatgcgaagtcagatatttattactatgcatatacaaatctgtaacaaataaaacgtttccatgtggtagattgtcttttttacaactttattgaggtaaattttacttaaaaatttcacatggtaggttttggaaaaaaaaatactttttaaaaacaaaagattaactcttctgtgtggtacatgaaaaactaactaaaaccaaaaacaaaaggcagcctgggcgacatggtgagaccccaactctacaaaaaattcttttaaaacttagcctagcatggtggcgtgcatatgtggtcctagctactcaaggaggctgaggcaggagaatcgcttgagcccaggagttcaagactgcaatgaactgtgattgcatcagtgcactccagcctaggtgacagggaaagaccctatctcttattataaaaataaaataactaaaaattaaaaaataaaaacaaaaggaaaatattttcacttacagtctctttactgggatacaacagctgttttcattgttctttcttttttttttttttttttttttttgagacgaagttttgctctgtcgcccaggctggagtgcagtggcgtgatctcggctcactgcaccctctgcctcccgggttcaagcggttctcctgcctcagcctcccaagtagctgggattacaggcacgcgttgccatgcccagctaatttttatatttttggtagagatggggtttcaccatgttggccaggatggtctcaatctcctgactttgtgatctgcccaccttggcctcccaaagtgctgggattacaggtgtgagccactgcacccagcctgttttcagtttttaatatttcttttctctcattacctacttttttaagggaagatggatatcacaaatatcctagcaagaacctgtcaatagacaggtttccaaaaggaagagtcatgatcctactgcataaatctaaatgaatgatttaattttagttaaattcttctgaatataatctgctgtaaaatggggatcattcttgaagtgaacctcttaatctaaatacttcctgtttttgtttcctcttgttaaatactccccttcatgatcttcactgaagaaataagagaatacaaaaatatatggggcttgctgttgctcttttcttggttggcttttgtgcagattactttgtagcagtcaggcattgtggtagttgttaattaaatgggtaagcatgactcctaccctcaaggagcttgcaccaaaccagtgactcagccttaggataatctgttttcttctcttttctccacccatctggattctaaccatccttcaagacctagttcaattcctaaaccattcatgaaatctgcaccagcccaaactttgaacttcttttgcattatttagcaacagaatatatacagttttatctctattttgtctcattaataggattttaaattccttctgaacatgaattattttcttgtcttctggatcttagcacataacgcagttgtaggtacatgagagatgctgaagtatttgctgattcctttgactcagaggcttttcaagatacactttatttaataaaaaaaaaagaaacacagaaatacaaaacaaactagaaaaacagagcttgtttttcacagctgccaagtagtggtaccactttttgattatttggaaattatttggctttggggtgaggtgctaaagaaatttgtcagggaagataaattgtttgcattacagcctagctgtttatttacagtttcctctcttgtagatattgcaggagaagaggctgggtccgatccacactcattatgtctgttccacaaacaagtacttcaaaagggaaagtcatgcttaaagaatacagtggacgcaagattgaagtagagcacatttttaaatggataactgctcatgcagcttctcggatcaaaaccatttataatgctgaacacttgaaagaagaatggaataaaagtgatcagtattggttaaaaatatacctatttgcaaaccttgaccagcccccagctttcttctctgcactaagtataaagtttactggaagagttgagtttatttttgttaatgtagaaaattgggacaacaagagttatatgacagatattggcatatataatatgccatcatacatacttagaactcctgaaggaatttacaggtatggaaaccacacaggcgaatttatatcccttcaggccatggattcatttttgcgctcattacaacccgaggtaaatgatctgtttgttttgagcttggttctagttaatcttatggcttggatggacttatttattacacaaggagctaccataaagcgatttgtggttctcataagcactttagggacatataattctctattaattatttcctggctacctgtgttgggctttttacagctaccttacttagatagcttttatgaatatagcttaaaattgttgagatattccaatacaaccacactggcttcatgggtaagggcagactggatgttttactcttcacacccagccctgtttctcagtacataccttggtcatggtttactaattgattactttgagaagaagagaaggcgcaacaacaacaatgatgaagtcaatgccaataacttagaatggttatcaagtctgtgggactggtacaccagctacctcttccacccgattgcttcttttcagaactttcctgtagaatctgattgggacgaagaccctgacttattcttggagcgcttagctttccctgacctttggcttcaccctctgataccaactgattatattaaaaacttaccaatgtggcgatttaaatgtcttggagtccagtctgaagaggaaatgtcggaggggtctcaagatactgaaaatgactcggaaagtgagaacacagacactttgagtagtgagaaggaagtatttgaagataagcaaagcgtacttcacaattctccaggaacagcaagtcactgtgatgctgaggcttgttcatgtgccaataaatattgtcagaccagcccatgtgaaaggaaggggaggtcatatggatcatataacactaatgaagatatggaacctgattggttaacttggcctgctgatatgctgcactgtactgaatgtgttgtttgcctagagaattttgaaaatggatgtttgctaatggggttgccttgtggtcatgtgtttcatcagaattgcattgtgatgtggttggctgggggccgacattgttgccctgtttgccggtggccttcttataaaaaaaagcagccatatgcacaacaccagcccttgtcaaatgatgtcccatcttaaccatgtgcaatttgtcctttataagctttgagtatcttacagcttgcctttttaatgttagtcacaatgtttttgtggtttgaagtttagtttaatgttagtgcagtgacgggaaatacacattatgctaatgttgatgacagaatttatttggttgccttgtgtgttaattgaatgcatacctaattgtaaaatttttttatttacaacattggaaattcagaagttaatgtttttttgtaagcacaaaagaagtattatagaaatttatcctagcaagactttacaagataggatcaaattctaatggaattgagccggtttcttatcctaaatgtttcctccctttttacaatctctgtccagcacctcttggttaaataatgtatgctgtgagacatgaaattaaaacagacctatgaaataaattattttaaaaccagaagattacggattttccaatgttaaatttttttgataaggtggctgaatgatataggtgttttgctggtttgttaatttcacagatagatcaaacatgattcttgactcacgttggggaggaagacaaaatgttgctggcacttgctagatgtgacagttcaccttttagcttggttagctgtgatgggaaagagtttcatggtgggcttttgaaaaagtactaaataatttatcagtacttagcacattcatctaaataaaatcaactatagcatattagccacacataaattatgttttttctgacttttgaaattttttaaagctacagaaagctgtaaacatagtacagtgaacatccatttctttttatctaattcaccaagtgttcacattttgttatatgttttatctcctatctcttatgtgtatatttctttttttttttttttttttttgagatggagtctcactgggtcgcccaggctgtagtgcagtggtgcaatctcggctcactgcaagctccgcctcctgggttcacaggagtagcagggtctacaggtgcccaccaccacgcccggctaattttttgtattttcagtagagacggggtttcaccgtgttagccaggacggtcccgatctcccgacctcgtgatccgcccgcctcggcctcctaaagtgctgggattacaagcatgagccaccgcacccggccgctgatccttttgaaaataaatttcagtcatcatgatgactgactgctaaatatatcaccacatatctaagaacaaggacattcttttatgtaaccactataccattatgacacccaagaaatttaacattgactcaataatagctaatgtatataaaatcgatactccccaattgctcctgaaatatcctttatatctaaatgtttttgttttatttttattgtgaactcagacatagtcgatacattaagtttagtctcctccttttcatcctttcctctagagtaattccccctgccgccaccccttttttttctttttcttttcttttctttttttttaaagacagtttccctcttgttgccccggctggagtgcaatggcgcgatctcagctcaccgcagcctccacctcccgggtccaagcgattctcctgcctcagcttcccgagtagctgggataacaggcacccgccaccacgcccagctaatgtttgtacttttagtagagacggggtttctccatgttggccaggctggtctcaaactcccgacctcaggtaatctgcccgccccggctcccaaagtgctgggattacaggcgtgagccacggcgctaggcccctgccccctttttaaaaaagtagactcttctttgatttctctctggtgttctgttttatttttcttttatcatttttttctttttttgagatggagcctctctctgtcgcccaggctggagtgcagtggcatggtctcagctcactgcaacctccgcctccctggttcaggcgattcccctgcctcagcctcccgagtagctgggattacggacatgcaccaccatgcctggctaatttttgtatttttagtagagatgcggtttcactatgtaggccaggcttgtctcgaactcccagcctcaggtgatctgcccacctcggcctcccaaagtgatgggattacaggcatgtgtcaccacacctggccaatttgttttacttatttttattttatttttttattttattttatttattttattttattttattattttattttattttaattttattgagacaaggtcttgctctgttgcccatgctagagtgcagtggcatcatcatagctcactgcagcctcaaactcctgggctcaagcgatcctcctgcctcagcctcccaagtagctggaactacaggctcaagccacagtgctaagttttgttttgttttgttttttgtttgttttgttgttgttgtttttgagagttgga

SEQ ID NO: 15856 - DNA, 9069 bp, Human
tgaaaaatcagcatcccatctggagaccagggtctaatatggacccctttagtacaatagacatgttaaaagatgtataatcaaagctcagagcaagatgagagaaggactgtgggtgtgcccatacttctttgagccacctcgccccttcctgcccgctgttcaggtagtcgtggtgattataaaaagccataagttctcagcatgcaggcccacttcgcttgctgcagggacagccccaattcatggcctgggaggcaccttgtgtcctagacactgtcagaggagggccaagcagggagggccagagcacccctctgtgctggagggaaaggtctgctggtgccagaatctgcatggcaggacactccattagtgagtgttctctgcccacagtgctccaaaggtgaggacctccctgtggcagggtacaccttaacaccacctgtcagggatgctgtagaaggaccctggcactgggactgtgggtggaggagagaacttctgaagtgctttgctggatcaacatgtccaaatgctggagaccacggagggcagagagagtggcatggacgcccccgatgtgtccacttggccctgtggctggaactgtggcttgaggagaaggaaggaaaaaggatggaaaggtagactggagttgccttttgagggctggcagccctgctagaagtttaggcaatgggagtcattttccaagccaaaaattagaactcatgatagggacatggaagtgttattgggggtggccatcatgacccgtcacgtgacactaggccatccaggacctgtggcctctgaagtgatgggaaccactgaggctcatgcctggagcagtggcccgactcagcctatgcttcaggatgatctgtctaaccacagagtagaggaggcccagaggatgaaggctggaggctgcaggtgaaaaggttgacgccaaagtccagacaaagaagggagagaatctaggggtgagggggtgcttgtaaggagctgcctcagaggcaggaactgggacgtgcacccattgggcaccacgcctctctgtgcttcacaacaaactggcacatcccaaggccactggaagccctgctgggccatctccccaaggccagtgctgtacacataaccctacaagaccagtttcctacacataaccctacaagaccagtttcctacacataaccccagatcccttgtcctgtcttctcagtggggctggagcaagtcagcaggtgccactttctcctgccttgtctctgcctaataaaatgcgtctcaatgttttacacctgccatttagcatggactgctttaacacctcaaaaaggcctgtggaggagcctataatcatcaaggaggaattcccagaatacaaaataacactagcggctgataacaactctaaaaaataagtttgtgtaataatgggggtgagaagagatcataaggttatgtaaataaggtgaggttttgagttcaaaggaattctctggtatttttctgtgtgtgtacacatgcacccacacacttgtgtgtatatgtgtacagacatatataaacacatgcatataatgtgtatatatgcattacatatatgcacattcatacatctttatgtacaaaatacatatatgtatatataaacaccgatgtacaaacacatacgcacacatctatatacatacacatgtgtgtgcacatatacacatacctgcatatacacacatttcgtggggtgcggagagtcacttaaaggctgcagggccataaggcttcctgcttgactgatattcattaatgtttgctgaattacagcaaacctttgctgtgcccatcctgttctttatcattgaccattgctctcaggagttaatgtttgaacctggccataaaggaatcaacagctgctgacctctggccgctattcgaagggaagggagccccctataaaacagcctacagtggacagtctggtcggcagagccgcaggtcagtcgtgaagagggagctctattgccaccatgagtttctccggcaagtaccaactgcagagccaggaaaactttgaagccttcatgaaggcaatcggtgagtgctggactgaaaggcaaagctgtgggtcacatcagtgagggtctagctctaccagcagtggctatttagggtccaaatgttgagatggggggagagattcaggctatatacacaaactagggggcattttactgacttctggagttatttgcagcaagtcctcactgcacaaggccaccccataggcaagtggaaagagcactgaactagggtgtggtctggattgatggccatgtcattggcacttcgttgtgtgatcctattcctgcatttattcattcttcaaacaaacagtgattcaaggccaaccacacactgagcactgtgctggatagataccagggagacagatgataaaggcaataaggcattttcttatcagggaagagaagagaagaaataaaggtaataaggcattccctcaggtgtatggagcgctgactgtgccaggcgactgtgctgaccatgggatatgcaataccccatctattccttgccaaaaaactaagctgggtaccattattttcccactttacagttaatgcaactgaagcccagaaaggtttagtaatcacaagcaaggtcatgcaagtaggaagtgtttaagttaggattggaagcaggcactggttctcagagaccctgctttaacccctgtgcctcctagggtcatgtacaggaggatgtggctcacagagagcatggggggatggctcagtggaggtaaagagaaggctcaggctgagctttggaagacaggtgtctagggaactgggggcagggagcatgctccaggcagagggagccctataagcaaagggtgtggcatggcaagggagggtgccaagaatgagaagggtgctgaagacagcaggggcagggagagaaggaccttcagtgctgccagagaaggatcttctgcaggcaagccataccacctctgtgtctctcatctctccctcatgcaacaggaccctctgtgctcactgtccacccacaaaatttttgtgaacctcaatttgtataacagcatagacaagttctgaaactggtaaagctctatcccagggcaagggattgctggtatgtcttcctccagagccttgactgcagaggtggacacaggcttgcctggcacagtgccgctttgtgtatgttggcctggcatgattatcagcagctcccctttcacttgcaggagggacctagcttggaagatcaactctctggtcaccaggggtatggggaatgaaatgctcacactccaagagcaaagtcatcaaaggaggagggaatgaggaaggagagtgagcaagaaccagggtgcttacaagaggaacggttcttcaggccagaagagtgtcctttttataaattgactggcaagatagcagcaggccaggccaggtcactgtcccttcctttctgaggccacagccgatgctgctgacaagcccccagtgagtttctgtggccccttgggagacacagtgcccttctctgtccctccatgtcatgtcgtttctctcacctacctaccacggtcatgaaactcccacctctgcccatatctaaacctcagacggtttccaccaggtctgccggaagagctcatccagaaggggaaggatatcaagggggtgtcggaaatcgtgcagaatgggaagcacttcaagttcaccatcaccgctgggtccaaagtgatccaaaacgaattcacggtgggggaggaatgtgagctggagacaatgacaggggagaaagtcaaggtaggagggcatcccttctgctgtcagaactttccttggaacctggccctgggacctcattcctcaaggctcaaacctcacaattccacccacagataccatctctgaacccacctcccatgtgggagaagcagagagacaaaggcagctcttagggaagaatcttatagagaagctgctctcctcttcccagggactgtctggggggtgttccagcccctaaagtctgagctctcccatatggaggatatgggagaaccaggcatacagcaggattctaagtctcaggttctcccaggcccagtgctcctagcactaagagtcctctaagcagggcccaggagtggggcaagtgggagtttgtgaaaaacccttaactgagcccaaagtcaactggccttcactgaacctagagctggtggtgatagggagagacttcttgaaggaggtgctagcaataccagaataccagggccccagacaggtgctcagaccctgccttcaggggtggtcacaaagtctctggcttcagccaccccatctgtaaaataagaacagtcaacctccctagactgaaggcagtgcagggcagcatcacttctgctgggcacaactcatggtgtgcaatgacagctggggtgtgggctgtgtgagtggttggcagatggtggcagggggatcctggcaatgggggtgcccgtctcctcctccctctgaaacactccatgctctagcagccctcttctctcctccccgtggacagctctgttcattgggctgggcgtgtttgctttttatctcttctggtcactctttatttctgcctctccaattagaacattacaggtcaggatgattttaggaggataatattcttgatgtgctcatggtcaagggatttaactatgggccttttccaaattttctttttggaggcaaaatgtttaatgttgcccagggtctttggctccctgctgggttcctgtcatctcttccaggatgtataagggcttggaaggaggccacaatatgaaaagttaacgctctgggaagaataatacatacctggttgggcgggtggctcatgcctacaatcccagcactttgggaggctgaagtgaaaggactgtttgagcctaggagttcaagaccagcctgggcaacatagcaagacctcatctcaattaaaaaaaaaaaaaaaagaagaatacataccaaagcaaaatatgtattctctactggtcaatatttgaattttgccactacctccctccattagcttgggagaattgagattttacttgatttgattttagcatttgtatttggggccacttaggtgttccatgctcatttctagatcacatgccatgaattaaagttctgacaaaagaagtcgtgacattttatttagttcttaaatgcacctcacttctatttggagccagagaactagaggcttgggatcataggaaccagagcattttggttgttatgagctgagacctgtgcaaaggaagcaacttcattagcaaggctcttgccccccaccaccccttcctcacaggtcacctctctgttccctgcagacagtggttcagttggaaggtgacaataaactggtgacaactttcaaaaacatcaagtctgtgaccgaactcaacggcgacataatcaccaatgtaagttggtggtgctctgagcgtgtggctcccagtgcttgaggggagaggggaggtgaagcatggggagcggctcacataccctaatgccacccctccaccctccaacccccaaacttctttcctgtggtcagtatctgccagcacttactgaggatccatcatgtcccaggcagtttacacacattatcactaatcctttctgctcagcgcaaccaaccagccacagaggcctccacctgccctgcatgcccagggtgcttcataaatgcctttgcccatttagcgtttataaagagaatcccattcatggtcatattatggcagcttacaagcctggcacagtccagttatgcagtcagccttggtgcctggctgccagccacatcctataccctatttgggggtgaatggtgcagtgtttctcctgcaggtatgtccccctgactcttctttgcccccagaatatgctttagggagtcacagacaacagaacactgcctcagggcgctgtcatcactctattcaaatggaaaaattcttaaactagagagagtgtgagcatcaaccacccaatgtgcagtttccacctccgccccagcacattcccaggagagcaggggagcaggagatgagctgtcctgcagtaagtcctggccaacgccctttgataggttccatctcacctaatcctcctgtctccttcgagggaggctggatgagggattcaatagacaggttgacctgtccaagtcatcagctaataaatgttaaatccagggctcaaacccatcaagcagcaactattgcattgctgctgaaactgaggggctccttttcaccctgatgacatggtatgtcattccagcagtcttattcaagagaactggcaggggtggaggaaacatccttaaaaactcaaaagctgatgcatccactgtttttatatgcttcacagctataggaggacaattatgcactacccactgccttccaggctgtgtgcctagttgtgtccatgtacatgtatccttggtgctcaacatgtatttggtgcatagtaggtactcaatgaaattttgagaaattagattgggctggtttggatggtcttgctataacagtcattgatgtagaaaagaattcagtcaaaggcaggaggactttccaggtgaggaggagaagtgacaaagacttggcataggattttggaaaacattgccaacctttcctccggtcctacaggaaaccagacgaatttttgaattgtttcatatgccaacatatttggtgctgttttttaagcttaattttgttttttatgcttaattttgttttttacaatacaacatcagatgaacacttcataatttcttttctggctttcagaccatgacattgggtgacattgtcttcaagagaatcagcaagagaatttaaacaagtctgcatttcatattattttagtgtgtaaaattaatgtaataaagtgaactttgttttaaaaaaaaatgtcttctcaatgccttttcattgatggtgctattgctcaccatattctcgtaaatatactttcgtaaatgttgataatccacatgatccacactaccaggtcaaatccgaagagtaattccctgaacacaaaacccatgctgcacacccaggtgttctgccaggaaagccaggtgtggctagatctgcaggaaggccctggaatgccctttcccagtcaggcacacgggcaaggagctggagccagaggatgtgcagtgggctggccttgagggtgctctctgtggggacagggagcaggaagactgggcagaaaaggagagctatacccacaagcacagccacagtaccagcccaccagcagacaggtgcagaaaggtcgacactgacccgcccaataaacttttcctcctgtgggaggctgagcaaagggcttagtgagaggcgccagaagtggacagaggaggctcagtggaagttccctccatgctatgggcaggggcagaaggtagaggaaggggaggagtcccttcaacactactttatgccaaactgttaggggttgagttgcattcccccaaaatttatatgttgaagttctagcccccggtatcttgtaatgtgacttcatttggaaataaggtcattgcaaatgaccataggtgggcccctaatccactatgtctggcgtccttataaaagggggaaacttggacacagagacatgcacatggggagtgtccatgtgaagactagagctatgctgccacaaatcaaggaactgttcgaagctgagagagagtcctggaccagatccttccctaactcctccagagggggcatggccctgctgtcaccttgatcttaggttaatggcctccagaattgtgagataatacatttctgttgtttaagcctcccagtttgtggtacaatggcagtcctagcaaattaataacagtactcatacccctcagagctgccatttctaccttcacaagaccgttcggcacccagaactgtaagccttgatgaatgactgaatcattcacattccccctcttctcttcccacttctagagttgaaactattacttgttacttggattgtttcccaggccacctgtagcacctccctgccccactctcacctgcaactctccagcccacaacagcgtcctcctccttaaacaggccaccaaccataatgcatcctacctcattgtccagcacgtaacagtcacactcctaaatctggcatccaagcccctatatcatgggtcagcaaactttttctgtaaagatccagagaatacattttctcagctctgcgggccatttggtctctgtcacaaatacttatttctgccattgcagtgcaaaagcagccacatccaaatggtgtggctgtgttccaacaaaactctaccagcactgaaatttgaatttcatataacttgtacatcataaactattactcttcttttaatttgttccaccatttgaacatgtggaaaccattattagtttgtaccttgtatagaaacaggtggcagccagatttggcctgtgaactgaaaggatgctgactcctacagtcatagcctgtccaacctcttttagcctgtaatatacattctaatcgaactaaacaaccttccactcccctcacaattcaagcaccacctgctgtgagatgtcttcccaaactgctccgctgaaagtgctctctccctctctctgccgttttatctggaccagtctttgcaatgccgttcctcctgcctcgcactattattttctccatatatttgttctccttctctcacctgagacttcttctcagccttgaggaagaaacagatccattatttggagaactaaggcagactgaaggaaacagtttcagtctgcctttagagaatgatattacttcagtaagaagtcagagttgggagttacagggagcaagaaaacaacagcacactatg

SEQ ID NO: 15857 - DNA, 52821 bp, Human
caaaaagaaacatgtaagaatgctcactacggctttgctaataatagtccaaaaaataacaacccaaatgcccgccaacagtggaaaagataaattgtggtataaacatacaacagaatactattcagcaattaaaaggctacacacaacatggatgaatttcacaaaaatactgataaagtaaaaaagccagacacatactgtacatactgtattattatatttaactggaattcaagaacagagaaaactgatctatggtgatacagtcagaagagtgattatctcaatatgtaaggatgtaatactgattgggagggagcactaagtgtgctagaaatgttctatatcttgatttgggtagtggcgacaggggtgtatacctatgtgaaaattgttcccatactgtatgttacacctcattaacaaaaaaaaaacttttttaacatggaaaaaaaattcaagttcaaatgccaccttgtccattaaagttttgccagctgcaatgaaccttttcatcagggcctccttagcattctgatgtcatttctttatgccattttatcacactccatcttgaatctcagtggagtctccttatttccctaaatatatgttcatcttcctggtggcagtgaccatgtccttcaccttttacccactcagtgcctgacaaataacaggctgaaaagatatttgttgaattacatggaagaaaaaattgggtgagttcccagatgggtgaaagtggggacaggcagaggaaggaaggccaagagaaggacagaggaggtttccaaggaaaccgtggctcacactgtaattttacctacttcctgaaatcacattaaatgtcaccttgagtggcaaaaaacaaaacaccaaatcctacctaggctgaaaataaataaatatcacactccctcactcgcaagaaatccaccaaataaatgctacctaattctgggtgtttcaacagtggataggaaaaccgttcaaggagaataattcacattgccatgctgctaaaaatatcacctccttagtgtggtgcaaagagtccagactgcaagtcagccgacttagggctgaattctaactctgcccgaacttgctgtgatctgtggccaatcccttcgcctctctgggcctcaatttcctcatacgtaacaacaggggatagattagcaaagtccctttatgttttgatattctgagtatacaatccatagctctcccggtgcaaaccaggaatacagcaaaaaaccctgaaatacatgtaaaaggcgcctcagaccaacaaacaagcacgatttgaagaagtcattttgttctctttcacggtttaatcagtgtttttgtttgttgtttgcagccttaccatgatttgcagatgtctgagttccatgtaaacagaagttaactctctgcgggctgtcatcttcttttgagggtgagaagggtcttcccgttgggtttcaagtctcgggattccgaaacgaccaactcagcgggcgggtttgtgaatttgcgcacactgcgcggcacactggagtctaagttacagaggaaccgagtgcaggggatgctgggatttgtagtccccgggcctctttgtggtgcgctgggatctgtggtcccccgagtgcgccgctggaatgctgggaaatgtagtctctgtcgcgtcgcacagtgcaactcagctgccgtctcagacggctagtgtgctcagtggctggagcaggtccctaaagcctctgcagatccgaagccaaccctccgctgggacaaactctaggcaacaacaccagatgaatattgtgtcctatgggacttcccggggagggcccttcccattgacgttaacagtccccctgcgaagccgctgcgcgctcctactggctggttgagatgccaatcgccaaggctggctttccattggttccaggagggcactgcgaggctagggggaaggagaagggatcagaagcgggagctgaggggagagagaggccggtcctggtctggccgctgcggctgctagcccgaggtctccaagccgggctgcggctccatcctcggctcctgggcaccgtctgcgaggctccgccgaccagagtgagaaagccgcgggtgcgcgcgattcatgtcagccaaggacgagcgggccagggagatcctgaggggcttcaaactgtatccgtccgggagcggggcgaggccgggaggacttgggaggcggccgctcactgaggagactggccgggggcgggggccgcgccaggtgggccccacagaagaagggccgcgggaggggagaggaaaggaacagcgtgccgagcacccggcgggacccggcgcgagaggcgccccaaggggcgtcctgagggaggaaggggacgttgacgggagcgccggggggtggcgggtggagacgggggagcctgggggacggggctgcgagaggtgccgggcgtcggaaacgctgtcggagaagccggctgggttccgatccccggccgggacccagaggccgggatggggctgcggcccgcggagaagggctgagggggcgcggtgggctgatctcgaagcctagaagcctctttggctataagcctacccggggagcggggaacagtgacttggagcgggcgaccttgtgtgggacaaataccagtgcttttaaaactctctcaggtcccccaccgcaccgcaccgcaccccacccccgtctggtttccacaacttctcttccaaacttgtggcttcttccaggactggagtagttgggggaggtggggaaagagaagtccaagatcgacctcgtcttaacactcttggccttctcaggcattggtcactgcttccccctcagcgcctcagttttctttccagcaagatgaggaccataggcttaggtgtggggtgcctcgcgctgggactcctagccgaggtgtctttgctcgctcctgtcggtgcggttatgcctagctgtggtggagctgtccagcaatggtgtgatgtcgctggggccacggtaggatagagtggggtagagaaatcattgcctcgggcctgttgtggtgccccttttgcatcctctccgtaaggaagctttgtgttttcgtggagtgtgttagtctgtcaccatatgatgcagatgaaaaaatgcaaacttggatattcaaattttccattctcctgccaactttaatctcttcatgcatcctatctgtaatctatagtacgaacgttcttaaattgctccctcagtgaaaaggtagtcaccacttcagggctcctcccttggaggtttagtaaagcactgttttcttggtattctgttgcgttttcacaatgtccatgtcacgcttgcaaatttaattgctttgctataatcagaaaccaagttggtaatacattttagaccacagtgcaaaaaggaagttttggatgtacaagtgagatttttcgaatggaaattgatctatgctttttaaaaaaactaaaggctgtatcacctttgcatactaccatctgtgataaactttcagtactttcatgttttggtttagtagcagcctcttttatagctccatgtgcctttctgtgtttctctccataatggatcaaataggtatatagggatgactgaagtgctggaaaagctatgacatggattttatttttccctcaaataatttatactattaacatctaacaatgtaataatattgctacttaacatgctttgtagacagtaaaccggaaactggagaattgagagatttcagaagcaacgttttcatctgattggaaataccgtattgctgaaaagaagaaaggcctttttaatggcttttgaacaaagcagaaaagtttgagcttctcaccttcagtcttagctcttgaacctgttgagaaagaggataagagacaaatacggaaaagagtttcagaaagcagaatctgtgtcagcccactggaaggaaaagcgaatcaaccgattcagtgatgttagtgcatccagaaacaggcttttgggaaaagcttgacctgagctgattaaatcctgaagcacaagggaagcagccacatcaaaaagttagcatgagagcagtggcgtgctcatcctctggtagcctttactgggcatttgtggagtaagagagaaaagaaaagcaggaatgttaagatatgctactaccttcaggaaaaagtaaaattaatgttttagtaagaaactgactattgtccaccttttattgggtaaatagattttctgaactttctttcagagtatctgtttctgtaagaatagtttatcactgcaaaaagagcaccattatgttctcccaccagcagtgttgatagtactcagttttccacgttgactaggtcagtcttttttatttgccagtttggataacaaatgatacattgttttaattggtattcttctggatccctagatccatgaaaaggtaatgtagcatagtggttaagagctatactggactatgtctctatactgcctgcattggaattccagccctgcgctcctagttgtgtgtccctgagcaactgctttaacctcacctcaattttcttatctgtaagatggggaaaataatagtacctatctcatggggctgtaagagtaaatgagttgatatctaaagcatttagaaaagcacctgatccacagtgagcattatgctttagccagtgttattcttgttattattagagaagttgcacatctcttctatttggccatttctttttcttctgtaaattgtttgttaattttgtttttgcccattttactattgtttatttttcttatttgtagatgttctttacatattgtaatatcaatcctttgcctattatgtattttgcaaatattttctttcaatgtattgtctccttttttgttgaacagaatttttaaattgtcatttcaaatttattttatttcatttgtttgagacggagtcttggtctgttgcccaagttggaatgcagtggcgcaatcttggctcactgcaacctccgcctcccaggttcaagcaattctcctgcctcagcctcctgagtagctgggattacaggtgcatgccaccatgcccagctaatttttgtatttttaatagagatggggtttcaccatgttggccaagctgttctcaaacacctgacctcatgatctgcctgcctctgcctcccaaagtgctgggattacaggcatgagccaccgtgcctggcctcaaatttattaatatttgccatctggcttttgcattttgtatcttgtttaaaaagatctttcttatcccaagattaactaaatatcctatcttttcttctcttttcaatgtttagctctttaatccacctggaacgtatttacacatttggtatgtggtagacatctaagtacttctgctgtttggatagccaatagttccagtactatttactaagtagttagtccatcttttcctcactgttttgaaatgccatccttgtcatatactaaattttcataagacataggtttttttttggattatttctgtttcattgatctatttgtctcttcttgtacctatacacatttgattgaattattatagctttataatatgatttagtatagtttacaatagaatggtctgtgactaacataatatgtgtgtttaaggtccctacaaatatgtgccccttttgttcacatggaagcttgcccatatgcccatagtagatagaaacatgaggacttggctgggcatggtgactcacacctgtaatcccagcactttgggaggcctaggtgggaggattgctcaaggccaggagttcaagaccaacctggccaacatagcgagacccccaactctaaaaaaaaaaaatttaaagatactgcataaaagtgaatactgtatgcataaattaggcatggtctgagtgaattcagtagaagctttgtatttgccatcagttgtttcaaaaacaaaatcttataagattttattcttgtatcaccttcaccccatctcaccctacctctttcagagtatctgtttttgtgagaagagtttatcactacaaaaagagcaccattatgatctcctgccaacagtgttgatagtactcagttttccacgttgactaggtcaatcttttttatttttgccagtttggacaacacattgtttcgatttgtattttcctggatccctagatccatacaaggtaatatagcatagtggttaagagctatactggactgtggcgctatactacctctcaagaaatgcaaggctctcatacacattaagaaccttgcatttctttcttgtttgttaaaagcataacatttcctaattgtaaattaatgttatgaatgaaatgttacttggggaacaatatgattctcctgcaaatattttggatttgattattttaagcagctgacatagagattgatgtttgtaaatcccacgtttcccatttcgttccttcaacaaaggtctgttgggtgactattatgtatagggcactctacacttgaaggatacaaaaatgaataacttacagtcccttctttccagaagcttaaccagctttatgtctgtttagaaggaatatcttcaaaagcaatgcattttttaaaattctatttaattttcctattacaaacgccagccacctagagtgacctttgtaaatattatttaatatagccttctaatgtagctaatgtttaatgtgttttttataaaaatggaattgtaaatatcactttgtaacttactttgttcacttaataatagatttaccatgtttatgatttccaaagatagttactttcagttgctttcactgacagatttgtcacagtactcttttttttttttttttttttttgagacggagtcttgctcttgtcaccccggctggagtgcagtgatgtgatctcaactcactgcaacctctacctccggagttcaagcgattctcctgcctcagcctcccaagtagctgggattacaggcacctgccaccacgcccggctaatttttgtatttttagtagagagggggtttcgccatgttggccaggctggtctcgaactcctgacctcaggcctcccaaagtgctgggattacaggcgtgagccactgcacctagcatttgtcacagtactcttatactagctttctagtatagtctgtatctactgttttgcctatttgaatagctttttcatcaacataaaaatataactttattaaattaacaagaaactgacagacttccataagaatgaattatgcttttatgatttcattatctttaatccatctgaattttctttggtataagatacagagtagtaatgtagcttttttttaatattggcttattgtctccatttatttatttaattcatttatacgtcagatattataatatccagaatataaatggctgcctacaaatcaataggataagcatttaactcaaagtggacaaaggatatgaacaagcagttcctagaagaaaaagcagatgaccaatgaataaatgaggacatgctcaaccttgttaaaataatagactatcttccgggtgcaggggctcatgcctgtaatcccagcactttgggaggccaaggtgggtggattgcttgagcctagaagtttgagaccagcctaggcaacatggcaagaccccgcctctacaaaaaaaaaaaaaaaacacacacaaaaattagccaggtgtggtggtgcatgcttgtggtcccagctactgggaggctgaggtgaggggatcacctgagcctgggaggtggaggtcgcagtgagccaagactgtgccccactgcattccaaccagggtaacagagtgagaccctgtcaataataataataatggactatctcttcccaattaattgacacagatttaaaagattgataatatatatgtatatcctgaaagtggcactgtacgaaaataaaattaaaaattaggccaggcacagtggttcacgcctgtaatcccaacactttgggagaccaaggtgggcagatcacttgaggccaagagtttgagaccagcctgcccaacatagcaaaactccctctctattaaaaatacaaaaaattagccaaacttggtggcacacgcctgtaatcccagctgctcaagaggcagaggcaggacaattgcttgaacccaggaggcagaggttgcagtgagctgagatcacaccactgcactccagcctgggctacagagtgagactctgtctcaaaaaaaataaaaataaaaatttattaaaaaaaaaaaagatgccaggcacagtggctcatgcctgtaatgccagcactttgggaggccaaggtgggcggattacttgaggtcagggattcgaggccagcctggccaacatggtgaaaccccgtctctactaaaaatacaaaaattagctgggcatggtgtggacagctgtaatcccagctattattagggtgcctgaggcagaagaatcacttgaacctgggaggccaaggttgcaatgagccgagattgcaccactgcactccagcctgggtgacagagagagactcagtctcaaaaaaaaaaaaagataatattcagtgttcacaacattgagggaaaggggcactctcatttggtttatgtgtgtgtgtgtagtgtctgtagaaagtaattggtatctatcaaatgtttacacattactgcagtagagtatatagcacagtggttgagagtatgggctcacttccaaggtttagacttactgcctctgctattgtgactctcaacagaacactcagactctgagcctcagcatctgtatctcatattatcagagggttgttttgagaattaaatgaaactgcataaaagatgtttggttcagggcctggcatatagtaatatctgctgccattcattttattaataattactaataataatgacaggccaggtatagtggttcatgcctgtaatcccagctctttgggaggccgaggtgggtggatcacctgagtttgggcattcaagaccagcctggccaacatggtgaaatcccgtctctactaaaaatacaaaattagtcaggcgtagtggtgtgcacctgtaatcccagctactcgggaggctgaggcaggagaattgcttgaacccaggaggtggaggttgcagtgagccgagatcacgccagtgcactccagcctgggtaacagagtgagactccatctcaataataataataataataatgacaatagtgttaatatgattgtaaagctacttatttctctgagatataactaatgccttcattctagttatattttcttactgaaaaactatcgtatttccattttgcctctgaataaatgattcaataagcattgatatatacctcatgtttatcttgtctagaaaatgaatctcattctaatttatggcaggttagcaaaaagagtttgggctcagaaggtttctgaaagcatctttcacttgttttcttacatttcttctcccatagtttggtcctggaatccctgtatcttctttctcatagtaccttaatccttgactttgcttccaatcaaaaaacagttggctttacatcttctatttactcacttagaataaagaataagaatagtagacatattaagaaaagtcgactgtagaacttctcttgaaagtcagtattccctggtacagttgccttggccaaatgttaaaaatgaatttgaggtttattatttcccataatataggttttgtctgacaacccaaagtcttggaaagcaaccagacataccactcataaagcccagtttcatgtagattgtgattggtagcttgtttcctcatgcatggactcttgagagtttgtattgttatcctgaatggattaaatgaatataatgtcctattgattatcttaggattctttttttcttttctgcgacagggtctcattgtcatccaggctggtgctatcatagcttactgcagccttgacctcccaggctcagatgatcctctgcctcaccctcctgagtgcctgggtgcacaggtgtgcaccactatacccagctaattttcgtattttttctttgtagagaaacggtttcactatgttgcccaggctggtcttgaacttctgggctcaagtgatttgcccaccttggcttcccaaagtgctaggattacagacgtgagccaccacgcccggccttacttaggattcttaaacaggcattcctgcttttgttttttggaaggaatttagtgtataattagatatttatagtcttctactgactttctaagtttcttgccagggttgtgtatatggtttataatgaaacattacagtaacttctggagaaatgggacagaacacggtaaaactgtcatggagaattccagttgtatcaccactacatttgataaaggactagcaatggttctgaggcttggaagctctaggttcttactagggttgacctcagttttgcctcccaggcctcacttgtcagcattctgcatccacaaatcctcgtgttatgagaggatttgacttatagacctatccctctctattcctgagctaaagcctagcatcataggaaggaattttaaggccatcttctccagcagcctgactattctaataattgcttgaatgcgtaaaactcaaattgtcaaagttctgagagcagcattcttttttgcttttgacctgcttataattttggagctgggaagaaaagcaaatatatttcttacagtccaatatccacaaagatttcaatggattggactaaagcttactgtttatggcaaagaaggcgatggtctcaccgtaggacacatgaaagcttgtttagtctactgcaaagggaggcaggggaaagtggagctggtataaaggtgggccacttgaaacatggcatacattcaataatgggggaactgaagggagtttaacctaaagatgaaaagagttggacaagagatatgagtattctcttctaaagttaaaaaaaaaaaacaactgttctaaagaggaagaattaaatgttgctgtgtagctctcagaggaagtacaagatttgcggggtagaaattacaggtgacagagtttaggccagtttctaacaattagtagaattacctgaaaaaagacattttccagaaagtgttttaagcagcagatagatgcctgtctgtcaagagtgttgcagagggaaattttgtatgtatcaaatgtgtattacagtagatgatctacagaaatactcaaatccttttccagcactacaattctttgatttggtgacagcctttcttacttaacaagtactttttttggcaaatgtttatattgagatatgttctacacctaaaatcggcaaaaagtttttttgtgacccaattgtttcctttttgtttctgacacaactctgagacactcagtattgaagtgtttggtttagtgcattgtggatacaactgattcagagtcaaggagagcaattattgcctctgaatttagataacatttagagaatgaaacataaatagctgtaatataaattagcactgtaaatatagccacaagaagaaacagcatggtctagtaatatctcataattctatactgcttttcggtttttaaagaactttgatatattactgcattatcacaacaaccctattcattgttatcctcactttatagactaaggaattgaggatcgacgaggcagtcacttagacgaaggcagaaccttaatttaagccttgttttgtctttttaaaagtccatgttttctacagtataccatgatgcctctctggagaatttattcttttgttgttgtattattaattttgagttttaaatttttctcagcttggctgagcaaggtggctcacgcctgtaatcccagcactttgggaggcctaagtgggcagatcacttgaggtcaggagttcgagaccagcctggccaacacgccaaaccccacagaagctatttgggaggctgaggcacaagaatcgcttgaacccgggaggcagaggttgctcaaaaaaaaaaaaaaatttctcagctcactgcagccttaacctcccaggctcaagtgatcctcccacctcagcctctcagataactgggactacaggtgcacaccatcatgcttggctaatttttgtgggtttttttttttttgaaatgaagtctcactcttgtcacccaggctggagtgcaatggcgcgatctcaactcactgcaacctctgcctcccaggttcaagcaattctcctgcctcagtctcccgagcagctgggattacaggcgcctgccaccacacccagctaatttttgtatttttagtagagacagggtttcaccacgttggccagacccgtctcaaactcctgacctcaggtgatccattcacctcagcttcccaaagtgctgggattacaggtgtgagccaccatacccggccaatttttgttatttttttagagaccagattttgccatgttgcccaggctggtcttgaactcttgggctcaagtgatctgactgccttggcctccccaagtgctggaattaacagacatgagccaccatgcccagcccttgtctcagtgtttaagtcacagccagatttatttttcacttgaaaattatcctcttctaatgtggtcatatctcctatattcttttttttccctcaattcaccagatacaggggccagggtttagcccaggataatgaattttttaacaattagagttaccagaggaaaaaaagacattttccagaaaatacttaagcagcaggtggatatattcttgttttcatatttttttcatcttaagcacagtcctcttaaacattgtcctctgtagtcaagagatggctactcataggggtctgattagcaacttcagtgatgatcaaacataggaggttgttactcaagtctgataagcacaagattgtgtccatatagttttgtccaataaagtaacacaaaatttatcccacaacgaagttgttttcagatgagcaattcagataatctcgttaatagggaaaaaaaggtgaaaaagtcttggatactagcatggataaacaaacatgtcctggctttgttcagaatacacaaggctaccttgtgaccagcttatttcagtttcattttgaaaccttttccttaaatgtctatgaaaaatatcaggtgaaagtatattgtgggtagcttatagaaccaactcgagggttcctgttacagagtgttattatgcatttagagtttgtttcaaaggccccttaagtatttatggattgagataagaatctaacagactatttccttttctgtgattctctgttaaaaaatgtggtcccatctgtggtctcagctattcaggaggctgaggcaggaggatcacttgagctcaggaattcgaggctacagtgagctatgattgtgcctcttcattccagcctgggcaacagagcaagaccccatctctagaaactgtgtgtttgtgtgtgtctgtgtgcatgtgtgtgtatatgtatatctgtgtgtgtatgtgtatatatatatatacatatctctgtgtgtgtgtgagagagagagagagagagagcaaattgtaggatagtcataattatgccatgtgtggcactgctacctaggtgactactctgtgtgaaaagtatggttttcaccaggtcactgctaaagattaagaaaaagggactaaatctgagattcagcattttcatgaaataggaagtgagaaatgtaactgtaagccttaattgcttttgagccatcttctgcctaaggagcaaagacaaaggaaccagaaaagctgcgttctggtcatagtgctgccactcactggccattcattcagacatttgttaacagaatctgtacgtggcatatcatctgctaaaccaaagagaaagaaaatgataaagcaggccaggcatggtggctcacgcctgtaatcccaacattttgggaggccaaggtgggcggatcacatgaggtcaggagttcgagaccagcctgaccagtatgatgaaaccccgtcaccactaaaaataccaaaatgagccgggcgtggtagcgtgtgcctgtaatcccagctactcgggaggctgagacaggagaatcgcttaaacccaggaggcggaggttgcagtgaggtgagatcgtgccattgcactccagcctgggcaacaagagcgaaactcccgctcaaaaaaaagaaaatgataaaccagtttccatgaccaaataacttgtattatataagggagagagaaagagaccataacaatcagaatgcaatgtgttacatgccgagtagtatcaagtactgtggaaactcagagaaagggtgactcctactaggggtgttgtgggagacttcaagaattatcacttgaggtcgggcgcggtggctcacgcccgtaatcccagaactttgggaggctgaggcgggtggatcacttgaagtcaggagttggagaccagcctggcccatggtttcaacatggtgaaaccctgtctctactaaaaatacaaaaattagctgggcgtggtggtgcatgcttgtaatcccagcaactcaagaggctgaggcaggagaatcgcctgaacctgggtggaggttgcagtgagccaagatcacgccaccgcactccagcatgtacgacagagggagactccatctcaacaacaacaacaacaaaaggattatcacttgaataggatcttaaaagatgaggtgttacccagtttaatctttatgacagtagggagtaacagaggaaggaaagtgtttcaagagtgagttggagtcaggaatgaggaaggatgaggaccaaacaaattcttggaattctttgaaattttattcattaatgatatttaagaatcagctgagagtcccatgataccttataggtcattgtgatctttttaagaataatagatagtggcagatacagtggctcacacctgtaatcccaacactttgggaggctaaggtgtatggatcccttgagctcaggagtttgagaccagcctgggaacatggtgaaaccctgcctctaccaaaaatacaaaaattagccaggcatggtagtgtgtgcctgtagtcccagctactcgggaggctgaggtaggagtatcacttgagcccaggaggcagagattgcagtgagccaagattgtgccactggctactgcactccactctgggccacagagcaagaacttgtctggaaaaaaaaaaaaaaaagaatagttaaagaaacaaagtataatctttcaagattagaaaatgaatacatgaggaaataaagtcagaaataatagattactctttcaagaaatctggtggcctaagaaagcagatattaggggagcagcttgagtgggtagatagaattcattaaataatggaaatcacttatttaagctgactttgtacaagtcacttaatatctgtaaaacaaggataaagtggttgggtgcggtggctcacaccgtaatcccagcactttgggaggccaaggcgggcagatcacaaggtcaggagattgagaccatcctggctaactcggtgaaaccctgtctgtgctaaaaacacaaaaaattagccaggcgtggtggcgggcgcctgtagtcccagctactcaggaagctgaggcaagagaagggcatgaacctgggaggcagagcttgcagtgagccaagatcgcaccactgcactccagccttggcaacggagactctgtctcaaaaaaaaaaaacaaggataatgcatgctgtttgatggagatgttatgaaatttgaacgaaataatacatgccaactcaatttaaaaaccatagctcttcaaatgcactatgcttgctattacattattacaatcattatttacctttgctttaaagtaggatatcagaaaagtcagagccttagtgattgttttttactttagcttcgatacctgtgagccttttttcacatttctgggaattaattgtggctcttggagtgacaacagaagaaacccccagatgacactgaaaaaccagaatcatctttgacttagctttttttttttttttttttttttttgagacggagtctcgctctgtcacccaggctggagtgcagtggcgtgatctcagctccctgcaacctccgcctcccggattccagccatcccgagtagcctcagcctcccgagtagctgggattacaggcatgcactaccatgcccaactgatttttgtatttttagtagagacagggtttcagttggccagactggtctcaaactccccctgacctcagatgatccacccttctcagccttccaaagtactgggataataggcatgagccaccatgccccgccagctttcatttttttaagagttataatttgaaggagttgagtttcttcccaatactatagcattttttaaaaactgggtgaaattcaggaatctgaatgtagattttgacaggattcaaggcaatatccctgtgcctccaaataacctgaaagaaacagtggcccttttgggaacatgcccttgggaaaaggccttgtattatttcttcctcagtcaggaggtgctgggaagcaaataaaagtgcaaagggagcctctaagaatctctttggatatgtctcttctagcttgtttctgaccagttccaggcacataactgtacatgtcagtaggataatgggctgactagaaaaaagaaaggtttgcgttattgtttgactttgctagggagaagactgtgttatgtttcaaatactgatctttttctcattactaaattacttgcctccactgtttcccaggccagtttgaattttgattgtatactttccaagcatagtaactttgccagcacaagagtattatttcacggggatatcaccactgattacaatgctgcatattatgtttcaaggatactgaaacctgggttctcagagatccatttatattttctcatcttatcccccataaatgggaaaatcactgggaaattattgggtggagaaatgcatttaaatgaccgtgaattagaattggtccttaagaaggaactaaaggcagaatgctctgtataaccaacactaaggcagaagcataagagggctctgacataagtggtatttaagaattaatgaagaaagtgggagtaagagaaggaaatgagttcagaaaggaaacaaggaggagagagtttgagaggggagagatcataaaggcaaagtgtgaaaagatagagaacaggaagaaaaaagccacaaccaaaaactatgaaaacagagtaaagacagacagccctgtaatgaaaatgctcaggataccaccaaatagaaactccctttgtttactgctagtcattgcagctgcttccaccccaaagtaatgagaagggagaggtttttctttatgcctgtgaccttggttttgaagctttgcctcatagtgctctggtctgccatagtagacattagcatatatcattatatgcttagtcagccattttgcctgaaaaatatacttacctggaaattactcagagccacatgcccatatataatttatgagtactctgtcaagtcatgaattcaaacttaatgcagaatgggcttttaaattctaatatattgttacttgcaattcagctgactgacttaggtgttgtccttagggagagtggaggttttttggttcgttggtgggttggtttttgctttttttttctttctgagttccaggtttaagttgcccccctcccacttttttattttttattttttttgagataggatcttgctttgccacccaggctgaagtgcagtggtaagatcctggctcattgcagccttgaaatcctgggctcaagcagtcctcctgcctcagctttctgagtagctgggactataggcacgcaccactgtatggctaatttgtctttttttttttttttcccttccgtggagatggaatctcactgtgttgcccaggctggtcttggattcctgggctcaagcagtcttcctgctttggcctcccaaagtgttggtattacagacatgtgccactgcacccagcctgaattgccctttttacagtccactggaccctgaaagcatcgcttgtggttgctcagcctgaagagaattctaatgaactctccctctattgcttagtgtgattcaacacatatttgagtgtcagttacatgctgagcactgagaagagaaagataaataatatagtgtcagtagaatttgacttgcaaactaatatattcatggtactctccgataagtactgtgacacaggtataaacaagtggccaggataggaggtgatgctgtaacaaacaacactttggagaatggaatgtatggcagagactggactcagtgtcttcctccagtaagccttgatttgccatcttgacttcttcacctgaggcatatagcaatttgttacacatgctggcctcctggttgcctgttgatttcctgttctttatcaaactatcctttctgttgacagcctttcttatctcacccttctctgttgtccttttaacctattaatagctcattagaaaaaaattaatattccccataactatttacaaagcctaaactttctgtgttcctcagaaatgtgtatgaggatggaaggagtttttgttgtttttggagacagggtctcactctgttgcccaggctgtagtgcagtggtgcaatcttgccctcagcctcccaagtagctgggattaaaggcacacaccaccacatgtagctaatttgttgttgttgttgagacacagtctcactatattgcccaagctggtatcaaactcctgggttcaagtgatcctcctaccttggcctcccaaagtgctgggattacaagcttgagccactacatctggcaagattttttattgaacactcacacaagactagactaagaccttgtcaagagcaaaagtcttatcttattcttcctgtttcctagaacaatgctgcttaaactatggctggcaaaagaatcggggttttacttctaatccttcatagaccaatatttttgtaaaatacagtgagattaattattagaaaaataacataaagccaggcctggtggctcaagcttgtaatcccagcactttgggaggccagagtgggaggatcacttgagcccaggaattcaagaccggcctgagcaacatagactctgtctcaacagcaacaacaaaaattaaaaattatccaggcatggtggcacatgcctgtagtcccagctactcaggaggctgaagcaggaagatcacttgaacccaaaaatttggggttacagtgagctgtaatcataccactacaccccagcctgggcaacagagtgagaccctgtctctaaaaaaaaaaaaaagaaaaaaaaagtttttaaagaaaaatgacataaaagtttttttaaattattattgaaatcaacaaataaattattctgctgtattgttattaaaaattttaaacacatgtcacaggctggtagcaaatggattcacagaccaggaccagtctgtgggccacattctgagtggtacagctgtggaatccccaatatttgcacctgatacacagtacctcaatacatgtttgtgcagtaaatacatgaatgagacgattggaatgattatagtagtaggcaaggaaaaaaggagaatagaggctctctttggagaattggagggaaatgattaagtgagaaactcaagatgactgcaataatgctaccctccatgtaaaacaaactttttgtcatcattcactctgaatactgttcctttggctctctagcaagacagataaatactaataaatactctctctgaatttctgcaaaatatagttttgatcttgctgaatatgtagaacttgctctaaatgactgcacaaagatgtcaacctatttatttaaacttgctctcatgagcagatctatagtagctaggattgatttcaaatattaacaactgctcttagaaccagtgcatttttccatgttgcaatatggagcataccaccaaatgctttctctggctgcaattttcttttcttttcttttttttttagtagagatggggtctcactatgttgcccagtctggtcttgaactcctgggctcagctgatcctcccggcttggcctcccaaagttctgggattacaggtgtgagccactgcacctaagatctctgtctgagattttcttgtttcctctgtgtcctctcaaaagattagctgaatagggtaagaaatatttttatgaaaaactttgaaacaaacaagccttctacgtccattaagataattttgcgttgcttacagcactacaagtcttcagttcttaaaaccaaattgttaggccaggcacggtggctcacacctgtaatcccagcactttgagagggcgaggcaggaggatcacttgaggtcaggagtttgagaccagcctggccaacagggtgaaaccttgtccttactaaaaatacaaacattagctgggcatggtggtgcccacctgtaatcccagctactcgggaggctgaggcaggagaatcacttgaacccaggaggcagaggttgcagtgagctgagatcgcactactgcactccagcctggtcgacagagcaagactgtgtctaaaaaaaaaaaaaaaaaaaaaaaagcgttagtccttgaatccacttcagatttaaaaaaaaaaatagtttcattcaagggatagaaaagaggaggtctactttttaatagccacacacatagctatactcaatggagatcattattttgaaatatttaagctcacaatatttaagtgcaacttacaacagggaagttttgttatcataaatggaattttgttttcaatgtggatcagtacaaattcaataactcaatacatcatcttccttctctactaagcatatccccaagagaacattgttaggaagggcaaaagggccatttccatggtatatttgaggaagtctgcttgcctttctcaccctgtcatcagttccctcagctcttctagccctggaggaatgtcgtcacaaagatacccaggaccctgcagttccctggagcctttctgttcccaagggtatgtagtgtgaacagacctctgtctgaatgttagctctgttatttaccagctgtgagttcctgagaaagatatttgactgctgggagcaccagtattttatgtgggtatgagtattaaataagactgaaaaataaaaaagagggactgttagcacagcacgtgacatatatgttgaaagtaggtactcaaatattagctcttttaccctgactcttgtttctttgaggactacctttaaactatgaatatagctagatgccagataaggctagaaatattgttcaccttttccctggcctcatgctgtctgcagttaagttaaacaagactgttagaaagctagccctgagaaatgcaaaaatagttaagactttatctgtctgcattgataatgaaccacaggttaagaattattgattcataggccaggcctggtggctcacgcctgtaatcccagcactttgggaggccaaggcaggcggatcacgaggtcaggagattgagaccatcctggctaacatggtgaaaccccatctctactaaaaatacaaaaaaattagccgggcgtggtggcaggcaccttgtagtcccagctactcgggaggctgaggcaggagaatggcgtgaacctgggaagcggagcttgcagtgagccgagattgcgccactgcagtccaacctgggcgacagagtgagactacatctcaaaaaaaaaaaaagaattattgatttatagccattgttgggccaatacaatcaatgggatttccgtttagcctttggagattttatagaaatggtctcagaagagagaccacaaccttagtcttagactcatttctgttgtctccattctaatgtattcatggaccaagttatcaggcaacacgctagtacttgaatatggaagagatcatccactcaactggtattagatctgttacctggacattgttagggctttatcacctttatatagactgatgtggttcagtaatttctggagagcttggctgagctagaaaatagtgtcactagccttgcagcgtgtcctttttataaatctgccttttacccattaaggttatataaaacttaaaaatcaagggctccaaaagtatatgggttttgacctgtggaatacactagcagcataatctgatctggcatcttgtatcctgtagcatttggaaatgtctttctaatctcatgtgctagaggaactacttgtcttgtaccatgagtttagggatcatgagttattcatcttatatccctcagtctctccctggtacaaactgggtatgcaggatagctgggggtgtcatataaagttaaaaatcacagatgttagaatcaggcagtcaaaaaccaacttgaccacttaactggctttgtgaccttttagcaatgaaatgaagcaaaaacttaccatcctcaaacctgtacagattcctcatccatgtaagagctataataataatgcctatttcatagggttatgtggattaatttatacatgaataatatctaaattattagcatactatctagtactcagtacatcttagccatcatcattatatagtaaatagatactgaatgtgaagactgtatacatttctgccaaagtttcatatacctaagcgatgtgtaacacaaatcatgtgacaacagaattctttccatatcttggtaaagtcttccccttactttcttctattgatttaaacagaaatttacttggatgtgacccatttgataaggaccagctgataaagtataccagctgattcaaataattgctccagctaatttacatgaaggttttcctattttattgtttttagaaattattttggaggtataaaagtctggtagtgacttatgaatatctttacattaaatgtttaccttattgttctaaaaaatactaaacatttctcatttctatgggaaagccctcaggagaaaaacacttttttccctgttttgggggctatgtctctagcctgcctggaagtttagaaattcccagaaggatattgccaagaagccgcaaagggatgccatgtttgagtttcttgccattcttactgcttataaagagaagcatttgggcagtagttcactgtttgttgttagttcctaaagcactgccacgggagacttatactcctggggtctcttcatgtccccaagagggagttgatggaagatggttattaatctataccaacttcagtttattagcttttctgcttcccaaacatgtttttggcagagaaatagattccacagatccctttatagtgcttctctatccctttccagcactgtagccaagggtttattttttccataacaattttttagacatttgatctttttctctcactgcctgctcctcttctcccccatgcttgcttgccttcctttgtacacacgaataataagctccaatggctgtttttccccctgaaaaatgtgttattccaaacctttccaatctctaaaatcttatttcctagaaatacctttttcctttttttcctctttaaaattgctttatttatttattttgagacagggtctcactttgtcgcccaggctggagtgcaatggcatgaacacagctcactgcagccttgacatctgggctaaagcaatcctcccacctcggtttcccaagtagctgggactacaggcatgtgccatcacgcctggctaattttttttttttaatagagatgctgtctccctatgttacccaggctggtgtcgaactcctggcctcaagcagtcttcctgcctcagcctcccaaagtgctgggactacaagcgtgagccaccatgcctggcctagaaatgtcttttaattcccagcctcaaccctttgttcatccactgtggaccaccccttcctgtctggtggtatagagtatgggctttagtggctataatttttttcttttcactctttatgagagttttctttcctggtaccctaaagctactcaaagtatggtccctggggcagtagcattggcatcatcagggagctagttagaaatgcaaaatctcagatcccaccccaatctactgaaccagaatctgtattttaacaagatctccagatgactggtatgcatatgaaaatttaagaaatccctgttgtaaatcaccttttgctcaagggtcagggattaggagacactttgtcaagtcatggttccccaccctggcttcagtggaatgacttggggaactgtgaaaaatactgatgcctgggttccacctccagagattctaattggtctgaaaggtcaggtccaggaatcaggagttttagaagttccccaagtgattctaataggcagccaaggctgagaagcactgttgtacatgattcttataatttgccctagcttcttagaacacaaggtatatataagttgatgtggccagatgcagtggcttatgcctgtaatcccagcactttgggaggccaaggtaagggcatcactcgagcccaggagtttgagccagcctgggcaacatagtgagaccttgtctctacaaaaaaaaacaaaaaaaaaattagctgggggtgcctgtaatcctagctactcaggagtccaagccaggagaatcccttgagcccaacagtttgaagctgcagtaagccatgtgcaccactgcactatctatctacctatctgtctgtctatctaagatgccgttttagacagacagacagacaggtaggtaggtagatatataggcaaagctaatgactaaaaaaaacttttacaattacatttattggggagaagtatatgtgcatcaaaaattagaaatatatacatcaaaatattaaacccagtaatctgtgggttataagattacagttatttcttttttgtcctttgttttcttttttttttaaggggccatgctcatcttctctgtatcattccaattttagtatatgtgctgccgaagcaagcactgtcctctattttccaaactttctgtaacagccattcctttggtaaaggaaatatatgtgtaaatataatttttaataactgtgatcacattatacatgttttgtaaactgctttttaattaaaaaatactcttcctgttcacatatcaatacattatgaacattttctcattatcattaaacattattagataggcttttatattgtttaaagtgaatcctgacccaggataactgaatttttaccttaattttatttacatactgatatggggatttaagaaattgactgtttagccgagcgcagtggctcccgcctgtaaccccagtactttgggaggctgaggtgggcagatcacctgaggtcaggagactagcctggccaacatggtgaaaccctgtctctactaaaaatacaacaattagctgggcgtggtcgcacgctcctataatcccacctactggggaggctgaggcaggagaattgcttgaacctgggaggcggaggttgcagtgagccgagatcgtgccattgcactccagcctgggcaacaagagcaaaactcatctaaagaaaaaaaataaatcgtttaatacttgaaacttttagtgtttggaaattgtcctggtccacaggaggggacatgtttaaaaggagatgtctgttgggaggctgaggcaggcaagttgcttgagcccaggagttcgaaaccagcctgggcaacatggcaaaaccctgtctctactaaatatataaaaaattagccaggtgtggtggcacacacctgtagccccacatactcaggaggctgaggtgggaggatcacctgagcccaggaagttgaggctgcagtgagctgtgatcgtaccactgcactccagcctgggcaacaggagtgagaacctgtctcaaaaaaagaaaagatatctggaagcgaggttagattagcccttctctaaggcttttacaacaatagtcaattgaatactatcttttttttttttttgagcacttaaacctaacacatagagcttgacttcactttctcagaagatgcttcaccacagggaattcttaatgatgtttggattgcaacctgtggctggagttatatttctaaactttctctttgaatctttggtttagggccaggtgtggtggctcatgcctataatctcaacactttgggaggccaaggtaggtggaacacttgaggccaggagatagagatcagcctagaacaacagagagagaccctgtctctcaaaaaaaaaaaaaaaaaaagccaggtttagtagtttgcacccatagtcctagctacccaagaagctgaggtgggaagaattgctggcacccaggagttcaaggctgcagtgagcttcagttgtgccattgcactccagcctaggcgacggagtgagaccctgtctttaacaaataaataaaccattgatttggttggaattgtgcttcaggacaaccaatatctcttacagtttgagtttcctctgcattaatatgtacattatgatgtggaaagctggaaaatccttagagcaacatcttgaaaacttcaatggtatatgatggccaagctatgttgtaatcaaagtcgaatatgtcttcttgcccaaacctttgggaataaataccactccaacaacttcaacaaaagaaatggtctgcccccaaaacttctgttcttgccccagtctgcttgcattataggggaagagagtaattttgctaatggtctctttacaatgaaaagaaaagagaaatgttctgtaattagggaacttttataaagatgcacagtggattattctgcaagagaaaagctctgtcatcacatttttacctcttttaaccatttctctaccagaatctgtacataaaagtttcagaagtgcacagtttttattttcagagaaataggctttatatatataattttttttttttgagatggagttttgctcttgtcacccaggctggagtgcaatggcacgatctcagctcactgcaacctctgcctccgaagttcaagtggttctcctgcctcagcctcctaagtagctgggattacgggcatgcgccaccacacccagctaattttgtatttttagtagagacggggtttctccatgttggtcaggctggtctggaactcctgacctcagttgatccgcccgcctcagcctcccaaagtgctgggattacaggcatgagccaccgtgcccagccaactttttttttagagatcttgtgtggtaggaaaataaatattgggcatcatgcctggctaacttttgtattttcatagagacagggtttcaccatgttgaccaggctgatcttgaactcctgacctcaagtgatcccgcccacctctgcctcccaaagtgctgggattacaggctcggcgtgaatcactttcataagcaatcagcttccccagaattgggagcctatgactgaaatcagaattgtcatcggtttgagcactttggtgcttatagaagtgcttaagacttagtttttctgggtctttttacaagtaagttgttctttatttcattatgaaaaaaagcactgtaattttaaaaatttatagtagagatatctgtcatttcgggctgctgtaacaaagtgccaaagactgggtggtttatatacaacagaaacatttctcatagctctggaggttggaagtctgagatcagcgtaccagcatgttcaggttttggtgagagccttcttccaggttgcagactactgttttctcgtatccttatgtggttcaaagagaggagaaagctctctagggtcccttttgtaggtcactgatcccattcatgaagattccaccctcatggcctcatcacctcccaaagcccacctcctaataccatcacattgggggttaggatttcaatgtatgaatttggaggggacataaacatttagttcattgtaagaaataagggtaaaatttagtctttggaagagaggataagaaaggtgatagcagagcaagaagaagattatccttttatcgttgctctgtaaccttggccagggcacttaaccagtctactttattacctttctcttagtctcatcacacaatgagaaactgccattctttggaataagttttgctgcatggcattaatggcattctcatacaaaaaaaaaaaagacaaaagaaggctgggcgtggtggctcacacctgtaatgccagcactttgggaggctgaggcaggtggatcatttgaggtcaggagttcaagaccagcctggccaacattgtgaaaccctgtctctactaaaaataccaaaaaaaaaaaaaaaaaaattagccaggcatggtggtgggcgcctgtaaccccagctactcaggaggctgaggcaggataatcacttgaacttgggaggtggaggttgcagtgagctgagatcgcaccactgcactccagcctgggcaacagagggagactccgtctcaaaaaaaaaaaaaaaaagacaaaagccattttcttctcacagcaatggaagtgaagactattgagatgatttgttttagagagattctcttggggtgatatggctggctttactctgcagttggtacatggtatggtacatctggggcacttgtagccagcctctgataacaataattgctgtctttgttactcccattttcctctgtcatggttacctccacagggatcctctaagttagggagaggtttattcctccctcctttatcatctttgtctgatgtggtcctatggtcatcataacacttaattgggtccctgaaaggccactcaactcttttgatgttgctgatgtttgaagtcttatgagaagcttcagacaagagtgtgcaagctcaccagagtgcatagaggggcatatgtgcatagtatattcactgtgcctggatgagaatgggtgtaggaaggagtgtaaaacagaaagggaagccagagagatctttgagccacaatgtaaactttcaatactaagctaagaagttagcacttttctctgaacagtgaaaacctattgaaggtttttgaagaggaggtaatgatatgatccagtttgtattttaggactggcactctggtcacaatgtattagattgtaaaagccagactagaggggttttttacattttttatttgttatttaatttatttccatgcaaaagctcatctatgtgaaagctagtggctttttatatttttatcttttattatttatttatttttatttgtttgtttatttatttttatttatttattttattttttttgagacagggtcttgctctgtcgcccaggctggactgcagtggcacgatctcggctcactgcaagctccgcctcccaggttcacgccattctcccgcctcaccctccggagtagctgggactacaggcgcgtgccgccacgcccagctatgttttttgttttttgttttttggggttttttttgtattttttagtacagacggggtttcactgtgttagccaggatggtcttgatctcctgacctcgtgatccgcccacttcgacctcccaaagtgccgggattacaggcgtgagccaccgctcccggccgaaacagcatttttaacaaggtcatggaaccaccctttgagaaacaatggaccagagactggaggagaaaaatgagttgggaggctgttggaccagtaatataaaagagaaggccgggtgcggtggctcactcctgtaatcccagcactttgggaggccgaggcgggcggatcacgaggtcagaagattgagaccatcctggctaacacggtgaaaccccgtctctactaaaaatacaaaaaattagccgggcgtggtggcgggcgcctgtagtcccagctactcgagatgctgaggcaggagaacgggtgaactgggaggcgaagcttgcagtgagctgagattgcgccactgcactccagcctgggcgacagagtgagactccgtctcaaaaaaaaaaaaaaaaaaaactcaaatctctcaaatataatttctgctctgtatatatctatctaatatttaatatatatataatacaagtataaaagtagaattaggccttatctctaaaacaaaagaggatgagcaaagagatgaagattaatatatgagcagcacaaaagattgcagcaggttttccaggaattacaaggttttgagtgaataaaactcaagtcaaacattaattaatacaaataagctttcagttgtgttttcctttttgaagattttagagaaagaataagataataatatatgcttttattagagaatttgaagttgttcataaaaagtcacttccataatgtgcctccttcaatcctgaagaattatggcataataatgtcctacacttgcttatatcgtgttttataatctctaaaccatttttgtaggcatttcatataatcctggaacaactgtaaggccttcatattatctgttgtttacaaattaaatctcaggcaggttaaatgactgatctaagatcacagctgctacgtgatagaacttggactccacagcaggtgttctgctctaaaccaactgtattttcccctctctcagcttttccttctgactataaactaacataccctgtggtttctgtcttaccccataactcaaatgaattcctgagacatgtaagcatctcaaataaatatttctaagcagatttcttagtgttaaaatactttcatcttggtgataaaaatttaggtatcagagcacagtcatttgattaaaaaaagctggactgatataaatgattgaataaaacaaatggggagaagagataaatctccagtgtataattccaagtaattcatatagttatttatccctcaaggaagtagagcataattcaccaccccttaagttgtgccagatttagtaactcccttccaaaggggacagtgtagaaaggagaggaaaagagtaacttcacaatggaagaaactgacagagtaccctcaaccaggtgatgaaggttaacatcagcatcgatcggtcatgttgatagcatgtatccttgatattgatgtgataaaaatgatactatctctgtggtcttcctcccaaaaaacccataactccagtctaataataagaaaaacattaaataccagtttatggatatcctacaaaatacctgaccagttctcctcaaaactgtcaaggtcatcaaaaacaaggaaagtctgagaatctctcacatccaagaggagcaataacatcaatattggttccttagttgtgacaaatgtaagatgttaataatagagtaaactgggtgtgcaataaatgagaactctactattttgcaacttttctataaatctgaaactgttcttggctgggcatagtgctcacgcctgtaatctcagtactttgggaagccaaggtgggaggatcacttgagaccagcctggacaacatagtaaggccccatctctataaaaaatgtttttaaaaaattagccacacgaggtggtaagtgcctatagtccagctactcaggaggctgaagtgggaggatcaattgagcctggaagctcaaggctgcaatgagcagtgattgcaacactgcagtccagcctgggcaatgaagcaagaccctgtctcaaaaaaaagaaaaaaactattctaaaataaatgtttatttttaaaaaaaaaagactagaatagaataacacctgataaaacaatttatttcttggtgaattgatatgaattgaaatgttttagattttccatccctagattggtaatgaggatttgggataatatcattagaggattatctcagtatcattaagaagtgtcaacttgcatatgagctattttgaaggagatgagtgaataagttatttggttctaactagaaggaacccataaaattatgagaataatgtccatatacaaggtaaccctgaatataatgcattctgtcatctttgcagtgaaaaaatatttttaaaaagtgatgtgaggccaggcatggtggctcactcctgtaattccagcactttggaagaccaaggtgggcagatcacttgagctcaggagttcgagaccagcctggccaacacagtgaaacccagtctatactaaaaaaaaaaaaaaaaaaaaaaaaaaattagatgagcatggtggcacacacctgtaatccctgctacttgggaggctgaggcagtagaatctctcgaacccgggaggaggttgcagtgagctgagatcgcactccagcctgggcaacaaagcgagtgagtgaaacagagtgagtgagactctgtctaaaaaaaaaaaaaaaaaaaagtgatatggatgaaatagacatatattttcacatatataactaagaccataaattttatcaaataatatatgaatttaaagatattgtccccctctataccacctgtcattttaaatgaaacatattgcccaaattttttagatgcaactttgacattaataccggtacatagtaggttgtattagtttgttttaacactgctgataaagacacacctgaaacgggggaaaaaggtttaattggacttacagttccacatggctggggtgacctcacaatcatggcgggaggcgaaaggctcttacatgacagcagcaagagaaaatgaggaagaagcaaaagcagaaacccctgataatcccatcaaatctcgtgagacttatcacaagaatagcacgagaatgaccagcccccatgattcaattacctcccccctaaatccctcccacaacacttgggaattctgggagatacaattcaagttgagattttggtggggacatagccaaaccatatcattctgccctggcctctccaaatctcgtgtcctcacacttcaaaaccagtcatgcctttccaacaatcccccaaagtcttaactcatttcaacattaacccaaaactccacagtccaaagtctcatctgaggcctggcacggtagctcacgcctgtaatcccagcactttgagaggccaaggcagctggatcacctgaggtcaggagttcaagaccagcctgcccaatatggcaaaaccccatctttactaaaaaatacaaaaaactagtcgggcatggtggcaagtgcctgtaatctcagctacttgagaggctgaggcagaagaatcacttgaacccgggaggcagagattgcagtgagctgagatcacaccactgcactccagcctgaacagagtgagactccatctcaaaaaaaataaaacagagtgagactccatctcaaaaaaaaaaaaaaaaaagtctcatctgagactttgccttgccttggcaagtcccatccgcctatgagcctgtaaaatcaaaagcaaactagttatttcctagatacggtgggggtacacgtattgagtaaatacagccattccaaatgggagaaattggccaaaacaaaggggttacagggcccatgcaagtccaaaatccagcggagcagtcaaattttaaggctccaaaatgagctcctttgactccaggtctcacaaacaggtcacggtgatgcaagaggcgggttctcatggtcttgggcagctccgcctctgtggctttgcagggtacagcctccctcctgcctgctttcaccagctggcgttaagtgtctgcggcttttccaggtgcacggtgcaagttggtggatctaccattctagggtctggaggagagtggacctcttctcgcagctccactaggcagtgccccagtagggactctgtgtgggggctccaaccccacatttcccttacttactgccctagctgaggcgctttatgagggccctgcctctgtagcaaacttttgtctgggcatccaggcatttccatacatctaaactccaggcggaggttcccaaacctcaattcttgacttctgtgcacccgcatgctcaacaccacatggaagctgctaaggcttgggtcctccaccctctgaagccacagcccgagctgtacattggccccttttagccacggctggagcagctgggacatggcaccaagtggctgcacacagcatggggaacctgggcccagcccgtgaaaccactttttcctcctgggcctctgggtccttgatgggaggggctgcagggaagttctctgatgtggccttgtgacacattctccatggtcttggggattaacattaggctccttgctacttatgcaaatttctgcagctggcttgaatttctccccagaaaattggtttttcttttctatcacataggctgcaaattttccaaacttttatgctctgctttccttataaaactgaatgcctttaacagcacccaagttatctcttaaatgctttgctgcttggaaatttcttccaccagataccctaaatctctctcaagttcaaagttccagaaaactctagggcacgggcaaaatgccaccagtatctttgctaaaacataacaagagtcacctttgctccagtgccgaacaagttcctcatctccatctgaattttattgtccatattgctatcagcattttgggcaaagccattcaacaagtctctaggaagttccaaactttcccacattttcctgtcttcttctgagcccttcaaactgttccaacctctgcctgttacccagtttcaaagttgcttccacattttcaggtatcttttcagcaacgcccccaatctactggtaccaatttactgtattagtttgttttcatgctgctaataaagacatacccgaaactgggaacaacaaaaaaaaagctttaattggacttacagttccacatggttggagaggcctcagaatcatggcgggaggtgaaagcctcttcttacatggcggcggcaagagaaaatgaggaagaagcaatagtgcattcagaacccattgtggactcagtgttcccaagaacctctcaagggaggtgccactgacaccaggacctgaggctgtgaagaataaggttaagagtactcaggctgcttggtgcaggtgagaagaggtattagtgtattggagaaagagttaagaggcttttgtgcctagggcatagtgattgaggggccttgtagaccatggaaagaactcgatttttttaagtgcagaggaaagccagggattgacatctaacttacagttttaaaagaccctttccttctatgaagagaatggagaaggaggcaagaatagaagcggggaaaaccagtcagaatgctagatgggagacaataaagaattaattgtcattgataataataatagctaacacatggcttactaatgccaaggactgttgtagcacattttatgaaccagctcatttaaatgtgctcttcagttagcacactctttcattctttaaagtatcataggtcgggtgtggtggctcacgcctgtaatcccagcactctgggaggacgaggcaggcggatcacctgaggtcaggagttcaagaccagcctggccaacatggtgaaaccccgtctctactaaaaatacaaaaattagccaggtgtggtggcgcatgcctgtaatcccagctactcaggaggctaagacaggagaatcgcttgaacccgggaggcggaggttgcagtgagccgagatcgcaccactgcactccagcctgggcaacaaagagcgaaactccatctcaaaagaaaaaaagtatcatcgtttggatgataaattacacgaaactatgaaccagccaattaacattttcagaggagcttaacacttggaatacttagtcttcctcctgttctcatcaatttcaaactgtcttgtgaaactcactaacccagacagctatacagtattaaagtaggaagaaaactgtatgggatctatctccaaattttcggagactcttcctttttgttgccttctgtcctggctctgtctcttggttctgagttgtatgtgggcctttctgtgttttttctcagtctttttttccccttcactccgtccctgtgtctctcctgtgtgtgtcccccgtgtttcttttctctttctgctttttgtcttccccattccttctcactctctgttctcttaccctgatttctctttcttcctccttcaactggccggtgaggtacgggcatgtagtgtggatctgtttattatataaaaaatgatgttgactatttccatttaaaacgaatcaagtctctcagaaccagtgtactcattccaaaatactcatagatgattgttacaaactactttaacaggagtgtccaatcttttggcttccctgggccacattggaagaagaattatcttggagcacatgtaaaatacaccaacgggccaggcactgtggctcatgcctgtaatcccagcactttgggagaccgaggcaggtggattgcttgaggtcaggggtttgagaccagcctgggcaacatagtgaaaccccgtctgtactaaaaatacaaaaaattagccggacatgggggcgggcacatgtaatcccagctactcaggatgctgaggcaggagaatcacttgaacctgggacgtggaggttgcagtgagccgagattgcaccactgcactccagcctggacaacagattgggactccgtctcaaaaataaaataaagtaaaataaaaattaaaaaataaaatacactgacgatagctgatgaactaaaaaataaataaaaaagttttaagaaagtttacaaatttgtgttgggccacatgcagcccagaggccatgggttggacaagcttggttcaaatcattttattatcctgttttctactttcacatctctcaaggaaatttacctagtaccccgttcatctaactgatctcttctgatccccaatccttcccttcccattctaccacccacctccttcactgccttctatacctcaagtctgcccccagctccagcaccagactgcacctaaatcacaccaggtcacaactattctgtaagacacaagaggatttgcgtaacctgtgttgagccaagtgtcacccattcttccataatatttatggaatatttacttccttttttacctttcctaacgcttaatactttgcaaactattggttttgttctgaagcttacttttaagatattcttattttacatacgaaagtgcttccttatgtttgcctggttccaaattagagggtaccagagcccgatctcctctaagcaggaggcttcccataggaaaggaatgttcctttgtgctcatccttcgtataaatcaccagggagcttttaaatgaacaaagacctggctgacccagagggtagaacttataaatagtactccagcccctcctttaaagcctgtccacctaatcctcctctcaagattggaagtgacttgacctttgagtcttaaaactcaggctctttttctctaaaaaatctggttagcagtaagctgttaaaacaaatatgtttttagccagatgatgaccaatcatcaaagcttgtctttcatttctagcatttttagccaaatgtttcctcggttttttttttgtgtttttgtttttgttttggctcctcagaagtcaacttgaagtttcctcttttgaggaccagcttttctcattgttattattttaagacatctaccttaataacttttatttctccttactaatagactattatggatttccattttataaagatgttcccaaattgctgcatttctaccatgaactaagggcttccttttcacccctaaaattacagaacttagaggggccttcaatggcctcaatcccaacgtcgttggatggagctctctttgtatttctctaatgctgtattgaggataaaatcttacaaaacttgttaaggattaaaatgtgcaaggattataaaatgatgcacatgatatagatactggtagataattttccagattagggcacatgcaggaataactatgtatattgaactggctaaacatataaatatattttatagaatatatttttatgtgattcccaaaaagataagcaattagggccgggcacggtggctcaacgcctgtaatcccagcattttgggaggccgaggcaggcagatcacctcaggttgggagttcgagaccagcctgaccaacatggagaaaccccatcgctactaaaaatacaaaattagccgggcatggtggcgcatgcctgtaatcccaaatactcaggaggctgaggcaggagaatcacttgaacccgggaggcggaggttgtggtgagccgagatcgtgccattcactccagtcggggcaacaagagcgaaactctgtctccaaaaaaaaaaaaaaaagaaaagcaattaagtccttaacctggttatttacagagaaaagacattcatgttgtggaaatcaaccatgtatttttagctacttctctcccttgaaataaggggagcttaaatttactattcactaaatgccagatagaagactaatttaaaacatctttcttttttatcatttaatacatagattgaagagtaagtcctggccccaggctttgcttttctgacctctgccagtcacagtagtgctttttctggaagttcagtctgctccaactgcagctttgtgcagggaccctccgggacttttctagttttgctagaatgcctcatctgcctgtgagcctggaactgtagaagtcattttagttttgtttagtcttattgtttaatttaagaaagtctgatgtccatgttgccgtagtgggtacataggacactatcggctgtgaaagaatgaaaagcttgttcagagaaggtcgaatgaggactatgtcttcagaaaaccttgggcttagctgcctgggacagtttagatctgagctcagaggggattgatagagcagtagtatctgttgttttccttctgccgttgggaagctttctcttaacatatagagaccctgggatgtgtgagcatatttatagtaattataattgtgagacatgacctaaggaagtatgtgaacttgcttttgaatttagttgtttaaaaaaaaaaagtggagtttgaaaatatgaaccagaggaaggcagatcacacgggtggagaggaacggcactgtctggagatgtattgagcatagaaggagagtttgttaggaattgcacaccctgaggggagaatgacacagccaatgtgatctgaaagcgacagtacattcatgcagggatgcccacaagcaggttgagtgcacagaaagatagactcctcatcacattgcaggcactctgctgaataaccctttgttatattttgagacttttctttttttttttttttttttttgagacggaatcttgctctgtcgccaggctggagtgcagtacatgatcttggctcactgctcactgcaacctccgcctcctctgttcaagcgattctcctgcctcagcctcctgattagctgggactacaggcgcacaccaccacgcccagctaattcttgtatttttagtagaaacggggtttcaccatgttggccaagatggtcttgatctcttgacctcgtgatccgcccgcctcggcctccaaaagtgctgcaattacaggcgtgagccacgacgcccagccgagacttttctcgtatagcagcaaaacctagacagaatctctccagagggtaaaatatagtgttattacacacatgatgattccagtcagctgtgttgtttagggttcttcactgcaagctattcaaacaatgggaaagggtatctgaggcttttggagctgcctggaagttgaaggacagggtctgtagcaaagaccacacagtaggaaagggcaggttggcatgcccctgctgcccccaccctgaagaacttccaactccctcgaaagtcctgtagcttcaggaccccagaactgggtagcacgtgtccaaggctaggccttcttgtgctcacccctgattatgccagggctgggagaaaaggatctggcctttctagctgctgtagtgcaaagcagtcactgccttccacaaggtagagactctcttctttgggaagagagtctgatcacaagatagcaaaaaaagaaaaccaaaaaaaagacacatgtaaactatatctatattatacatatatttatctgcagctcagtctcttcgcaaatattaacgatcttttgcagacagcctctgtgcttgcataatgttaattttcttttcctttaatggtttgtcaattgttttttaaaacaaaacaaaaaaaaccttagcactctcttcttaaagttagtctttatttttattaagttgtatgtgttcatcatttaaagaatcatagtcagccgggcaaggtggctcacacctgtaatcgcagcactttgggaggccaaggcaagcggatcacctgaggtcgggagtttgagaccagcctgaacaacatggagaaaccccatctccagttaaaaatacaaaaattagccgggcatggtggtgcatgcctgtaatcccagctactcaggaggctgaggcaggagaattgcttgaacccaggaggtggagattgcagtgagccaagatcatgccattgcactccagcctgggcaacaagagcgaaaccatctcaaaaaaaaaacaaaaaacacagtctatctagtttctaatgaagagcaccactccctgtccccctattttctactccccagagaaaactattttcaatcctttttagcttatttatttggtattcatcttggtatttctaaaaagcaaaatgtggctatgtcgtaatgtttccattttagcattatttatccactttccactacggaaaatgacagttttgttgtttctcaacatttcgtgcctgactatccagatatacatactcttgttcccccatcctcccaggtaaattatattgggtgttagcatgtgctttcattgttatgaccatatcagcactacttgcaatgaagccatgagttatactatgactacttttttcttccagtactacctttaatttttcttgatgtcagtacttggatttttgtcatttgcttagattttctgtgcttctcatgaatttgaccccaaaatctccctctaattgtataaatctcctttccatataaacacactaggtattctatgaattttatctttttaaaagaaaatctcttcctgagctttgtgacctgctctagcctggaccctggactagtcactctccagacctgttaaagagctattgtcttgggatcttccttcactgtcactcaggggactcccttcagctgtttcttgcttgctatatcccatgtcatcccctttcttggttttctctgtcattttgatgaagccatattttccttagtttcttaagaaagcaaatattttttagtttgtttcaggaattgtttccctgaaaattttaaaggccctgctaagttgtctcctaccctccagggttccttttgaatttgatttattctgattttttttcctattctgatttgaccctttgtataatgacttgtttaacctctggaagcttttcgcttttctttatctttgatattctgtaaatgcactaatgatgtgacttgggcatttgctacaccctttttttttttttttttttttttttgagacagggtttcgctcttgttgaggctggagtgcaatggcgcaatctcccgggttcaagtgattctcctgcctcagcctcctgagtagctgggattacaggcaggcaccaccacgtctggctaattttgtgttttcggtagagatggggtttctccatgttggtcaggctggtctcgaactcccgacttcaggtgatccgcccgcctcagcctcccaaagtgctgggattacaggtgagccatcgctcctggcctagacactttccatctacgaaattttcttgaattaatttattgatgccatcctcccctctgttctctctgttctacctttctagaacttctattagttagacactagaactcttggactattcttggactataagtttttgtgcctttactctcctttttttttttttttttttttttgagacagggtctccctctgtcgcccaggctggagtgcagtcgcatgatctcggctcactgcagcattgattttgtggactcaggcaatcctctcacctcagcctccagagtagctgggaccacaggcatgcaccaccatgacttgttaattttgtatttttgtagagatggggtttcaccatgtttcccaggctaatctcaaactcctgagctcaaggaatccacccacctcagcctcccaaagtgctggaattacaggtgtgagccaccacactcagcctgctctcctgttttctatccttgcctttttcgttctgaaagctttcttcaattttgtctttgtgttgagttgtttggttctgctatcaaaatatatgtgtttctagagttcttttttgttctctgaatattcttttttaaattggtattattgactcatttaatgtatgaaacaatacagaaactagaaaatataaatacttatgttagaaggcattttctgacagagaacatcagttaaccagcttcataagttgtaacctcaaaccagagaaattcacctaaaatatacagaattttattatattaatttttagtgtctgtaaaggttatgtcttatctctcttttttaatgctcctttttaaaacttatgtctttatctgtaagcctctttattcttctaagttacttttttcttttagtttgttttggtctgtctttcataataaatgctttcttaaatttctgttgatacttggctatcttctcatatttaaaaacagggcactcagaggctgaggcagacagatcacttgaggtcaggagttcgagaccagcctggccaacatggtgaaaccccatctctattaaaaatacaaaaataagctgggcttggtgacgtgctcctataattccagctactcaggaggctgaggcacaagaattgcttgaaccaaggagatgaaggttgtagtgagccgagattgtgccactgcattccagcctgtgtgacagagtgagactctgtttcaaaaaaaaaaaacagagggggccactacaaagcaatttgagagttctgtgcttgtgggtgaagtttatggactgtggcattcactatagagtgatcttcatgagttgtttccttggggtacatctgatatttgtttctttaggtattttatcttggttggtcagatcctgttggtaaattttaaattttgcactattcgttttctgtccctttcttgcagtctctaggtgtgtgcagtcttaggattctcatagataaaagtaacttctctaggtttctgcttcttcctttagatgtctttttgactctcctcacattcttatgtgcttccatggcaatgagcagtttgacaaactttttaaaaagtaaacaagagttggtgggagtaaacatgagacacctagaatacaaagtgggagtcactttcagtgccttatttttccttagtcatatttgatcagaaattggatgaaccttcgggatgctgagacagggaagatactctggcaaggaacagaagacctgtctgtccctggtgtggagcatgaaggtactttccaaccctttatctacacagggctgtgaccaatgccagactagcacctgagcataagagagctaagttaacacatacctaataggcgggtgagcccctgaagacacagcatgttaatccatgtgttgttgacagtttcagttactttcttttttttttttttttttttttttgagacacagtcttgctctatcacccaggctggatggaatgcagtggtgtgatcttggctcactgcaacctctgcttcccaggttccagcgattttcatgcctcagcctcccgagtagctgggactacaggcgtgcgccaccacatctggctaatttttgtattttgagtagagatggggtttcaccatgttggccatcctggtctcgaactccggacatcaagtgatctgcccgcctcagcctcccaaagtgctgggattacaggtgtgagccaccacgcccagccagttactttcttaacagttctttctctcacttcccaaaacccattttgtgctgatattttaccattagaacatacccaaagatagaaactaagatctcaactttttctccaaaagaaaatttgcatttttatctccctgaagtaaagaagaaggaaggggttaaaatcaccagaacagagtagagagaaggtacccatgcagcccccttcctgatgagagtagttagatgaggcccttagatgcacaaaacctggtgttccttgaagatctaatatctttcagatacgggtgaccaattagagacctctgctttcagccacacaaagtgtaatgcacttaccaaggcattatccaaaatgtaagaaagtgttctctaaatcagctgtaagaaagtgttctctaaatcagctgtaagaagctcccagaaatttgaagcatcatagtcctgtggttttcatttagaaaggcttcaacatttgtttttctcttaccagcccgtgttcccaagaaaatcctcaagtgcaaggcagtgtctcgagaacttaatttttcttcgacagaacaaatggaaaaattccgcctggaacaaaaagtttacttcaaagggcaatgcctagaaggtattctgctgcctacatgcctgaaatcagggcttagggcgaccaggacaaaaggcaacaatacccagtgaactaaagcagtgctttgataacattccttttacaactcagtttgtggtaggattcctacactctgcaagactgtgaatccccagtgaaacaaaccaaaacaaagctagccactacaaggggctttgaggtctctgacactgggagcgtggatggtggtgcctggtttaggcactgacgttgtattgtgatatgatcatggaggaagctgctatgagcagggcctagtacagtgctctacatacagtatcatacagatttgactggcaaggccactctgcattgaattctcaccatgcagtgtaaagggcacataagccccttcaagctaattccaagtgaatttaactatgtatctatatatagttcacatctagcctacctctaagaaaatgctgcttatattgtgtcctgctcgctggtcctagtcctttagacctcaaagcatgagaagcaagcctttggtgtggttcagaggacaacctgagcaggcttccctgtcttttttacgcccctggtctgagaggttgctgatagcttcctttggtggttctcagggtaggaagaggctcactctagagagggagacaaagagcccttaaactttatactggggcacctgctcaccccggcttttccttcttccttcagaatggttcttcgagtttggctttgtgatccctaactccacaaatacctggcagtccttgatagaggcagcacccgagtcccagatgatgccagcaagcgtcttaacgtgagtgagcaggtctcaggaaattatgaagtgtgtctagaaacaggcattccaggcaggtgggactcctggtgccattcagtgggcagagagctcggttgagaaatagagtaaaagagtatccaagggtatctaggtttccaggttcctgacctttttcatatgaaaaagacagtatgatagagtagaaagaataaaaaactaaaaataaaaataaaactttagattaaaccagatttaaattcctgattcaccctgactacctgtgtcatcttgggcactaatatactttatctctctgagccttagtctttcatctctaaacacagaaattaattctgtcttacagaggtgtaatgaagataaaatgtgatgacatggaaggagactggcatttaatatatataccgaatctatgttaatttgctcccattcctgactaccgtacttccggtatctctgtattttgtttagatcacctttaacagaatctggcaaagtcctattaataattctgttttcgaggatactacttggttacagttttttggagaatggcttaccatattaatagctttggttcctgttccaagaacaatttgtttgtgctttttccaaaaacactgtcaataacttcctacctcccattgtctgtgggaaagatgttagtctctcaaatgttatagtaatagtaccttctaaagagttagctgggcgtaatggcacacacctgtaatcccagctactcaagaagctgagataggagaattgcttgaacccaggaggtggaggttacaatgagccaagatcatgtcactgcattccagcctgggtagcagaccaagactctatttcaaaaaaaaaagagttagtcccacagataattgtgtaatattggatcatctctttcaacagttcctttatgaaagccatattgaatttgttaaaaattgaggttattgactttaaggttttttgtttttgttttgggttttgtttattttatttttttaaaaaacagggtcttgccatgttgcccaggctggactccaactcctgggctcaagtgatcttcctagctcagcctcctaagtaggtgagactacaggcatgtgccaccatgcctgtctctactttttaagtttttttttttttttttgagacagagtctcgccctgtcacccaggctggagtgcagtggcgtgatctcagctcactgccagctccgcctcccaggttcaagcaactctcctgtctcagcctcccaagtagctgggattacaggcatacaccaccacaccggttaattttttttttgtatttttagtagagacagggtttcaccatattggtcaagctggtctcgaactcctaacctcgggtgatccacccgcctcaacctcccaaagtgctgggattacaggcatgagccaccgtgcccagcccctttttaaagtttttaatagtttttttaacagccaggtgtggtgacactttcctataatcctagctacttgggaagctgaggcgggaggattgcttgagtccaagagtttgagactagcttgggcaacatagattttgtaagaggctgggcgcagtggctcacacctgtaatcccagcactttgggaagccaagtcgggtggatcacgaggtcaggaaatcgagaccatcttggctaacacagtgaaaccccatctctactaaaaatacaaaaaatcagctgggcatggcggcacacgcttgtagtcccagctactcgggaggctgaggcaggagatcacttgaatctgggtgccggaggttgcagtgagccgagatcacgcctctgcactccaccctgggtgacagggcgagactccacctcaaaaaaaaaaaaaaaaattgtaatagaattttttaaagttttaatagttttaaaagtagattttttttttttttttgatatggagtctcgctctgttgcccaggctggagtgcagtggcaagatctcggctcactgcaagctccacctcccaggttcccatctttctcctgcctcagccttccgagtagctgggactacaggcacccgccaccacgcccagctaattttttgtatttttagtagagacggggtttcaccatgttagccaggatggtctcgatctcctgacctcgtgatccgcccgcctcggcctcccaaagtgctgggattacagacgtgagccaccggtgcctggcctaaaagtagattttttaattacagtagtagctatttttatatcttatcagccagtcagattctgagtaccttatttacctgttttttggggtttttttttttgtttttttttttgagacggagtctcgctctgtcgcccaggctggagtgcagtagcatgatcccagctcactgcaacctccgcctcccaggttcacgccattctcctgcctcagcctcctgagtagctgagactacaggcacccgccaccacgcccggctatttttttttttttatatttttagtacagacggggtttcaccatgttagccaggatggtctcgatctcctgacctcatgatctgcccgcctcagcctcccaaagtgctgggattacaggcatgagccaccatgcccggcctatttacctgttttataattaattaccagcagaaatgtatctgctggttattaattaccctgggaaagtacagagtagtttaggaaagcaggggttttttttttttagattttattaaacttcatttgacttcttcttcacgaggcgtgattttttgttgctgtttttttttgagacggtctcgctctgtctcaaacctatcataagatgaaaatatcataagtcaaaaatgcatttaatatccccataaatccactataaagttgaaagatcataagttgattcattataagtagggaaccaactatacttaactttttattttttatttttttttattttttttgagacagagtctcgctctgtcgcggaggctggagtgcagtggcgtgatctcggctcactgcaagctccgcctcccgggttcccaccattctcctgcctcagcctcccgagtagctgggactataggcgcccgccaccacgcctggctaatttttttgtatttttagtagagacagggtttcaccctgtttagccaggatggtctcaatctcctgaccttgtgatccgcccacctcggactcccaaagtgctgggattacaggcatgagccaccgtgcccggctacttaactttttagaacccccaaaaacagttgccctaaactcagctcaagtgtgatttggtaaggccatggtctctcccattttacaaatgggagcaccgagatacccaccaagaaaaatgaaattcttccctcacacctcacaatacaggtgcatcatttagtgttctgtagttgtaagtcatagaaacaggctctggctaatacaagagctgaaagactaagggggagagctgggcggcttggaagatgcagatgggcaggaatccctggatggcttcctcaaggagaagctacaggaaggatcttgctcaagagaaagagtctgattggcctaagttacatcctctgttcacccttttgccaggtgagtgaggggccactcacttggcacatggactggaggaagggtggttcccaaatgaagagcaaggtgctgttacccaaaggcaggaaaatagatgtgggccaggccaaagcccacctttcgactattgtgagtactgtagggaaggatactgcccctgaggtctgcaggcttctatatgtaagccagccagaggtgtccatgaatgcagtatcagaaagtcagtcggatctataagcaccctgtgtgcagagcactctactaagggctttagagtgtaccaaggagtggagacatgctctcacttctgatttgtgagcttgacagggatgaatgtaaccacataagttaaatgtcatgttagacttgtagccccatatagacaaggattttaatgtccccaagctaagactctgggtgggtgcatgtccattggcccaggaatccagatggaaaccactttgtggaaatgaaatcttgtgcctaacatgctcactctcttttgccctctgtttctcttcttacttacagtgggaacgttatcatagaaacaaagttttttgacgacgatcttcttgtaagcacatccagagtgagacttttctatgtttgaaagaagaatgtgtgtacatttcaagaatttgggttttttggagggaggaggaaactgtttacttttttcctccacacgtttgatttttgacacatacacccctaattccctcaacagcagaacctacctgcagccaccaggggaccagctctgtgtaggtaaccagatggctctttttcccaagccaccatcttccagctgaccagactaaactcccaaccccagaccagggcaggggacaggtctcaagtccttcccagcatacacacagggaacaaacacataccacaaaccggtaactgtacctgtcaccctccttgtctcctccttgggccctacaggctacacatctacctttggcccctggttttggaaaaattccgtgttcctgacccatgtttagttttttcctaccatttctatttcatacattctcatacatttaacttgtaaaatagactgtgatattattacataatgtaattaaaaatatgaattaaaatattcctacagtctttagcatggcactgcttttatctctcctttttctggaaagtgaacctggctgcataatggaaagaaaccaaatataagatcacaactgtatttcactccaggaatggaactgatagatcttgttccctagtgccacagttactgctttccaaaattgtgcaacatacttgaaccaaacccatgaccttaacatttgtcttttagacacaatctttaatggttcttttccacaacatacatgcaccctttgtttgtttattattgttaattttttctatttgtttacagtattcatttgttcaagaagtttcaagaaagggcaattctaagttagtagagtagggactctcatattcctaaatgagactagaagctacaaaatgaaaagatctgcatgaacctaactggagaatgatgggaaggcgtctgggctgggaggaggctgggaggcctttaagactgtcgtcattggaagccagcgtgggagagaagggattacaactggcagtgctttcaggtccgacataagagagaacaccaaaaagtgttcttacctctgagctactagtagccttcagtgtctttttttgttgttttgttttgagacagagtctcactcttgttgcccaggttggagtccaatggcgggatctcagctcactgcaacctctgcctcctgggttcaagcaattatcctgcctcagcctcccgagtagcccgtcaccacacctggctaatttttttgtaattttagtagagacagagtttcaccatgttggccaggctggtctcgaactcctgacctcaggtgatccgcctggctcggcctcccaaagtgctgggattacaggcatgagccaccgctcccagcatgccttcactgtcttttataaaataccaacaattacatgttttcaagttaccaaagcagtaaggtctgaggccagaggacagaacacatcaaaggtatggctctctttggtgtagctcttgctctcagattcctcttttccttttctctctattacctgagtctgtttgcatctgcgggtggggaggagaaaccgtatatttttagtgtactaccatctttcaatgatgattcaattcctcatattagatctgttgtcttcaaaagctgttttttattaattttatttatttatttatttatttagagacagaatcttgctctgtcacccaggctggagtgcagtggcatgatctcggctcactgcaacctccacctcctgggttcaagcaattctcctgtctcagcctcccaagtagctgggattacaggcacacaccaccacgccggttaattttttttttttttgtatttttagcagagacagggtttcaccatattggtcaggctggtctcaaactcctgacctcaggtgatccacccccctcggccccccaaagtgctgggattacaggcatgagccaccatgcccggcccaaaagctattttttaaataccaaagtttggatggaaaaacaagttggggtaaccccagcaatttaggagaccaaggcggaaggatcgcttgagcctgggggttcgagacgagcctgggcaacaatggtaaaacccagtctctacaaatgataatacataaattatccaggcatggaggtgtgtgcctgtagtcctgactactcgggaggatgaggcaggaggattgcttgagcccaggaggcagaggttgcagtgggttgagatcgtgccactgcactctggcgtgggtgacaaagcaagaccctgtctcaaaaaaaaaaaagaaagaaagaaaagaaacgaaaagaaaagaaaagaaaaaacacagccgggcatggtggcgggcgcctgtagtcccatctactcaggaggctgaggcggaggttgcagtgagccaagatcatgccactgcactccagcctgggcaacagagcgagactccgccttggaaaaaaaaaaagaaagaaaaaaacaaggtgaaaatgaatt

SEQ ID NO: 15858 - DNA, 145320 bp, Human
tacaggaagttgaattttaagtcaaatcaagtaatcacctttcacctattgggtttcttcatacatagtttcccccaaaacaatttttttttttttttgagacagggtctctctctgttacctagactgcagtgatacaatcatagctcactgcaaccttgacctcctgggctcatgtaatcctccttcctcaaccactggagtagctgggactgtaggcgcatgccaccatgccctcctaatttttgtgttttttgtagagatgtggtcttgccatgttgtgcaggctggtcttgaactcctgggctcaagctatcctcttacctgggcctcccaaagtgctgggattacaggcatgagccactgtgcctggtcccaacattttgttaggaaataattttgaacacacagcaaagctgaacaaattttacagtgaatacccatttacaatgaacctagattctaccatctagattctaccattatattttaccattatattctaccattatattttactatatttggttaatcacatatttatccatctatgcgcccctaaatccatcttattttttagatacattttaaaggaaattttatatacttttgtctgacactgggaaggcaatgcaccttaatcccacaagctttcttacagaggctaatagctgtttactggggacactgtagtgaggatttctgcattgagtaggtgaagaggaccataactgtggctttcaaacttttctgactgctacccttactaagaaatgtatttcacattcctatccagtgtacaccacatacatactgaagtaaaaattttgggacacaatatttaccctttacatgtgtgaagcatgctgatattttctattttatttcatttaaaaagatgctgggcatgcttccctaacttgatttagatacccactaatgtactgtaatttaccatttgaaaatcattgtacttagtccaactccaagaagatttttctttttaaaagaatcctgtggctactactagaattttccttatgttcccaattatcaagaacctgttttgagtctcagcacagtacttacttaacatgcatggcgttaaggcacgtgtaattaagagaaaaaccttaaatgcctgctaagacttctggatagagccaattcaaagattctttattagtaagtttaccaattattattattttttttttgagacggagtctcgctctttcgcccaggcgggactgcggtggccctatcttggctcactgcaagctccacctcccgggttcacgccattctcctgcctcagactctccagtagctgggactacagaagcccgccaccgcgcccggctaattttttttgtatttttagtagagacggggtttcaccgtgttagccatgatggtctcgatctcctgacctcgtgatccgcccgcctcggcctcccaaggtgctgggattacaggcgtgagccaccgcgcccggccccaattatttttacaaagagtaagataaagatatgtactcttggatgggtgggagggttcagtgctcatatagtcttctgttaaattaggttattaatgcctgcggtggttccaacaaagtagagaagaagatcaaataagaaaatggatgggaaagtactttgaaaactaatgttttattaatactgttgtgtgatgccaggaagaaagggatgttgcgatcaagctctagggaggcagtgtttcagtattttaaaaactgtttttgtggaactgttaagttaacctccccaagccccaataactacgctttgacgcaagattctcagaagagggtagaagctatgaacttggagaggtttggtcgcgagttcaagcgtactgccccgttggcgcatgctcaagagcgactcgggcctccttgctgggttaggcagaacacggagggcggagttcggaccacgtggggtctcgtgacgtcatctccgggcgccgagggtgactggacttgtggtgcgctgccagggctccgcagcgttgccggttgtattcgctggataccagagggcggaagtgcagcagggttcagctccgacctccgcgccggtgctttttgcggctgcgcgggcttcctggagtcctgctaccgcgtccccgcaggacagtgtgtcaggcgggcagcttgccccgccgccccaccggagcgcggaatctgggcgtccccaccagtgcggggagccggaaggaggagccatagcttggagtagggtacgtgtgtgtgtccaccttgtgtgaggaaattcctagaggaggagggctggggaggggccaggtaggtgtggtaggaaggaggggtgagtagttgcctggaggagcgcccgcccggccgcgatggcgggtgaaggtggttcctccgggcaaggtggagttggcgagacgccggcccggagccctggggccggttggcgggtgtggcctgcggggtccctcttggggtacatgtctgttgcttactaaggtaggaaagcgagagtctagtcgcaggctctagagttcagttcaggacctgaattgtttgtggaacacagttatttaaacctttattgcacagtgcagtgtgagtctgtccaaactcggtgggtatgtcctccaagcaatttatctatttacgatattccctgtctcaataacaatatttagtgctaccaaagacattttctgttggcaagacacttttacatacttcatttgtactttggattattttaaaattatcctgaacttgaggaacctaggaaactattggttctagatttttctgaggggtgaggaggtacagcctgtcttgagcaatcagaacccggagacttaccagacagtagctgaacttccaaagccttccagaattggcttgttaaatttctgagaccttgaaactggatacttggctctgaactgaactatttgtgatttccatagagggagtttctggttgaattttgaatttgaaaataacgatgttgtgctcagggtagtaattgagaggtattttacaccagatttaagcctgtgcttttatcttcaaagatatgctacttaaaattgggggaaagtgtacagaatggaactgtatggatatggatttttagaatagtgcacacacctcaagtgtgtatttatttcattaatttcccccaaactgagtacctcctatgtgttaggcactggacaaaacagtaaacaaaatagtaaacaaaagaataaaaatccctgccatcatgaagttccactttggggatggggtgagaagacattgatacaaaaattaaggtacagtctttcctgtccctcggcatctgtgggagattggttccaggacctcccttggataccaaagtcctcaaatgctcaagtccctgatataaaatggtgtagtgtttgcagataacctatgcacatcctcctatctttagttcaactctgcattatttataatgcgcaatacaacttaaatgctgtataaatagttgttatggtgtattgtttagggaataatgacaaaaaagagtctatacatgttcagtactgacttttttttccttccccgaatattttttcatccatgattggttgaatacaaggacgaagaacccatgggtaggaagggccaactgtgtacgtcaagtggcggaaagtgctagagaaaaaaaccaaagcagtgcaggggtatagggaatgccaagagatgggagtggtggccatagaaaagatgatattaacttggaggcctacgggtgataaagaagggtgccacttggaaggagctgccactgaagccctgaagcaggcgcatactagctagtttgactggaaaataatgaacaagagggaaagaagtagtggatacttaggtggaaatggggccaagtcatttaggagcatgtgggaatttataagaaccttaatttgtactttgaatgagttgggttttgagtaagcagtgagttgatctaacttgtgttttaaaagatctgattgctatgttgactgtatgcagcaggtgcagaaataagagttgttagtaggccattgactgcatttatccaggttaaaggtcgaggtgacttgaatcagggtagtaatagtggcggtagtgcgaaatgaccagattctagacttttgagagcagtcaggtagaagaagggtcaaggacgactccaagggttacggactgagcaactaaagaatataacttggccgggcgtgatggctcatgcttgtaataccatctttgagagaatccccagcctgggcgacataacgagaccctgtctctacaaaaaaataaaaaattagctgggcatagtggcatgagcctgtagtcctggctacttgggaagctgagatgggaggggaggatcacttgacccccttgagctcaaggttacagtgacccatgatccttcactgtagtccatcctgggtgacagcaagaccctgtctctttaaaaaaaaaaaaaaaaaaaaaaaaaaggacttttccacttagcgaaacggaaaagaccacagagtgataatgataggagaactttttgttgggaggccaaggcgggcggatcacgaggtcaggagaccgagaccatcctggctaacacggtgaaaccccgtctctactaaaaagacaaaaaaacaaacaaacaaaaaaaacaaacccgagcctggtggcaagcgcttgtagtcccagccactgggaggctgaagcaggagaatggcatgaacccgggaggcagagcttgcagagagccgagattgcgccactgcactccagcctgggcgacagagcgagaccccgtctcaaaataaaataaaataaatgataggagagaggaggaaggaagatctgaaatggttttccgttttgcatatgttaaatttctaaatggaaatgtcatatgtggtggtatatgtgaagccagccagttcaaaagagaagtctggacagaagataaaactgtgggagtgtaaatgtataagtgttatttaaaaccatgtgagagatcttcaagggagtggttcaaggactgagtcctggggcatttcaacatttacagtttggagagatttacaaaatttcctccctcccagggtgggactgttgagtaaaattcctcttgagaatcactgattcacagtacctggatagaaggaaatagaaagcaaggtcattagctgagagagaggaggaggaggaggaagaagtgaacatttgagggaggagaaggtatagaatagtgatgtaggaaagtgggagaataaatggactagggaagagtaggaaactagtgtttatgaatttaaaggaagaccagccagcatagattataattttttttctgtttacacgcttagtttagtaagtatttgatatttctaggtagttgggggttttgtcagtgaaaattacttcaggtagtaggttagtttttcttggtatgtagtgtgaaagaaactattatgcattatattgttgtcacaccgtgccattttctgaatgactgattggttaacagatgttgttggtgggcacctactctgtcccaggctctgaactagatgcagaaaatagaagtcaataatagcccctgccctcaagaaacttacttctagtagattgcgtcacaggttggagtttctttatttccaagacagttccttgaaattggatggtgattggatggtgtagtgtatgtaggagagggaaaatctttctaaaataacaaaatatgccgaatttaaagtgcgactatactgatttggagaggagtttagggagaaaatttcttaagtagctagattcatatatttatatatttttccccattatttaacaaaaatttcaaagcctactatgtgctaactgtactaatattggtgataagaaggtacttatgactaaattttgctgtcaaagaactcccagttcaatgtggggaggggcaggagacagataagataaacagataactacattgcatgatagtgcatgctattaaagaagtaattagactagaggctgcataggggaaaacttcccaaggagctgatattaagccgacacttaagaggattaagagttggccaggcgcggtggctcacgcctgtaatcccagcactttgggaggccgaggcaggcggatcatgaggtcaggagatcgagaccatcctggctaacacggtgaaatcccgtctctactaaaaatacaaaaaattagcttggcgcggtggcgggcgcctgtagtcccagctactcgggaggctgaggcaggagaatggcgtgaacccgggagacggagcttgcagtgagccgagatggcgccactgcactccatcctgagcgacagagcgagactccgtctcaaaaaaaaaaaaaagagttgacccagagaggataaaagagttggccaaaagaggagggaaaaagtgttcaagcagaggggccatggaaatatgaggaaactgtgtactaaaaacatacattgtttattgagtggttaccaaatgtactaaacacctaacagccctgtgaaaattataattatcttcattttacaaatatgagagtcaaagaggatgggtttgttgttcaagacacgtaactaataggtggaaatcagggtttaaacccatgtcagtctgatttcaaagccccttaactattttattgtattttgcatgctgtcagcatctaaatcttccctgcccttgttctttatccctcatttttcatcaacttctctttcttccttggaaagactcatctgtttctcaccagtccatgactacctctctaggtcaggcactcattactttttgccttagttgctgaaattactacctggctagcctctctgactcaaggctctcccttctgtgcactgctaccagataattgtttttattttaccattctaaaaccggtaggcactataggactggtggatgagattgagattccccctcagtcttctgtttggtatgtttcatggtctagtctcattttatttacatttatagatttgacattagagggataataattgcttgcatttcctagcacttaccatgtgtccattattgtatcaaacactttatggatttttttttttttcagaacagccttttgacttgggtaatattaattccacttcacaagtaaggaaattgaagcttagtgaagtaaagtgacttgcctaaaggtcacgtgtgatgttaagacaggttatggtatcagctctttcattatctattaatactactctcaacccaaaatttccttaaaagttggcatatatattgcacctgcccacttaatacctttattgatgctattttggcctgttagaatatttgtcatctttttgcctgtccatattctacccattcttcaagttccacatcttttaaaattatttgaacactataggatgtattaatatctccaacccctcctctttcccctgccccatgaaaactctcacagagtaacatttaattataccatggacataatggatgttttggagttgggagggatgatggcaatcaatatagtatgatggaaagaatgtgagattagaaacctgagttaggatgtggcttctaattttggctccgccatttattagctacaagattttagaaaaatcatctgacatcctcatctcaaatttatcatttgtaaaatgggaacatataggcttgtgtgtatcacatgtgaggtaatgtaaaatgtatagtgtttctggagttacttgatatttaaagtagtatataatctactgttaactaatttttattatctaatctcacctgcttacctcattttttgggattctgtttggttctgtagttttatattcatacactgtctttccaacaaattcaaattcagtaagcattttttgagcacctactgaattccagataccattccaagtatcagaggtgaaaagatgaatgagatatgatccttctccctaacggaatctattacagtctgctggaggagacgtacaaataaatactattgataaaaacttacaagggtagaggaaaagtagaggtgccaagagaaaacaaggcgagttctgcctgaatcatgtgtagaagaaaggttattttgagctgggtcctaaagcatgtttaagttgaaagataaggtaaagaaggctgctttagggtaagggtaccaccagcatgggcaaaggcacagaaaggacagaaagtgcatagtatgtttagtagatttggagattatactttgttaatgattgaggtttttaaaagtccattattcttcttctagcacctgccacacagctaggcatatcaaacgattaaatatttgactctaaattgcatattattagcagtgtttactgcaaaatttttagcttttttatacctataattactacttatgttatataatgcttttgattattattagtttttgaagtctttaaatgttgacttttaaacatttttgagacatgttcttgttctgtaaattataatagtagataacctttatagtacatattatatgatagacattgttcaagtgctttacatgtattcatttaattcttgtatctaatgtggtaagtgctgttttcccatgttacagatgagaaaacagaaatagagaagttaaatgacttacttgaggttacactgtaagtggtggagctggttttggctccagacagtctggctccacattttacatttctaacttctactgtatagtgcttctcaagagttaaattttgttttattgcctctttaaaaaagtattattgaaaacttaacatcctttagttttattcatgtatccccaatttttcttacatatttttaaagttaagtgtattcactggagacatgctttcttatataatttattataggtaagcattaatattgaaagattaacattttaagatcctataaatttgggtctgtgtattttgaggcagtaagcagccttgtttgcagttttcataaatctgttttgcagagtttgtttgttttgcaacatttgtatcagctctactacattatacctttagctgccttggctgagttagttcttcccttgaggtcttgcaaaaaatatacatgtaagcaacaatggtatatgggaaataaagtaccaatttatctttcactagtttttgtacttaaaatcctactgtagaactttggtaaactttgctggaacgtaagactttaaaactcaagcctgtagttggagtcttgaggtgttctgccttctaagtctatatttgtatctcttttgggaagggactcagaagcagcattggtcattcattttactgttcgtgacatgtggaagggagaaacagaagagaatgttatggaaagaaagagcaggatggtcagggttctcgtctggcagcctagaggggagagaagggagccacactcacatgcatgatgttttggtttatgatgatccctgcctattaataaacatgtcaagtggtgtcctggaatctgaccaatcagattactattcctccttgagaggacagtgcttgaagaggagggaagagcaattgtcttggattatattttctatctgcttcttctgagaagaaaaataatatcaatagtgacaatatagtgacttcaactttaagcttgtaattaacttttattaaatatttttagtagaggaactcttcgtctcaaattatttttctcttcatcatcaaaaggtgaatctcagttgcagctgttgactaactggatgtatcatggctgcagaaacaactgcataccacctttatatcagattcaattttagatttacttatttgtcataacctagatttcattattttttgccactagtgaattcactttaaaaagagcaagctattaatgtaatcaggacgtagtgaggtctttcctattttcagtgagttaattttgtgtcatttgtaaacttggaaattttttgccaaatgcagaaactcaatagtttgaatttgtagcctatcagtgtggaatgatatgaagtttacatgcatgtatatcattcgcttaaagtagttgtttttatggatatattttaataaaagttaaaacactagtagtatgctggaaagagcactggactcagtttaataaccagaattcttgttgcctagtacttttatgttggacatattttttccacctcttgcagtttacgtacctgtagatgacattgcatccagttgacctccaactttttctttctttaactaattaatttataccatcttaatgtcattggtcagtggaagaggaaaaaaaagggaaataagctccttgaataattcagtgttaataatttatatttggctaaactcgtaagattatttagagtgttttcataggctacattgtgatagattatgaattagctgcctatcaaagatgagaaatattatttggataagtatattgaatcttagtatccaggtgccacatgttgagttactctaagtgtatattatcaacaatatttatttcagcatttactcatatcgtgtattgtgatgtgttattcagttgcagaatattagcattggaaggcacttggatattacagaggtcaaaagccatgtccttatgccatacctagaatattgttttgcagatctagtgctatatttgtggtatagagaatattctgagagatccaagtggaagcatttactgtttcactggggccagagggctgtgagcatggtttgcagagtagggatttgaataagtgagagaggagcatactaggtaggggaatagtaggatacagagaaaggtgttcagggggccacttttggtagagggtttacaaaaggaagtacagtaattaaaatggaagtattggtgggattaaattgtagagaggatgaaatttagaatggggaatgggtttatagaaagattttttccccaatgtgaaagagatattttctaagatgggagagtagttttgcaggaagagaggagaaactatctggagtaggaaaaggtgaatatattggacggggcaggggtaaatgcgagaatgatcctttggagttggactgtcaggattcacagggtataggtgaagctcctctttaggtaagcagtagactcttctgggcttgaaagactgatgcagatacagtttcattttgactgtggttcagtacttaaatatgcaatgaatattactggcatatgtaattttgatctgattcctttacataagtaataattttacatttagaatttgttgtactcttttctttgaatttatactaaagattggtgatcatcgttttttttttttgaagtggataatctttatggcatggattttttaaaataatcttttgttttctagcaggttcattcatcgttgcaaggatctgactaatgctcttcattttattttcagtttggctttggttgaaataagaatttagcctgtatgtactgctttaactcctggaagaatgacagatgacaaagatgtgcttcgagatgtgtggtttggacgaattccaacttgtttcacgctatatcaggatgagataactgaaagggaagcagaaccatactatgtaagtacattgattgtggcaaatgggatatttaaccttgtccatttttgtaagaaaaagctgtaagaacttggaggccattatgtaacgttttagatacagctaattcatgcttattttggaaaaaaaattaacacagataagcataaagaaggaaataatcacctctaatgctaccactcagaggacaaaaccactgtcagcatgttgtcatgatgcgttctggactttgttttccttacatgtatgtgggtatgttaatggaatcatcagctatggtgccttcttgactttctttttcttatgcatatattcatatataataaatgtatgataatggaataataagatgtgcttttttaataggaagagatattgaaaataataggttcagattgtattcttttgtagttaggagattctaagcaactgtttgttaaaagtgtttttatagcttaaagaacatataaacatgcacacatacacacacacgatacgttcactgagctattgtatgttatatgtgagctaatatgtaatatatatttaatatatattataaattgcacatagacttgcaggtgtgagttaatggattatgtattttacaaacacttttcaaatgtcttctgattttggtgtgctttgtttcccttttctaagtgcatgtataatcccagtttatgcctctgtcagagatgacatcctgcctgttcactgaatagcccataataggcaaagatattctcaattgtcgttactgttttttctttttgtgtctcaggtatgcattctagtgtttacctggagatgatgtggaaaagtagaagtgtatttgtgatgaggaaatgcttcttctgtttcactttaatgaagtctgccctttgctttccccctcatctctctgagaggcagtgctgctcctcagcctgctccagctacggaaagtcagattactggaggaagctacttattaaggagcccattcgctcactttttgggtataggactgtttttttgtttttgttttcctctgtgcatcctcagcatctggcacaggctcctcaagtggtactactcggtgcatgaatgtttccccaggctcatgttgggattttgtttgaaatcatctttatgggttttcttactagaaatgatagttttagagaagttcggcaatcttgttactggtactcaagcttatatacacgtgagtaatcttaactttggaaatatcaaccgttttctgtctagaaaaacatccacagttaaaaaccaagtatggtcatagttttatttttagaagaatttcatttgttagaggtattttttctgttcttgttctgtaatataggttaggataccattttttttttccaaacaagtttttgctgttttaattacaacttttaaccttcattggctttgtaatagtatataagagtatgtgagagtataagagtatatttggccaaattgacaacaactgaaaaataatttaagtctgtttacttttatttatttatttatttattatttattttgagacagtctcaccctgttgcccaggctggagggggcagtagtgccatctcggctcactgcaacctccctctcctgggttcaaatgattctcatgcctcagcttcccaagtaactaggattataggcatgtgccatcatgctcggttaatttttagatttttagtagagacagggtttcgctatgttggccaggctggtctcaaactcctgaccttaagtgatctgcccgcctcggccttccaaaatgcccggattacaggcatgagctactccacccagcctgtttacttttaaatcaaactctaatgtttgacatacttcctaaagttagagaaatttcatgtaaagaatacagtattttttctttatagacctgtttaaattggaaaagacttgtgagcactagagcgtaagttgttttctagtgtttctaatcaaattgaaaatggcaagagtgtttacagtaactgtaggagaaagaggattgtcttgtcttataggtaattggttttttcttgaattcttcctaattcttcacccagagaaacctcttatacagtcatgatttgtgtttttgaagactgttgggtgactggcatataataaacataaaacaaaaaactggaatttaaaaccatatggcacaatccaaattttgctatttaaatatgtacatgcttaagtgtaagttaatacgtacaaggaagaaaatatataaaacatcagtgatggctagtcttagaattacagatgaggattttagtgccaatatagctgtagttcagataatatgtcccttgctgtcaattaagcttgaacatatttttaatattaatagtacatatattcctcttttctgcattttgatttgttgcctctgtgcataatctttccgcctatatcctatatgtttatcactgagcattatgttttatttttcagagaatattggtaaggaaatttgtagaaactagataacttttcaatttgtattttttcgtttatgttcatttaaactgttgcttttcatttagattatccagtataaaaacacatatactcatttggattgctattttgtgacttgtttctagaggaaatcatgattggacccatggtcatcaatgtcatggacccttaacattaggcagcgatccgtttatgtatccttagtcaggtgtctgccctattccactatgactatgtctctgagccctgacctcttccttcactctgaacaggtgacctcacttcctctttcatgaagaaaagagaaatgatatgataggtgtgataggacctcccttaactttctgtcaccaaatctgcaaaacctatctgcatcccacacatttacttctctttccctcctgttataatggaagaagtattcttccttctaggcaaggcccagccctctatcttctgccttctcaggaagctggtggtatctgatcttctcccacctccacctctgccttctctgtttattttactttcaacttcttatctgctggctccttcacagtttttagtgttgtcataaatccttcctatcctgaaacaacaaccttctgttgaccccatctctcaactttggcttttcctccatggctagacttcttaaaaaggttgcttatagtcattctctgccttccacctcctaccagttagttttctgtaatcacattttcatactattccaagaaaactgttcttgccaaagtcactaatggtatttttttagccaagctcagagtctgtttgttaattttcatttgctttatctcagcagtgtttgatgttgttggttgcttctcccatcttgtggcattgtcctgttagccctgcagtgctcagtatccttggttttgcttttgcctgtctggtttttatgtgtgtgtgtgtgtgtgtgtgtgtgtgtgtgtgtgtagtcttttttgccagatctttctcctttgtttattccttaatattggtatttcttagggctctgctttcttttttttcacttcactttttaccccctggagttcttgtccatttttatgtctttgtcaagcatttatatcttgacaattcccaatatttttctccagagctccaaacctatatatttgtctgctggagatcctcacttagatgtcttataggagctcaaactatgtatgttagaaactggactcatcagctttccccccaaaaaaatctggtcctctgcattattttattcccttcctgttttggcaagaagaactactcttacttgaaacctgggactcatcgtttggtgcttccttccttctctcttatcccagatagtcggtaacttactccagagacctcagtgtctctcagacttatctgatccctttcatcccccactgctacagcctagaccagactactgcttaaaaactgatcaggccaggcacagtggctcacgcctgtaatcccagcactttgggaggccaaggtgggtggatcacctgaggtcaggagtttgagaccagcctggccaacatggtgaaacccatctctactaaaaatacaaaaaattagcccggtgtggtggtggacacctgtaatcccagctacctgggagactgaggcaggagaatcacttgaacctgggaggtagacgttgcagtgagccgagatcttgcctttgtactccagcctgggtgagaagagtgaaactccatctcaaaaaaaaaaaaaaagaaggagatcaaattgcacagtagtaaccagtttcctgcttttagttttcccttctttccattttctagtctgcagttggagtgatcttttcaaatcacatgtctgatcttgtcacttgcttgcttaaaacctttgtggcttttcatcatttttaggatctttcatttagtttacaaggttctcgataatctggctcctggcttcctcagcactattctgtcttaactctgtaccttcctatcatattcagcatcttagacttcactcaaatgtgcccatctttgtttctttgtattcattccatgccttttgtcttgcagtgtcccctgtttggaaaaggcagaggtatctcccatacctacacacacccagacttccacactcacccatgttcatttcactcctatttgtcttttgactctttgccttaagatacacttcgtgtcaaggcctcccgtgaaactcaagatcaggttaaattcctttgctacttgctcttataacattctttacttcctccctgcattaatcacatttgtaattttgtttttttgtatcttttttgctgtctaacctgtatgctgtataaggggaaggactcttctgtctctttcaatgttgtatcctcattgcctagtatgatgctttacacattggagtggaacagaattctagtatgttttacttctatttttgtcctagaaaggtctctaattttaaaattgaaaattgttggacagaattggacttggcataaagaattaaaattatgggcaacttttttggaaacataagtattccatataattgcataaaatatgtattcttttaagctgtatagataaaaatgaatcacttgtatcagagtcatggaatactttatactagggctaaatgaggaataagagaatgatagtttccattgtagctgacagtatttccaaatgtggttaatcttattcaaagtaaaagaactaaaagaacattgaagacatatgttaagtgaaataaaccaggcactaaaggacaaatattatatggttccacttaaataaggtacctagagtagtcaaattcatagagatagaaagtaaaatggtggttactgggagctggggaagcagggaatggggagctactgtttaatacgtacagtttccatttagcatgatgaaaaagttctggagatggatagtgaatgtatttagtattactaaactgtacacttaaaaatggtttaaatggtaaattttatactaggtatattttaccacattgaaaaaaaaagaacttaaaccaatgaaatacacctaagaaaaacaatgagtagtatatatagtctgcaggtaaaagacaagaagatgatgtcttttcattgttgttttcatttttatttgtttaaatatttcctaggtaaattgtatctatatgtactatagaatagtcattcttaaatcttagagtgatttcttagtgtttctatggatatattagttaaagattactcccacaggccaaacggaacagaaaattgcagctacatttcagtgtggattctgccttaaaaatgagtattcttttaaaattacagttgttggctctgcctcacttaaccattggcatctctgactcattcagcaaatatttattgtgtgcctcctttaaagcaggcactattttgggcagtggaaatgtagcattgaacaaaacagacaaaaattcctgtcttaattgaggttatagtctaatgttcttttttccttattgtaaaaaatattttatttcataaaaatcatttgtgagttctttagcaattttgagtgaagccaaggcatgtaatacaacactctccaaaatcaggagctgatatatccatacccattagctgtggtgtttcttccctcctactgtctccataagttaatattgttttctacagaatagattactatgtaatgcccattaatcatttttaaattaaagttcaaggtttgctaaaagagaccttattagactaatagattatacttacatatttttgaaaacagctagtttgcgacgctgttttgcttttttaaagagactttaatgtcacatctgtatttgtcatttctgaaagactacactgaatcttttctctgccatttatttaagaatagcatgatattggcaagttatttaaaacaggggcgataatacttcctgtgggggaaaaactgctttttcttatattaaatagtaagaattcctttttctttcttcactaatcacagttatttctttataaaagaataacttatattctgttgaatgcataatactattcagcagcttgttcatagtatttagttccttgtattccatactggagcatgccaactatctccctcccatacccctgtattctgtagcccctaggatcaatgtcacgttctcctacctagttggttggtacctattatcttggactcccatgattaaatataaattccttcaaccagaatatctctttctgtatatatttgtcagcttagtagttctacttgatttattagtcaaaagatatcaccttgaataaaaagcatgaaagatgatgcggttataaaagcagccaaaagaataacaaagcagttttatcagcaaaagaaatcagacacttaggaaagcaagaaatggctagagtgtctactgcaaaggaggaaaaccataaatttttgccaagctccttcttttatctacttgtcggttctttatataaatcataattgattttccaaaacactcctgttttatttttgggtaccttttctggggaaaaaacactgaccaggttcttcatactgtttttttttgaggctttacctagctcagcattctctctcagccttcaaaacatgatggactggttgagaagatttgattgataagtcaaagtatactttagaacttgagttgattatcttcttagaacagtttaattgactcagatgaatcattttaatttttaagttaaattttatagaaccaataagtatcctaaatagtatgacatctaattacatttttatttagtgttataggaagattgtagatagatttgtgttgatcattctgggcatttatgtggtaagctgtgcttaaagtaatggccccataagaaatattaaaacatcttaacctttaacctttgatcttctataaaaagcagtagactttgtgtgggatattcaaaataatgcaaagaacacggctgtttttccttaaaattcaaaaacctacttagtattttttaaaaataataactagtaaataaatacggttttacaaattttcatttcagttgcttttgccaagagtaagttatttgacgttggtaactgacaaagtgaaaaagcactttcagaaggttatgagacaagaagacattagtgagatatggtttgaatatgaaggcacaccactgaaatggtgagtgaatttttctgcattattaagcattaagtatatactagctttaaaaaggtatagtgccctgaaacaattgtaaaaaaagtcctgcgaggatagaagtcattagtctagctcatacaatatgtgaagtttagactattactagaatacgttattgaaaatatttctgccttctgtttggatgcatggatgactggacagattcatatatttttagcaatagatttttatatggtacaataagaatatatttggttatgggctattttcagatatatttaaaactcccttatgaaaagtcatctcttgacattattcaattttatttctgacaccaaaatatttataacatctttatatacatgattaccttaagtggcattgttcaaactgattgccatatttagttgaccactgtgccagaaacacatcttaactaggcttggtttagagtatttaaaatatattgatttcctttttacgtgaaaaataaatttgatgttttgcatttttaagaagggtattgaactgataagaacagatactacacgaatcccagcactttgggaggccgaggctggcggatcacctggggccaggagttcgagaccagcctgaccaacatggagaaaccccatctctactaaaaatacaaaattagttgggcgtggtggcacatgcctgtaatccgggctatttgggaggctgaggcaggagaaatgcttgaacctgggaggtggaggttgcggtgagctatcacaacattccactccagcctgggcaataagagtgaaactctgtctcaaaaaaaaaaaaaaaaaaaagggtattgaaatcaaatcctaaacctgtgcttatccatgtactaatgatgttttttggtgcttcctctgttattgggagttttgttcattgtgcttccaaaaatatttaatgaaactggaaattacagagagaagaatgtaaaaaaaaaatagttgaaggtatgctggatgttaatgttgaaatgctatcatttggatacagttgaatgaaaaaaatacaggctaagacagatttaaatgaaacatgaaaaatacaaattggttaaaaatggacttgctctctgaatcggggaatattaaaatgaagagtttttgaaagagctttaggacagatgaaaggaagctacttaggtgtttaataaatgcagctgatgtgaatcaaaggactatttattagcaaggagagaaattttggaactcaccttgtgctgatgagatcccaagaatgagtagatttttcataatggattacaaacataacaaggttgtattttgggtcccgtctctaatcctttgagatggttctgggaatttatgacacagttgtcttgttatagcattctttctttaaatcaaaacaatactgagcttcatgatcatgtatcagactcctctgattcttcttgtgtagttctagacctcacgcagcatagataaggcaatgcttcccatttctttttatttctcaggagaattggagattttggaatgggaaggcgacttaaaggaagtgtaaacagagcaacaattattaaatagaagagtagaatgacaggatggacggggaaacagtgtgggagagtagcaatgggatgtatgtatgcacttgacatttctagctatagttatttacattgtattgcattatatgtattacagattatctcagaattttgtgtgactagcggggcttttcagttttattgtaaagcaggatttctcaatagggtcactactgacattttgaatttgataattctttgttgtggtgggctaccctgtacattataggatgtttaacagcagctctggcctcttcctacaagtgccagtagcacttcctccagtcttgattatcaaaaatgttgccagatgtccctgaatggaggcagaaccgcccccagttgaggaactctggaaaatttgggaaacctcaatttagcttgtaaagtaagtgattgctaagtcatcatctttcagctgctgttttatgctgtccctcatggtggttattcttgtattcaatatggcttatattttataggtttatgggtaaatagtgtttggacccatttctccttgtcactgcaaaacaatgattttggcttaaatattattataccatgttcttactttgtcagtatttatccctttggaaagtcttttattaaagagtggagttcttttcccttttagagagcttatgtgaaagtaattatattcaagtatctttatggtagttttgggggtgttaactttttatgtgttatatcacttccacagttatgtcatgctgtaagctcattgtagctatatgacttttgatgcatcttttcctttagtgtttttaagtactccatatatatgaggcgtgaataacttccagagccataaatgtaatccagggcctctgggcttagtcttgatcttttctctctttgcttccagtaatagcagttttctctcatgttaaaaaatgtatcttcctggaaataggctatcaatataagaatatctggcatttaagtagtgggcttcgcaaaataggatagttctgtgaatttccatcagtggaggaaagcagctaccactgaagtgttggaagacttggacttttgagaccatacaagtgtcttaaggatagagaagcatttatttgagttgaataataacgtccttcctatatttattcttcggagttttaaataagttcaggtaggaaaggaaattagtcgccagttgagacaactcataagtgagggaagaaagaacagaaattgatgtttcttctctctttataaccttgtcactgattctgtccctgaattcaattaagtttgtcttttcataaggtgacagttctcaatgacaagaaaaaaaaactaaagtccttgacaaatcatgactttcatcatactcagttgggaaaaatatgactttatcttcctgttggtaggacatagatgaagagtaccgggggctttgttttttaaacaaatgcttggttttaaagattttttaaagaaatagtacatatagtaaagttagttatagataatagcagaatggagtattcttaaaacaaattatttttcctttactgttaattctttcttactattctttgttcatctacttggctagcagactctgtgtgagaagggaaaaataatcccaagcatataattaatgtggaataaaattcatcttttttttttttttttgagacggagttttgctcttgtcgcccaggctggagtgcaatggcatgatttcggctcactgcaacctccacctcccgggttcaagtgattctcctgcctcagcctcctgagtagctggaattgcaggcttccgccaccacgccagctaatttttgtatttgtagtagagacagggtttcaccatattggccaggctggtcttgaactcctgagcttaggtgctccacctgcctgggcctcccaaagtgctgggattacaggtgtgagccaccgtgcctggccaattcatcttttttggagtatggtttgaagagttttcaaacaattgtgtacagttgtgtagctacttacaaaatcaagataataagatatttaatttcacaaaattccctggtactcctttacagttacctcttccttcccccaactcacagtaattactgatctgatttccatctcagttgttttacctttttcagaatgccatataaatgggctcatgtagtatgtagcctttcgtgtctgaattttacctcgagtaatgtttttgagactcatcctttttgcgtgtatcagtggttttttcctttttgttgctgagttgctgagtatcccactgtatggttataccacaaattgtttattcattaactgatggacattggattgtttccattctgggactatattgagaaaagctgctgaaaacacctagaggtctttctgtgtcaagccacatatattgtaaaagataaaaattaattttgttttctgaatgttcctttattttttatttttataatttaaaaaaattttactgtggagcgcttcacaaatttgggtgtcatcgttgtgcagggccatgctaatctctgtatcgttctaattttagtacatgtgctgccaaaacgagcgtgaatgttcatttttagtatatggaaaatgttattgatttttgtgttctgcaaccttgctgaactcacacactagttctaggtgtttttttggtagatcctttggggttttctatgtaaacagtcttgacatctgcaaatagaaattatataatttttccaatctgtaggccttttatttcttttcttctttttttttttttccttattggagtagctagaacttctagtactgtgttggataagagtggtgagagtggacatcttctggtgttcttaattttatggggaatgtattagtctttcacaattgtcatgaatagatgttggattttgtcagatgccttttctgtgctaattatatgattgtatcacttttcttccttagctggttgctataatagatgacatttatggatttttgatgttggaccaaccttgtatacatttaataaatcttatttggtcacggaatgtaataagttttatacattgttggattcagtttgccaaataatatttcgttgaggatttttgtgtcttatgttcataagagggattgtagttttctgttttttctattgtctgatttagcattagggttatacgggctttataaactgagttcgaaagtgttctgttctgatgtattttctggaaaaggtcgtgtaaaaatgctgtcaattctttaagtgtttgatagatatctttagtgaaaccacttgggtctggagatttctttttggggagcatgttaattaccaattcaatttctttgatatatatagatctactcagcttgcctatttcctcttcattgagtgttggtagtttatgggttttggggagttggtttgttttttctaagttgttaatttatgaacatagagttgtttatagtatttccttgtctgtgaatgactttaggatctgtagtgttgtcttcatttttgtcagctttgttagaggtttaccaattttacttatttttttgaagagccagtgttgtggttcatggatttttctctcctttttaaaatttccaattttgttggtttctgttttttgtttttaataatcttattccttctgctcctttggttttattatttttttctagtttcttgaaaagggacttaggttatttttttgagctcttaccttaatttcttttttaaattgtagtaaaatgcatgtaacaaaatttaccatcttaaccatggtagtgttaattacattcacaatgttgtacaagcatttagtgttacaaatatctatttcagccaggctttagtatagaccataaattttgatatgttctgtttttgttttcattcgggtctgtgtatttttaaaattttcttttgaggctttcttttggaatcttagttttttttagaaatgtgtttaatttccacatttagtggtttttctgttatcttttcattattgatttctagtttgattctattgtagtaaaaaaagagctcactgtaattttggatcttttaaatttgttgatgttcgtctccactcttgattccctcatcatctagcctctagattgtgattctggcttctaagtatgccttaaactccctgctttgtttttcgggattcaggcccatctgatttctcacatggattgttttagtggcctcttaatttgtcttcctgcttttaatactattacttttagtttatcttccccagtgccataatttttctttctgaaatgcagatctaacattgttattgtcctcaagaaccctattctgacttaccatcatctacagtataaagccaaacactaaagcatgatgtgtgtgtaaaggttgtccatgatcccacttctttccaggtctttccaggtgtactaagctacttgttttaatgaatgtgggataatgttttgggcttccgtttctttgctcatctaatttgataaatcttttttgctctttccagcatcctttgttttggttgtaattaattattcattcatatattccctcctgtagctcatacttctaacatctagcttaactatgaccttttttgtggttctttttagcccaaagtgatcatttctacgtttgtgccatctctacactacgtgtgtacttcctatattcttgtcatgttataactgtgtattgtaacataatggttattaaggatgctgactctggagtcagaaaccagatttcaaatcccagcttcatcacttactagcggtataaccttgggcaagttatttgacctttttgtatctcagttttcttgtctgtaaaacagcaatgataatggtaccttgtacttcgtaactttgtttcaagaattaagtgagttaatatgggttaagtatcctttatccaaaatggttgggaccagagtctttcagatttcagattttttcagattttggaatgtttgtattatatacttacagtattccaaatctgaaaatctgaaatgcgaaatgcttcaataagcagcagttcctttgagcatcatgtcagtgttaaaaaaggttcagattttggatcatttttctttgtacttaaaccagcagcatataggaggggataagtaaatgtttgttcagtgaatgaatgaatgaatgaatctaaatttgccccttgcttttatttggaaaaccgagactcaaataagtaaggtaacttgttcaaataagttaggacccagattttgagagtatcagttcagggctctttttaccacacctgctaacattttgtttaaaaatttttctcccatcttatctgttctctctaattgcttatatcaatttgtccaaattagaattaaaaaaatttaagaacagtggtatacttataatgaatactcaatacatttgttgttgtcgatttgtagagagcttacaaggaggttatgtctgattagagctttatctttgcatctttagcttttaaaaattacatgggaaatggaaagtgctggcctaactcaaaatagagtctctttcttcagactgagatgttagtcagcagagggtgctctaacattgtattttaaggggtgaagtttcttattaccacaactggtgttcacattttatatttgttagttttatattagaattatgttaagagaccagttcttggtccttccgaagaatactttgtaagtaaaccctaattttggtttagatcttagaccttcaagcacgaaatttagaacaagcttctcattttgtcaactgtaaaataaataactttaatgggaaatttttctctgcaaattgactttcaggacaggtggtaaaaggaagaagttgaaattactttttgaattgtaaaaaaaaatacatactcttgggctacatgattttggtcaatgatggaccgcatttaggatggtggtcccagaagatgataatctgtatttttatagtatcctttctgtgtttagatgcatacatacttatcattgtgttacagttgtctagagtattcagtgtagtaacatgatgtacaggattatagcctaggaacattaggctacaccatgtagcctaggtacgtagtaggctatggcatctaggtttgtgtaagtacactgtgatgtttgaacagcgaatgaaattgcttaacaatgcatttctcggaacatatccatgttgttaaatgtcccatggctgtattgatgttgatcttaaacatagacatgatagaatgactcagaatttaatactctttgtgatttcaaaagtagattttagcaaaatgctttagtgaaaacctgtgtataattttttaaaaaacatttaacattttaatcataaatgctaacagattcttctgtcttatttccagtctttttaaggttgtgaatttctggaacttaacccatttatgcaggagattaaaattttttgtgtgtgaaaaatcagaccttgtcagtgaccttgaacagtttacataactcccacaagcttagcgttccaataatggaaaactaggcataaaggagttaacaatgtattctgtaaactagatttttgaaatgtgacttacatagattttatatatgtggtatcccttcattatttttgaactttttcatatataagaatgggcttagaaagctgtgaaacacattgctactctatagttgtttgtgtttgtcctacatatagagtaagtcagtattcacagcaatcatcaaattactttggtttgcatttgtagttacatgcttgcagttacaatgaaatgtaatcccgtttccagtgaatcagaatgcagcaactttccgaataggaggcatttattttagtgacatgaacttgggcagtagttctccagtatggggaaaattctttcagtgctgattttagaatacttgtattagtttgctatctgagtacagatatttatactagaatcatgtcccttctgagaatatccattattgctacaccatgtgccaatgtgcacacatgcacaaacatacacacacacataaatggagtaatgaataaaaaacaaaaagcaaagaaatattaaaatatattcatttcgagaattgaatatggaagactagagcaatgtaaagaagaaaaagaacaaagtgtaaaaatagacctaatactgttcttatgcagtcattttctatagggcaatacactgagtctttagctagttgggtcctcttatttacacagaaaatacagttctggataagagttggtgttctgtatccatgggttctgcatccatggattcaaccaaccatggattgaaaatatttgggggaaaaaagcaataactaataataatacaacaataaaaatgaaatcacaaaaagtccaatatggtataacaactatttacgtagcacttacattgtaataggtattataagtaatctagcaataatttaaagtatacgggagaatgtgtgtaggttatatgcaaatactatgccatttaatataagggtttaagcatctgcgaattttggtatccagctaggtccaggaaccaatccccacacgtaccaagggtggaccgtattccaggttcaaatccttactacttgcttttctattaaatttaagttagatggtagaagtagcaacataatagccaatggttacgttatgatttacttagggtatatgtggtttctgtgttgtgggttagaaggcttctcacaaaactgtatataatatctgtttagaagacttgtacaaattagtacttttgaaatccttgatgtaaatcagattaaagtgtaagagaaactcagtacctttaatttttgccagttctgttttcttttatagattgtgttgaatatcagtagattcattagaaataagcaatctgggaaccagtgaattcagatagcatatttgtttggaattaatatctttgcatgaaaataattctaacataaaaatttgtattgaaccgcatgttaattatggaatttgacaatagaaataagtaaatggttatcttactccttcgtttttctggttcatttttatttttaaaaaatcataacaggatgattattcatttttataatatttagaatgtttttatgttaatactttatttattttttttatggagatggagtctccctctgtcgcccaggctggagtgcagtcgcactatcttggctcactgcaacctccgcctcccgggttcaagcaattctcccacttcagcctcccaagtagctgggactacaggtgcatgccaccacgcccagctaatttaaatttaaatataattttaaggaagcatatgtttaaatttatctcctaattcttaatatgccaagacaaaggagttgtcgtcatttaccatctgggaccaatgaaatttaaaaaaaaattttaagattttgacaggctagcgctgggtgcagtggcccatgactgtaatcccagcactttgggaggccgaggcggacagatcatgaggtcagaagttcaagactagcctggccaacagaaaccccatctctactaaaaatacaaacattagccaggtgtggtggtacgcgcctgtaatcccagctactcgggaggctgaggcaggagaatcgcttgaacctgggaggcagaggttgtagtgagccaagatcgcacaactgcattccatcctgggcgacagaacgagactctgtctcaaaaaaaaaaaaaaaaatagattttgacagggtctccctctgttgagtacagatcatgcctggctaattttttttgtagagacagggttttgccatgttgctcaggctagtgtcgaactcctgggctcaagcaatccacctgcctcagccttccatagtgctaggattacaggcataagccaccatgcccagccccaatgaactttaaaatatatatgtgtgtgtgtgtgtgtgtgtgtgtgtgtgtgtgtgtgtgtgtgtgtgtttaagtcattttgcaaataatttagagaatttagaataaaggaatagtgtataacaactttattagaaattttaatacaggtttaagtacagcaaatttacattttcatttcatatttttctagttttaaaggtatctaaaatggtcaacatcccctgaatgcaactaattgctcattaatttttatacattcaaatatacctctgagaggttctagtttattacttctggcccttcttgcatctaatagtgttaataatacttgaagaaatctataaaccctttgccagctcatgatttcattatgaaatattttcttttttatgtgaatcaacaccaattagactgagcagcccagtactttttttcatttctatgtgatctaattccttcagtcttctttttatataaatagaacttttgcatttgcccactatcaaataaatttgtgtaaatagcataaaagatgaaataatattgtcacatgttcttttagtaaaaagaaatggtccaggtttttgtcataaaatatcatgtaatgaagttttttctgttgatgactaagctgttaagattaccatgtgttcctttttgtctttagaaatatattgttcttctattagttcttgagctatggaaaatttaagatatcatctaaagactcagagtttgagatttcacttaaatgatcaatttcactattgtcattaaagtctagagtactgctgtctctctttgtattttgtcctgatttgtctaataattgtgaaacatcttcctctgtcagtttttttctctgccattgttggtagaaaatgagaaacttggaattttcaactgtgttaatgatagctaaaaactgattccagaatggagtctgcttgcttttttcttttttctgagaccaagtctccctctgttgcctaggctggagtgcagtgttgcagtcttggctcactgcaacctccacctcccaggttcaagtaattcacctgtctcagcctcccgagtagctaggactacagacacatgcgaccacgcccagctaatttttgtattgttagtagagatggggtttcaccttattggtcagcctggtcttgaattcctaacctcaggtgaaccacccgcctcagcctcccaaagtgctgggattacaggcgtgagccaccacgcccagcctgcatgcttattttacactttattgaaagatgtttcaatactttaggcaacacataagaaaatgaaagaagggtacattcttctatcatccttctaggcatcatgttattttttcaaattcttactgttttagtgtcttattgggaataattgacaaataatgatgaaataagttctagagtgatgaaatagtaaaatgttttgatacataggaaacaataagatcattaagaccctaaaatatatcttagatttataaaagtgtccagtagctccatgtggtaattactacatggagtaagttttatctttttttttttaaagtgagttttttctgttctttggaatacctttaagaatgaataaaagtcatgaagtgtcaatcattaaaatagttggaactgctcaaaaaagaaactcagaacctaaaattggctccattagatctttatgttgtacctagggttagtctgtggacttcttcgatttatgcattcagcagttgtttattatgtactttgttcaagcttctgtgtatttataattttctcatttttaaaatatttatagttttctcgttttttaaatattgagggttaaaaaaataatttatgattgagtcttatgtttaacttgtattctgatccagatatttccttaaagagttatttgggctggacatagtggctcatgcctataatctcattactttgggtggccaaggtgggagtattgcttgagtccagaagtttgagaccagcctgggcaacatagttggacactatctctataaaaaataaaataattagctgggcatagtggcacatgtctgtagtcccagccactcaggaggctgaggtgggaggatcgcttgagcccaggaggtcaagattgtagtgagctctgactgcaccactgcactccagcctaggttacagagtaagaccctgtctcaaaaaaaaaaaaaaaaattacttgattttatattatagattgctttaagatatatttgttttagaatttgcttacaaattcacaaaagtgtttcacacatttgttaatggcagggaatatgtaaaacactggattgctagtaattttatgtgatctcgagtgaatcttatctaatagattagactattttgcctagcggagttctttgtgttttcagtgctgtttagaatttggaaagcaatatggtgtcacttttgaaatgttaagtctttttaatgaaatccaagtgaataaaactttaattaagtgcctacattcatctttaaccctgttgcagatacctaagagagatattctaaaaaataaattgaagacgttaaaaggtctgttttgtaaaagtataaggtattatttagagcttgttcaattttaatactttagagagaaggatcagaattggattaaatctataacttgtctatagtactatatatgtgtgtatatgtgtgtgtgtgtgtatgtatatttttttttaattttaggttttgactgaggcgagagtttttcctggttccagaattttcttcagtattagtttctggatatgaaaggattgattagagagaaatttaagggatattattaagagatataatgcatataagactaaaagtacccccactgctttatttttaccgaccgggcgttcatcctaaattcttttttttttttttttcttgagaaaaggtctcactctgtcgtccaggctggagtgcagtggcacagtcttggctcactgcagcctctgcctctcgggctcaagagagtctcccgcctcagcctcctgagtagctagggctgcaggtgtgtgccatcatgcccagctaattttttttttttttgtatttttgggtagagacagagtttcaccatgtcagtctcaggtactggaactggtctcgaactcctgacttcaagtcaagtgatccacccaccttggccccccaaagtgttgggattacaggcttgagttacagtacccagcccatcctaaattcctaccaaataaatacatgatctctagaaactgatgacttttccataattctatacaagtaagcaagcataaattatatatacaattatatatataaacatatatctatgtttatatatataagcaaatgtgtactgctccttgcagtgcagggctatcccataagcatcgtgcccagagtagcacaagcataaataatattaactgatatttgaatcttggtcagagttactcattttgagataaatttgatgtgttttcaaattttgcagctcttaaatctaggagtaactcattaatagattatacagataaagacaggactgtgtataacaccaagtagtcttctttttgcccttgttgtgagtacagggtgagcatcccaaatcccacaatttgaaatccagaatctaagactacaaaatccaaaacattttgagcactgacgtgacactcaaaggaagtgctcattccagcatttcagattttcagatttgtgatgctcaaatggtaagaatatgatgcaaatattccaaaatttgaagaaaaaaaaaaaagctgaaatctgaaacacttctctaatcccaagcattttggaaatgggatactcaacctgtattatttaattctgattaaccaagtaagctaatttactttagattttttaaaaggatgacttaaggtttgtccattgaaatctacaacatttgtattagtcatgtttatttattgctaagttatttacttcactgtgggtaatggttatattaggaaatgttctcttattttggaacttatttttttaaatttagaattaggtttcagaagaatattcagtggcttgggaaaatgttgacattatattatgtgaaaaaagttatagtacagtttgtaaaggatagtcctaatctgtatttagatatgtatgtgtaggtagaagactggaaatgtatatgctataatgttaatggtaataaccacagaataggtgatttgcatgcgttttagttgctcatcttggttcttacagttttttaaaattttaagttctaaaagtaaaaaacatatttaaataaatttacaaaaatcaactgtcctttatgaatacagggatgacaattagatgcaacagtactgtgacataacagttcacatggctgataaagaatgcctttgcccacaatcctattgtgcatattgaggtttctatgggaatggagtggttagaaggaaaccacctgatgcctggaaagtagatcatactagcctaggcacgtaactgtagaatgtagtcttcctgtgatttgtgattaaagcccctgacatttggtgttaaaatatgtgttggaaatttattttggccttgtagttataactttaaatatttattttctcaaaatatactgtttcatttttaggcattatccaattggtttgctatttgatcttcttgcatcaagttcagctcttccttggaacatcacagtacattttaaggtatagtaaattgcatttctccttcgtcccatttgtgatacataataaatagacttcgagtagaattttctttttaagtgaagttatttattgcttttcccctgacactgttttagttgctaagcttcgattagtatttgtctataagatacttttcaattttttcctaactcttggcagaaacacttaaacttttaatatatgaactgcttttctttattagtgctgaatacactttttaaaatttacgagtttttgggccagccttggtggctcacgcctgtaatcccagcactttgggaggccgaggtgagcccaggatttcaagaccagcctgggcaatgtagtgagaccctgcctctataaaaaataaaatttaaagttttgaaagttggtgttaatttttaaaagtcggctagaaaaaacaaaaatcttgcatgtagatgtggatatggaagtacagaggggacaacctaatactgttgagtaattctaaggctattttgaatgaattaagagaagggttaggagatagaattccaaagatttgatctacctctgttttgaaaaatgttcattcctgtagtttttaagaccagactgaatttagtgtgacctaattttgtctcattattttatgaagtgctggtccctcattcccttagccaccttgcttctgctctgttcccctcccccaattcacaaacaccatttggtttttgtgattggaaacacttatattaattgattacgaacagtaattcattctcaaatagcaatgattccaccatgtcggtctcttatattagttgatcacgaacagtgattcattctcaaatagcaatgatttcaccatgttggtctcaggtgcttgaactggtcttgaactcctgacctcaagtcaagtgatccacctgccttggcctctctccaatacattattggagagaggcatgtagagtttgaaaaagtcatttaggtgtctgagtttctttcccatcggggtgtccattcatagttactgcccaaaggttgctcattcattcttcatgtgatgcttttccttcctgttttactgaatttgagtttgtgggtcattagagcttatttccgtgtacatttattataatgtgctttgcacaataccatgttattaaacacgttagttaccaaagaacagtacagatagagcacatagtgttggtatgcatgaatttcatttaccatgttacatgcaaagcaaggaatgcttgcatatacaacaatttaagtttagagaggtgtggagataaaactacttcaaacatattaagggtaggggtgctatattgcctaacgagtcttttctgttaatgttggaaggtaattccaataattagatttttttgtgtgtgaaaaataagctctaaaatactttgaaatctagattaaaatatagctgtctccttgtttatttattcactcattcattcattcaacaaatatggagatccttctgtgtgtcgggttcctgaaaccctttcaatggattcatcaggtcaaatctgtttccatgatataataatatcaggatgttattggcccttcccgttgtgttaacatttacactgataatgcaacaacaatggtggttaaaactgtgggtgccttagcacaaagcagggcattgtacctcactgtactagttgtcattgttttctttataaccacacacttagagtaaaaagaacaccagtttaagacttttctggatgtagtagtacaaagtattaattattattaattttgactcttaagtacatgtctttttagtatcctgtatgatggaatgggaagtacacataaagctcctctgttgcatgccaaatatggttgtcttgaggaaaagcacttgcgtaattttttggttgccagctgaactggccacttatttttatgaaacaccattattttacttgaaagaatgattgacagacaaactgtggttgttgagactttgttatttgttagacattttcttgaaaaagaataaagtgaacctctcactgcagggaaaacaagtgatagtatttgttgtcagtggtaaaatttcaactttttagtgaaaatttgaattttggaaaacatgatgccactgtaaacttgaaagctttattcttaaataattttctgatgagatcggtggttattttaacatctgatgttttaaaagtttcatagtgaaagggtcaacatttggaatgcgtaaatcagtgaacatttccagatgaccagtgcttgatgttacaagatcatgcatgtgtaaaaagatccattcaaagtgcaacattagaataagaaatcttaatgtaacagagtagaaaatgttcactggtaatgtttcagattccacattattattacaataaactggatgggcatgatacctcacacctgcagtcctggcacattgggaggctgaggcaggaggattgcttgagcccagaagtttgagaccagcctgggcaacgtagaccccatctctacaaaaagtttaaaaattagctgggcgcagtggtgtgcacctgtagtcctagctacttgggaggctgaggcaggaggatcgctttagcccaggaattcgaggctggagtgagccatgatcagacaaccgcacttcatcctgggtgacagggcaaaactctctctaaaaataaatgaacgaatgaaagaatgaatgacagggcagactctgtatctaaaaataaaataaaataaaataaaataaataaaataaaataaaatagataaataaaataaaatatataaaataaataaaataaaataaaataaaataagccaagtatggtggcatgcacctctagtcccagctacttgggaagctgaagtggaaggatcacttgagcccaggagtttgaggttacattgagctgtaccactcacagtgattgcactctatcctgggtgacagagtgaaactctgtctcaaaataataataatataataaactgaacttgttaaatttggtgtagtattgaagaatatccacaaagccaaaaaggctattaaaatacttcttttaaactacatatctttgtgagcctgaattttctttatatacttcaaccaaaacaacatattgtagaatattgaacatagaagcaagtttaaggtaatccattggttgtctattaaggcattaaagttatttgcaaaaatacaaattagtgccagtgttcctgttttttttgttgttgttgttctgggaaacatagttgatttttgtggaaatacaattttagtgttaatgtatagtggttttattcttggtatttttaagtgaattaatgttttttttaaatgtttcagctctaatttctagtgtaaatatcagtaatataatccacataaatataaactctttgggatccttagtaggtcatacattttcttcccagtagaaaagtttattagcaaatagaaaaaagaatcttacagttaataaggaaattacagagaacatttagagtttgttcaagctatcagtgtgtttctttcagctgttcttacttattcttatcctggcctgttagaggaaagttattgcccagattttttttttttctgtatatactaagttccattcatttaggggagcatcaggacctaggttacttcaaaggttgtcttcacatgtttaattgatagcttgtactgattgatgtaggcctgcctctattgtactgccttatagatttttgattgattataatgaaactgggtaagtgttaattttcaggcagaaaatcaatgcttttagtgaggaagtggtttttaaagtttgtagaaaatagtttatacattcaacagattggatgtattgagtaacaattttgtgtcacttggtgtctctgcatttatcttctgtggtgttgtattgagtatgccagataatgttgatgttttaaccagacttcttagaatttcttttacaattgttttcaaaggttgtaatagattttgattagatttttttgtgcaatatcaaagcttctaagagatcctgttgcctctgccacacacacacacacatttggatcagtagttcagactaaactcttcaaaaaaacactgttaaacagttttcaaacagacatatttcctctaatttttaactgactttgatgtttgtgatttgtataggtttataatgtttataataaatgcattttaatgtctacaatagtgattttcaaactttaatgtgctttcaagttacctgtgtctcttactaaagtgcagtttctgattctgcagcattgggttggattcagagagattctgcatttcttacaagtgcataggtaatgctatgatattgttccaccagaccacatgttgattaacaagagttagagaacaatgaagatctaaaagttaatggtaattgtctgtagaaccaaaagcttttaagggtgaatcagaaaattaatatttttataggcatttttgtattttctattttctgggagataaatataattgtagagtgttaattgctttataacatatagatttggatgtatgttttgtttaccaaaacaatgaaaatggtaccttcttcaagcttttctcattggtttttaaggacattttgattcctaaacttggtgagactaccaagaaaattatctcatttctgtgtccccagttttttatattaaaaaatttaaacatatattagaaaaattaattgtgcggcagggcagtgactcatgcctgtaatcccagcaccttgggaggtgaggcaggtggatctcttgaggtcaggagtttgaggcctgcctggccaacatggtgaaaccctgtctctactaaaaatacaaaaattagctgggcatggtggtaggtgcctgtaatctcagcttctcgggaggctgaggcaggagaatcgcttgaacctggggggcggaggttgcagtgagccgagaccatgccactgcactccagcctgggcaacagagtagactccatctaaaaaaaaaaaaaaaagttaattgtggtccagtgaatactcataatacctttcacttggatttgctgctttttaacattttgccacctttgcgttttctctctgtattttttttcattaattctataggcatgctgcttgcaaagcgacattacagttaaaagattacttacagtatgtagattttttaaaattaaaaaaattttttctctctttgtccatgttgagaacagtgcatggaatttttaaaaaaggagttaatgtgattcaaaagtttaatgacatcaggtgaaaatagtggggtctttaaaatgcccagttctgttgcaaatcctaaataaagtttaatagagtaaacaaatcctataaaaccttggtgtttttctttcttcctcttggtaacatggtgctgatttggtgcgttttggttttgaggagaggagacattttaattttgaatgttgacagcaatgattaagggtaagagctcacatttgttaagtaaaataagatcaacattcagataagtgcttatgtgctgaactctgctgaatgccagagataacacaagttaggtttttgaaccaactgtctttcaagcacagcaggcaaatcctgttttgcttaccatgcttgaaaaagccctgcattggtcctgactgttccttgagtatttttgtgtgactgagcaagcttcttttctgatggacaagttttttcttgctaggccaagagccactgtgtttctttgaaggaatttatcatgtccctcctcctgttatgtgttgttgacataggtctgtggtagcttttctttcctgaagttcttgagtgtatttcatggtctctcctttgcttctatcactgcctgcacttcccagctataaatgttggtagctgttttatagtatctatcaatagtatgttgtattagttatctactattgtctgacaaattaccaccagcttaaaacaacatttgttctctgacagtttctgtgggtcaggattctgggcatagcttatacctggatcttctgcctaggttatgagggtgccatcagggtgttggctgggctgcgttcttaactggaagttcaactgagggagaatccacttgtagacttagtttgctggcagaattcatatcctatggttgtaggattgaggggcctatcttcttgttggctgtcagtaataagctgcattgaccacctaaagaccatgtgaagttcttgtcatgtggactttcccaacatgcctacttgcttcagggcaacaaagaaagtctagaggtagtctggtagtaagacagaatcttactgtataacatgacttaatcactggggtaacatcccatcacctttgccgcattctttgagttagaagcaagtcacaggttctgcccacatgcaagggggaagggattatagaaagataggaataccaggtggtggaaatcatggagggtcatgcaaacttagaactttatgaagtaaggcttgtttagtcatttattcatcagatatttattgatgttaacatatacttttagccgtgacagagtaactggtatttgagttttcctctagtcatcaacaattagaaaacaggaccaaaaatatgaaatagagctgtttttagcactgaaccttagaaagggaacaaacaaggtgagccccatgtgctttggaacggttgcctgacggtggtacggagagtggagctcaagcagagcaaagaagttcagttgagctgaggatgcacaaattggagttctgggctgctgaagtggttggaacttgctaggcagggtatcagagaaggaggagccaaagtgtacgtgtatgttctccctgggtgcttggctgaggcctgggttgcacatgcatagctgatactctgcaaggtctagtagatagtggatgttgtagggttaagagtggacaaaagatactgaacgtcttatgatgctgggaaatgttggattccagctcattcaaagtggagagacatctggctacatactaggcagttacttgagatgccagaaaggccatgattttggagtaaggatcatacatcagagcaggagttggcaaatgtggtccactgactgtttttgcatggcctgtgatataagagtagtttttacatttttaagtggttagaaaaaaatttaaaaaaatattttgtgacgtgaaaattgcatgaaatacagatttagtgatgaccataaataaagttgcattgaaatgcatccactcatggaaattcatatacatattgtctatgactgctttgcggctacaacagcctagttgagtatttgggatagagactgtatgacctgcacagtgttaaatatttactgtctaatcctttacagaaagtttgccaatctctattgccagtctttaaccctagagtaagagttgctctggacctgcctttttaggattaaggagagctgccagtaagttaactgccagccagaacaaaacttagcatcttaaaggaagacagtataatctagaatccttacaacatattcacagtgtccaccatacaatcaacaactacttgacttgcaaataagcaagaaaatatggtccatatcaaataaaaaaaaattttactctcaatagaaactgacctaagagaatccacatcttggtactaccggaaaaatgaattaaagcaactattataaattcagtaacttaaaaaaaccacaaaattgtagaactgcttagaaaaatatctgaaatgaggaatttactacatgggcttaacagcaaattaaagatggcagaagtaaggttctttgaactcaaagacagatcgatagaagttacccagtttggagaatagagagatggaaattggtatagaggaaaaacagagcctctgggataatatcaggcagtctgcatgtaattggattcaaggagaggagagagaatgggtcagaagaaatatttttaagaaataatggttacactcctcagtgtcaaagctataataatcaagactgtgtgtgggttgcctacagaaagggagaaaatatttgcaaatcatatactatctaataacagtttaatatacggaatatggaaataacttgataataaaaagaaacccaattaaaaattagtcaaaggattcgaatagacatttctgtaaagttctataaatggccagtaaacacatgaaaagatgttcagcataactggtttttagggaaaagcaaaaaaaaaaaacaaaaaaaaccccacacaacgagttaccccttcacgccctctagattggttatcatcaaaaagatgatgtacaaggctgggtgtggtggctcatgcctataatcccagcactttgtggggatgaggcagttgtatcacttgagctcaggattttgagaccagtgtggtcaacataacgagaactcatctctactaaaataatattttaaaaaatagcctggtgtggtggcatgtgcctatagtcccagctatttggaaggctgaggtgtgaggatctcttgagcctgggaggagcagtgattcctgatggcatgtctgcaacccagcctgggtgacaagagtgcaaccctgtctccaaaaaaaaacaacaaaatacagaaaacagtaacacatgatggagagggtataggttaattagacccttcacacgttgctgatgagaatgtaaaatggtgtagcctttttggaaagcagtttggtatgtcatcaaatgatatacttaccacattacacagcagttctattcctagtaatattcccaagagaactgaatatgtaattctgatatgcaaaatagggaaataacttgcgtccacacaaaagcttatacatgaatgttcataataggcaaagtggaaataacccaatgtccatcagctgatgaataaacaaaatactgtatgtatccttacaatggagtataatttggtcatgaaaaggagtgaattactgataatatgctacaaccttgaaaataccatgttaagtgaaagaagacacaaaagactgcacattatataatgcatttatattaattgaataaataactttgtgccaataaatttgacagatggacaaattcaatgaaaacacaagtcaccaaaaccgacataagaaataacagaaatgaatagctgttgataagtaactttgatttgtaattttaaaagcctcagagagtaaaacaccctgcacagatcgtttcattggtgaagtctataaaatacctaagaactagtcgggcgcggtggcacatgcctgttgtcccagctactcagaagactgaggtgggaggaacgcttgagcccaggagttctgggccgtagtgtgctatgccgattgaatttccacactaagttcagcatcaatacggtgacctcctgggagcaagagaccaccaggttacctaaggaaaggtgaaacagcccaggtcagaaatggagcaggtcaaaactcccgtgctgattagtactgggagtgcacctgtgagtagccactgcactccagcctgggcagcataatgagaccctgtctctaaaaataaaaataaaataaaatatttaagaaataatattacaaactttacaagctttgttactctgtacaaactttttccagaaatgagacacttgccaacttgtgttagaggccagaataaccctgatactgaaacctgataaagacattaaaagaaaattataagccagtatatttcatgatcatggatgcaagagccttcaacagagtactagcaaattgaatctcgtaataattaaaaaggatggtacacaccatgactgagttgagtttatcctaggagtacaaaattgattcaacattcaaatctcaatccgtgtaggccaggtgcagtggctcatgcccgtaatcccagtactttgggaggctgaaccaggaggattacttgaacccagaagttcaagaccagcctgggcgacatagggagacctcatctctacaaaaaaaaattaaaaaaattagctgagtgtggtggtgtacacctgtggttccagctactcaggaggctgaattgggaggatcgcttgggccccagaggttgaggctgcaataaggtgtgattgtgccactgtgctccagcctgggtggcacagtgagaccctctcaaaataaaaaaatctcaatccatgtaaatcacagaataaaatagaaaaatcaatagatacagaaaaagtcattcatggacagaatttaatacgtgtttgtcatcaaaacttatagcaagcttaggaatagaagggaatttacttaatttgacaaaggatagatatgaaaagcctacagttaaagtcatgctacatgatggtttatcgaatgttttaccaaactaagatcaggaaaaaggcaagaatgtctgctcagtgtaagcacttccataatgcatcgtatgtgttcttaactttgctattaaaaattgtacagtaaaaaccacaggacttttggaggaaagggttacttctggggcaaagggttaggggcacaacatccacaaacttacactgataaaaaaacaggaacctagtaaaaaccataccacagttttacacaggtaaaatgtatgagaaatgcataaatactacaataaatatggcatttcatgttgcaaagactggaactttgcttgcagaaatggacatagaagacttgcgccgtgacaggtgaagtgaaaggaggattttctggaatcggacaagaaattgtagcacctgatgtagatgagtacagctcataacatgaattgaagtagctggtccattttggaggtgtgcacatgtgtgcattgtatgttttcctagctgattggtttagctaggtgaaattttctgttcacctagcaattcttgtgaacagtatttacatatgcaaccataaaattcacattatactcaacttgttctctattagttgcttttaaacaaatgcaaaaaaacttagttcacagaacatatatgaatttaccaacaaacatgaaaaggcactcaacatctttagtcatcatggaaatgtaaattaaaaccacaaagagacattacattacactcactagaatgactaaaatgaaaaagattgacagtagcaagtttgaggacacggagtaaccagaactcttatacattgctagtgggagtgtaaaattgtacatcatgttgaaaaatagtttggcagtttttaagtaaagttagaacatacacttactctatgacccagcatttctttttccagctgtatacccaagaaagatgaagacgtgtctataaaagacttgtgtattaatgttcatagcagctttttaaataatagccagtatctagaaacaatcccagtgtctattaacaagtttttagataaacagattgtggtgtattcattaaatggcctgctactcagcaacaaaaaggaattaattactgatatgtgtagtaacaggaatgaatctcaaaaatatgctaagtgaaagatactaagttacataatactgcaattctgtttatatgagattttattacaggcaaaactaatctggtgttatgtcattatcagtaattccttgggaagggaatgagggaactgactgcaaagggcacagaggaacttttgtgggtgatggtaatgctgtatacttgggctgacagttactcattgtcaaaactcatttaattgtactcttgatttctgcatttcactgtatgtgaatcataagtttgacttttaaaaaagtttattgagagagatgaggaatggtatctttaatcactttcaattaattcctgctttccatcagtgtttcatagtcactcaggagcttctttctttatcttttcatttcattctttttatgaaggctccatgacagggttaattgaatgttgtttgtgaatacagtaaccggagtaggctataactaaatgctgtttttttgccatttttagctccttttaaatttattaaaggacatataggataataactttgtaaaataatgtttgaatataatgattatcttaaatatttaagtctttggaggaagtgatattgtacagtggttaaaatgtaggacttgagtcaaattagccttaaatcctagccccatgactatcaagctgaatgacacttgcgacttgagacattccctaagctttaatttttttatctgtaaaatagcaataataataatgtttacctcaagtgttgttaggattaaataagataatccatataaaaagttttaatacggtgtcacagtaagtgttcagtaactgttagctgttattatctttttttcagtgaaaagtgcatcagtcgtctcatttacctaactccctatatgtccaatgatcattgctttagctgcctaaaagaatcagtgaagttatagaatgtaaatttagctatttgactttaaaatctacttttttaacagctttattgaggtctaattgacttatagtaagcttaacctagtcaaagtgaataagtttatgccacaatttatatgttcatttacctgttgatatttagatttgttttctgtttggggctgttacaaataaaactattgtgaacattcatgtagcaagtccttaaatggacatatggacataatacttttttcttttctttcttttttttttttttttgacataatactttcatttctcttaggtaaatgcctagttgtggaatggctgggtcagatggtaggtgtctgtttactcttcttaagaaactaccagacttttccaaagtggttatactattttacatttctgttagtagtgtgtgagggctccattccacatctttgccaatattggtatggtcagttgaaaagctatttttcagattattaccctttgatgcctttttttcatgttgttataaaacacataagaattatttgggaaaagtacaaaatgggccaaatagctaaagatttttaagttaaattttaaagtattttgggttatttcagtgctaagagatagtttactagaaatattgaaaaactgggggatatagttctcttttaagaggttaattttgtaatgtgtgtatcctgttttatatgtatattttttcctttgatagagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatggtaagtataatagtgtttaattttagaataccactttataaaatatgatacagccataaccctgtgagtagttgatacattttagaattggtggtacaagtttaaattgtagcctctgtgcccagatttgcacagaagctacttttagtcatcccttacattctgctcttttggtgtccctctgttcatggattctctagcattagactgattgctcagcccctaacatatggcatatgtcatataaacttgggtatagcttctgaaggaaatgccattactctaaggatgtggtctttattccttagtcatgacccttctgtggtcacagtggaaaattctgggtatgtacaaagatacctccacgtgtggggattgaactccaacctctgctttctcaggacagtagacttgctttgtgcttcaattccctttctccttgctgtggtttagaaaatactcccaaggaaaaagctaagtggaatgtggtgctcatctctgtatccctcatattttggagaatgtaaataactctgtgatcttgcctgcattgatcaccctctagtgccttcaaacagttattttatgtacagatagtcctccctttccatggttccagtatgcatgaatttcagttatcatggtttagttaagtaacaccaggtccccaactgtatggttcaaatttcaattactgtggtatattaaccgcagataattacataaaatgcaaactttattgctagtttagtccaggaatcattacataacaacagatgagcttatgatcggtgataaattatgtcacttctttccatgtctgtcagtgattggcctctctatgtctgttattcattttacccacagatagcaaagcacatagtcgtgttgcctccttgtctccagcaataagcccatgtaacattttataaaaatggataattgaaaaaagggaattggccaagagagatgtaaatccaacaaagaaacaaactgataatgttgggaatgaaatttgaatagaaagaaatggagttatggaagcaatagctgactttggaaatgttgacatggctgcccttcaagagactagattatgcagccaggggaacttactgaggaacttatatgcagtaaaggtgaacttattgacataaataaggaaagtagttgtgacaaaaggatgaagatgtcccaaaggaagtgatgctataaaaaatttcatattaaaggaactctcagatattttatgacattgaaatacaaataataaaatattagaagttgattaaaatgtagaaaaatgacttcagttcaccaaggcatgggaaagatgcttgcccataagttatatgttgagaaagcaagcactcttcaaactatagttcttaagtttttacaaagaaataaaacatttttggctgggtgtggtggctcattcctgtaatcccagcattctttaggaggcccaactgggaggatcacttgaggctaggagttggagaccagcctgggcaacatagcaagacctcatcactgcaaaaaaatctaaacattagccagggcatggtcgcatgtgccgacagtcctaggcaggctgaggcaggaggattgcttgagcccaaggagttcaaggttacagtgagccatgattgtgccaccacactccactctgagtgacagagtgagaccctgtctctaaaaaaaaataattaataaaatttaaaaataaaacagttctcagtgtttctaatgtgttaaattataagtactaaataaatattaggatttcttttaacttgttattgttcagtatacatttattgtggtgttttgttttgttttgttgagacgaagtttcactctgtcacccaggctggaatgcagtggcacaatctcagctcactgcatcctttgccttccaggttcaagcgattatcatgtctcagccttctgagtagctgggattacaagcatgtgccaacatgcacagctaattttgtgtttttagtagaaacagggttttgccatgttggccaggctggtctcgaattcctggcctcaagtgatctgcccgccttggcctcccaaagtgctgggattataggcatgagctaccatgctcagcctctagtgtatatttataaccaacggtaagagtttttaatgttttgacaaaattttttaaagattgtggaacaatcgtaattgtccccattagttattaagatcactttgcttagttttaacttgcatgattacttctgcagtcccatcctatgatgcaaagtgagggcatgtcctgtaattcctgtgtcttcaacagtgtttttggccagggagttagtccagtagatgttctttcatggcaatgactagaataaaacagaagaaaaccttcacctgccataatttttaaaaactgtgatctagttttaacttttggactatgctattaccacatcaaatgggtgtttgtaggtatttagtatttgttaaactttccttttacaaaattagggcatttctgtggtatcaagagcaagtaaggcatgcattttatgacagtgtatactgtaaattacattttttcatttctcatttctttgttttaaaatttttagattttacctaggttacatggagtcactccttagtttcatatttatacatctggcatttctcaactaggttataagctttgcaaagttaagcactaggccccgtaccacatttttattactgagttcacaaattcttattaaatgattacaataatttacacctccttaagaaggtgtagtgccttgtttcttgctggtgatttgaagattaaatgatattttaggagacttgtaaataagaagatagcctaaatagaaaaagatgaggatcgtgtaaagagagaaggatttgagttaacttcacaattgaagttaataatttaattagacagttaagtaggtgttcttagagtctattgtgaatggctgagtctgttaaaaagaactcaggggttcagcagaggattctaaaactgatttaaatgttttatttggggcattggaagattgggtatggaggataatgattaagtgttagaagaacaacaaaggcctggtttttagtttcaggtcttagtagtccttaggtcaagtcaactgctttgagcttcagtttcttttttttttttttttggagacagagtctcgctctgtcgcccaggctggagtgcagtggcatgatctcggctcactgcaagctccgcttcccgggttcacgccattctcctgcctcagcctcccgaatagctgggactacaggtggctgccaccgtgcctggctaattttttgtatttttagtagagacggggtttcaccatgttagccaggatggtctcgatctcctgacctcgtgatccacccgcctcggcctcccaaagtgctgggattacaggcgtgagccaccgcgcccggcccagtttcttaatctataaaacaagagaatatctgttaggtttgcttcattgatatctgtagaggccttatgaaacactaatacagtttgtgtgaaagtatttgaaagggagtaaagcggtcttgatgaaaagagttagtgagaagtcacttttagattccaggagagggctggcaaatacgatcatgggccagccatctgcttttgtaaataaagatttactggaacccggccacactcattcacttatgtattgtcgttggctactttcggtagcagagttaaatcattatgaggagactatgtggcccacaagcctaacatatttattgtctggccttttaagaaaatgcttgtcagcccataaaaggttggttaaccaagctacagctcatgtttatctttgacctgaagtctgactcaaaatgttacacattcagaactgggtataacataatgtagctgacttagtctaataactgcatttattacaattttttggggcataaaattactttttttctatttctgccttggctcatattgtttcttatgtgactgttgtaaagttttctttattaaattttattaaattaattttaaagtgacgtttgattaaatccaacttaataatgtttggttaaaatatactttattccattttgtttttggttataaattatttttgtagctattatgtttggttttatttgtgatgattatgaataagcttacactactgtaattgagctaacatacttctaagactgagtagtcttgtgagagatctccacagcaaagtctaatgagaggtatgctgtggatactggagtccttggtactttattttctgtttattcagaatgagaatattcatttcggaaatctttagcttggtaaatgttgcttgtagaaaatatattttggagtaaaatgctgaatgttaattaatgtaaatgggtaaaaggtggatgttttctattctgtttcttttatcaggaatacttttttccctttaactcctactgatgctttaatgctcatctcagttgtcactttctataagaagctttccttcttttattgttttagtcaacagatatttattgagcaccttgtgtatatctgacattatgctaggggctagtgatcatccagcactgatgggacaaacatggctcctgtcttcacagagctttatagaaaagtggaggcagaactgttaatgctttcaactttcatgaccttttgtccatttaggcatttttttctcttgtattttatcacactctggtatagttatatggtttatgtattttgctggcctatcagttagcctggttggggtacatcttacatttttgtatccccagcacctagtgtggtctttggcagagagtagagaaactaaatattaactgcatgacttctttattttattcctttctaatactaacaggaaataatattaacaatttttcataagtagtttcctattaaactaaaggaagtgtcttgtttgaatttatttatggaattggattttatgtagagttttttcttccaaaagaagtttttattaatttgtgaagtcagagatattaaacctttctgttagtgcaattgtaaatttctcaatattgtgacataatagatggcacatttatttcatttagaactgcacttgtagattataacagctaaacaacagtttaaacaatttttgaatactttcaaatgctaattttaatttctcagaactctgtgaaagagaaataagaaaagcttatgaaaccaagaaaactcatttaggacatactgtgcctttcagtgttttttttatgagttttcattttatatataaaaatatttaacctctctgtgaaataaagttaatggccacaagaaataaaagaaagtagcatttttatttatgagcagttgttactgcaagtgcaggctattacctatttaatatcaagttgtttttcttataagctagtgatttgaggaaatctataaaaaatgtttttaccatgacttagtttcttgcttttcggagtatacaatcccaaaaaggcggggagggttggcattagatacgttctgtagacctgcaaataaacgcaaggtttaactgctaatatgttaaaagtgtacagtgtttctaaaatgtggttaggctttttcaactaattaatattttagagacaataattatttgatagtgtgccattttaacttaaaactggtttttaagaggagatggtgattagctaatggtaattttataacaagtcacgacatttggaaaatacttttgtttggtaggtaacataaaagttaaatgcagccgttccagctctttggaggtttgtgtgatatagactggtgggttgtcattgcattgccttgtttttactacttctgcttatagtagaataagtagactgagaaattattgttttgagatggagcaccagacctgatctatttatttattgctgtgtctcttatcagttgtatgatcatggcaggtcacttttctctctaagctggacttttctttcttttcttttctaccccttccccaattcccttcccttcccctaggtgatgtctgtaaagctggagttttattacaaatacgaaggtggtaatgcctcataagactcaaattcaaggattgtaaagcaataatcacatacaccttaattctgatgatagatgttttcagttcatttcaaaaggacttcctgggtgaataatatttattgttctcccatccccctccttctcggtctttttaagcaggacttactaggtagaaggaaatagataactttccagaaataactgtggtaacatagaaaaactactaaaacagaaacaagagtttttagacttgatgcagctactacctgtgtatctattttgagtctttaatttctgtgttttttgttacagtgtcaggttctgttgtagttgcaggtggtgtaaaagtagattcctaagtagaactgtaggaggcataactactcttcttgaaccttttttctcattgaaagactgatattggataagcttccttttttacagtctttagcaaaattcagatttttatcagtctttggaacactgagattacattgtataaataagagcaaagaaaatagtagaatgaatctatatcggtcactcagtctcatctgttaccagtatatggccagccttgtttcatctattatttttcattccttgtctgtgtgagtttttggaaatttttctttcttccattgccacaaatatttctcacagattttatactctcatgtttaatcaagtcttggaaacaacattcattgtctttgatcttcatggctgcaaattcagtcttcattataggagaatcatgcccggaccgtagtagtgtggattagctagccagtataagaacctactatgtgccagcctctgtgctaagcacaggggacgctggggtaaatatgacaggcacgatcccttccctctgaatgtgtagggtagcagaggagccaggcattaaacagatcacttttacgtaattgttacatttataactggagttgtagaggaaggaggaagggctagagagagtggtgtggttgtgatgaaagttgtttcaggctgagggaatgatctgggctaggttcagaagcaaagagcctactaagttctgagaactgactagaatgtggtgatcaagatcgagagtggtaaggaggtcaaactggaagtcaggcagagacgctgcctgttcagggctttgtaggccattttaacaatattgaacttaatccctggcaggaggaacagagagtgggatggtaggagaccagtgaaacattttaagcagacctataacagaatcagatttccctttttaagacatccctttggctgcagtatggttaatgaattagaaagaagcaaatgggaattgaaaaggaccaagtgggagtctataccagtggtcatatcagaccagtggtctataccagtggtgatatgtattatgtgtcctatgatgatgagtgccatgagagaaaaagcaaaggaagatgagaaaggactttgttgggaaagggcgttgttattttaaataggatggtcagggaagtcctcactgattggatgacattaaatgaagacctgaagcagtttaggagatcatgcatatttatctgggattaaaaacttcctaggcagagggaacagcaagagcaaaggcactaaagtgggaatattctaggcacttccagagaactaatcctatgcatagcttttaaaagtgtagataaacacaggtttttcttcaaggatacccttctctatttcccaccatttttttttttaaagcattctgtgtagcaaaaatggcacttgtctatatctagttcttgtgggatgcaaagcatttttttggcagttggttttatgctgtttgccattagcaattatcatgtcttggatgaacctcattggttatgatattgccagtacacaaagcttcgtttatactattttgaaagcaataaagtgctgagaatattgaccaattagaattggacctgtttacattaaggtgattagggaagacgtctgattattttcacaatctagcggctagagagtccaagaggaaggtgcctgcaattcagtgtctgatgagggccctcttcctgattcatagctatcttctctttgtgtcctcacagactaaaacagagctttctctggggtctgttttctaaggacagtaattccatttatgaggactccgcccttatgacctaatcagctcccaaatgccccaccactttatctatcatgttggaggttaggatttcaacatgaattatagggggatgtaaacattcagtccacaataggtatgttttgagaagtcaaaagaagataagcatgtcttaggtgtagtgactgaggaggaagtgtggcccgagatgagtttggagagatgagaaagaaccaaattatctaaggccttgtaggccaaggaaaacaatttggattttaagctattggaggacttttaagcaggggagtgatgagatgtagaatatgatataagagctgttcaatgtagaatggaataggagtccagaatgaaagtggctctagtaatagtcttaggtataagaatatggtgatatttagggtgatgttgggagagatggagaaaagtcagtaaatttggggcttattttagaggtagattggcagagcctgttgttaggctggatgtagaggatgggttaaaaacaaggaaggaattattcctgggttatgatttgggcagctgcatggagagtggtgctttatactgagatatgaaatattagataatgagatgggaagtaaagcctatttgagaggccatcttggaggctaaaagtttgagatgtctaatgaggcattcatgtagagatacactgaattagattttgctaaaattaaatattgtgagtgtgggacagcagatggagaatgcataatagactagaatctaatgctgcagcttctagtttcgtactgtgtttactttgcaaattagtataggaattttagcttcaggaatatggcagtgaatgtgtcacagtcatacaaagcaatgaaatatggagccacctcatttatgtttgctttttttgtacatatagctgagctaattaggtcatttttgttattattattatttgcctgtagtacgttttgcaggaaggtgaataattccaacctgaaactctgtgtgtggcatttaagaatctacaacttcgtgagaaagttgcttaaagcaaatttgtaacctgcttgagcattcaattaagttttactatggaacaaacaagcattttactatatatattatatattttaaatcagtctcttggtgttctttctgtaattaaaaataatggtgagatttttagagttcatgcatttgcattttaatataaagcagtaaaaaatttgctaagcttctggagaaggattgctcctgaaattacttgatttaagtgaataaattaactttgtaataatttggactatagccttctacagtgttttgggtagacttggcagtgagtatcatggataataaaacttggtgaaacatttaggcagttatttcgcagtgcaatacagattatactaatgagaggtgacagcgtgctggcagtcctcacagcccttgctcgctctcggcgtctcctctgcctgggctcctactttgggggcacttgagcccttcagcccaccgctgcactgtgggagcccctttctgggctggccaaggctggagccggctccctcagcatgcagggaggtgtggagggagaggcgcgagcgggaaccggggatgtgcgcggcgcttgcgggccagctggagttccgggtgggtgtgggcttggcggaccccgcactcggagcagccggccggccctgccggccccgggcaatgaggggcttagcacccgggccagcggctgcggagggtgtactgggtcccccagcagtgacggcccaccggcgctgcactcgatttctcacctggccttagctgccttcccgcggggcagggctcgggacctgcagcccgccatgcctgagcctcccaccccttccatgggctcctgtgcggccaagcctccctgacgagtgccgccctctgctccacggcgcccagtcccatcgaccacccaagggctgaggagtgcggggcacggcgcgggactggcaggcagctccaccagcagccccggtgaagccagctgggctcctgagtctggtggggacgtggagaacctttatgtctagctcaggggttgtaaatacaccaatcagcactctgtatctagctcaaggtttgtaaacacaccaatcagcaccctgtgtctagctcagggtttgtgaatgcaccaatcgacactctgtaactagctactctggtggggacttggagaacctttgtgtcgacactttgtatctagctaatctagtggggatgtggagaacctttgtgtctagctcagggattgtaaacgcaccaatcagagaatggaaaacttttattttattttactttaagttctaggatacatgtgcagaaggtgcaggtttgttacataggtatgcatgtgccatggtggtttgctgcacctatcaacccgtcatctatgttttaagccttgcatacattaggtatttgtcctaatgttccccctctgcttgcccccaacccaccgacaggcccccgtgtgtgtgatgttcctctccctgtgtcccatgtgttcttgttgttcagctcccactaatgagtgagaacatgtggtgtttggttttctgttcctgtgttagtttgccgaggataatggcttctagcttcattcatgtctctgcagaggatacaaaatcattcttttttatggctgcgtagtattccatggtatatatgtgacacattttctctatccagtctaacattgatgggcatttgggttggttccaagtctttgctattgtaaatagtgctgcagtaaacatacatttgcatgtgtctttatagtagaatgatttataatcctttgggaatatactcagtaatgggattgctgggtcaaatggtatttctggctgtagatccttgaggaattgccacactgttccacaatggttgaactaatttacactcgcaccaacagtgtaaaagtgttcctatttctccacaaccttgccagcatctgttgtttcctgactttttaataatccccattctaactggtgtaagatagtatctcattgtggttttgatttgcatttctctaatgatcagtgaagatgagctttttttcatgtttgtttgccacataaatgtcttcttttgagaagtgcctgctcatatccttcgcccactttttgatgggtttctttttttcttgtaaatttgtttaagttccttgtagattctagatattagacctttgtctgataggtagattgcagaaattttctcccattctgtaggttgcctcttcactctgatgatagtttcttttgctgtgcagaagctgtttagtcactctgatgatagtttcttttgctgtgcagaagctgtttagtttgattacatcccatttgtcaattttggtttttgttcccattgcttttggtgttttagtcatgaagtcttttcccatgcctatgtcctgaatggtattacctatgttttcttgtagggtttttatggttttgggcttgacatttaagtctttttatccaccttgagttcatttttgtataaggtgtaaggaataggtccaattcctgttttctgcatatggctagccagttttcccagaaccatttattaaataggaatcctttccccattgcttgtttttgtctggtttgtcgaagatcagatggttgtagatttgtggtggtatttctgaggtctctgttctgttccattggtctatatatctgttttggtaccagtaccatgctgttttggttactgtggccttgtaatatagtttgaagtcaggtagcatgatgcctccagcttcgttctttttgcttaggattgtcttggctatacaggctcttttttggttccatatgaaatttaaagtagtttttttgtaattctgcaaagaaagtcaatggtagcttgatgggaatagcgttgaatctgtaaattactttgggcagtatggccattttcatgatactgattcttcctatccatgagcatggaatgtttttccatttgtttgtgtcctctcatttccttgagcagtggtttgtagttcttgaagaggtccttcatgtcacttgtaagttggattcctaggtatttcattgtctttgtagcaattgtgaatgggagttcactcatgatttgactctctgcttctttgctgttggtgtataggaatgcttgtgatttttgcaaatagattttgtatgctgagactttgctgaagtttattaacagcttaaggagtttttgggctgagacgatggggttttctaagtatacaatcatgtcatctgcaaacagagacaattagacttcctatttgaataccctttattttttctcttgcctgattgccctggccagaacttccagtactatgttgaataggagtggtgagagagggcatccttgtcttgtggccgttttcaaagggaatgcttccagcttttgcccattccgtatgatattgactatgggtttgtcataaatagctcttactattttgagatatgttccatcaatacctagcttattgagagtttttagcatgaagggatgttgaattttacctaaggccttttctgcatctattgagagaatcatgtggtttttgtcattggttctgtttatgtgatggattacatttattgatttgtgtgtgttgaatcagccttgcatcccagggatgaagccaacatgatcgtggtggataagctttttgatgtgctgctggattcggtttgccagaattttcttgaggattttcacattgatgttcatcagggatattggcctgaaattttctttttttgttgtgtctctgccaggttttggtatcataaaatgagttagggcctcataaaatgagttagggaggagtccctctttttctattgtttggaatagtttcagaaggaatggtggtaccagttcctctttgtacctgtggtagaattcagctgtgaatccgtctggtcctggacttttttggttggtaggctattaattactgcctcaatttcagaacttgttattgttctagtcagggattcaacttcttctggtttagtcttggcagtgtgtatgtgtccaataatttatccatttcttctagaatgtctagtttatttacatagaggtgtttataatattctctgatggtggtttgtatttttgtgagatcagtgatgatatcccctttatcattttttattgtgtctatttgattcttctctcttttcttctttattagtctagctagtggtctattttgttaatcttttcaaaaaaccagctgctggattcattgattttttttttttgagggtttttcatgtctccatctccttcaattctgctctgatcttaattattcttgtcttgtgctagcttttgaatttgtttgctcttgcttctctaattcttttgattgtgatgttagggtgtcgattttagatctttcgagctttctgatgtgggcatttagtgctataaatttccctcttagcactgctttagctgtgtctcagagattctggtacgttgtctcttttttctcattgatttcaaagcacttctttatttctgccttaatttcgttatttaccaagtagttatttaggagcggttttcatgtagttgtacagttttgagttagtttcttcatcttgagttctaatttgattgcactgtggtctgtgagagtgtttattatgatttccattattttgcacttgcagaggagtgttttactttcaattatgtggtcgattttagaatacacatgctatgtggtgctgagaagaatgtgtattctgttgatttgggatggagagttctgttgatgtctattaggtccacttggtccagagctgagttcaagtcctgaatatccttgttaattttatgtctcgttgatctgtgtaatattgacagtggggggttaaaatcccccactattattgtgtgggagttcaagtctcttcgtagatcttgaagaacttgttttatgaatctggatgctcctgtattgggtgcacatatatttaggatagttagctcttgttgttgcattgatccctttaccattatgtcatgcccttctttgtcttttttgatctttgttggtttaaagtctgttttatcagggactaggattgcaacccctgctttttttttttttttttttgctttccatttgcttggtaaatattcctcaatctctttattttgaacctatgtgtgtctttgcatgtgagatgggtctcctgaatacagcacactgatgggtcttgacgctttatccagtttgccagtctgtgtcttttaattggagcatttatcccatttacatttaaggttaatattgttatgtgtgaatttgatcctgccatcatgatactagctggtttttttgcccattagttgatgcagttttttcatagtgttggtctttatattttggtgtgttttttgcagtggctggtactggtttttcctttctatatgtagtgcttccttcaggagctcttgtagggcaggcctggtgatgacaaaatcccttagcatttgcttgtctctaaaggattctatttctccttcgcttatgaagcttagtttggctggatatgaaattctgggttgaaaattcttttctttaagaatgttgaatatattggctcccactgtcttctggcttgtagggtttctgcagagagatccgctgttagtctgatgggcttccccttgtaggaaacctaacctttctctctggctgcccttaacattttttccttcatttcaaccttagagaatctgatgattatgtgtcttggggttgctcttctttaggagtatcttagtggtgttctctgtatttcctgaatttgaatgttggcctgtcttgcttggtgggggaagttctcctggataataccccgaagtgtgttttccaacttggttccattttccccatcattttcaggtacaccgattgtaagtttggtcttttcacatagtcccatatttcttggaggcttcattcgttcctttttattcttttttctctaatcttgtgttcatactttttttcagtaagttgatcttcaatctctgatatcctttcttccacttgatcagtttggctattgatacttgtatatgcttcacaaagttcttgtgctgtgtttttcagctccatcaggtcatttgtgttcctctcaaaacgggttattctagttagcatttcctataaccttttatcaagattcttagcttccttgcattgggttagaacatgctcctttagctcagaagagtttgttattacccaccttctgaagccttcttctgtcaattcatcaacttcattcttcatccagttttgtgcccttgctggagaggaattgagatcatttggagaagaggcattctggttttttgaatcttcagcatttttgtgctgtttttttttttttttccatctttgtggatttatctacctttgatcttggaggctaatgacctttggatggagtttttttgtgggggtcctttatgttgatgttgatgttgtattttctttttgttagggcccctcttctgcaggtctgctgcagtttgctggaagtccactctagaccctgttcgcctgggtatcaccagtggaggctgtagaacagcaaagattgctgcctgctacttcctctggaagcttcgtcccagaggggcaccggcctgatgccagccagagctctcttgtttgaggtgtctgctgacccctgttgggaggtctctcccagtcaggaggcatggggatcagagacccacttgaggcagtcggtcccttagcagagctggtgttctgtgctgggagaatccgtcttgtcaggatcagctcctctcttcagagtcagcaggcaggaatgattaaatccgctggagctgcacccacagccgccccttcccccaggtgctgtgtcccagggagatgggggttttgtctgttagcccatgagtggggccattacctttccttcagagatgccctgcccaatgaggaggaatctagagaaggactctggccacagccactttgttggactgtggtgaattccgctcagtccagacctcccagactccttagcactgtcagaggaaaactgcctagtaaagcctcagtaatgtcagatgcccctccccgcaccaagcttgatcattccaggtcgactttagactgctgtgctggcagtgagagtttcaagccagtggttcttagcttgctgggctccgtaggagtgggacccactgagcgagaccacttgactctgtggcttcagcaccctttccaggggaatgaatggttctgtctctctggggttccaggcgccactgaagtacgaaaaagactcctgcagctagctcggtgtctgcccaaatggctgcccagttttgtgcttgaaacccagggccctggtggtgtaggctacatgagggaatctcctgatctgcagattgcagaaaccatgggaaaagtgtagtaacccagccgggtagcacagtacctcatggcttcccttggctgggggagggaggctccctggcttcttgcacatcctgggtgaaggaatgccccaccctgcttctggtcaccctccatgggttggatccactgcctaaccggtcccaacaagatgacctgggtacctcagttggaaatgcagaaatcacctgccgccttctgtgtttgtctcgctgggagctgcagaccggaacttttcctattcagccatcttatcaactcgagaatggaaaactttttaagaactttatgattttctttaagagaatggaaaactttagatgtacttacttttctaatccttttttgttttgtctgttagcttcttaccacctttctgtagatcagtgtttcccaaagtgtgccaaaagcattagtgttacttgggaactgattagaaatataccctagaccggccgggtgcagtggctcatgcctgtaatcccagcactttgggaggccgaggtgagtggatcacaaggtcaggagttcaagaccagcctgaccaacgtggtgaaaccccatctctactaaaaatataaaaattaggcatggcacacgcctctaatccgagctactcaggaggctgaggcaggagaatcacttgaacctgggaggcggaggttgaagtgagtcgagatggtgccactgcactccagcctgggtgacagagcgagactctgccctagatcagctgaatcagaaactctgggtaagtcccagcagcctgtttcagcaagtcttccagaaggttttgactcactaaagtttgggaaccactcctgtggagcagggtttcccaacctctgcactgttgacttttttggactggataattctttgatgtggctgtgagggttggggctgtcctgtgcattgtgtaatctttagcagcacttctggcctctacagactagatgccagtagcacactgcccgctcccccggtaataattgtttcatttttttcaacccaacttctacatccagcctaacaataggctctgtcaatactacctccaaaataaacccctatttattgacttttcatctctaccattatcaccctaattaccaccatactcttaggagaaccactactctagagggaaatgatgtggagttaataggtaaaactgcttctcatttaaagtagcagtgaccacttgttgagtgcattttaactcattccaagttctgttctgggtacttcacgtgaattatcactgccatcacaacagctgtgccagatatgtttcaaagttcacagtgtgggctaacccatttatgaagtttctcatctattccagcaattcttcccttgagaactagtatgtcctgttgtcataatgacttatttggctgcatgtgtaactatattcttttttaaacaaagggatttagctgggattgtaggtgtgaactgttttgcctggtgaactatgtaaacttctcattgcaaacttaaccataactgtttctggatgatggtgattatttactttttctgaggtgactactaaatgacaaatgaatcaatagtatgctgtcgttgcagtaagacattctgcttacattttttgaaataatgtgtgttctgtgtattttcctttcagctctagctcacttgatctatctctgcatattttaacaactcttctttcccactctttaactctaatttaaacttgcctagtctctgttccattcctttattacctttctagggtatggatggctagatacacattttaactcaacaatcagtagttaatgctggttcatgtattacgcatttccaggtgtcacatgcttttaaacaaaagcctagaaatcatttgtattgagaatgtcaagcccccacacctgacccctgtgacattttatgttcttgaacttggcctgtatagaccagttctgattagtggctatagtgatgaattctggctgttaaaattctgtatattaataatgtcatctcctgaatcaagaaagtcagtgcagttctgttgcagtgctagtttcttgttactcattggatactgtttctcttttactactttagaagctatgtaacgttcagaatccttttatgtgaaaatcacatttaagactaaaactatctgtgccactggtattttaattagcattcagagaattgcaaggtttttacccaaacactggaaaaaataagcaacttatgaaaaagaggggtaaaatgaacacgtttgttcatctaaaataaagcatgtttagtcctgattatcgtcttcaaagtgcttttctacttaagaagcatttcttcgcacagtatccctttagtatccagactatgcttaagttcctggagctcttttacatttagtgtatttctctctttcccgttagaaggatataaaagtatcccaaacagcatttcaaattggagttaattttcataattctaattgtagttaaatttcaaattccaagccacactcagaatgtcaagattttgtggctattttttcttttttaaaaaattatactttaagttctagggtacatgtgcacaacgtgcaggtttgttacataagtatacatgtgccatgttggtttgctgcacccataaacttgtcatttacattggatatttctcctaatgctatcccttcccccaggcccccacccaccgacaggcctcagtgtgtgatgttccctgccctgtgtccaagtgtctgatttttcagttcccccctatgagtgagaacatgcagtgtctggttttctgtgcttgtgatagtttgctgagaatgatggtttccagcttcatccatgtccctgcaaaggacatgaacacatcctttttatggctgcatagtattccatggtttatatgtgccacattgtcttaatccagtctatcattgatagacatttgggttccaactctttgctaccgtgaatagtgcttttgcaactattttttcttaaactatcttcttgtttttgttaatgcttagattttgtcccacaggtattttaacctgcatgtacttttcatgtatttaaaagtcattatttttatgtaagatttaaaaaactctataactcttttacatattttttgaaagatgaaaaaggattaatatttgtctacctagaatgtaagaaaggagcagaagagacaaggtgatgaagggaaatataggaagtgagaagagaaggaaaacaacttcatggacttgttgaaaggggaaatgctttacaattataatacagctcattctcaccagtatttttagcattatttattttcaggtgttagtactcagtagagtaatgcaattcagatatctgagctgtaaatgaaaaaatttgagaaacactgggaggataatttcaaattttaataactttattcttatttttactgttaggattcctggaaatcctgattgaagttttggacctaacaggatacactatgtatatcacgtatccctaaaagttatgggatacatttaaaacaataatatttagtccacaataagccaattataggtaataaagtataatttgtaaaattctgggtgggccatatgttttgagaaatatatataattttcagccaacttgttttgcagtgaattagttgttatataacagttttgaggaaaatacttcttgaacagtccagtagctaaaagttgaactaagatgagatttttcagtttcactcattattgtccttgtcttcttttaaagaatagttactgagtaatattttcaattgattatcacaatgcctttcttcatgtactcattgaagaattatggcttaatgaacatgttgaaacaagtaatatttatttctgtagtagcagctactgctagctgtgctgttctgtcatctctaaatactacaggagatgagatttgttgaattactataccagatgttaccataatttttgaagcatagaaccctggaatttttgataatatgaacatgccattcattaatagtttcccagatctcagtcataagttatcctgaattggctgaacattgaatgttagcaaacaagctgttttatttatagaaatgtaactaaaaatcttctgtgtcatggtatcacccactagcagctactagcctgatgaccctgggcatgtcatgtagctgctttgagctgcaattttctcctctctacaatgaggagagctatatcagtaagttgtgtgaaaattaaacaatataaaatcctagggttttttaaattgctaaattctttacaagtgtataagttattgataaaagtcatcactggtcccactgtaatgagaaccaacagcttttccctatttctcactctagtattgtttgtttttaatagcacttttgactagccttttttttttattcagggcctccttgctctgtcacccaggctaagatgcagtggtaaggtcatggctcactgcagccttgacctcctgggttcaggcaatcagtcttcccatatcagtctcccaagtagctggtactactggcatacaccaccaatgcttggctaattttttttttttgttagagacgggatctacctatgttgtattacttggtcatctctgccgtttgaggagatggggagtgggggtgggtgggaaggacttgagccatcaagcattacaagtgcaaaataaaggattcatcagacttattagaaattgtgataacttgtgtcaatttggcttccccaactacatgttaagtgaaaggaacaatctcttgtgtacttgttttattttggtttttgctttttaattctctacagctcctgttactcaattaagtgcataatgggagcaaggggtttgatagatttcactctacacaggtcctacaaaataaaaacttgtttgagcatgctgttttttctatctcctgttttaattaaactccagattcacaatatgaactgtttgcaaattgggaacttctttatagaggtattttccatgtagctaccatgtacagattaggtagatttgaaatagaatggaggagcttattaggcttactaaattcctgtgatatcccaggcctagagtgattcctcacaagaattagataaatattaccatctttgcaaatgaggaaatgagttcacagaactaccaagaggtggaaccagaatttgaacctagatccctgattctgaagtgaatgtacaatcatgctctgcattatgatgtttcagtcaacagtggactgcatgtatgatagtggtcccttaagattataatggaactgaaaaattcttatggcctagtaacctgatagcccttgtaccatcatagcacaatgcattactcatagatttgtggtgatactgtcataaacaaatgtgctgccagttggataaatgtctagcacatataattatgtacagtaattgataatgataaacgactatgttactatttacttttttcattattttagagtgttcaccttctacttattagaaaaagttagctgtaaaataggaaggtccttcaagaggtattctggaaggcatcgttttcattggagatgacagcttcactcatgttattgcccctaaagactttgcagtgggacaagatgtggaggtggaagacagtgatattgatgatcctcccactttgtaggcctaggctaatgtgtgtatttgtgtcttagtttttaacaaaaagtcttaagttaaaaaaataaatttttaaataagtttcatagaataaggatataaaaaatgtttttatgcggctgtacgtgtttgttttaagctaagtgttattacaaaagactcaaaagttgaaaatgtttataaagtgaaaaagctatagtaagcttaagttaatttttaaataaattcaatgtaacttaaatgtacagtgtttacaaagtctacagtagagtatagtaatgtcctaggccttcacattcactcatcactcacttgttgactcacccagagtcagccctgcaagctccattgatggtacgtgcactatacaggggtgccttttaaaaatattttatatggtatttttactgtaccttttcctggtttgcacataccatataggtttatagcctaggagcaataggttataccatatagcctagttgtgtagtaatctgtactctctaggttttctaagtacattctatgatgttcgcatgatgaaattgcctgatgcatttctcagaatctatcctcatcgttaaatgaagcatgactatgttttttgttacatctggaggttgttaacgctggctatatattagaatcatctggggagctttcaaaagtacagatgccagggaaatcaggtaattggtctggagtgggtcctgcacattagtattttttaaaagctcttcagatgatcctatcctggtgagaagcaaaagttaagaaatgttgcattgcatactgcatctccagtgaccattggtggcccctttgttttgaaagcttgtgttatttgtcagtggataatcattaacagattaatagtgttttctactttacactttctctccagaagcataaaggatttgtattaaagagagaattacctacataataaatgttggaaagattacagtgaacataatgggggtatctttttgtcagtctttcaaaaattaaaatatttttgtttttaccttatgactttggcttgctttctgagtgaagtaaaaatgaactcaattgcatattaaatttgtttctggccctctgcatctaggaaagtaataaactaatttcggccaagagaaataacattttcttaatatacagtagttttaaaaagtaatagaacaggaggttattggttataaatctatagatgattgtaacaggaatacatttagataattagtcctggcctaccactgtgctgtagctctgtaaatctctttttgacaagctgctttaaagattgtcatggatgaagggaaaatgggagtatagttgaagatcattattattagaaattttaatataagcacatagaacaacagaataatttgttttttacattatgaaatttttgagttttgaatcttttttattacctggcttaaaaatacatttgaaataaattattcttaattggttagaatacgataattgaatcctgtctacttaaaaatgaaggcagttactgggattgactcttggaatacgtttaaagatgttgtaacttacagtcatggtttattggctggtgatgttgaaattggaatttacagtctgcttttctcaatacttaataagattaattttctttaaatttccaagcagtagtttttaacgatttacagagttttcatgaggtagctagtttttactgactccatttataaagctatgctgtaataaggtgtagcaattgtgaacctctcatcttttcagattaacaagaaccccttcccccatcatgcttatgtcctctcccctactatattaagacatgttagaagaagaaggggttggaaaggaatggttatctaggtcttaagcgatagagttggaactcagacttgcttgtcaagactggaggactcctcagatgttggcccagatgttcttggaccaccattcttattcccaccgttacatgatatggctggagatgaatgcagtgaaattgatgggaggtaaatggcaactaaattgtgcccacagggtgagaagatagaaccttatatggtggttgaaaaagttggaggaagcaaaagggacatagagggtatttggttgtaaatattgcagctatactgtgttagggcttttattctcccaattatggctagcaaaggctgctcaattgcataactccaacaggcaacattcacatagaatttgatgtgagtgatgcagactccctggctctgagccagactgaacagtccagcagttctgtaatgatggggttttggcagggccacttttccatactggtcctgacacttcttacctggtagaatctagaagctcagtgccttctcttgttgaatctgaggcagcctaaaagataatgataataggaaacacttatgtagcacttaatttgtgtcaggcacagtaagtgtcttgctaaaactcacacaactattaaataaatgacaaagctgggaaacaaacccaggcagtgtggctccagactgtctactttttccactatgccacactttgtttgctattcccttgtttttattgtctccattgcctagtcattcatttagctattagtgattaacaaacattcgttgagtatgtactatgtgcatactcatagtacattaactttctagggctgaagtacgtagaactttctagggctgaagataaagtctttgccctcatgggacttacattttggttgagggagagcgacagtacatacttaaacatgtaaattgcataatttgaagtaacgataagtatttagaataaaatagagtgatggtatagggaatgattggaaagtgggactgtcttacctaggattatgaaagaaatctttctgagggggtaacactattgagacttgaatgatgagaagcagttatgtaaagattaggaaagtggggattctaggctgctaaaactgaaatgggagcaagtttggtatttactagggaccgaaaagaaaaatagcatgacttagagcttagtaagtaaggtaggtagtaacttagtaagttagtaaggtagacagtgagatctcagagaaatgcagcaataactttccaagggggtggaatgggcctggtaggaatctgcttctaggggaagaggtattttgttactcacattatttatggttgcctgcatgtagagtttggtcagggagcagtctgccccagatgcaggcagtaaggagatgcagtgggttgcatatttttaaaaatgattttagtacataacttaaaataaccatatcattaatgtgcatcataaagcattatgttttatggcccattagaaaatatttgaaaatttactcgttgatgatttatactttaaaagagctttctggatgctgtgcacaggggataaacataggacagtgaccaagtaggaggctattgtgttggctcagagaggtgaaagtggtagtggtgaacacggagagaagtaattgcagtctaaatatatattgattactgttcttgatgccaattttctaagactgtggcacttactttgtagggtaaaggagtaaatgtcttctctcagttaattttcagacagttactgtccaggtcacaattgtccaggaatttggattttattgcttttgtgattcactgaaaccacagatttccctgggtagaaaccttctgccaagatgtgtgtttatggacaggatgaaggatgaacttcctccaggactggcactgctcagccctgacgcagaggctagcccactgggcccacctacttctgtgttcatgatgaattttcaagggctgattctcttaatttgacctggctcataaggcagatgagtttgaagatacaggtcacttactgaaaacctgcttttggcagcctaccagtaattactacttgttcatttttatttttctcctgttttgtcttacagagatgtttaacatattacgtatgaagagattaattcatatgggtctatatttgaatgtgttttctgttacataccttgaaagcctctgattaaaacaatacaattattacatgatcacttgtagtactgatttgaataatactgttgacagatggaaaattttgtgaagagtgggttcccttctgtagtgattttcagccatttgcttttccttccaaagacaagcttacagtctgtcttctatgtgctgtcacaatccgacatttatttgaaatgctgtaactctgctctcccttggcttcttagatgttaaagaccaggaggtgaatagtgtatgcatgtggagaccatttcatcggtttcctgcatgagggtcctagccagctgaattgagcctgagtagcaatccctacactctccttatatgtcctccatgtctcccgtgggggattttagacatgttatttgtggcataagaattattttgccttgagtttttacctctcgtaaagcttaagtggaagaataggtaaatcctttaaagttatcactttttcctgcagtttgtccatgtgagtaacaaagaatacaaattaacttggtatcttatgcattttagagagctctgaaattaaaaaaaaaataacattttttccaggtgttttaaaatttgcaagaccaatataaaagcttaattcagcagagagagagaggaaaaatggatgaccatcaggatttttgaggaatggtatttttcatcttttttttttttaattgattgaatatttctgtagaacagtccttcagttttatgcttttgatttgatagccttcttaaatgttaagttttataaaaagaaactaacatcagtaatattgcttgtagctctggcgagaagtatatatattatcttcctcccaatgtgaataagctaagtgactgctagttttaattttctcctacttagtctttgttttgtttggctctgcacggtggctcatgcctgtaatccagcactttgggaggccaaggcagatggatcacttgaggtcagaagtccaagaccagcctggccaacatggtgaaatcccgtctctactaaaaatacaaaaattagccgggcgtgatgatgcatgcctataaccccagctacttgggaggctgaggtgggagaacctcttgaacctgggaggtggaggttgcagtgagcagagatctcgccactgcactccagctggggtgacagagcgagactctgtctctttttaaaaggaacaaaaaaatccattgtgaaagacacttggttattccttcaatctcaacactgattttctctcctccttttcttttcttcttttctttttctttctttcttttctttctttctttctctttctctttctttctttctttttctctttctttttctgtctttctttctctccccctccccctcccttcctccctccctccctctctctctctctgattagggtgtttttagctattgctgggaaaatacctttttaatataagaatatagcgtttctataagaagattaaagttaatatcaattaatacagattttttttttatcgtgtcttccttttaaacatagttgtatttgggcctaatcagtgggttaagcaggctaagttttatgtgaagaattaataaactctgataaaagagtgtctataaaatataagaaaactatatattttaccttagggctgagagaggaagaccaaacttgtaaggggtcccacctgcaaaggctagggctcagacttcactggaggaggtatattcagctcattgaattagtagaaaagttccctcttcccgccaggccagagttggtatgtagtacattggcagtcagggcaacctggaatgcaggtgatcaacaacatgtggcatggttgtgcagagggagtggcagctgggtgggaaaccacagatgggcagcccatgcaggcctccagagcaagcaaattgagatgttgataagggcaagcgcccattagtgtgcctatgcaagcaggaagcctttggagtgctagattctgtcttgagggctggttaaccctgggccaggctcctgctgccaccttgctgagagacttgcgtatctggacattgggcagaaccgtttctcctacaacttcttttagcattttctgctgagaaatcttaagatagttgttgcagtagagatgcttaaaggatttgtgaccatatagcgatgcatatattgaagggtgaatttggagaagagagtcatacaattgataactggcacaatcatgtttctttttccagtttacttttatgagaaattatgttcatagtgttctatccattctttgattcaagagcacatactatgcatgcaccatgctaggtgcttgagatttcatgacaaggcagcaaagtaaaattttaagtatgcatgaagaatcattatatttagctgtcacattcttgcttgatacttgatggtagaaagacacttttttaagcattgacagaataattgcttcatatgtgagaggactatgtcaaagtagtattcttcacattaagataaagtttcgtggcagcaactgttgaagcaattggggactttgaatcggaagaccaagattctggtcttggttattaattaaacatataataatctgggccttagttatcatctgtgaaattgtgctggacttactggattcagaattttctctcacaccatttctaatatactgcgagtcttccttcacattggagttgaagattagagtaaggaaggcctaaagcctgtcacagtcttttaggacaggggtgtaagaagaaattttttaaaaatatacagttaggatggtttaagcagaatcaatagattgccagtagattggattcaaacaggtctagtaatagaaaaataccaagctgaactgtaattctggatgtatttccttgctttatagagataagattttgatacaaatttctgaatataaaatattttattataaggtgggattctgggtgagttaaaaaaaaaggagttgcttaaaaaacaatgtacagaacgggagaaaatatgtgagtcatagataaggggtttgtattcagaatttataaagaactcttataactcaacaataaaaagacaactggtttaaaagggaaagtgatttgataggcatttctgcaaagatgcacaaatggccattgagcacatgagaagatgctcagcatagtcattaaggaaatgcaaatcaaaaccacaatgagatacttcttgatgcctgccagaatgattataattaaaaagaccagtagtagcaagcattggcaaggatgtggactaattggaatccaaatacattgctggtggaaatgtaaggtagtacactcactttggaaaacagtatggcagttcctcaaaacacagttaccatgtatcagttaaatagagttacctaatgacccagtagttctactcctaggtacatacccaagagaactgaaaacatatgtccacacgaaaatgtgtttacaaatgttcatagtagcattatttataatagataaaaagcggaaactacttaaatgtcagtcaactgagagaacaaaaatctggtaactccacataatggaatattattcagccgtaaaagcaaatgaagttctgatacatactacaacatgaatggacaccaaaaatattatgccaagcgaaaaacccagatgcaaaagaaccacatattatattacttcatttatatgaaatgtctggaataggcaaactatagagatagaaagtagtgatttttcaggggctggggcaagggggagtgggaagtgactattaatagttacaggtttctttttgggatgctgaaaatgttctgaactctgaatatactgaaaaccactaagttgtatactttaaaaggggtgaattttatggtatgcaaattatatctcaagttgtttatttaaaaaatttgaaattgaaaagtttttaaaaagagcttaattggtctgagattaagctgcagttggcacttcataagtgccagttccatgtttctttcaaagcttttttaaaaaaatctttggtatttaatgtttactgtgttcagtattttgactttatttttatttttatttttgagacggagtttcgctcttgttgcccaggctggagtgcaatggcgtgatctcggctcaccacaacctctgtctcccaggttcaagcaattctcctgcctcagcctcccaagtagctgggaatacaggcatgcaccaccacgcctggctaattttgtatttttaatagagacggggtttctccatgttggtcaggctggtcaggaacgcctgacctcaggtgatctgcccgcctcagcctcctcctaaagtgctgtgattacaggcgtgggccactgcaccctgcgactttatttctttacacaacttctagttaacatttaggctacttgaagctgtacctttgtagctcagcaattagaagtagtaccaggagagtcaagacatctatcctctacctggtgtgttttttgccttgataacacaagtagtcgtatgtttatatgtttacagtttttcttatgagaaaaaaatggctgtgcgaatatctagggagaggatgcaataatgtagaaaaaaattaattttatatttgctttatgtttatggaaagataagtttaataaaaataagaaaatatatgtgatgtcctttcagaaacttctagagggatatttaaaactttcatctcttcatgtgaggtattccattataatgttgttcatttttaataacaaataatttatatcattacagacagatttgaccagttttgggccatcaatcggaaactcatggaatatcctgcagaagaaaatggatttcgttatatcccctttagaatatatcaggtaggaaataacattttaaaaaacatccatttatgaaagcctcagacatcttaattgaagcactctagtgtagaactctttgtctgcatagtaactaaacggtatttattaggggttttccaaactgtgtctttcagtggcaatcaagtcagataccgcactgaaatatttgactcatatgcatttggtactcattatttgtagatttcatattggcagattcacatgcttactaaaatttatgtgtaaccccaaagtcagtacttggagcacttttacggtcattcagagtggtgaaaaattgattcacctgatgctcatttcccagcagaggttgatcaaagcgaggctctaccttcttgtctcagctgtcatactataaacaagccttcttgtcacagtgtatgtagtgccatgcttttacatttttgtgctttttgttagtgattttgctgtttaaaacagactccaaatgtagcactgaagtgctctttttaaacagaaacacacatagaacaaggttatgtattgatcagttaatgaacatgttgtgaccgagggctcacggaaacataaccttgtattcccccaggagcgatgatttcagtgtttgtggtaaccttatagaacagaactactgcaaatcacaagaatttactaagtctgtttgttttggatggtgagtcttcagtgttgtaccacaaagtaggcaataggctcttaagtctttctcacagcatatttgcatgaggtaaagaaactccatgtttctgtactttaaaagtgctggcataaatattgacatttagcaaatattaaatatttttttaatgaatggcattccaggaagtaagttacatactattaatgagaaaagcatttaagaacaagaaccagaagcataatgtcacaggcttagactctaatctagtaggacttccattcaaactcagaggttttgtcataactttctttgtagccatttttagtatcccacagtctttaccaatagttccttctatagttattttaaaatcttttatagagccatcacataactatgtgttcagagaggaaagcaaattgtctaattgaaagtaaacatctcaatatactggaagaatgaagaatatttatttagtgttgcaggtataattttcaaatagtccatatttttcatgaaggcggggttattgttaggttcatgctttgtgtccaggttctagaaaagtgcccggcatttgaatttctaatttattaaatcatttatcatttgtcaattttattttaattatttatattctttctattttaccatgagctccacagtaacatgccgtaaggcattcccacagcccagcaaaatatcttacttgtataatttagttgaagaaaatatatcgcagactctgaagacatttcacaaagagtccggaaactgttttgagatttatacctctcagcacttatttgggtcaagttctggcatatatatttatacaagagattctttactgtaacttctttaaactcctgtagggaaaatgtattatacttaatttaggaattattattgtcagaatatagtgcatgtgtacagaggaaaggttttcctttttgaatttattctgttttaggggaaaattgtcagattaatccatacctagtgttgtgttattataatacagataagtttcagagagagagagagagaaagggtgtgtgtgtgtgtgtgtgtgtgtgtgtgtgtgtgtgtgagagagagagagagagagagacagagacagagagagaatggtttttataaagtgctataattagatagaaagtgggagggtagagaattctcaaaatttgcttgacaaaacctggctgccagatggggactctcggcagaacctcctgcttgatctttaatgtgtcaaggcacttgggcagtttttccttaaacagaaagcaacaaagagcctaaggacaatataggttctcatttgacctacataactttccttttggctttatctcagttccattttggtttttatttgaatttaattaaagttttagaagtgagatatgaaaatgaatataaaaattaaggagtccagtttttgctaatttgccatttcctggcttttcctatttccctatttggtattcagtcttcaaccatggccttgaccaaaggaggatggaactctatttttgtttgcctaattgtgtgatctaaaggcaacatcagatttctgttgctgacttctttatatctgattagtttgtatggttgtgatattctgtttgttaaatgtagcatttatttgtgcagcattttgattaacacctttcatttctttaaaatactagatacaaatctctataatatttgagcccttaagttactaagtaaatttaaggaaaatctgaaaatctagattcattaataaagggcataatttttactgaaatatttattttactttgcagaatcctaatagaatttctgcataaccggagagagagagacagagtactgagcatgcttgagtgaggcccatcttatcttgttgaagcctcaaaaccatcttaggaataggaatcattatctgattttacatgtgaggaaactgaggctagggaattttaagtcacttgcctcagtgaacaaatgaaaaatggaagaactagaatccagacctaggcctgatttatgagcaaactatgacttttgtttgtaatcattaagtttgtagaattttcagaacataattatcatgaaaagtgaagtctgccctgaccaaataagttgataggagcctagaatacctgtgactggtggtattctttgaagataaacttttgtaaagattgtcatcaaactatttatttttcatctgtaattcatttatcatgagctcaaaatgactatagtcaggtgaccgatttttagtggtaaaagttgaattggtccaaaagccatctagagatgttgcagaccaaaatgtgtcatttctgtcatttacataacagtttagtttggtgtgttagtttcaggtttgtgttcctgaagtccaggtgcttcatattagccagtattctagagatgacattaagtgcaggaaatgttacagaatgtaaccaaaatgttatttagcacttgtaaacaggtggtgattaatgaaggcatttgtcaaaaagatttgtaaaatgactgtgaattccttaggcattggtatttgagatgtaaaatgaaaattaagcacatcatatctgtttttcaagaagcaatagattgataaatgttatcctgccattatactttgggtaagaaaagtgtgtctcattgattcattcaacaagtttatttacacacatatttgcctgccatgccctgtgctatgcacaagggatacaactgatgatcgatattatgtgtgaccccttagaaggttatagtctaaaggtggaaagaaacaaatcaactaagaatacaaatataacattggaactgtgattgctgtgaagaagagacatacagtgcaataaaaacctaatgccccaggaagaatttgttctagtttgggaggagagaaggctaccttgaggaaatgttgcattcccagagatttgacagataggtgaacttaagataggcaaagagtcatgagaagagctttgtaggcaaagggggacgttgtaagtataaggacaacctgtttgtcttgaccacagagtttggataaggctgcaaaggtaaaagtcaggccatattaacgagttttctctgtatcctgtaaagaatgggagatcttaagagatttttaattatttgaatatccattcatatttattcaacaaagatcattcagtcatctactttgttctacatgttattcttaaggttataaataaatttagagaatcttcatagaaacaacctagcagtgttatttttagttttaaaaaaacaagaagctgataaaacaatgcttgttttctaataaagttaaaatgagaccagcctggatacaacatagtgagaccccacctctacaaaaaaatttttttaaatgagccggatggggtggtaagcacctgtagtcccagctacttgggaggctgaggtaggagagtcacttgtatttgagaggtcaaggttgcagtgagccatgatcatgccactacactcaagcctgggcatcagaaacagaccctatctttaaaaaaaaaaaaaaaaaaaaaaaaaaaggatggttcctacttatctttgttttatttttatatattttttaattttatttacttacttatttatttattttgagatgaagtcttgctctgtcgcccaggctggagtgcactagtgcaatctcggctcactgaaacctccgcctcttgggttcaggcgattttcctgcctcagcctcccgagtagctaggattacaattgcccaccaccatgcctggctaatttttgtatttttagtagagacagggtttcaccatattggtcaggctggtctagaactcctgacctcaggtgaaccacctgcctcagcctcccaaagtgctggaattacaagtgtgagccactgcgcccagcctattttttttttttttttccccagagagggtcttgctctgtcacccaggcttgagtgcagtgatgtgatctcagctcactacagcctctgccttcccggctcaagcgatccacccacttcagccttccaagtaaccaggactacaggcatgtgccatgcctggctaatttttgtatttcctacttgtctttggaagaagttgttcattagttacaaaaaagtaaaataaagtagaatttgaacttcgttttgtttactttcataatcctcagaattctgcttcctttcccattgacgattgaatgtaaagttgttcatttgtatcattaaagcgccattaatattttaattcttttgggaggtttactggctattttggttaagcaaatctatttaacttctatgtgctaaaaatatttaagaatctagataccggtttggggagagaaaaagtacatttttgaaaatggaaactaggatgtcagggattaacttggcaccttctaaactgaagaaggagccaaattttagactctgttttgtttccagaaatgttgatttctggattttgaaaagtgaggacagtagaaatatgtggcaaattatggccatgtttgttaggattcttcccctccagggttttagcgatgttgataagaaattataattttgccttttcagttgttttccattttagtagatatcttgcaataacatcttacagaaaagtcaggaaccatgaaagaaggacttactggttagtaaactgaatattattgcttttaatttagtttttcagtcatttcaaaaagatacacaacatcatttgtaataaattttgaactgcagatatatctctagcagaataggatgtattctgtttcccaggtgaatgtaagttgcttgaggtgttttttttgttgttgttatttatagtatttttccttaatattattttgttttaatttttaatcatggtaaaataaatgtaacataaaatttataatcttaaccattttcagtagtgttaattatgttcacactgttgtacattcattctccaaaactcttttcttcttgcaaaacaaactctatacccattaaacaactctctgtttccccattctactttatggatttgacatccataggtacctcatacaagaggaatcatacactaattgcctttttgtgacaggcttatttcgcatatcatgatgtcctcattgtttatctatattgtattatgtgtcagaatgtcctttttttggctgggtgtggtggctcacacatgtaatctcagcactttgggaagctgaggcaggcggtttgcttgagcccaggagttcgagaccagccttgacaacatggtgaaaccctgtcttctataaatgtgtgtgtgtgtgtgtgagtatgtgtgtatagatatagatagatataatttccactttttaaaggcttaataatattccattgtatatacataccacattttgcttctccattcatctgctggagttgcttccaccttttggctattgtgaataatgctgccatgaacaggggtgtattagcattctccagagaaacagaaccatcatggtggtggtggtagtgtgtgtgtgtgtttgtgtagagagagatttattttaatgaattggctttcctggttttggcagctcttccttgagtctgcagcctacctcatcagaccctggactcaccaagccagggtgatgggatgggctgttgactcaaggaagagttgcagttgagtccaaaggcagtctgttgcctgaattctttcttgctcaagggaggtcagtctttttctgtaagaccttcaactgagtagatgaggcccacctacattgtggatggtaatctgctgtactcagaatccaccaatttaaatgttaacctcagccaaaaaacatatatatagaagcatccagaagaatatttgaacaaatatctgggtattctggcccagttgaattgacatgtaaatgttgaaatgggtgtacaccctgttttcagttatttggggtatttacccagaaatgcatattcctatcataagataattttatttttattttcttgaggaatggccatactgttttccgtagtagctgtaccactttacattcccaccaacagtgcacaaaggtttctgtttttcagatcttcaccaatatttattattttctgttcttcatactagccatcctaatgcatgtgggatgtaatcactaatgaatagtgctctgcatcttttcatgtgcttgtttatcatccttgaagaaatgtctattcaagtcctttgcccatttttgaattgggtttgggtatttttgttgatgagttgtagggtttaatttgttctttttgttgagacagagtctcgttctgtcacctggactggaatgctgtggcatgatcttggctcactgcaatctctgtctcccaggctcaagtgattctcctgcctcagcctcctgagtagctgggactacaggtgcccaccaccatgcccgactaatttttgtattttttgtagagccagggttttgccatgttggccaggctggtctcgaactcctggcctcaagtgatccgcctgctttggcctcccaaagtgctgggattacgggcatgagccaccgcacccagcctaatttattcttttttaatggctgcattatgtttaatctgtagatgcactgtaatttgttcagtattcactatcaagttttctttttttctagtttttaccattataaacagtactacagtaagcatatgtattttttttaaggtatggaataggtacccaaaaatgagtttttgcatcaaaaggtagagattaaaaaaaaaattgccagcttacttttcaaaaatgtattagtttaaattttcactaacagtatatgagagcatgcttctccccttacatctccaccagcaatagggcattataactctgatttttagtagtattgtgggtatagagagatatttttactttaactaataattctctcacacttagtgagtttataaatctgttttatctttgttgaccatttggacttggttttctgtaaattgcactgtattttgttttgcctatcttttcttcttaactttttattttataaaataattttatagatattttatattataatatctataaatatattaaagatattttataaaataatttttatagatattaaacttttaccgtcaaacacattgcaaaatataactgtataattcatcttgatttttatgatatctatataaaaaatataaatatatatcaaatatgcccttctttttcttagtagtatgtggatttctttctctgttaaaaaggccccttagccaggcgtagtggcacacatctctcccagctgtttgggattctgtggtgggagcattacttgaacctgggaggttgaggctgcagtgagccatgatcatgccactacagtccagcctggtcaacagagcaagaccccgtctcaaaaaaaaaagaaggtcctttcccacaatgtgttgtgtgagataggtgtctatgagatagctgatcttttattatataaactaaggtttggcaaactttcttcaagggccagatagtagatattttcagctttgtagacaagatggtctctgttgaaactgtgtgattctgtaacatgaaaatatttatagacaatttgcaaatgataggcttggctttgtcccagtaaaactttatttgcaaaaataggcagaggccacaatttggccagtgggccatagtttactcacttcttactgtccttttcccactggatgaatatgccacccctggtttatagtaaagtagtttgacttactggaatctaattctggattctttattcattacatcagtatatgtattttcttatcctagtagtatttttatttaattttagcgttctgatatctgttggagcaattcatttgtctccttttttcatacttttcatggttattctcagttattaattttccatgacttttaaaatcacttattcagttccccatagtgtcctgtctgattagagatggaaatacattaaatttcgatttaaattttgatataattcactttcttatgatattaagtcttcccagacaagaacatgatatttctttttattcagattttgttttatgttctgcatagattttaaggttttcttcaaatagaccatttttctttttatttccaggtgttttgtagattttgtttttctttattttgtttccatttctagttatttatggcattggaaaaacaaaaatctcatcctattgtgtttttacaaacttttttttttcttgctttattgcattgctattatagtattgcattaccaagactgtgctgaataatgatggttctagtagacttttctgtgtttgttttctggtattaattgatacagtttaagtgtttcatcagttagaattatagcctagtctttatcagatctaagtgatttccttctagcgtttctaattagaaatgatactaagttatttgctagtttgatgaagttattgggttccccccctccacttttttttatgcttttaaatttggtacctctgtgttttcattccataacgttgaccttcccttttcctaaagctcattatcaggttattaaaaaatactacccattttactcatcaagaccctttattcttttacccctatttcaaagatacttatttagcatttgtatttcatatcccagatattttctcagtatcaaaggtatcaatacctggcagggctcttggtcgaagtctctttgttccctggtcttctctctgtctgcctcaggaatagaaaggattcagccttttattcagctttttctgttcgtatgcctgctagttcctcccagagaggaaaacactgtagaggttctagctttctccatgtacacccttccccaaccccaggagctgcttagctcaggagagctggtgtgttaataggagatggaatttggaggaaaggggagagagggatgggttagctcccagaatcccatccaagtatagttgttaatatgttctttttcatttagagatatatgttacagtaatatttggggtaagctgtctttaatacttaattcacaccctagttatggcagtagcatgctaggatacatgttgagaatctgtgcttaaaagtatgatttgttcacttgaaccctgggaagtggaggtggagattgtggtgagccaagatcatgccactgtactccagcctgggctacagagcaagactccgtctctaaaaaataaaagtaaataaaagttttaaaaatatgatttgtatctcatatgtaaagacaagaaagtatagaatggatgcttagtgcttaaaaggacttcacttctgattcaagtaaatataacagttataagataaatactggtatgttaaagacagatcactcaggcatctttttgtaatgatagtaatctaaggtcagtctatgaagttaatttcatttcttcccagaatactttaaatattgattaaatacccaagaagaagtcttctttagtaaatgtagagaagctaaggctctgtactgtgcttatgtctttatgctcctcacaatgcctctcacaaaatagggactgcataaatatataaactatatgaacaaactaaggaaatcctaaccaactatataagcagtgattatttggggctcgtaatatgatgtactataatgttcatatcatacattttatggaattcgggactggattttcaattaggcaataattgttattttctactattgctctaaaattgtacaacaaagtattatgggatgtagagtgatttttaaaatctgtattatagcactttatatcttgtaaaatacctttatgctaccttgtttgactttcataacacttctgtggggtagacaaggcaagtattattttttaagttggaggtcaatgaccagacaaaggacagccagccggtaagcaatggaacaaggactaaagtacaaatctgcctcaaaatagtatatactgcatgtgcatattataaagaaatatcttttttgcaagaagatgaatatgtttattgaggttttagcagttgcatatgagatctttcatgggcatagtttggttcagttaatgaagatttcattggagcattgtgtgatttgaattttaaaggattaaagaaatacagcccaactttctttcctcttattgggtttagttttgcttttatttaaaattttctttttatgtaatgtatttcattgttaactttcaaattatattttaaaattagttggaatcttaattatttaaaaaattaaatttgcctgatttaccaaagtagaacagtagggctatttcaggtacagtggatgtggagtggaacataaagatatgttaataatttgagaattcttcaaaccagaggctcaagaattagttttcttagatttgtgggtctaaaaattaatatatgtttatatgtgtgtatagatgtacatgcatgtagatgtatgtgcatgcatacacattaacatatttattgagttcatgctttgggcaagcacagttctatgtgctagtgatactcattagtgaaataagcactgtgtttgctttcatggggcatataataatagactaagcaaaccagacatacacagagtaaaacaacttatacaaaaaatgtctccactgtgtttaatttttcattccaagactgtagtttattcacttgagggaaataggcttactacctgaaactcaggaaagcacctttagttacaaatttaagttaactatttcacaaaagatataggaatggctaataagcacatgaaaagatacacgatattgttactcatcaggaaaatgaaaataacagtgagatactacttcacgttccctagattggataaattaaaaaggttgacagtactaaaaagattaacaaagtagtaaaaaggctgtggagcaaatataactctcatacattattagtaggagtgtaaaatggtacaaatcactttagacaagagtttaccagtttctttcaaaattcaacatatgcttactttctgatccaacagttctaacagctccactcaagaaaaatgaaaatatatgtccgagaaaacattgtacagaagtgttcatagcagaattattcataatatccatcataatagctcagatatctgtcaacaggtaaatgaataaacaattgcattatattcctaaaacagcatactattcaggattaaaaggaataatacatgcaataatatggataaatgtcacagaacattacattgagtaaaaagaaccaatacaaagagaacatactctatgattctgtttttaagaagttctagaacagacaaaactaatatgtagtgacaaaaaaatgattcttctgaggccaaggtctgggccaggtcaggagggtgtagtagagatggacccaaccagtaagggacaagaaggaacttttagggcatgatggaaatgcccaatatcttgttgaaggggtcctcttgaaactgtaacactgttacagtttgaactgtatacttaaaatgtattccttttattgtattaatttattcttcaattaagctattttttttttgcagttgcaatatttaatagagtgaagacagagagagctcccatacaaagggaggggacccaaagaaggtagccgttgccggcttgaatgcctgggtttatatcccgatcattgtccttcccgctgtgctctcaggcgatagatgattggctatttttttacctcctgtttttgtctaattagcattttagtgagctctctttactacctgattggtcgggtgtgagctaagttgcaagcccagtgtttaaaggtggatgtggtcaccttcccagctaggctttgggattcttagtcggcctaggaaatccagctaatcctgtctctcagtccccccactcaacaggaaaacccaagtgctgttggggaggttggctgacgaccagtctaactgcttcctgcggaattggggcatagtaggggttgtgcagttgagatttcctcgggaggggtgcgttcgatatcattacaattggagcatgggctagtaggccggtccaggggtccacggtagatcttagtcatggacttcatctggggttccatttgaagaacgatttgtagctttacaactttgattctggaagagacaaacttaacaaggaggttaaagatacagggtccaaagaggagtatcaatattagagctgctagagatcctaagaaggggagaatccagggcatccattggctgaggaggccccagggtctggtgtttttgaagctcctctgttctacgttgtattcaatctcgaatttcttcaactttctctgtgacaattcaggattgattaacataataacaacattcttccgctaaaataacataataacaacattcttcccctaaaaataaacagcttccccctctttcagaggttagcaagtctaaagctcttcaattttgaaggactactgatgctaggaagttaagttgatcttgcaaggtgaccagggagtcggcaacccattccatgtcaccattgagttcttgagatagtttgtagtagaactgagtagaggttgtggtaccgccaatgccagaacctagtccacctagcactcctgctccgataacaaaaggaagaatgagtactcttttgttgtggggcttaggtacaacataattgtataaatcttgttcagtgtaaatggtcatgggggcactaagaatgagaggaagcacatagattctgaagagccattcaaacaacgataggctaaggtaccacagacaaaaaatattcctgagggtaggcagactattcgtgtgggaggagttacccacctgatgcattgggagttggttgtgtctacagtattgctaaattttacacaggtgaggtttgaggtatgggttatttccagattggaaacaagaggtcctactaaaacggaagtggtgtttatttctgtgctgtagttgttccattgttcaggtacagggattgaaatgcatggcctgaagtacagggggaggcacatccaacagttagtagggttttgggccgagacctcatggagccgagtgagggtggtattaaataggcttaccaggcaagtatgggtatggagggtttcatgtagttttagagagatctagtcctttgtaggggctaggggtgctatgtacccgggtcagttgggagattacttcctttacatgtttttctcttgcctgatcttgaactccacccccctcagacataccagtatgggtgaagtaagtccgacagacagtggctccaagtcttccaggacaactaggattaatcattttccctgtccaataatgagtatttgcatgcatgcaaagagtggcagagttatagcagttgtggggcatatgggtgtgggcagtgaaggtggagtttcctttaggtaaactcctatttgatggggcatcaatatttctgggaagccgcattcttcatagaaactcttggtaaggggagctgctggttgtacagcagcatggagggggtgcagtgagagtgaaagggggtaagagaacagtaaagagaaaaatatgataagggagggccatggggatttacgattttagttactttcctcacggttgtctgacagccacaagtctcctttagcagtgagtatgccgttcacattatgagatgtctacacagatctcttccttgtattattttaactgcttcagatactaagactgctactgccgccactacccataaacaatgaggccaaccctttgccactacatcaatttccttactcaggtatgccatgggttgcaagctcatcgacctgtgtaaggactcctagagctatttctgtttttttctgtgacatgtaaagaaaagtcttgccccgttggcaagctaaacactggggcttgggttagggccttctttagggcctggaaagccgcttctgcttcaggtgtccatcttactaaatgggtattggctttctgagtttccttaattagtgtatataatggtctggctatttcgccgtacctgggaatccatatttggcagaaacctgttatgtcaaggaatcctcttagttgctttagggttttgggatgaggataagccagaataggcactgagggccctggtgcctttggataattttagccctaagtatttaacctgctgtgagcagagctgagcctttggtttggaaaccttgtagccacaggtagcgaggaaatttaagagcacttgggtgacttgatggcacaaggtttctgaactggcggctaaaagtaaaaatcatccacataccaaaggacaagagtgcccaggtatgagaaccggctcaagtcttgggctaatgcctggccaaatagatgggggctatccctgaacccttggggtgaaacagtccaggtgagttgagacattgggtttgaaggatcttcaaaggcaaataagaattgagagtcaggatgtacagggatgcagaaaaaggcatccttaaggtccaggtctgtaaaccactctgcttcctctggtatttgggaaagcagaatataagggttaggtacagctaggtatagagggacagtgacctcattgataatcctgagatcttgcactaacctccactgtccactgggtttctgtactcctaaagttggattattgtaggggctattgcatgcttttactaggccttgggcttttaggtccttaatcttttggagtccttgttgagcctcgggtctaagggggtactgcctttggtggggaaaggaggcagaatcctttagtttaacttgaacaggacgggcattctttgctcgtccatattgtccttctgttgcccagtcttcaagattaattccttcctcaagcaggggacaacaaacgggtgttctcctatgttcaggtgtataatggcccctgcttttgctagaatgtctctccctaacaagggagttgggctttcaggcataattagaaaagcatgtgaaaagagtgaagttccccagtcacaacttagtggctgggagaagtatctagtgactggctgtcctaggaccccttggatagtgacagatctggaggaccgttgtctgggacaggaaaataagactgagaaggccacaccagtgtccaggagacagttagcctcctggccgtcaatggtcaagcatacccagggctctgtgagggtgatggcatgggctggtgcttgccccgggcactctcagtcctgctgctggatcatctggttagtggcttctgactcagaggacctacgtcccctggggcagtgggccttacagtgattcccttgacacgaggtgcatggacgagggggcggcttatttctatttggacaatcttttttaaagtgtccttgtagaccgcactggaagcaaaccctattaggcatttgatttgcctagcttttcccttttccagtgcctccaaagtccgcttgcctgagggccatgactaaagcggtggccttttttttatcccatttgtcccattctgcctgctcatcctgatctctattataaaaaactgaggttgccaagttcaatagggtttctaagttttgttccgggcctaaggcagacttttgaagttttttcctaatgtctgtagctgactgagtgataaacttatcctttaagattagttggccttcagtagagtcagttgacagagagaggtatgcttcctcaatgcctccgttagtcactccagaaaggcggtaggattttcttcctttccctgtgttatagtggacatcattgaataactcacaggcttctttctagttttccttagtccttctagcacgcaagttagcaaatgtctgcggcaccaatctccatgttctgattctgtgtcccagtgagggtctacactgggaactgcctgctggcctgtggggaatcgttctctttcctctgttgtcgacctatcattgacctgactgagataccagagatcgccaaactctcaggctgcagttacggcgacacttctgtcatttggggttagtgtctgatttagcagtaacattatatctctccatatcagatcaaaggattgtcctaaaccttgtaaaacatcaatatagccattagggttatctgagaatttacctaggtctattttaatttaaagtctgagagagaaaaaggtacgtgcactctggctgggccgaattctcctcccaccgcttggagggggcataatcggggaatattggcattctttggttagttgtttacccctttgtctatctccttttggaccgtttgggttgaaggggggtccttattatttggggaaggagtctgggggatgctggggtagggaggtagactctgagggcttcctgtagggcataaatcacactttttacataattgcgagttgtctcttaatgaaaagaaagtttgtacgtatgacacttcacaccatttgccttcttttctacaaaagaggtctagctgtaagatggtgttataatttatgcttccctcaggatgccaggtttctcccccttaaagagtatatcgttgccaggcggtactgcagaagaatatgtcttttttttcttagcatctgagagtcaaattggtcccaattctccagaatacatcttaggggtgtttttgccttgaggggaacgtttcctatctgaaaaaagaacatagggatgccagcaccactagtcattttccgatgagcattagtcctagagcgtcctctatggtcctaatgcttattcctttccggggtgtgtaaccacccatggacctctgcttatcggattagttatgctcactgatgtagcagccctcaccccttttcccgcctttcttgatcacaaagaaaggggtccgggctgctggattctagtggtcctttaccagcgtgcccaacattgcctttgtgctcaggggtgagtcctagagctaggctgagttcctgagtatttcataacaacccagctgctccatcaagatgcattcccataaacaacagttcttaggcaaattcgtttcagagagggtataagtaagcttttgagtcaggattgagatagtctttttgattcggtaagtacgttaaggcttggctgagtgcaaacagctctgacatttgaggagaccaattattaggcaatttttctaactctgcttccacaagagtctccctatcaattactgaatacccattgtggttttttcctcagtcatttgggaggaaccatctatcatcctgtcctgaagggagttcctcctaggtctggtcggacctttgtatggtaattaagatttaaatcccctgtaaggaaatctgcagggttaagggaattatcagtggttagtgttaaattacctttttctgacagaatagccccatactttaatatttttgagttaataagctacctttttgcttttttgacttagaataattctgaaccggtgaggtgtgctcacaatgaggtttcctctaaaagttacttttctacttttttctgttagcaaagcagttgccgctacagattgaatgcatttgggccatccgcaggtcactggatgttaaggatttttgataggaaggctatgggttgtcagtggtcttagtgttttcaggctacgcccttgtttacgctgacaacaaggtagtattggagtgttatagggtcgcggagaagaccttcaattatcaattataggttttacatttaccctggcttttaaaggaatagggcacactgtttttttttactatttctatctttgtctttctttctctgactccctgtttgtctctctgcctctttctcctctttgtctctctccctctcctctctgtctctctccctgtcctccctgtctctctctctctcctctctgtctctctctctctctgtctctgtctgtctctcactgtctctttctctctgtctctctctgtttcctctcttagccatttacaaacttggggccctggcaagggtggtggggaacaggtcccacataactgcccatgtctagagctgtatacctaaatcaggagggacaccagggacaagactccctgggtttatagcctagatgcctaagggcgcagcatagagcttccttagatccctttggagatacaacttgctagaggaaatgaaagtctcaaccattagtacctaggaggcagggatcagaggaagtagattcagaggtaaggagaattttggggctacactttcaagaaagtcgtggttgggacccaggaggtgtgggacagaagggaaggtaggagcgcacgcatgggcgactgttgagtagagacttctggctgcgacatgatctcaaccggctaatgccgggagttcgggacgacagctttctgcctctagtcagcccttggcttccccaggaaaattgaaagtggaagctggctccaggcagaccaaggttcccaacccagaagggttgagggttgttagaaagcccttccccagatagcctcatacctgagtctaaagtctggcggccatgctaatcgtttttaaccggccgacaggtgcccagtattttcctccaattctaagggataggccagagtagcaagcaaaagtggtccaatattaccgctttggagatcccttcatggttgcgggttcaggtccctttgtggtcgccaaattgttaccagggggtccttgctcccagaactccgaagatggtggcgggctgcttctaagatgatggcaagcctcgtgttctctgacctggggttcttggcctcatggattccaataaatggaatcttgggccacgcggtgagtgttatagctctattagaagccacgggtcacagaagagaaccgtggaacccagtgactagtgttcagctcaattaggatgaacccgggcacttagccgcgtaggaacaatggcaagtctttagcccagtcgggatcggcaatgggcgtctcactggatcaggagcacaacggacaccctgctagatccagagggatggaagtcagtggcaggcctgcgatggcggcaaacagcagtggtggatggagagtgaaagctcagctcgagccgtaacaaacacggaccagaagagtgcagttgcaagatttaatagagtgaaaacagagctcccatacaaagggaggggacccaaagagggtagcccaataaagctattttctaataaccaaatagtttatggactggtgaaactcctgaaagttttttgtgggataattgcacccaagctgtaaaataatcagtttaagcccctccttgttagattaggttcttacgatatgcttaggttctgagttgttttatttccctgtttgttttaccttaagcttttttacaattcattgctgcctggtttgagttggttccttattccttctccttcaagttgaattacaactagtaattgcttgcctaactttacctgataagattttatatcctgttctgtattctgtatttcagtcatcagtttgtgctcatagcttgacaataaccagaacagtgcaagaacagttacagtattatgtgtagttatcaaacaaggctgtcttaattttcttacattcctaaatactaaattattttctatggtattgatctacagtcttaagcaccttcagagcttcaaggtactgatcatttcttgaagtgcagtttttctgcatgtagtttttggttgacattttttctttatagagacagggtctccactgcaagagtgcagtggcacagtcatagctcactgcagcctccaactcctgggctcaagcgatctttccaccttagccgcctgagtagctgggactacaggtccacaccaccacattcagccaatctttttattctttgtagagacagagcctctttctgctgcccaggctggtcttcaactccttgcctcaagtgatcctcccaccttggccacccaaaatactgagattacaggtgtccaccagcattccaggtcccagacattctacttctttcagtgctttgattatgtcatctgattgcctattgacaacatcatttctgatgagaaatttgttattaatctgaagatgttttgtacataagtcccttgcctgttttgagagtctctctttatatttcagtcatttgattatgatgtacctaggtgtggatcgctttgattttattctttttagtttgtttatcttcttggatgtgtagattaatttttggggtcaagttcgggaagtttagggccattattttttcagatactctgaccctttttctgcatcttcttctgggcctctcattatatgtatattggtatgcctgatggtgtctcttgggtctctgagcctcctttccttccttccttccttcttccctctctttctcgcaattgacctatctttagatttgctgattcattcttctggctgcccaaatcagctgttgagcccctcaagttaattcagtttttgtgcttttcaactccagaatttttgtttggtacttttttgtaactcctatttatctctataatttctatttctgtttgggaatgatacatgcaacaacatggataaatctcacacaacattgtgttgagtaaaaagagctgatataaagagaatatactctatgattctgtttttaagaagttctagaccagacagaactaatctgtagtgacaaaaagtggttcttctgaaggatcagaaatattgttctgatactttcctgtagttctttagataaacttttttttagttctttgcgcatatttaaaataactctcttaaagtctttgtccagtaagtccagcatctggtctttttcagggccagtttctgctgctttttccccccagtttgtggcttatacttgtttctttgcatgtctttgtaattttgttgttgttgagacctgaatattttatatagtataacagaataactctggaaaccagatgcttcccccctttcccaaggtctgtttttgttgttgctgttgcttgtttagtttctttcctgaactaattctttcaggtttttattttttatcacacaggcccctaaagttactgcttggtgagtttagtgatcatctgatgattagaagagattttcttgaatgcctagaactagagtatcttccaatctttgccaggggcctatgtgtgaatgttggggcattgccttcaatgatacggcaagcaatttataactggattttactttcttcttgtacagagcctcagggtttcccataggtgagagtttagggccttcgtagatgttttttgagcgtgtacacagctctatacatgtgtatggctttctggattatcagaaatatgttagaacttttcagaccccctttggatttcttatttcccaggtttttcttttaattttttggttagcttgtttgtcccatctgttattgctatctcatggcagatgtgatgtttaacaattgccactgattttccacaaactctcctggtgataaaattgtttgcactgagtgagctctgagtcaagtcaaataatgtcctatgagggaggtttttctagggaactggcagatcaaataatgacagttttctgagagtggggcttttgaaagatttcagaaaaagttcattttgagaatttttgtgttcttgttgcttttatggaggagagtatattcagggtcctcactctgctattactgatgatatcaccactttaatgattcaacctcaagtttggataaatggattttgttgaaatttggggaagagaataaaaactgaggtgttttttaaagttttaaaaaatgtattctttctaattatttataaaatataaaaatttcaactcagtatattgcttaagaacatgagtattgcaatagatgatcagtgattgctttctgtaaaagttacatatccttgattattttggaaatttttatctacataggttttccgataaccttgaaaaatctgaatgaattgaatctttgacatgcatcagtatagcatgtggttaagattgagagcttttgatttaggcagttctgagtttatattccaggtaactaggtgatttggctcgttcaccttacatctctgggcctccattttataatctgtaaaatagggttattgtgaaaattagaggtaatacctttaataaactattgtgcctggcacataataaattaaattgcacactatagctggaattattagatgttattgacttaaatcattataattttgctgtgagttattttaacagcaatgatgatggcttgtcatgcctcctgtattcttttgttttatgaccagtggaacatatctggtgaatagctcacttttttaattgatgtatttctgtgttttgttttgttttgtttgtttgttttttgagacaagagtttcgctctttttgcccagcctggagtgcaatggtgcgatctcagctcactgcaacctccgcctcccgggttcaagcgattctcctacctcagcctcctgagtagctgggattacaggcatgcaccaccacacctggctaattttgtattagtacagacaggggagacagggtttctccatctttgtcaggctggtcttgaactcctgacctcaggtgatccgcccacccaggcctcccaaagtgctgggattacaggcatgagccaccgcacctggccgtatttctggtcttaacatagttcctctctgtgaggttctaactggtcccaccaatctacttccattcactaccaaatacataatctacttcttctgtttcagtgtccagtttcctctttctttacttttcttcaagttaccaggtcaatactttggaataactcttttgatcacttttgttgagttgcagttctaatggaccagaactgtcttcatttattcccttcttgccatttgcactgatttagctcatgggtcctttatcttctagatgaactattttagtggttcttagatttttctacctgctttttctccctccattctgttgagttttatactgatattaatttgatgtttcctaaaatatagctagactgcaaccaaataacactgcatgctattcccctaaacatctttgatcttttattatctgactctgttaactcctgggaatagccttggctcccagagtgcttctaaagttacttcagatgtcaccttcctcaagaagtcttccttgatttcttcacatatgccccagcccttcatatcatatagatgttctttctgcgaagtctgtttttgaaacatttccttctaccttttgttttgacaaatgtaactgtggaatattagagccatagaggctggaagaattaactaatttaacctcctcattttgggaataagacagcttccccaaaactgacttgtacattgtttagcttattgtttgatggcagagccaacagtagaacttggatcttagatcttcagccttgttctttttctatagcaaacataatatcatagaggatatcatgagctatttttaaatatttcaccatgtatgtagtttctctgtaagcagtaaactattaattcctcaaggacaaggattgtttcatttctctctgtatctctatagatggttctcagagactgtttcctcctatagtgaatgcgtgaatgataatcatctgctttagcattaatattgttaatgtaaaacttgaatcatatttcctacttacacaccttttaaaagaaataggtaaattgagtcctgtagggggcagcccaacacagcaagttttgattgccctaagctatctactacgctgagattgagacttaggcaatttaggcttaaattgcttcctatgtggatttttgaaaactgaaaacaactattaattataagcttatttggcagatatgtttttccccttcctcctccagctttattggaatagtttaaaattacatttctattttctaggacttcagttgctttttccagcagatatattttaaaacaattgtcatgttataagagtaggaactatttgatgcagatgatttgccattttgtttttaaaacataagatgagagcaaaagttatgtattagaacttttttaggaaatgctttatttgttaacttcaaaataacagatcatctgatggcaaattatttgagttatttatagctggggaaattaaaatatgcaaagtgttatcccaaactactaaagttattattaaatgaaatcaacattttctcattatgaatttatttactaagctaggtcattgttttattcaatatttttaagattaaaaaatattgctggtaatgaaagtaaagtttagatgaataataatagcagctaacatttattgcgctttattgaataccaggtactgttttaaattattttacatgtatttatttaatccttattgtcctctgggttaaatgctgttactgtcccctttatatacctgaggtaattgagaaaaagattggtcattgaaacttgctcagggttacctacctagtaattagaagagccaggatttgaatccagggagtccagtctggctttatagcctatgctcttaatcattattacctttcatatattaagttcattacttttattttttatgcctcttctgtcataactttttatgatttgagactgttctccagttttcacacacatcaggcttcttattactcttccttttcggttgcttactgccctcagtccattttcttctaataaagaaagtgcatgcacagaaagtaaaaacataatgttctccccttaatatgaagagattgaaacagctaaaattctggaattttacagaaagttattttcctaatcatcaattaggaaatttttagtgatcacattaaaacatgaagtctcaaacttaggaataaaataacttcaattcccatgctcatgcatgtagtatatggggtaattttagaagccaaaatagttaatacctcattttgaaagatagattgtgaatgatgcagttttaattatttcactaaaaatgagttttctttacctctctccacaaataaattcttggttataataagacactttaggccagacgcagtggctcacgcatgtaatcctagcactttgggagtttgagaccatcctggccaaactcatggtttaacgtggtgaaaccctgtctctactgaaaatacaaaaattagctgggcagggtgacgcacacctgtaatcccagctactcaggaggctgaggcacaaggattgcttgaacctggaaggcagacattgcagtaagccatgattgcaccactgcactccagcctgggcaacagagcaagactctgtctcaaaaaaaaataataataagacactcatatttttattatgctagcctaatatatgtaaaaattgaccttactgacttactattttctttctcatcctcacctttttatgatttcatctctccttaagatgtctttgggaatataagtagatatagtaaacataagttggacctcaagtgatcagttttgatttttttttctttctttctttttttttttttttttgagacagggtctcactctgtcacccagggtggagtgcagtggcacgatctcagctcactgcagctttgatctcccaggccctggtgattctcctccctcagcctctctagtagctgggactacaggcgcacaccaccaggcgcagctaatttttgtattttttatagagatggggtttcaccatgttgcccaggttggtctcgaattcctgggctcaagtgatccgcccatcttggcctcccaaagtgctgggactacaggtgttagccaccgtacccggcctcagttttgacatttgataaaagtttaggttaaatgtgagatggcttaaaatgttataactgttgaaaatagagctgttctatagctaattatttgatagtatttatatcacaaataaaatcttaatgtacagctcttagaagaaaatattacaaaatgtaagtctactgcctggtttatattattttttaaaggacctcagattacagttgatgttagaatttcttggaagaattgtcaactctgataatatacgccagaggtagcctataccttagaatagttagaaccttgctgctgctttaatgattgatttcagtcctcccatttttcattggttgacatgggctttagtttcctaatttactgctggcataatacattcttggtagttgcaaacttcagcttagttcctgtccaaagaatgtttatttcttcaactttactattggatattggtttctttatgtcattagtgcattttactttcagtccctttccatcatagagaatgtcggcatccagaatgatgccccttagggtgattattgagtctgctgacaatttcatggtgtaagaaaatctgcttaatcacttacctatttccatagtgaaaactaccttctaatttttttttctgttcttctcataagtgattttcatgtaacatgccagaatacacaacacctgtctgttaagaacagaattactaggctttgattcttggtagtggttccttcttttgggtaaatatgagagttgcttttggtctaattactcatacttttaaaataactatttgctaataattttaagtaggtaatatatagggttatcattaaggaatattagaagaaaaaatcaatttaaaaatacaaagactaatgtcctatctttatttctaacctgagcctgggtaattttgtttgacatttcatatcaggatatcatactcattaatgaagtatacgcctcagttcttgtgtgtgatgcctgttttttggttttattaaattttcaaggttttttgggattttatattatacttttgctttgcagtgcatgcagattgtttgtaataattagtgctaaggagatgatataagtacagttacgtattgttgtgtgcattgattatattgatattacatattgatacagatattgacatatgcatacttgaaactcctgaaatctttaggcaagttgcttcttttgcagattgcttatggtatattaaaatgtaattctcagcttagaaatataatctagcataaacattcagttgtatcatctgactttgatatcttgggagcattttacagaatatgttctgtcttcaacagtatgtacttctcaatggttagctttttaaaaaaaggctatcaatttaaaggagggtcaatattggttcagagaaccactgttatattgcttggaggggataagcaggttggtagaggtcgcttatcaatggaatggtgagtttgattataattaaacaagattggatacacatttggaaaccgtatttgagtagaccatatgtctatcttgggtgtaatcttttcatgaaagtcacctgtctgcatgtatatgttgtgacacaattatgtgaacaacataaaattatactagttgtgaaataatgtgaatcctgaattcactgagtgatttatatatagccatctgtcgatacctctgggtgattagttccaggacctccctgggttaccaaattctactgatgtttgagagtctgatataaaatggtgtagtatttgcatataacctatgcataccctcttgtatactttaaattatctgtagattacttataatatttcatacacatgtacacactgtgaaaatagttgttatactgtagttagggaatgataacaagaaaaaaagcctgtacatgtttggtacaaaaacattttcgacccatggttagttgaatctgcagatgcagaacccctggatagggagggctgactgtgttagatgtgtggctgagttaatgtgcatgaaatttggaatagccaaactaatgtatgttatacttatttttgaacttcatttaaccatgttttacatcatattgaactttataacatttgcaaatagaaatgacatgaaatatagaaaattgacgtatgttaagaaacagcttgttttcagagctgaagacccggaaatccaatgtagtacttactcttaacattttgtctaaattttccaagcatagataagaggaacatagattatttcatagttataaaacaaaagaatttattctgctcgtttaaaatttgaaagaaataatatatttcaataggcctttctgtccttgtgttctttcctccttttctcttttctttccttcttcctttttttctttacatttttctcccacttttcctccctcatagaatccttccttttctttgcttcagtaatctaaaaagtatttttactacatagtagagcatttcctattttaatttaagttttgaagttttcttttaaaagcaaagctttgctaaagggaaaatacctgtattaacttacatttaaagtttttttcattatgccaaaggtaattatctgttacttctaagaagtaagtcatattctgactctgcatacatgtttaaagtaacttagaatcagcttgggacaattctgacgtctgcttatgtattgcagcattcatactcttcactaggtgttcattttagctgcggatgcttcatataaaacagggtagagtggctttcaaaggatctacacatcaaagtgtaacttgaactctgatttttacactgcttgaggaatgcttaatggagtagaactaacaaatttacttttggcccaaccattattagagtttttagtcctttttacctacatgcctttctaagccatatcacatacaattgaatagttttgttgctttagagtgtttttaaaatgttcacgttaaatattgtgattcatttttcctttagtaaggaagatttcatttaactatgatttctggggaatgaggctgctgcttttggagccttaaataaaattatttgaataaaacaccatattttaagttagaacaccacactcttgcactcttttctatagtttggttgatagttattcatgaggccatgtttatcatcttttaagacctggttctgaagagggatttaaaataagtacagtgattatagcttgtaactacagtataccctcttttgctagtgaattctttgacacagaatgctccttactcaaccccttaccaaagtctcttttgcatttctcagatggataaattgtcacctaaattatacaagaagcacattaatatttgatgtatactattttcttagaaccctgtttaataatcataagttaagcctgctatatattaaaatgtttatactattttaaaacttccattgtggaaaataagcatataatttgacttgatgaattggtggtattattattatctcaatctgaaatactgttgggatgtatcagcctactttggattcaatagaccattctctcttcagatattgtattccaaaattttgaatttttttgtggaaataggtacttacattgtaaataatagttaagttcctaggacaagccatataagtaatagtgaaatagaactataaactctgacctggatttataacattgttcttttgtaatgccagattctaattcagaaatctataaaaggaagagttcccttactatggcgtttctcttccccattcaggtcacagcagtgtgggtgggaatccagaggttccaagctagtgaggaagaaagtgaagatgaggagttcttggctaccctaactggtggcgagcgttctggaaaagctcgcaaacagtggacgcagtgagtccacaatgtgggtagcaatttgttagtaaggacatttttaatggtcccatatttgatacttttatttcatattactccttataatgaaattatgtattttagtaaacctttttaaactagcatattgtaatttcaaaacttttcagcttcattttcagtatcagaacatgaatattaaatgagttttggtgaacagttaagacaaagttatttaaattcctacaggtaacttaaaatcaccatgatgctatacaatttttaagaaaaaaacttgtaatttttctgaattgataaggtagaaatgtatctctgatctttgttgttttggggttcttgactttaatttttttaaaatttgtttttatgaaatataatttttttaaaaaacccacaaaatgcataaaacaaacataaggtatgatgcataggtataaatcaaatactgatgaagttagccatcatcccagaatgatttcccctgccacccatatgataacttttttttttttaataacagcttacttgaagtataatctcaatactacagaggtcacccttttatttatttatttgtttatttatttagagacatggtctgtgttgcccaggctggtgtgtatggtggctatttacaggtatgatcatagtgcagtacagcctggaactcctggctcaagtgatcctcttgcctcagcttcccaagtagctaggactatagccactatgctcagcaaaggtcaccttttaaagcatgctattcattggttttaggagtcactgaattctaagttacacagagttgtgcaaccattcccgtgataaaatttcagaacattttcatcaccctaaaaagaaaccccatgcccattggcagtcacttatatcattccccctccctccagcccttggcaactactaatttatttctcccttctggacattttatgtaattagcatcatgtaatatatggccttttgtgtctggtttcttttgcttgcatattgtttttaaggttcattcattttgtagcatgtatcaatacatcattctttttatggcccagtaatagttgtatgaagataccacattttgtttatcaattcaccaattgatagacatgtggattgtctccactttttggctattatgaataaaagctgcagttaatatttatgtacaaatgttttggtgaacatatattttcatttctcttgggtagatacttaggagtagaattgctgggttgcatggtaattccacgtttaaacctttggggtattgtcagactgttttccaaagcatctgcaccattttacatttctaccatcagtgtatgaggagggttccaatttgtccacatccttgccaacgcttattttctatagttttaattacagcagtcttagtgggtatgaaggagtatatcattttggtttttgctctttcctaatgaccagtgatgctaaacatcttttcatgcatttaactagccattcgtatttcttaggagaattgtcttcagatcctttgctcattttaaaattgacttctttaactttttatttataagttttacaaattctttacatattctgaatagtggtctcttatcagatatggtttgcaaatattttgtcccattctgtgggatttattttcttgatgatgtcatttgaagaacaaaagtttttaactttgatgaagtccagtttgtctgtttttttctttggttgcttgtatttttaggttgccgtatgtaagaaaccatttcctaatccaaggtcacgaaggtttcctcttatattttttttaaagaattttatagttttactatgttacctttttaatatatttttaatagtattcaagtgctatgtttttaaaatttgttgatcagattacgtaagtggtgaaatctgtaaaatatttatcacttgcctttatttgctacttctaaaaatttcaaaagaatttttatgaaatttccctttgatgttactttagtagaataaatttttaaaaattatttgtgttagaaacaaaataataaatattcccatgttataaactttagcgttcaccacagaacccatagaccattccttgaggggtgagggtaggtgagactgtttgaagagctccactagctcctagcccaggtttagaatcacttttccctgggttagacacttaactgggcatcaagagaacagaatttcacttttgaggtcagcacagctgcttttactcagacatttcttcttgctattttgatttctttgtttatactaattaaaagtgtttcttaattattttatgtaagtacaccaaaaggataaaacatgttcatatgcagaagtgccctttgattcttcagaggaaaatagtttattaattacattctttttgtattagtctttttagtgtggctttgggtagaattagcaaagatattttaaagctattatatataatgaaatttaaactatacttcccttggtatgatttttcagatcttttgggagaaaattttagagaatttacctaattattactaagaatatcaatcctagcacttttatatgaagcttcttttttggctagtctactgataagttcatataaaaatttaaaagcaataccatttgttctgtaaatgggcttataacaagcatcaaattgatctcgatcccaagaaagggaagtattacttctctgtaccacacgttattcagtcaaaggatacgaagaggaaacaaagtgttgcgcttatttgaagaaaatttgcctcaagtgtttgtatgacaaagtacatttggcactgtctagacagaattataataagtataacaatttaaataagacaaaacataaactccaaaccagattgtggatataattctgatggatgcttttatttaatcatagtatcaattaagaaacttctcctttggagattaagtgtccctgactataataatgacagcttttcaaatgttaattattattttttagtgttgtcaagactattaaaagtgggcttcagactctcaacataagtacagaaagtgcttattttcaactctcctatttctctacataaaggataaaagtagtctgataagtgctacagactcccacccactcccctctctgttccccctctttctaccaccaaaagactgtttactgtaaagctctaaaagcattcatttggaaatggtctgttctttttatttaatgaggtattgtatattgtgtacattcttaagctaattttaatgaatcttcttttgaaaaccatgtgatgtaaaatttgatatgcatgaatatatcttaagccaaatatgcatgggacagttgaagcagatatcatgtgtcattgttggtaaagtctggcagcatatcctgtgtaaacccctgttttctttttctttgtgccacataatatttattctcattaacaagacttcaaaggaaactgaagttagaataccagttattttttattctctcttaatgggttctgtaacaactaaatactgttacctttcttggttctacgtttcacaatggttcaagagaggaatgaaaagaactagtcattgttaagcacttgttacattagatatttcatatatctcatttaattatcacatcaattgttcaaagataagttttcctcatttttcagattcagaaacagtactcccaaaggttgatgtaatttgctctagatacacagtacgttgttgggagttgggattccaaccaaacctttgttatttccactacatttgacattccaagctctatatgctatggcctttagtccacttttctctccttatccactgatttctcagaagtaccattatattcagtctgccctctgaatactcaaatgactttatctctttctctatttaaaaaaaaatatgtatttcaagctggaagcttgaagaccttctatattccctccattatttttatcttcttttgaaattctctactgttgtaatattttactttctaccacaattagcatattttactttgtacctactgatatagcttccaactcttagaaaatgaaattaaccagttaggattgttttggttttgctctaaatgccagtaagtccagagttaaaatttgtgctcaagctttgtaatttttttcatagtgctttgtacatatttctgttatcacataacactgtattacagttgtttgcatgttatttatctttgtatccattagcatagtgataccctggtaaatgcatagtaaatatgtaatgaatgaagatttctgataaaatttattcctgccttctgatcattacttagagatcctgcacttgggtactactattaagataattctatccaggctacttatatgttagtagtagtagtcgttgttgtacctatgcttttgttaaacataggtaaaaccaaagcttttttaaaacatggacaggaaataaaaacaatattctttgttgtaatttgtttatatcattgtagtgcctattaccactattactcaactagcagctacttgattctctaaagtaatgtaccatagtatgcttggggtttttttgtttttgctaaagatctataagaaaagttttattgctattcatctttgtcaccatttcagcaatgaagcttcactaatatttattatgtaatattttcaaaaatagtaagttcggttcattatctcaaaattgtgtgtcaagtgaaaatatactgatttgatggccctagtaattgccaatagggttttttgagttttgttttgttttgtttaatatacggagtctcgctctgggctctcgcccaggctggagtgcagtgggacggtgtcagctcactgcaacctccgcctcacaggatcaagtgattctcctgcctcagcctcccgagtagctgggattacaagcacccgccacagcgcccggctaatttttgtatttttgttagagacgggttcaccatattggccaggctgatctcgaactcctgacctcaggtgatccgcccgccttggcctcccaaagtgctggaattacaggcatgagcctctgcacccagccatccaatagggtttttaattttggaaggtagcttttgggcatgaacaagcacactcatagttagttgtgttttattagagttataaattgtaaaatctagtttttctaaaatgccttttcagttcaattaatgctacttagaaatttagtaattgttgtacaaaaatgagagcagtctttttcacttcttgatatttccagagtccatcccttttctagatttaattcttaaataacacatagtactacttatatagttaggcaaatctaattatattcttgattaatcaataaatgaactttgctaattccagttatagtttagtatagctgattttttaagcacctgcaaatataacaagtgaaatcctgtgatacacttaagcaacccttgtaaatcaaataaattttacttataaatgtagtaaatcaccatcctgtttcaaaagacttaaaaacaaagcacacacacaaagtagctgatgaataaaaacttgttgctataccttgaaaaatacaacatacataaattatcaatataatatttgtttcttcagctcaaccaagaagactagaatgtccatctaagcctcactggagcaaatgatattatgcattcagtttacagggatttgggtctttgggagatcctgagcagtctcactctgttgcccaggctggagtgcagtgacatgatctcagctcactgcaacctttgcctcccaggttcaagtgattctcctgcctcagcctcctgagtagctgggactacagatgcacgccaccactcccggctaattttttttatttttagtagagatgaggtttcgccatgttggccaggctggcctcgaactcccgacctcatgatccacccgcctcagcctcccaaagtgctgggattacaggcgtgagccaccacgcccggcctgtccaatctctttttaaataaacttgagccccttgtcattgttacattctgcctgctgtgtccgtaggagactcccccagcacctccatccgtgcttggcttttaattaaggccattttaagttttacaacccagtgcattgtgcatctactgggcatctgttaagtttcacccctttggttattttatgtttttctctttcatagctttttatcactttgtttcagtgaatagaatctccttttactctgatggcattcttcctcctctttatggacattgactccacagtcagtgagccagatatatacccttctagccataaatggtcatttttaataaaccaacatttctaataattcttaatgtatgtaaaacaatatgtatgaccaaaacaacaaaactgacactagtaataacatagtaacagggttgactacaagaatagtatatgttattataatccttattttttttgacagctcaatacagaatacatattagaattcagtagagttctgttgagagtcaagtcacatttaaaaagaacaattataacactcattgagaattcactgtgctagacattgttctaaatactttatatgaattaattgtataaccttcacaaaaaaatctatgaggtatatactgttaatatcctcattttatagatgatacaattgacacacaagtaacacaagaaggtttaagtatttgactagggtcatataggtactaattgacagagctgggattggaaccataagctgaatccatcgtcatcaagtgccatccagagctagaatatgtgtcttctgactggctttaaatatcatgctcttattactgtaccaggccataaattatttgaaatacgaagggtcagttttggaaatagatgtttgtgactaggaagtatgaagagtaaaagactctagagcttttctcactataactgccattattagtatttacttagactacattcatttttatactttttaaaggattttcattatgtgcttagtgattttaattctgattttggttcttataagatttatacattgtaataattacctttgctctgttatagtatatattatctgccttttaaagatctccagtattataaacattacttttgttttgagccttaattgactgttctgggtttttcagccaggatggagaaaacatttcatcaggatcacctaaggggcttttcctgctacctgagtcttgagtccccacctttcctcactcatttgtgttgagagtcactgtccaaccgagcaactgttattgatgtgaattttgttatggccttcaagtgtgttagagtaggttgaaaggttaaaagtcattgttgtagactagtgcttctcaaactttaaacatgaatcacttggaaatcttgttaaaatgcggattccaattcaggaattccaatatgcagcctgagaatctacattttaataagatccaggtgataaccaaaatgctacaggtcctcagagaaaactttgattaacaaagctctagactagttgttttgaaattttgaaaaaaatttttattttgagataattacagattcacatgcaattgtaagaaataatacagaaagatctacatacccttcatctagtttcccccaattctaacatcttgcataattacagtacagtatcacaaccaggaaattgtattaatataatccacaaaccttactcagatttccttagttttacatatactgtgtgtgtgtatttagttctatgcaatctttatcacatatgtaaattcaccctatattcaaaatatacccgtttcaacagaaggatctcttaggctacccttttatagccacagccacctaccttactgcatttcttccctaacctctgacaactactaatttgttttccatttctaaaatttttgtcatttcactaatgttatatcagtggagtcatgcagtgtgtaaccttttgagattgacttttttcacataacataactcccttgagatctatccaagttgttgcatataccagtagtttgttcctttttattgctgagtagtattccgtgggacagacctattacagtcagtttataagcattcacctgttttaatgggtagccctgggattgctttctgtttttgactctcacgaataaaacagctatgaacgttcatgtataagttttttggagaagacatttttacttctgggaatattcaagagtataattacttggtcatatggtaagtgcatgtttagttttgtaagaaactgccatactcctttcctgagggactgtactgttttgcatttgtaccatcagtgtgtgaaggactatttttccacatgcgcaccagcatttggtgttaccactaatttttattttggatattttggtaggtgtgtaatgatatcacattgtggttttaatttgcatttctttaatggctaatgatgtgtgagatatgttttcatatgcttatttgccacctatatattctctttggtaaaatgtctgttcatgtcttttgcccattttctaattggattatttgctttttttaaaaactgttgaattttgggagttcttatatattatagacacaagacctttctcggaaatatggtttgcaaatattttctcccagcctgcggcttatgttttcattctcttcacaggatcttttgcagaacaaaagcttagctgttgttgttgttgtttaattttaattaagtctatttattagtattcccttttatgggtcatgcctttagtgttaagttctaggctgattttgaaagtagtgttaaaatgactttgcccttttttttttccttgccatatagaaaaacattaaaacgtaaacttctgaatttcatgattctggactttttagcttacaaacaactgaagagtaaatgaatgaaattaaaaggaaataaaaccttgagtgaacacagtttgcatagtattaaattagactatgcattacagtgttctaaaactagtggccctggtgatggtatgttttaagttacaaattgttatgtgtcagaattgtgttgtgcattttattatctcagaaactataatgtaggtattatctccatttatacatatacatatgtgtttacacagatgtatatatacacatatgtgtttacacagatgtatatatacacatatgtatatattcctgttttgcagttgaaaaaactgaggttcaggaaagataggtagttgtgtccatggttccataataaatgacagaaacaggacttgaatctaatactcttttttgagacagagtcttgctctgttgcccaggctagagtgcagtggcgcgatttcggctcactgcaacctccgccccctgggttcaagcaattctcctgcctcagcctcccgagtagctgggattacaggcacgtgccaccatgcctgactagtttttgtatttttagtagagatcaggtttcactatattggccaggctggtctcggactcccgacctcgtgatcctccctcctcggcctcccaaagtgctggaattacaggcatgagccaccacccccagccgaatctaatactctttaacaactggctggcatcttttgttgcatcatgtaactgtatataactcataggactcaaacctgatttaagtttgtgatgatcgtgcctgttactcttaaagtccatacattgtctgattttcagcttatagtaaatcatcatttcttgttttatcaacgttaatgttaatattggttaacctattggctctactggctacatttgaaatagagactttttctttgcatttcatttctttctttctttcttttttttttaagagatgaggtctctctgtgttgcccgggtgagtctcaaactcatgggctcaagctctcctcccacctcggtctcctgaagtgctgggattacaggcatgagccaccatttacaatatagctgtaacacacattatttataagaattctaagttttacacttgaactatttaagaaaatacataaggtttcctaaaatgtttataagtttcgtttttctgcttttcttcaatatatctctgagctatatcaacactgtaaatttcccatataagaaaaaatgattgctgtattggtgaaggcacatgagtagaggagagatgggagcagccagccattaccacctcagtttttcatttcatttggtgttaagaaatgactaacatacatttgaaaaagtaacaaggacagtttcaaaggtgacttacatcatgttatttctcatgagagtaatactgtttcttggaagttattgaaatactttgcatatttacaaatatgtggcaagatcaggtattgtggtatattcctgtttgcagtggctttcttgtctgtcaacctaagatttagattgcattggatattgttagtcttgtctaattttatatatactaaatcaacgtttacagcattcctatttgtggagatttaaaaatatttctcagtataatttagtcttctttgcagagctctaacatcgggctaatgagagctgttgaaaagtttgcaggaatatgtcctccattcccattgcccttaagaacctctgtacttgaatgcatgatctctctatgggagcttttattttaagggtaattgtcttagtccattccatttgggctgctataccaaaatatgttagagtgtgtactttttttttttttttttgagacagtttccctcttgttgcccaggctggagttcaatggcatgatcttgattcactgcaacctctgccttctgggttcaagtgattctcctgcctcagcctcctgagtagctgggattacaggcgcccacaactatgcccagctaattttctgtatttttagtagagatggggtttcaccatattggccaggctggtcttgaactcctgacctcaggtgatccaccacgcccagcctagactgggtaatttataaacaacagaaaattatttctcacagttctggaggctgggaagtcagagatcaaggcttcaacagattcggtttctggtgagggctgctctctgcttcagagttagcactggttgctgcgcccccacccccacccccccaacatggcagaaggggcaaaagccttacaagctccctggggcctcttttataagagcattgatcccattcttgaggactctgccctcatgacctaattacctctcaaaggcttcacctcttaatactgccatgatgaggaataggtttcagcatgaattttggagggacgcattcagatgatagaagtaactaactccccaaattgagtatttttttgtcgtcctgattgacttaggtacttaattgctatttgctagcacactaaatttttaagaataagaatattacgtttttaaaggtactgtataataaatattaaacagaaaatgttcatcagatttttggttggggtatattgagtttttgtgttttaaaataagattttcattaaatgagaaacaacactttgctgagcattttcttgtttttaccattctacagcgtttagctacactatgtaatagcactggggctttgtccccagtaagcaaatacctcatcataaaagattgttgaaggttatacctttataatacttgctcagatttgggaaagggtgaaaaaaaagatatataaaaataacaggatatttctccaatagtgaggttagagaagaatttctgttttttaatatgtaaccaagactagttggcctttcctgtttagcattttttttcaggtaatttttaatcttttagttttaattattatggatacataatagttgcaattatttatggggtacatgtaatcttttgctataagcatgcaatgtgtaatgatcaaatgaggatattcaccacctcaagcatttattatttctttgtgttagaaatattccaggtaatttcattatagcaaagccacctcacatttcatacactaattaggatatgaatgagagctccaaattcttgaaaagattcctttgactttgttgttttcaggttggactgcgggaggtaccttctgacttttttctttgagttgtgggtacagtcctgctgtcttccttttccactgcaccagctccagttgtcttcacataagcttgctgtattcagtcagcctctcaccagtcattctggttttggttcataaccaagtcaccatacatagcactgctttccattagtcgtcagaaaaagcctttcaccaacattacttcctttgctaaaaagcattaaaagcttcttcatggcctgaagatcaaaaaccctgagtgagggatggctattttaaattatcactacagttccctattcatttcttttcttctctgaactcctcaaccttattatctttacacagttaatcacttgattatgcatgatattgttcttggtttcaacttgtatgagaaagtatggctttttaaattgaagaatgtattagtctgttttcactctgctttaaagaaatatctgagactggataatttataaaggcaaaaggtttaattgactcacagttccgtatggcttgtgggggcctcaggaaacttaaaatcatggcagaaagggaagcaggcaccttcacaagccagcaggaaagagagatgagagtgcaggaaaaactgccacttttaaaaccatcagatctcatgagaattcactcagtatcacgagaacaacatgaggaaaaccacccctatgacccaatcacctccctccctcgacacatggggattacagtccctccctagacgggtggggattacaatttgagatgagatttggatggaaacacagagccaaaacatatcaaaggatatcaatcatatttttaaaaataatccctaaagagttcaaatagtgaagtgaattaaatcatattcaatgcatattatcaagattttttaaaaattacaattttcatacttgtcacaaacactcaaatatattattggattactattttaaaatactatgtattcagtgaatacataaacatagaattaggaaaggcagctcacatgcttacatgtttattttttctacttatttttatttattttttcattttgtattatactttaagttctggaatacatgtgcagaatgtgcaggtttgttacatagatatgcatgtgccatggtggtttgctgcacccatcagcccctcatctacgttaggtatttctcctaatgctatccctcccctagccccctactccccgacaggccttggtgtgtgatgttcccctgcctgtgtccatgtgttctcgttgttcagctcccagttgtgagtgagaacatgaggtgtttggttttctgttcctgtgttagtttgctgagaatgatagtttccagcttcatccatgtctatttctttttaaaccaaatctctaacagttgtgtcaaatatgttgaggtatacctctgtcattaaaagacaaaaacaaaaccttgtcgctaatgcctaagtgtttgaagtcatattcttataaaatatgaggcagcctgggcaacatagtgagacccccttctacaaaaaagtaaaaaaattagctgagcatggtggctcacacctgtagtcccagctactctggaggcttaggtggaggattgcaacttgggggttgcaccactgcaattcaacctgggtgacagagtgaaaccttgtctcaggaaacaagcaaacaaaaaatatgtatgtatggcatttctctgttcttgttaagttttaatgatttttcatctcagaaagcttaaaatttaccatcttaaagtgaaataaccgttaagagggagagaggaggtaaaaatgcttttattctctttaacatttatttatttactctgtggttggcaaagttgctcatttatttccacaacaaactcaagagatatggaatgtcccaaattaacagataaaggaaactgggtacaagatcatagatcttgcaaacagtggtgctcttcatagacactggctcatttcagagcctctgtactctgtcatgataaagcctccatcatcactaaggaaatttagtaaatgaaacaattttaagagtaaaacaatgagattattagcaataaattacgatgtagtgctgctaacagtttttgtcagatgaaatggctggatctgctgttttggaaattgtgaaacctatcgaaaagttgaaataatgaaactactaaaatcatacaccctctacctagaatcaccattagttaatatttttttatttttgctttgtcttcacacacacacacattctctgtctctctctttctctctctctctgtctctctctcaaccattagatggttaagttttggggccaggagcggttggctcacgcctgtaaccctaacactctgggaggccgaagccggcagattgcctgagctcaggagtttgagaccagcctgggcaacatggtgaaaccccatctctagtaaaaatacaaaaagttagctggacatggtggcgcactcctgtagtcccagctacttgggaggctgagccatgagaatcacttgaacctggaaagtagaggttgcagtgagctgagatcgcgccactgcactccagccggggtggcagagcgagactctgtctccaaaaaaagagaaagaagattaagttttggatatcatggcacttctttcctaaacacttgaacaatgaatttcttaaaaataaggattgtccttattgtacctaagaaatttgacattaactcaataatattatcagttgtccattctgtatttccccatttatcccaaaactgtgtttcatagttggatttctaaaaaatgtccttcttcaatttagtattcagccatggtttatgttttgtatttgctttgttagtctctttaagagatactgagaaaaaatgcttttgttgatatctttttgtgttgtttgctttttaatgtctttaagtttttgaagggtcccagccaattatctttagaatgtcccacccaactttggatttgtctgtttcctcagaattagatttacctgaatttatcatgttaaacatttttcacagtgataccacatctgtgatgttgtgtaattatgctaacaccgtatcaaaaggcacctaatgccaacataaagtttatgatatataaatttgtaattggcagcaacaaagacttaattgcttgaatcattttttcctttttcaaatagacaacgactgaaagacctttcattcagaagctgtttcgtcctgtggctgcagatggacagttgcacacactaggagatctcctcaaagaagtttgtccttctgctattgatcctgaaggtaatacaatcagcaacattaaaacatttctttcattttctgttactgaagtaaaataagcattccacatttataaacaacaggttatttcaggaagatattttcatatcttacagcgaaaagtcttttcaaacagaagcacctaatatttaatatattattttgtaaattattgactaacaaaatgatgactcgactggcgaaataaaatacagtttttaaatcatcctcttagtatatctctggtactctggtttttaatttatggattcagttctgataaatactacttttaatcttgcattttgtttattaactttaaagaagtcagaaatggtaaaaataattttctcatttttgatatttgaaagttgataatactgaaaaatggatgagtattttatttgaattttctactactttctactttttcagttaacctttttcttttaggctttgacaatctacaagttcgttcaaaaacttgacctgtttcatggcgctaattttgtaacttaggttaaggctgttttcctgcaagcaagggacaaattttaaaatttctgaattctgtttttctttattacaacataaagaacaccaagaaaatgcagaaaacaataaaactgcccataatccattaactgatagagaccactgttgagacacacacacacacacacacacacacacacatatacacttgaatacttgagatatacatatgtgtataatacatacacattggcccttcatatccatgggctccccatcatgcccacagcagataaaaaacatttgggaaagaaaatggatgattgtgtctgtactgaagataaacagacttttttttcttgttattattccctaagaatacagtataagtatttatatagatttacattgcattaaatattacaagtaatctagagatgaatgatttaaagcacacatgtgcataggttatatgcaaatattatgccattctatataagcgacttgagcctgggtggattttggtatcctcagggatccttgaaccaatccttcatgaataccaagtgaccacattgtgtgtgtgtgtgtgtaaaatgtcctgctgctcttgaatcccagccctattaatgcttactaaactataggggaaattttcagtggcatattactgtattgacataaaaattgcatagagttggtcgggtgtggtggctcacgcgtaatcctagcactttgggaggccaaggcgggtggatcacgaggtcaggagatcgagaccatcctggctaacatggtgaaaccctgtctctactaaaaaacacacaaaaaaaatcagctgggcgtggtggcggggcgcctgtagttccagctacttgggaggctgaggtaggagaatgacgtgaacccacaaggcggagcttgcagtgagccaagatcatgccactgcactccagccttggtgacagagtgagactccgtctcaaaaaaaaaaaaaaattgcagagttgtatttattatataatagaaattttttttaaaaaactttaaatccatgaaggaaacaggtaatgcattagtatatatgaaggtaatactttaacagataatgcttgtttcttacgaatgtattctgaattggaggaatgcaggattacttgcatgacatataccacacagttcatgaagcattttgcatctaaggaaatagtttgcctaagtagtagaattaggaacagtgggtttggtggtaatgttgtggtattccagcctaaatgactaagcaaagaatatggagcccaaaatatgtgtcattcagcctgagaatattgcaattttccttagtcaagtatgcttgcttatactagcattcctacatgtatgtaatgctttaaaaatgaacagaggttcattaggaaggggaagggcacctacaataatactgtcagaaccaatgccagaaaggattgaaggaagagaccactgactacccaaattattaaaactgaacaggatttaagaggttataaatacattttataaagtcttccttgaactttactagcctttatagtaaggtttctgatgatgtcttacacacatccatgtatctctagtgctagggtaaatgtttgccaaacaatccagttactgaattctttctatcattaccatgaaacatattatttacgatcattaaatcttggagcaattaacattaagttgattataatactatcttagactcctaatccatctttactactgtgtaattttagctttcaataagagttttagttaaataatttttttataatttaatgattttttagtaaatttatagagttgtgcaaccatcaccacaatttggtttttagaacatttccatctccttgtacttacttgtagctaatctctgctccactgccagctataaacaaccactggtctgttttctgtctctataatttgcctattatatttcacataaattgaaccatacagcatatagtcttgtgcaactgtttttttccacttaacattatgtatttgagttgcatccgtattgaagcaagtgtccatagtttgattggtgaataatactccattgggtagatacatcacattttggttctccctgtaccagctgatgggtgtttggactgtttccagcctttcacctttataaacagagctgctaggaacattcaaatatgggtctttctgtggacatttgttttcatttttcttgggtagcttcctaggggtggaatgacaaggtcatatagtaagtttattttttattttaaaagaaactactgagctttcccaaagtggctgtaccattttacagtctcaccagcggtgtataaggattccagtttctccacatcctcagtcacatgtattgccatcctagtggtatctcatgatgattttaattctcatttttctaatggctaatggtattgaacatgttttcatgtgcttattataatttgtagatctctttgatgaagtgtctattcaaatccttgttttttttcatggattgtttccttattactcagtttttagcattatttatatattctggatacaagttctttatcagatacacaatttgcagatattttctcctagtctgtgacttgccttcattttctttctctctttctcactctctctcttttttttttcccagacagggtctcgctctgtcacccaggttggagcgcagtggtgcaatcttggctaactgcaacctccacctccgggttcaagtgattctcgtgactcagcctccctagtagctgggattacaggtgcctgccaccatgcctggctaatatttgtgtttttagtagagacagggtttcactgtgttggccagactggtctcaaactcctgaccacaggggattcatccgcctcagcctcccaaagtgctggcattacaagtgtgagctaccatgcccagccttgtcttcattttcttttgaaggataaaagcatttaattttggtgaattcctgtctatcaagttttttttaatggattgtgttcagttaaataactaaaactttttttcttataggcaatacatttacatattttaaaaatcaaagcatatataaaggaatttagtaaaaagtctctttcctaactacctgttcaccaaactctaacctggttcccctttctagagacaaccagtgttgccattttcctgtatatctttagagatagttaagtaaactttttatttttgaactcaggctacagaaattttgccttagtaactcataacttctgagaaattcccagaaattcaagaataagcttacttttttagttcattttctctgttataagggtgtttgtttttgatctatttaatatctatttttgtttttgaggattttggaatatagatgagttattttcatttgaagtgtaatgaagaggttaatcgtttttattgctgatagagataaaccccataaacctcttacctgtccgtggcagcactggctttcagttactcatttctctgtattgtgtttttttccctttttgagtactttgtagtagtactttaaagaacattaaaaactagatgctgtgttagtctgtttgtgttgctataaagaaacacctgaggttgggtaatttataaagaaaaaaggtttatttaactcacagctctactgcctggagattgggcatctcatgagaccctcaggctgcttctgctcatggtggaagctgaagggaagttggtgtgtgcggtggtcacatggtgagagaggaagccagagagagcagggtggtgccaggctttttataataaccagctcttgtgggaactaaaacagtgagaactcactcctccacacccagggagggcatgaatctattcatgagggatccacccccgccccccccaccccaacccaaatacctcccattaggccccatttccaactttggtgataaaatttcaacacgaggtttggcggggacaagcaaccacactataacaaatgattttatcaattaggagtaaatgaaatttaagccagagtttaatatttgaataactaccttttttgaaaacaaaaggcagggtctcactgtgttgcccaggctggtcttacatttctcactcaagtgatactcccactttagcttcacaaagtactgagattataggcatgagctactgcacccagcctcaaatgactaccttattgcacttttcctagatttttttcgacaatctactttttaaaatatgttgttttaaacttccttttttataacatccttgactatagaatgagaacactgcaatgaaacccaaaactttggaagtaatgtgttctgtaatgatctgtcccctaacagcagcacaattgtcacagacacaaaatgatccatatttgctagtcccaagtttatataagtggggggtctcccttgatacatttgtgttttatctgtaaaaactaaagttaacagttgctttttaatccaggaaagagggcttacttgaaattttatattgtttattttgttaatggattcatttgttcaattcatttttatttcatggttgccaatttctagtttgtgggtgtggttaaggagtgcctagagtgggaagaaattagttgggtgttaatactgtattttacttctttaaagaattgtataactgtagaactttcaatctacttttttttttttttgagactgattctcactctgttgctcaggctggagtgcagtgatgccatctcagctcactgcaacccctgcctcccaggttcaagcaatcttgtgcttcggtcacgcaagtagctgggattacaggcatgtgccaccatgcctggctaatttttgtatatttggtagagacggggtttcaccatgttggccaggctggtcttgaactcctggcctcaagtgattcacccaccttggcctcccaaagttcactctcttaatttttgcatgattgtgccaaacgtctcttaaccacttaattgcagaaataggtttagaacacaggtctccatctcctggtggtcttttggtttttccactttactatgctgccatttgtttttgttttctttctttttaactttttggtttagtttaaaataacattctgaaatacttgctttttccttactctttattttactttcacaaatcttagtcttcaatttgtgtttagtatctaatctgcctacatgctcttctctcttaataatatttctgatatgatcttaggaacctgagtgtctactgtttttattttgtttgttttgttattttagtgttcctatatataatcctgaccactcttgttgaattttttaaatggtgattatgaacatcagacacgtaaatgaaaagcattcaagtgctttgaactgacactctcagaatacacctttattctgctcttatacccaggttacaagacaagattaacgtgaccctacacaagaaaggcacacaaatttgtgaagctgttcttttaaaagagattctttgttctgttaaatttctaggctgctctacgtgtacatccttttctaggggatacacagtgtgacttcccttgtggtttttttttttttttttttttttagaggggagcagtgaggcagcgcagccacacaacctaatccacaaaccttccttttaggtgatttcaggtgctgtaggtgagtacatctgtgtgacagacttctccccatgcaaactgtcaaatgcttctcttgactgcagaacacacacttcattgaaatgacatagataatgcctattcttttcaggtatttttgatggtatctttcataccaggaggaagccacatctctaacacatctcagtatcttttctttagaaaaaaacttttatctttgcttcttctttttattacgtattaaaaaaaattgtcatttaaaaatctatgtagagtatccaaaacatcgagtcactgtttcagtaaaaaactgtttactgcctggttcagttcacctgtagtattgtcagatgtgtcaaacatgaagcattttgacacacctgcactcaacttaagttgaaagcgaaagactttaagattgggtgtgtatggataagaacttgctgtcatcacatgatgaaaagagaaagtacttcataaaagttatgtggcaccattgtcttctactccctacaagtgattcagtgatgaaagaattttgtctgatttcatcatatgaaagtcaaatgtactagtatttatgaatacgtgctttaggtcattgttcttgtggagtaactaatgatgagctgctgcttgtggagtaactaatgatgagctcttttgtgtgttcctttctttttttgtaaatggctaagggaattagtcaagttggaggtaacaggaaatgaccaaaggtgagctcaggtaaattgtttttgtcgtttcagctgtagttaaaatgactcagagatctaagcttctgtgccagacctgagtgaaatatttttttctttgtacattaaaaataacacatcaagaacatttatttttaccttggagaatacaaaacacctataagctttacccaattatacttcatttcccagtcttctaatgtaatgtataacaacgtggtaagctaggcgggtggatcacctgaggtcaggagttagagaccagcctgaccaacatggtgaaaccccgtctctactaaaagtacaaaattagctaggcgtggtggtgcatgcctgtaatcccagctactcgggaggctgaggcaggagaattggttgaacccaggagccagaggttgcagtgacctggaatgcgccattgcagtctagcctgggcaccaagagtgaaactccatctcaaaaaaaaaagaaaaagaaaaagaaaagaaaaaatggtatattcacatttttttctcctttgctgtatatgattagattatgttaataaagtgaattagttgacaagataaatttttttcagacataaagcagttagaaaaagaaacatataaatctcatgctgaccgtataaagcagatacttttaagtatttggacaaaattgaagctggttagtatctcgtgatttgagataatatttgagcaataatcacatttgtcagtgtgatggcactgcccccggaagaataggcactcagtttgcaaactcatgccacaggaataaaaaaaactccaatccccaaacctcatcagattgcgggttttacaatttcagtaattctttagatattcatttagaatttgaattagaaggaactagtatctctgtaccttcacgctatttgatttgggcaataataatgctgattattttcattctccactactggaaatgatgacattactggactgacagaagatgcttctggtttctccttctgaattattgttatcttaatctcaagaagttaaatgaattaacctgactgttcccaaaatgagaaacacacacttgcacaactatttcatctttagcactagaaaacaaaattctcttaccaaaataatagtatatgcagacagttaaaaacaagttatcttttcattgaaacaggtactatggggcttcattctgaccatatgtaaacagtacaattattgtctatattttaaataaagcaagtaagttgagctattctgtagttcatacttgacaaatattaatggaccctattacacccaactagaattactgggtcattttatgaaagcagataaaataatattgttttcaaagtttatttatgtatttattaatgaacaaggtttaatttttaacttttaccacatttttatcttattgtcaggaagcttttaatcagttttaaaatggccttacaatcacttaatttaatacactttgctttttataattacaactgatcatatgggattttttatattatttaaattttagtttatgtcctccttactaagaaatacagagattataagcaaaagtcaatgaaagaattaatatggacatgtttttaaattgtttaaaatgttaagagtcaaagctctgaaaatataataaagatataaaatgtatacatggaaagagatatgtggtatatctggtatttggtatatactatgatattgcatgttcattaagacctgtactgctaagtgagtatgcatccggaagaagttaatgtaagtatttttaaatgggtttgtatttttctgataaacagcactctccttctgtttgtgatcataggataaaagccctgtaagcttgtatatgttcatttttactgctacatcatgtagtgtgctcttaagattgagatctcattccccaggaagcatttctgtccaagattaattgcccttttaaaatcagcgtttgatgtatttctttggctatatcctggcttggtttaaccctctttgacctgacctcgctgactattacctccgtggctgagacaaaatccttcagcatgatgtatgcacttcacatttcagcctgtggtttttcatgtcgatggattcaattagttggtgttttactaatgaacatatcagaggttaaagaatttgtcagacagaacaaaattgttcaggctagtggtaatcagaaagctcgtcgctctattttttaaaacttctaggcagtattaagtatttttcagaaattttaccttcagtattacacattccaagatagcaaatcaagtcattttctgctgaattataaaatataaatatgaagctacaaagctgaacacaatggttatatcatttgatcttagacttctactccatatttaaagtatgagcttttaaaaaattaattaaactgaaattttcttgttaaaaacatgtatgaatttcccttaaagatacatcatccatttctttaagcctcctttaaatattaatagtaagaaggaaactcaagcatctcactagaatctcaagtcacctgtttttaaagacatttatagatcatattccttgttgaaattggcttagttgaataagacctaaaacccagattgggatgagaaaggtaattagtagccattagtaatagaaatctttagaactcaaatttatcacacagtgcaagttctcaaatgatatacttaaaatgtataacataaagattttgaaaggttttttttttttacctgaatgttttcatcttttttaaaaaaaataaccttacctaaagtctattaaatgatatatctgtagtacactagggctcatttgacttataggtgatgtgctccacttgaatatatgtgttgagagcactattaaataaacgtgaaggtttctaatacttaagaatttttcttaatgtcatttaatttgcataatcatcgagtctgggtttttgttgtcttttaaaaaatacatttattaaaattatatgccatactgcataaaaatggaactgaataattcaggaggtattaccatgaggccaaattcttacagccctttgtatgccaatcacataattgaatccatggtttttatatatcttttgatatatctagtactaaaaaaatgaacttattcttataacgtgtgtaggaagagaattacaatcgctctttactttttgttactaaatcatgacctttttaaaatgatcttctgtcctcacatactttatcagttacatttttgacaccattattttttattagagagtgagcaggagagaggggtggagaagagtcactcgtgttattgagtaccctgtgtccaagtcctgtgctagggtcgctgctgagtactttgcttggatatcccatttaatccttcatgtaactggagattagaattctttgttcacactgtaagatgaggaaacagaagtttgagtgaattgcttgagaattcaaaactaataaattatgatggtttacactctgaaagaaatattttgctgtttagacgtaaaagacccagatactggaactgggagacgtgttagtgatcctctactctggaccagtttgcaaactgacccacagagttaaatgagaagctatcatgggttataaatcagcaagcagaacttaggagatggtctcaatcccacattagcaaaagctgccatatctttacctgtgttgtatattgggtttctacataaaattttgtttgtagaaaaattctacactggtatgatcataagattcattctagggaacatttttaaaaaaagactttaccccagaaattgattcagaaagtctggagaggagctcagctcatatatatgtatatattcttttaatttcccacatgattctaatggtcagctagattttcaaaccatacatctatataggcatcttcattttatatataaagaaacagcttcaaagtgacgtgagacctgctcagagccctttgttgccagaactggaattcaagttgcctaacccccaatttgtctttcattagtaccttgctaactagtggtgcataattggccctctctcctttatgtctcatttatattattgtatattgataacagtcattgtatctatgtctatatgtaagcatcattttttaatatatacataagaagttaccattattttaactttgtgatttccattaatgacttgtgtggttaatgtgatttttattttttcttcttattttttttctatatgtaattcttaccattctaatcatataaccaaaatctacttgaatatgtttttcttaaaacgtaactttttttttatgttcacttttaagtagatgctggtttctaaaagtgctttgtggacattatacaaaataatgagatgtactcttcaaaattgtaaaggttaagaaatgtagaaaaggctaaaaaacggttgcagattaaaagagagtagagagacataaaaattaaatgcaatatgtgcatccttgacatgacctgaatgtatcccccagaattcacatgttagaagcttaatccccaatgcagcagtgttgggaggtgaggctttttggggggtgtttaagtcatgagggctctgccctcatgaatgggttaatgctggtatgaaaaggatttgcaagagtgggttcactgtctctcacacttccacgttcttccatatgagaacacagcaagaagctcataccaggtgccagcactttgatcttggattttccagcctccagaactgtgagaaataaatgtttgtcctttataaattatccaattatagcatcacagacagactaagacagtcctggactgaatcctagattgaagaaaaatacattattgggatagttgataaatttgaatatggactacaatgaatattttattattttatatatcatggtatatcagtattttttattgtgataactatactgtagttatgtaaaagaatatcttatattagaaatggtacactgtaagtttgaaatcataacaaaaattactctctaaaaagtgccctatataaagaagttcatatagaactagttcacttgatttttctcatatgtttgcctaacttaaagcttcaagctagctttttttaaaaacctgagtgggagaggcatacagtaacatttttctcctgagtcattttctttgtagtgacatttctcattctaagtattaaggtctagattcccattttgaaacaaaaagacatgtttaccaaaaatattgtttactttaacagtatcaggtgtttcctttgtactgtaagaaaaagacatctactgattttttttttttttttactgttttattattaattttttgtttttacacagggtctcacttgttacccatgctgtagtgcagtggtgccatcacggctcactgtagccttgacctcctgggctcaggcaatcctcccacctcagcctcccaagtagctggaactacaggcatgcaccaccacgcccagctaaagctaatctttgtttggttgagtttttttattttttgtagagatggggtctgttgcccaggctggtctcaaattcctgggctcaagcgatcctcccaccttgacctcccaaagtgctgggattacagacatgagccaccacacctggcctgttttcttttattggttttgatattgctaaaatgtccttcatactttgttgttatttatggtaccatgaattaaggatagcatatacatttggcttatctggaaacattttttactttgttgttttaataaccaaaacagtctttacgggtagagttattctccatggtagggctagctatcagaaagcattccaaaaacattaattttgacagtataattctaccagcaacaatattatgccagctatgagaatatttattatctaattactgtatatgtcaggtaccatgctaggcactggggacagagtaacaaataagagagaaacttcggtttgaagtttctgctgccctattctaagaatccctctgtttaaaattgtgttattgaggcaagtcagaaaataaacaaaatacataaatgccggtgagatatttggacatatgtaggcagtgacaaaataatatatttaaaaccttaaactgttctgttgagggatatgacagtcttagattctttccttagttacttaaatttagttagtgatgcttttatgttaaaaattaaaagtggccccagcttctaaaccagagaatcagtgctacttattcagggtttgggtaaggggatttattaggcttgttacacagtgtttgaatagtgcttttgtcctccagcttctgttgtacaactcataaactccagcaatccttttgtaacatggttggtcttttgcctttcagatacactgtgcatcatcagtggattgtttaccatattgtatttgctcccatgtttaaatattgctttagatacagtactttggatattgagttgtgacttgtttcttctgctgtttcatagtatacaaaggtgactggcttaaggaaaaactttagagataaggaacttttactcttacaccactattctttcattttttgactcagtgctaagtaggaggaagattctgagaatattaaaatatttcaaagaaatataagaatatgaagagaattataccggaaatgttttcaaatattctaagaaagatttaatacagtaaagctttagcaaactggaacttataagcaatgaatcattccagatagctgagggtttctccatttcaataccaatgtttaaaaaatcttcccaaagtactggtactatgctttctatagtattctgtatatagcttaatatttcattatgaaaacaaatcattatattaacactatggtcacaactgtgtcaaattatgtataggtgcaacaaagaaaaaataaagcatttttttaggttagtagtattataaagtgataccttttttcaaaattgttttaagctatggcacagtgatttgggagtttggaatgttttatttggttatctttggaattgttagtatgttaaagtttttatttttcacattcttttatcaactgtagtattttgtgtcctctgttgactgtcacctgggactgtgctgcctctaacaggaagtctaaatatttctttaaaagggtctcttgtttcaggtgccagccaagtcattatcaccatacatcatcagctcattttgcccagaccttagagcacttacagattcaaaagtcattttgaacagagcagaaaggaaaacgtagggtatttctcctttatagagttgcttgattccctgtttccttgttgtcttctgtcaccaggaagctgagaggtttagacattgtattttgaagagaaggtaaaggagacaaacccagaattgtgctaaaggaataacacaaagtttcttgatggttctattttttttttctttttcattagaggagtttggctttgctttctttgtttttctatgacaaaaatctttatatttactttaaaagttgtcagtacaacacaccaaaatcatgaaaaacacaaaatcttaagtttaatttggaatacaattgaatttaaaagaaaggtgtaaatttcagcccccttttaattagcaagtggatgttaacaaaaatcagtcaggctttatgactctaaaacaggaatccctgagtcagatttgtaatcccttctcattaaaattttaactgttattcaaatagtatctctaagacattttgatacatacttgaatgctttactgaaaacaactaaagctcacctgtgtcttactaaacatctcaaatactgatctgattcttgatttctagtcacatttctattttacattttcaaaatatgtatggaccgacttcatgtacttgtcatttttaataaccatatattacagtttttaatgtataactaaaataaattttggtcattggtacaatgggctgtttttgccactacagtttcattaacgtcaatcttaagtaagcacagtaattaagaaagaagtaatactttcacatacagcaacagaatttttatcagaatatattgtaaccctcaggtttctgttttgggtgatacatactgcaacatttgaactttctccatgtccacatttcctgttcaggggacaaaacatgtttaaaatccatttaatgcactaaggattctcaaaaggcaccagattattttttcttcaactgttttgacttttattgttgttgggtttctttcttggaatagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataacatacagttttgtcacttttcaagtactttctgactcacatacagtagatcactttttactctgtgttaccattttgactggtcgtcattggcatggggtggatatagggcataggattacttgtctcagaagctgtcatagaatttcttgctgccaattaaaaaacctgtgttctttacacactacacgtataaatattgtaactgttcatctttgttgttttatcactgtaagcctgtcaaatcatagtatcctaagcatctgtaaatgctaattttgcatttttggaaaaacccattccttccaagctagtgtttttcattggctccaggtctaatttttcactgtggtccctggcagccagtcttttgaagtttaaagattacctgtctcttgactgcagtaccttttctttaatttttaccaaaaatatccagaggttactggagttcttattcaatataaggaaagtttgctgcactttattaccaagcctctgggattttaccagtcaaacatatttgtgcattacatttcatttcttgtgagctagctggctgtccatattgaatgttgacccatttgagtacgctaaaaggcttacagtatcagacacgatcatggttttagatcccataataaaaatgaatgtttttcttataaaaaattatacaaatgctgaagtgagattctactattgttcattgcttccttttctttttccttttgcgattttcactgattaatagcacatttcttcacaaaattagataaagttggtcaaagaccagatattctggaatggaaattgtaaagcttaatcaaaaagaatagccagtacagcatacaatctcagaaacttagaagcaagtagaaaataattggttgatgtaaacgaaagtgccattttagtaaaggcaggaaaaaaatagcaatatttgagttatgtaaggataaaaaatccactgacttgtatttttgcacaagaggctggtctgaatatgattgttcacattaagagtgtttattcgtcggttcattttggggattttcccccttgatgttttgacagattgaagtgagctttagtgagcaaaaggatcagaatgcagggaacactaagctgtgatgaagaaagtgtggtaaaaagccagagtagttttatacagacaaaaccagtgtcaggcctttgcagtaggcttgagtgaacttctgatctagatttgaaagtaaattttatgaagacattgcccatttttacttcctcattcattattgtaccagcatcatagctttattactctaatcccaggtaagtcaagcctacaatgccctagaggaagagtaaaaccagaaattcatgctggcttaaataatctatttttgtttcttttcatttgaatatttaaattttatggtttattaaaaaattaaataaatgttgtgtccgtctttatttaaaacaagttacctgttgataaaatcattaaaatttccttagtcacaaactgtcataaaagtttcttggagaaataggatggagggatatagaagagaatataaaagaaaattggagaagacccccaatatgcctatttgactaatagtaaatagtgacctcctaggaaaatacaaatacatttttaaatattggcattgttaactaggaacgagtaaattcagattaaagtaagtcattgtcctttataatgttgattttcattcggatgacctaaattatgaccatggaattcaactctaattgccattttaataaaggcagaaaaaaatagcaatatttgagttatgtaaggataaaaaaatccactgacttatatttttgcacaagaggctggtctgaatatgattgttcacattaagagtgtttattcttcgtttcagtttggggagttgaactgataagcaccaggattttcttacagatttagggacccgaagtaacttgtttatagtttaagttgacttatcagtctttataggatgatgaggtataaaccgtattccaatctgagtgtgaggtgaattcgtttagtgtactagtcttgttacatttaacactggaaacaagctaggagttgatcattatctgagaaaacaatatataagctttgacattgtgtgacagtagtttttaatggttatctttctacagtattttttaataggctatttgaggtaaccttttcttcagtttttagaaatttggtttatgtgggtcatgccagagaatgacagtctcacttttatttatcatactattgatatttaggtctgaggtaagttgggtttcctgttacatgtgccagcatggttgaaatacaaatgtaaaaccttggggtatgataggaaaatcaagtgtgaccatatttaggaatatttgaacctattcattgtcgatcaatggatggagtccatcaaaatacctacttgcctgagttctgtcatcctcttgtttcctaaatatatttatctcctggtctgaaaatattaaaaattacagtgatggtagagaggaaagaagagaggcatgcctcttttcagatcatttgagattaagcgaaaacttggacattataaaaatttatttactatgtagctttatttgacaaaagcatctttcacattatcaatcatgaattataaatttgattcttcatgcttacgagcagatatagtactactgtaaaatctagtaggaacaatatagtaaccatggagtgaaagactcaatttttaggtcctttaggtagctctttaagtacttaggtttttaagtgcaaaatcatttttattaactatgttactgtattagaatgatatatagtgagataaagacaaatttgaagattgagggatgtcagtacgctttgacgtataagttgactcctatgaaagtgattagtttggctttccctctgtagctttctcacctccacatctcaaggataaataaagtacaaccaggcgttttccattttttcccccagttctcagtggagtatatagcacacagttggtgtttagcaagtgtggaaaaaaggattacttaataactttataatgagtgttatatttttctggtaagaataccagctataaaaatagaaccttgtcatttagaaatcagtatacaaagtgcacttggttcggcctggcattagtgatgaagacttgcttactcaaatcgactactttcggtaggaaccactgtggaccagatccttgcgtcagtccacattcattttagttgcagtgtagaccgcagcacatatcttgtgtttcaacatcactctaatttaagcagcccctaaagctggagctattctcaccaagcatctggaggtatttgttaattctgaccttttcataaatgagtgatttgtgtcttgcttttgcttagaactttacttctgaaaata

SEQ ID NO: 15859 - DNA, 53451 bp, Human
ttacaggcgcaagccaccgcacccggccaagtaatttctttttattccagtgtttcttagtgttattaagaatggttgctgttggccgggcacggtggctcacttctgtactcccagcactttgggaggctgaggcgagcggatcagctgaggttaggagttcgagaccagcccggccaataaggcaaaaccccgtttctactgaaaatacacaaaaattagctgggtgtcatggcgcacgcctgtaatcccagctactcgggaggctgaggcaggagaatcgcttgaatccgaaaggtggagattgcagtaagacaagatgcgccactgcactccagcctgaacgacacagcgagactccgtctcaaaaaaaaaaaaaaaaaaaaaaaaaaaaaaaaagcaagaaagaaaagaaatttgcagttcaagggacagatcagtccaagcacggtggttcatacctgtcatctcagcacatatgggaggccacggcgggaggatcactttgatgctgggagttggagaccagcctgggaatcacagtgagatcccgtctccacaaataattactaataatttaaaatctaaagaaaaggggggcggggaagatcaggttatttaaagtaattatagtgttaaacttgacatattaaaaaatgcagaaatagttgtgagggataactctctgggcagagatagaaatgtatcgtatctcaacatttaaaatctgcatttcccattggaccataagagatgaactaggacctaattaattgggttttctccccgtttctttctttcttttttttgagacaaagtctcactctattacccaggctggagtgcaatggcagatctcagctcactgcaacctctgcctcccgggttcaagcgattctcctgcctcagcctccagagtagctgggattacaggcgcgcaccaccacgcccagctaattttgcatttttaagtagagatggggtttcaccatgtgggcaaggctagtatcgaactcctgacctcgtgatccgcccgcctcggcctcccaaagtgctgggattacaggcataagccaccgtgcccggccttcctccccgtttcttaaaaaggctcatgtgagttgcatttccagtcctgtagaggtacgtttaatacttttcaaaaaaaaaaaaaacttatcaggacttcgtgagaaacgaaagtggacacccaaagcagcttgcagccggtctactgttactttgttttagcggaccgacctgtctccaaaatcgatttgaccataatgctaggatttaactagggctttagtttttatttcactcccccactttactggtttcaacctatcaatccagacgcgtgtctggtgcaacgctcgggtttatggcaaaatcatctcaggcatttgcttaaccttctccagaaaggcattttcaggggttcacagtgagacggtgcacaggttggcacagagttagtaggggcagttttgtttcgatttgcgggcaaatctctaagatctctccgtttaactttcgcccgcaattcccaaagccgctaaagccgtttccggcgctctaccccgccgcaggccgaggctggcgcagagagacaggaagcgccagctctgggcgtctgggtcctcgcctcctcggccgcagccccgcggcggcgcgctcgcggtgcattgtgggcgctgtagtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaaggtgaggccgtctctcccctctcccaagaaacccctcccgctggctctggtcacccccactcgacccgggagtggacccccgcgggcagccacagcctcccaggccgggagcccccttgcagaggcgggccggggtcgtgagccagggcccctcttcctgtagggctggtgtggggggctgcagagcgagcccggcgcgctggcacttggagaaggtgctcgaagaggagggcgtgggttgagcgccgcttgcccctccagcagctgatcagggaatgacatttgagttggaaaggggtagatctttcgagaacacatcccttcgctgggaagggaaagagatgttgacagagaaaaggggcttgcgcaaagttaaagccttttcccagttttctcttcctggagacttcccagaggtagcaagccaacccggctgctccaggcccttcccgagctgctaaagtaacctgggttgtgcagtcttctgaacgggacttaatgaaagttcacagaagcctgacaatttttgatagggctgagccagaccagaagggtgattggacatggttgacttcagcattttgggccaccgccctgccaaaggctgaggtgtggtgtcacctacctcataatccagaactacagttgctttaagaaaagactagggatcttgctctcttaattcgagatttgcacttaattgaataaagaaatcaacagaaataaaatatacctaatttcataactagtatttgttggcaataatttagatgatttgaaagatgttaattgaaaatagtgcttcactttcactctataattcaggattaaagaatttgcccatgtatggaagcatctttaaaaattaattacattaatttaaagatgacagcaaattattaaaagttaagtgtaaagcgatttttcctttaatcaaaatttatatgacaagctactattaacatttaagtgaaaaaattctcattaacttacacactttgtgtcgtgaaaaacacaaaaatcaaatttaccatcctaaccatttttaagtgtacatacagctcagtagtatattcacattgttgtgaaacttaagtatttttaaaaaatgattcttacgtagttagcattgattttaaaaagttaatcaaactttaagatatgaaacgaatagtttaatgtttcaagccactgttgtcttcttatggatgtgtaaaatgtggatcataggccgggcgcggtggctcatgcctgtaatcccagcactttgggaggccgagctgggcggatcaccgaggtcaggagttcgacaccagcctgaccagcatggagaaaccccatctctactagaaatacaaaattagccgggtgtggtggcgcatgcctgtaatcccagctactcgggaggctgaggccggagaatctcttgaactggggaggcagaggttgccgtgagcctagatcgggccattgcactccagcctgggcaacaagagcaaaatcccttctctaaataaataaataaaaattgaatcataggatatgttgtcatagggaaactgcaaaatccagacttcagtacacctggggaactacattcatacataaacctagtggaaaagtgaatgtttttctaattgtctgtaatacatgacagatggttcactaaaaagaacttcctcttttgccctattcactagtattttctttttttttctttcttgtgctaaaacagaacttggtattcttgtttctatacttccatagcaggtacttcctgtcacaaaactgaattggaatctcctgcctacacttcctccacttactttgagtttatcttgctgaatgcattatattaaatgggttctagtataataatttaatcctcttttttttttaatacacctaataccttagcaaatagctgatgtgacacttaaaaatggtttctgggcctggcgcagtggctcatgcctctagtcccagcactttgggaggctgaggcaggtggatcccttgagctcagaagtttgagaccagcctgggcaacacgttgaaaccccttccccacaaaaaaagaaattagttgggcgtggtggcgcgcatccctgaggtcccagctactccagaggctgaggtgggaggatcacttgagcccaggaggtcgaggctgcagagagctatgatgaggccactctactcaagccggcataacagaatgagaccctatctcaggagagagagaaaaaagggttttggtatagtcatttacatgttaaagaaaattttttttttttttttttgagacggagtctcgctctgttgcccaggctgcagtgcagcggcgctattttggctcacagcaacctccgcctcccaggttcaagtgattctcctgcctcagcctcctgagtagctgggattacaggcatgcgccaccacgcctggctaatttttgtatttttagtagagatgggatttcactgtgttggtcaggctggtcttgaactcctgacctcgtgatccacctgccttggcctcccaaagtgctgggattacaggcatgagccaccgcgcctggcctgaaaataatcttttttaagaacgattaatgagtcagggaactaacaaattatacacttactttggtttgtatttttgtataaaccaactcactgggtgttaatagctgttaacagtcataaatgccagtgcctatgtgaaaacctaattgagtttttaatgcatgaaatgactttggatttctttctttttttatttttatttttattctttttgagacagagccttgctctgtcgccaggctggagtgcagtggcgcgatcttggctcactgcaacctctgccttccgagttcaagcgattctcctgcctcagccgcccaagtagctgggactacaggcacgcgccaccacgcccagctaatttttgtatttttagtggagacggggtttcaccatgttgaccaggatggtctcagtcccttgacctcatgatctgcctaccttggcctcccaaagtgctgagattacaggcgtgagccaccatgcccagcctggatttcttttagtatgtaatgtgttaacttaaaactaaggacaccatatagtaaggaaattaggccttatttgagcagcatatgattttttagagtaattatagtcttgcattaaggcagagtggctatgacatgaatagtttaatattttgtaatttttttcttcttgagataagagtctcgttctgtagcccaggctggaacacagtggcatgattgtggctcactgcattctcaaactcgaggactcaagtattccccccgcctcagcctcccaagtagctggactacagggtactactatacctggctaattttttattttttgtcagatgagacttgctatgttgcccatgatggtcttgaactcctggcctcaagtggccctccccctctcagtctcccaaagtgttggaattacaggcatgagccacctcacccagccctgcaattttatttattattttctaaatgttgctgctctcccgaacccctactgactaccttttgctgttgaatttgctatgtggaaaaccattttatgttccagaatttgggcttttaaactatcttacagttactgtctcattctggtcttgagaaaaatttacagttttacaggatctgattgaaattactctaattcacagggcaattttatatggatggtggcacttagaatgcaagtttcccaatctccatttatcttttggtttgaggatagtgtttaagactattaggatcacttgattagtatctctgggcttttgaaaataattacacagtgttatgtttttaaaaattgttctaatgggtaggtacagcagagagcaccataaatgattaaaggtttaggaaagttcaaggtctggaattatttaggcatattcaagagaaggctgaaagcaaaattcagtcactgtttatgaagtttgtgctgtaatataactttaatattctggagatttttaagttaatcaagatctattttacctggagaccactgttttgaacaggaatggaattagaatctttcttgagctctgacatagtcctcagttcaaagaatagatttaacatttcctagctgggtaagatacaaaatcaaagctccacttcccctctgtgaaataggtgtgctaataatagtacctacctcttaggactaaatgggataaggcacatgaatctttctagcacagtgcctggcacataataagcacgcaaaatttagctctttctaaagatagacattttctaaattaaacgtcagtgatcaactacattttctgtgtgttaatgtttagttgagttactaaaattgttagattttcttgtcaagaaacctacttgtcatggaagtataccttcattaagcaagcatggtataaaaataagctatcttatttggtacttaaccaagtaacctttgtgtatgtatttattttttcgagacagggtctccctctgtctctcagcctagagtgcagtggtgcagtcacagctcactgaagccttgacctcccaggctcaagtgatcctcccaacctcagcctctctactagctgggaccacaggcgcataccaccacacccagctaatttttaaattatttgtagagacgagatctcactatgttgcccaggctgctcttgaactcctgggctcaagtgatactcccacctcagcctccaaaactgctaggattataggtgtgagccaccatgccaggctccaaataatcttttaaagttgagctttattaaagcataaagctgaataataacgttggctgataaaaattttgacaaggtgctaaataaatgtagcatcttatcttgacagtgcttgccgttctaaacttgtatatgttttttcctctgggtcagtcatctaatcttaaattaggagtcattaatatccagattggaagctgagaaataaattttaaaatcttagacttatttttgggaattataaacatgtattattgaagggctaaaatattaatagtattttaaagaatcggggggtcgggcacggtggctcctgtatgtaatcccagcacttgggaggccaaggtgggaggactacttgagctcaggcgttgccacacagcctgggcaacgcagtgagaccctgtccctacaaaaatttaaaaattagccaggcatggtggcgtgtgcctgtagtcccagctatgtgggaggctgaagtgggaggatttcttgagcccaggaggaggtcaacactgcagtgagccacgatcataccaccgcactctaacctgggtgacacagtgagaccctgcctctaaaaaaagcaaagcaaagaaaaaaaaatcagggcattttgatgccagaggacatctgcagaatctatgtagctctatcaattggccaatgagatgttgtctgttacacatgttgctgccagctacggctgacttttccaggatctccatcaaggagaagcatgctattagcagtgaagattctgtccttatctaatccatccccagaatggagagtgggggaggaagacagtggctattttaaagtagtcctgttatattgagtttttagggattctgttctgttaagggatgtatcatttgagtatcttttatgtgcaaagcactgtgctctatctataaaatttaatcttgaggtaaccaagcagagtagataatattcctgtagaagctgatcaactgatcctcatctcttgtcctttcctcattttaactccagtcctgaactggtatctcccaattaagctgagttcttttgtatccaggccttttgcacacacttcctcctctgttaagaacaggcttcctttaagagcctcatctggttactatcacttatcctgcaggactcagccttaatgtcccctttttaaagattttgctgatcccttgactctggaccagatttccttcctgtgtgccctggtagctttgttaggaataaatttgtttgcttgtctttggcttcctgtaagttcctgtgtcacccattataagctcttagaggacagggactgtcataatcacccttactcaatatccaacactgcttggcacatagtggacacttacaaataaatgaagtttaagaaagttaacttccccagggtcacagctattaaatggtaaaactgggatttgaacctagattttcggaccttcagagcccgtacttttgtttgagacagggtctcactctgttgcccaagctagagtgcacggtggtgcaatctgggctcattgtagcctcgacctcctgggctcaggcaaccctcccaaccttcgcctcctgagtaattggggctacaggagcacgccactatgcctggctaatttttttgtatttgtagagacagggtttctccatgttgcccaggcttgtctcagacaaggttttaccatggttgcccagagccctcacagaaaattcatatcacctgaggagcctttgaaaccattcaggttctcttttactggggtggggtggggtttgggcagtggcggtttttttttttttctttgagacggaatctcactctgtcacccaggctggagtgaggtggtgcaatctcagctcactgcaagttccacctcctgggttcatgccattctcctccctcagcctcccgagtagctgggactacaggtgcctgccaccacgcctggctaattttttttgtgttttcagtagagatggtgtttcaccttgttagccaggatggtctccatctcctgacctcgtgatccacccacctcggcctcccaaagtgctggaattacaggcgtgagccaccaagcccggccggcagtggtggtttaaaaagcatcccagtaagggcacttatatgcagcaaggatttctcctgctgcttatcatgctatctgtctcactgagatagatagacagtagagaaggaagagaaatatacatagaaccacaatggttggtagctttgatgggattaaaaaaatagattctaaaatagtaaaacataaaatgaatagcagatcttggcaacagagaggaaaaccagtgacatttgtcaaagatagaaaactttttggaggggaggcatttaaatattaactgaaagcataccaatctctacagcttaagtttttgggaggaaggggagacacagactacattcaatcaagccagatctttttgcccttgtcttgcatcatccatgtctatatccctgtataataatcatgaaagtaagccagaagtaaaaaaaaaaaaaaaaaaaagacatatgtattcatttaagaaaggaattttttggagacaggttctcgctgtgttgtccaggctggtcttgaactcctgggctcaagtgagcctcctacctcagccaagtagttgggattactgttgcatgccatcaagcatgcctcaaaaaaggaatctttataaatattgtcactttatacctgtaaaggggaaaatctaaaaaagtgctttgagctatcctggtgatcacatgcaatagacattttcctctcctgctcacctttatcatcatgcttatctcaccccttccagaaagtagtagactgttattattagatactttgatgtttgtaccatgttatgctgctttcatgtaaatagagccagcaatttcttgaacatcagataagaaagatggtgtccaaaaaaatcttggaactgctattttcttttttccagaagtttattcttagggccgggtgtggtggctcatgcctgtaatcccagcgctttgggaggctgaggcgggtggatccctcgagatcaggagttcgagaccagcctgaccaacatggcaaaaccccatatctactaaaatacaaaaattagccagtgtggtggtgcatgcctataatcccagctactcagggggctgaggcacaaagattgcgtgaaccttggaggcagaggttgcggtgggtggcagcgcgactctgtgccaaaaaaaaagagaaaaagagaaaaaaagtttattcttaaatgtgcaacaggctccaagacatttcatcctttgcttcctagagtggaagcagaagattttatagtaggaaatgcagatatttaaataggaatgggatcaagggtcatcattgcctcggacacagtggtttgttttttggtttttgttcttgttttccagatttctcccttctaagtactaaccaggcccaaccccgcttagcttctgagatcagacgagcaattgcattcaggatagaatggccatagacttttgccggatttcttaattccacctatccagggaacccttccctgtggcctttgcttttagctcctcaagttttttctgctcctcttcttgtttctgcttgaaatccttgtcttcctcatacatctccttggcctgtttctcgtcaggggcttcttgccgtaggtgcctgtcaggaagctggacgtggtgcctgccatcccttccttagacccagcacaggaaactggaactgcagtttactgttttgattccttagttaaaagacaaagctttcaaccaaagttctacttcatttttttttttttttgtttgttttatttatttatttatttttgagacagtctctcaccctgttgcccaggctggagtgcaatagtgcagtctcagcttactgcagcctctgcctccctggttcaagcaattctcatgcttcagcctcccaagtagctgggaatatataggtcgtgcaccaccatgcctggctaatttttgtatttttagtaaagatggggtttcatcgtgttgcccaggctggtctcgaactcctggcctcaagtgatatgcccacttcagcctcccaaaatacaggcatgagccaccgcgcctggccactacttctttaaagaaatatttaactgacaacctaggaatttggaatgtgttagtaaaatgtgacgtttgctatagcttgccagaaaggttgtatcaggtagtatagagtttgggctgttctcagataaagaggataattttttgtttttttggtttttttctccacatggagaggtttcaggtacagtccagggttagtattgtggcttgactatcagcttctaacatcatattcacattctagccaaggggaatgtttatttctgcccttgaaggacacaaccaggaagtcgtattatttctgtttctgcgcattgctgtacttagctacaaaagaagctgggaaatttaaccaggtggccatgtgaagaagggaagagtagacactgttctttgctttgccacattaacaaatggttgtggttggcccttctaggatatggctttaagctacactgtgatcatctgttatttcctttttttgctaatgcctggaatttcagtttagagtaagttcatttgatttgcaagaaataaaattgtactttcattagtttggaagtcttaagtgagtaagttttgattctttcatgataattaattttgttaagttgagaaaaaaggcaagcatgaagacatggcatatctgataggggtataccttgagattgggctagagattctaaaggtagttgattaacctttttttttttccttccaaggctgcttaaaactattttggttttacttaggaccaccattgtagttgctgacattgaatgatggagtatataatttgagccaccaaaataaatgaagccagtgtctcttggcagagaatcacttaatctcttagcagagaagtagagaattacttaaaataattttgtaaagttactttgtgtccagcagtattggaatggtcatttgataattatttgttctgtaaactttgattttatcactgatggagcatttcttttggctttcctaaagttattttagcacctgccacctatagcttgtttgctttccgttttttctagtcctgcccttgtgggatgaagttctctgttgtataagtctcgtccatattgagaaacagaggagtctcaaagcccctccttgtgtctggtcttggtatctcacccctctcttgtcttgactttactggttatcttcaagtggaaacaagtagagaaaaatcttgtcagctaggcatgtatgtgtatatcaccaggtcttgtcttaaatttacacccaaagattcccccatggtatataactgaggacattcttaggacactgaggagtttaaatagagcaagggttggcaaattatgggcttacctttttttataaataaagttttattggaacacagcatacccatttcttcccatattatctaagaccacttttactctataagggcagaactgagtagttgaaacagtatgtttactatcttgccctttaagaaaaggtttgccaattttatgtctagagtttgctcatgtaacattgaaataatggaaatcaaaaggcacttggagaatctattatcaaaacatgaggccgggcatggtggctcactcctgtaattccagcactttgggagtctgaggtgggtggatcacttgaggtcaggagttcaagaccagcctgaccaacatggcaaaaccctgtctctactagaaatacaaaaattagccagctgtggtggcgtgcccctctagtcccagctactcaggaacctgaggtgggagcatcacttgaaccctgggggcggaggttacagtgagccaagatcacaccactgcactccagcctgtgtgacagaatggaaccctgtctcaaaccctaaaaaatatcatgaggctatggaaaaagcattcatttaggaagccagtagtaaacgactgaggaaatagtcattaaatataacactgcacattcatcaaataataagatcttaatgcataaccctattgttgggtggtgaatgaaatattagataccattctttcctcctagaggcccagttttacatagaaattgtaactttgtgttgtcatcccactgataatattaaggccaggcacaaggtttttcaacttttgaagtttattttctcactcgaaaccttttatgtaaactcctttgaatacccacataaaggaaagaaagttggtgctgataaactagtgggcagcaggttcatggtggttcagggtcggtcagcaaaccagtgccaacactgaagatgatgccaaacaaaattgactgcaatctgttctagccaggatcatggtttagatattttctagccagaattaattaatttattatttttttctttttttgagacagagtctcgctctgttgccaggctggagtgcagtggtgcgatctcggctcactgcaacctccacttcccaggttcaagcaattctcctgcttcagcctaccaagtagctgggattacaggcacgtgccaccatgcccagctaatttttgtataattaattaatttctcatacagtatcatcatttaatgatttgtggggttttgtgtgtgtatgtgttttaagagacagaatctcactacattgcccaggttggtcttgagctcgtgagctcaagtgatcctcttatctgcctcagtcttctgagtagctggtactacagatgtgagccattacacctgtcttaatgttttgtattcttacatgttaaccccctatgtaatatggcaatgtgcagttgtataaataatttttaataatatttaagttggtattggttgaactattaacataggtaagtcctttctacaaactctgtctctcttgtctaaaagctgggtgtggtgatgcatacctgtagtcccagctactcaggaggttgaggtgggagaatcatttgagccaaggaggttaaggctgcagtgagctataatggtaccactgcactccagcctgggtgacagagtgagaccccgtctcaaaaaaaaaagaaaggaaggaattaagttgaaaattgagaaactgtgataccagctctaaatgggacaacatagtgaattgatagaatttttgtcttagtttagaaggccagattatgttgatatgcttaagttgggataaattgcagttttagagcgtttttgtttagacctcagcatgattcttatctataattgatatttgttcagttttcttccctcaaaacatccgatcaattgtttttttctaactaaatttcttttttagagttgttaactttaacttgagtagctcctgtgggtcagttgatttattgagtacttgcaatgctaagtttaataacacatgttactgcattcagtaagttcacagcagcctgaaacagggctagatttctctgataagttttccccagaactgtccaataaatgaacatttatgaactgtctgttatattccagacattgctagatgcttgtttaaaagatgaataagatatgcctagcctttggaagcttccaaactggtggtaaggagagtggggagaggtaaattcataaaatatgcataatctgtagtgggaacccaggtctgccctgaggggccaggagtgtgtgtgggcagaaagtgagccagtagtctagctagggggagcacctgtctcttttgtgcttcactgccagcatctgacatcaatgacatgccagaatcacacagtaataatactggagtgattccttgttactctctgacacaaacatttttctcgatttttatttataattttatatataatgtataatttggttttaaaattgttattttaatttttattttttaataaatagtgacagggtcttgctgtgttgcccaggctggttttgaactcctgagctcaagcaatcctcctgcctctgcctcccaaagtgctgggattacaggcatgagccaccacacccggctataatttgttttaagcatcgatgttcaggcggtatggtaggcactttcactctgtgttttctctgatatagtttattctactgcattttcttacaaactgtaattactcttatttccagttaaaacaaatgataggctgggcgtggtggctcatgcctataattttagccctttgggaggcagaggtgggaagatcacttgagcccaggtgttcaagaccagcctgggaaacatagggagacttaaacgttgtttttttttgtttgttttttgttttttaattatctgggcatggtggcatggactagtagtcccagctacttaggaggctgaggtagaaggatcacttgagcccaagtggttgaggctacattaagccgtggtcgtgccactgcactccagcctaggtaacagagtgagacccggtcacactcaaaaaatacatcctagatattgaccacttcatcattcttacttagcaataatcgtttcctgtttcctcctgtcttactccattttcacactgctataaatttactacccgagactgggtaatttgtaaaggaaagaagtttaattgactcacagtattgcatagctggggaggcctcaggaaacttacaagcatggaaggcaaagaagcaagtacctgcttcacaaggtgccaggaaagagaaagtgagcagaaagagccccttataaactgtcagctttcgtgagaactcactcattatcacgagaagagcataggggaactgcccccatgatacggtcacctgggggtttacacgtggggattacaattcaagatgagatttggatagggacatacagccaaaccatatcacatcctgaccatgctttatgatatagctaagaaagtctacctgctcttttcccatgctaaactctgatgatctttcctgattcctcttgccagaagctaatccagtgtggacttgagcctgtagtcttagctacttgggaggcagaagtgggaggatcgtttgaggccaggaattagaatctgcactgagttatgatcttgcccctgcactccagcctggacaacacagcaaactctatctctgatgagaatgctgagaacacattctattctatactgaatttatgttcccaggcaaaagaataaaaaaaatacaattttaagaaaaaaaaagggaggcaggagatacagtgtctcacgcctataatcccagcactttgggaggtggaggcgggtggatcaccagagatcaggagtttgagaccagcctgtccaacatggtgaaaccccatgtctactaaaaatacaaaaaaaaaaaaaattaggcatggtggtgtgtgcctgtaatcccagctagtcgggaggctgaggcaggagaatcacttgaacctgggaggcagaggttgcagtgagctgagattgcaccactgtagtctagccagggcaacagagcatgaccctatctcaaaaaaaaaaaaaaaaaaaaaaaaaaaagaatgctcaaagctcttttaagaatttcttacttagaggcctcagaaataacaccacacgtctacaaccatctgatcctcgacaaacctagcaaaaaacaagcagtagggaaaggattccctatttaataaatggtgctgggaaaactggctagccatatgtagaaagctgaaactggaccccttccttaacaccttatgcaaaaattaactcagatggattaaagacttaaacgtaaaacctaaaaccataaaaaccctagaagaaaacctaggtaataccattcaggacataggcatgggcaaggacttcatgtctaaaacatcaaaagcaattgcaacaaaagccaaaattgacaaatgggatctaattaaagagcttcagcacagcaaaagaaaccatcatcagagtgaacaggcaacctacagaatgggagaaaatttttggaatctatccatctgacaaaggtctaatatccagaatctacaaggaacttaaatttataagaaaaaaacaatcccttcaaaaagtgggcaaaggatatgaacagacacttctcaaaagaagacatttatgcggccaacaaacaattttaaaaaagctcatcatcattggtcattagatgcaaatcaaaactacaatgagataccatctcacgccagttagaatggcagtcgttaaaaagtcaggaaacaacagatgctggcgagaatgtggagaaataggaacgcttttacactgttggtgggagtgtaaattagttcaaccattggggaagacagtgtggcatttcctcaaggatctaaaaccagaaataccatttgacccagcaatcccattactggatatatacccaaaggattataaatcattctactataaagacatgcacacgtatgtttattgcagcactatttacgatagcgaagacttggaaccaacccaaatgcctatcaatgatagactggataaagaaaatgcacgtatataccgtggaatactatgcagccataaaaaagaacgagttcatgtcctttgcggggacatggatgaaactggaaactatcatcctcagcaaactaacacaggaacagaaaaccaaacactgcatgttttcacttattagtgggagttgaacaatgagatcacatggacacagggaggggaacatcacacaccagggcctgctggggattggggggcaaggggagggagagcattaggacaaatacctaatgcatgtggggcttaaaacttagatgacgggttgataggtgcagcaaaccaccatggcacatgtatacctatgtaacaaacctgcacgtttttttgcacgtgtatcccagaactaaaaagaaaatttcttattttcttggccgggcacagtggctcatgcctgtaaccccagcagtttaggaggccgaggcaggtggattacttgaggtcaggagttcgagaccagactggcaacatggcgaaaccccgtctctactgaaaacacaaaaaattagctgggcatggtggtgcatgcctgtagtcccagctactgggaaagctgagacagaatttcttgaacccacgaggtggaagttgcagtgagctgagatcatgccactgcactcccgcctggcaacaacagagcaaaaaaaaaaaaaaaaaaaaaaaactccttacttatattcttatagactatattattttaaatgtggttattccagagattgatggtggtgatgtttgcataacaatatggatttacttaatgccacagaactctgtacacttaaacatgcttaaaataattttatattatgtatattttaccacagtaataaatatggaaacaaacagtatggaggggccaggtacagtggctatctcctgtaatgccagcactttggaaggccaaagcaggaggatcacttgaggtcaagagttaaaaaccagtctgggtaacatagtgagaccctcctctctacaaaaaataaaaattagctaggtatggtggcatgcacctatagtcccagctactcgggagactgaggtgggaggattgtttgagcccaggaggtcgaggttgcagtaggccaggattgcactgctgcactccagcctgggtgacagagtgagacccaccatctcataaagaagaaaaaaaaagcgggggagaactggagagggcagtttctttcccttcaaactatcaaagcaaggaaaaaagtagttctttatgtctttttgccaagaactctcagttcttagtcatctattgtgttttacagtctactttatctgatactaatatagccagtccagttttcttatgagtatttgcagggtatgtaattttctgtcctttcacttttaacctgttttgatttttgaggcagtctcactttcttacccaggctgggatgcagtggcatgatcttggctcactgcaaccttcacctcccaggttcatgcgattcttgtgcctcagccttccaagtagctgggattacaggctcgtaccaccatgcctggctggtttttgtatttgcagtagagacggagattcaccatgttgaccaggctggtctcaaactctcgacctcaggtgatccaccccgccctcggcttcctaaaatgctgggattacaggtgtcagccaccaagcctggctcttcatgtggatttcatttactatctggtatcatttttttcagccggaagggctttctttagtatttcttttttctttttctaaggttcccatcagatgggtaatgtgctgaagtcataacaaggtttgaaggaggcatgtcacacacatgagcatgaaaacccaatcatcatgcttacaaactacagaaggatttctttagcatttcttctaagtcaggtctgctaaccatgaaggcttgtagtttttttgttttgttttgtttttttgtctgggactgtcttatatttttatttttgaaggatagtcttgttagatgtattagttttttattgctgaattaaaaattaccacaattgtagccctcagaacacccccagccaggtgcagtggtttgtgcctatagtctcatctacacaggaggctaagacaggagaatcactttagcccaggagtttgaggcagctgcagtgtgctgtgatcatgcctgtaaatagcctgcactccagcctgggaaataagcaagacgctgtctcttaaaaaaagtaaaaatttaaataagtaaatggagttttaaattattttaaaaacaccaccaaatatcatctcacaagtttctgtaagtgagaagtctgaatatggcttgtctggactttttgctcagggtctcacaattgcctacaatcaaggaggttggtcggggttgtggtttcatctgaggcccgggagttctcttccaggcttacatagttgtgggcagtattaattttcttggagctgtaagtttagagtagccttcctcttaaaggccagtggaaaaaatctctttgatctcagggaagactaaagcccccttttaaggggctcacctaattaagtcaagactactcacaaaacttggtgaagtcaaagtcaaactgattagggagtttaacatctgtaaaatcccttcacctttgccatgtaatgtaacctaattatggaagtgacatccattgcattcataggcctcactcacattctaggggaggtgtgtatgccaaggggtggcaattttaggcaccatcttggaattcagcctaccacgctggatagggaattctttgttgattttctttttttctttgagcgctctgaatatgctgttgcttccttgtctccattgtttctggtgagaagtcagctgttaatcttattatgggtcccctgtagtgatgagtagatttctcttgccactgtattcaagattttgcttttctttggctttttactgtgatgtttattgggtgggaatctctttgtgtttatcctacttagagttcattgagcttcttggatgtatagattaagggtttagtcaaatttttttaagttttcagccattatttattgtttctttctctcatcgtgggactcccattacatgtgtgttgatatgcttgttagtatcctacaggtccctgatgctctgttcattcttatttttttctttctttctgcttttcagaatggacagtttcttgatgtgtcttcaagtttgctgatgcttttgtctgccagtttgaatccactgttgatccccttcagttaatttttcatttcagctattatacttttcagctgtagaggtccaattcagtgttttttaaataatctttttgttgagattctctattccttgaatcattgtcatcatgctgtctttcagttctttaagcatggtttcctttaatttgaacatattgatagctgcttggaaatcctggacagctgaacagctgaaccaccccagagacattttctgactttttatcctcctgtctatggctcacactttccagtttctttgcatgtctcataattttttgttaaactgaacattttagataatacgttgtagagactctgagttagattgcctcctgcccctccccaaaggggaggtggtggttgctatttattttttttagggacttgcccacattaagtctgtagtatgaggtggtgatagcacggatcaattttttttttttaagccaggttttctaagggtcaccctgagtcagtttgtcagcttatctcagtggtcagaaatgactggtcaaaggttatgcgtagctacttgagccagtgaggcttcagcctttttctttttttaagagacaggatcttgttctgttggccaggttggtcttgaactcctggcctcaagcagtcctcccaccttggcctcccaaagtactaggattacagacgtgagccactgcacctgaccagcttctgctttttgccagtgcaggttggggaacaagtcaaagttcaggcagtttacaagttcgccccagcttttacttcgtgccgtcttctcatgtccatggctctcccttgtctgtgaaaggtctcattcagccatggatgtttagataactagggttctctccagctgagcatgcatacagctttgtgtaagcacacatacttttttttttttttttttttttttgagacggagtcttgctctatcgctcaggctcgagtgcagtggcgcgcaatcgtggttcactgcaacctccacctcccaggttcaagtgattctcttgtctcagactcccaagtagctgggattacaggcatgtacccctatgcccagctaattttttgtatttttagtagagacagggtttcaccgtgttggccagggtggtctcgaactcctgacctcgtgatccacccgcctcagcctcccaaagtgctaggattataggcgtgagccactgcgcccgacatcacacagattttcagacctccacagatacttgggagttaatcaaggccccaccatggctatgtaattcttctggtaagtctgctggttcattgcttgcccccagtattgcaaccttgggttgccgcaatattagccttccccactgtttgctgccaatgttgctgttggtttcaacaatagtcctgcatttgggacttctatattctactcctgaccagtggcccccctccagcagtgatggtgttggttttcacagcttgccacatcctggtagaactaccattgatagagctggtggagcatggtaacaatagccctaggttaaaacacacagacttctggccgggcatggtggctcatgcctgtaatcccaacactttgggaggccagggcgtgtggatcacctgaggtcaggattttgagaccagccttgctaacatggtgaaactccatatctactaaaaatacaaaaattagccaggcgtggtggtgggtgccggtaatcccagctacttgggaagctgaggcaggagaattgcttgaaccagtgaggcagaggttacagtgagccgaggtcgcaccactgcactccagcctgggcaacaagagcgagactccttctcaaaaacaaaaacaaaaacaaacccacacacagacttctgctcttcataactgagttgagtagtttttcttgaatgattacttttcaatttgttatacacctgtgcccactttcctgagttctgatatagtggtttgacatgtttgtctagttttttcattgaattttggagagacgctctgttgagctcactctactattccagcagttccccctttacctttttactttatacctttcttttaggttctcatatttttaagagaaatggtcttattcatattatgtttttcttcacattattatgcttttactcttaatttataggtgctcagaaacactttttatgcagtgtttaaatgtttttagaagcttcttaatcaaatatttccaggccccttgaacatagtagttgttgagatattcattaaatgctcatttagtagagttttaaaggtttatttaatatctgctttgggtcaagtactataaccatagtgtgactttagagcatggactttgaagttgaacgtgtgtaagaatcctctctctgttaatggacatgtgaccttgaacaagttacttaattcttctcttttgaatgtcttcggccataaaataaaacttcagaggagtaaatgtgacttaaggcataatatttgccctacattaagtattcagtaagtgataacttgtgagaatgtgtgagaagaatgtataataatagtttctacttaattattaaggtaagtgacagtattttctttctttttcttttaagagacagggtcttgctatattgcccaggcttgtcttgaactcttggcctcaagcagtgctcctgagtagctgggattacaaacatgagccactgcacctggctcattttaaagatggtaaaactcagattagagaaggaaagtaatttggcatgatcgtactgttaatgagttccagaaagaggagtcgaacccgggtctgcttgactaattcatttttccctgctacttccaggaatcagaaaaggtgtcaagggctaggcacagtggctcacgcctgtaatcccagcactttgggaggctgaggcgggtggatcacctgaggtcaggagttcgagaacagcctggccaatgtggcgaaaccccgtctctactaaaaatacaaaaaaattagctgggtgtgggggcacatgcatgtaattccagctactcgggaggctgacataggaaaatcgcttgaacctaggaggtggaggtttgagtgaaccgagattgcacatggcactccagcctgggtgaccatgtgagactctgtctccaaaaaaaaaaaaagaaagaaaaggtgtcacaagtttgtggttagctcctatcattggtacaaagcaaatattgaattatacttacatatgtttgtttgcattttccccccaccccatgcaacatgtcaagaacttccactacaaaagtgatataccaattatttgaactttgtgtgtttctgtaagatacagccttagtgaataaaacctggaatttcttaggtgagcggaaaaataagaggctttaaactcttcatccacaaatacaagcatgaaaacttggacactttttaaaaaaattttcttttttatggcggttgaggtggaggtttcactgtgttgcctaggctgccctcaaattcctgggctcaaaggatccgcctacctcaggctccctagtagctgggactacaggcacatgccaccgcacctggctctcatgaacacttttgatatgtagtggtgtaagtggctgtaaaaagtatacttagaaaatttttgttagctttaaagcctctgagcctaaaacattgtatatacatgtttttatcacaatgtactccaaagattatgtactctcttacagaaacctccccagtggtattccatctctttaattctctttcctgacctatgtttgtctgttctgtgacacctactctgcttgggtatcctcttataattcttaactgtgtcataaaatcagctaatgcagggacaatgttcatgtacttagttcatggtagattctttttggaggagaggggtatccattatagttgattctttttttgtttgtttttttttttttttttttgagacaggatctcactttgttgcccaggctggagtgcagtggtgccatctcagcttacttcatcttcatccttgacctcctgggctcaggtgatctcccacttcagcctcccgagtagctgagactacaggcgcgtgccaccatgccgggctaattttgtatttttagtgaagatagggttttgctatgttgccaaggctggtctcaaactcctgagttcaagtgatcagcccacctcagccttccaaggtgctgggattacagacacaagccactacacccagcccatcatggtagattctttttttttttgaaatagagtctcactcttgtccctcaggctggagtgcagtgccacgatctcagctcactgcaatctccgcctccctggttcacgtgattctcctgcctcagcctcctgagtagctggattacaggcgctcaccaccatgcctggctaatttttgtatttttagtagaggtggggcttcaccatgttagccaggctggtctcgagctcttgactttaggtgatcgatccgcctgcctcggcctcccaaagtgctgagattacaggcgtgagccaccgcacctggcctcatggtagattcttaatgccttttatgttgtacacttattagcattctaagtaacatcattttaatggctaatgagctgccataatcaatatttatagatatcatggtttaaaatcttaccatgcttccaagtaagatttgagggctagagataaaggatctggaatgatatccttttcttacaaactctgcaactcagagtagaggggaaggtattggaaggtggagagaaaggtggccaaagtacttagaaatcaattttaaattatgaggaaaagaaccagaatattctgctctccagctctacctcaaccacttattatacctaacagttaaagaagatatagtagccagaaaatattttaaattgtgctaagctgattatgtattgaaacttttgatggcaagttgcagcttctcttagccatggtttatttaggggattcttagacaaagagttactttccatttctaataaaaagatttttatgttaagtgatttgagtactgtcagactgttagaacaataaacattctttgtggagctttatgaaaggagtaaagtattgtaatggcactactgtcaatctgcaaatttaaagcatatgcgtgtgtatagtgtttaatgtcatgatgtctagttgctgttatagctaatcactctgactggaagagtttattaatatatgtatcactcatgtgttagagaatttagacttattaaacattcattttcatgttttttatagttttccaagtaatacttcaagctttgaagaaacagcttagttttgttcttttataatataggtggaagccgggcacggtggctcacgcctgtaatcccagcactttgggaggccgaggcgggcggatcacgaggtcaggagatcgagaccatcccggctaaaaaaaaacggtgaaaccccgtctctactaaaaatacaaaaaattagccgggcgtagtggcgggcgcctgtagtcccagctactcgggaggctgaggcaggagaatggcgtgaacccaggaggcggagcttgcagtgagccgagatcccgccactgcactccagcctgggcgacagagcgagactccgtctcaaaaaaaaaaaaaataaaataataataataataataatataggtggaaactgttttatatatatatatataaagagaggtagagagagagacagggtcttgcttgttggccaggttggtattgaactcctggcttcaagcaatcatcctgcttcagcctcccaaagtcctgggattacaggcacgaaccatcgtgcccggccaaaactgtttcatatgactattcttagaggtttattaagttatttattgtagagagcaactcagtcttcaattacagtttttatttagaatcttacctttctttagcatagaaaaactttagctgattttatcagatttctaaattatgaaggaatactttccttgctgaataattgagaattaattgacttttctgtattattgaggaacttcaactactcagaatataatcagaagctaattaaggaagtagaaaagaactaaacagcgaagagttgaataaataacaagtctatatactttttctttttttgaggtagagtctcactctgtcgccgaggctggagtgcagtgcgtggtatcagctcactgcaacctccgctttcatgtgattcttgtgcctcagcctcccaagtagctgggactacaggcatgcaccaccatgcccggctaatttttgtatttttagtagagacgaggttttaccatattgggcaggctagtcgtgatctcctgacctcaagtgattcacccacctcggcatcccaacatgctgggattacaggtgtgagccaccgtgcctggcccaagtctatgtacttttgagttaccaagtttttagagatgaaatactgtcttctcatgatctgcatcttgtttagcataactctaccaaagtcaggttattgcttcagttgattattgctatgtaaaaaccctaaaagttggtgaccgaaaacagttacaattaaacattcacttcattacagttctacagtttggtcaggtcttgaagtcatggcttgtctctgttccacttgatatctgtggggccacttgactgggactggaggatttatttttgagataactcggtcatatggctggctgccagctgggatatcagatggagatgtagatcaggtcctcagttctccttcatggggagagttagacttctcacagaataacggtgacaggatcgcaagagagaatgtctttatgaacaaatgttccaagaggacaggccccaattcacaaatgtttgatcaaaggcagtcacatggccaagccaatgtgagagaggatacaaaaagatatttaaatattgagtgtcatggtttgttgtaggctaccaaagtagctactactactgcagtgttccttctcattctatagcaaagtagcctttctggaggacaactcgaagacttaacatttatagtctttggcctagtaatttcacctttagggtttattctaaggaaaatatttaaactccctggatctgtatcaaggcttcatttagttttcatccattgcattttgcctagagttagatagctggttaatgcaggaatccagattaaagccagattttctagttccagaactgtgtgcttcatcattgtactatacagcctctcacccagggatgtctgtatataatcatgttaatgatatgagaaactgataatatatttaataaaaataagatttgtatatataaaaatctaaaaggctatatactgaaatggagtatctacaagtcaatatgtatgttttttaattgtaaggatatcttttataagtctaccatgcaaactcaatatattcacatgtatatgttttgttttgttttgtttttttgagacagagcctcactctgttgcccaggctagagtgcagtggtgcaattttggctcaccgcaacctccgcctcttgggttcaagcgattctcctgcctcagcctccgagtagctggaactacaggcacatgcctccacgcctggctaatttttatgcttttggtagaaacgggttttgccatattggccaggctggtcttgaactcctgacctcaggtgatccacccgcctcggcctcccaaagtgctgggattacaggcgtgagccactgcacccagctgtcacatgtatatgttatatatatatatatatgttttttatatattttaattttgccttgattactcaaatactggtctccaccctttcattcaaacatcaaagagctgtgtgataaattgcggctgtaaatgctacatgtaatgaatcttggaagagtattccgctctcccctccccaccccctctttacactgtaaatataatgtaaatataacccttgaggaggatgtcttgagatccctgtagtccatagctgcctgatgcaccatatgtagaagcttagaaaatacgagtacttactgaatagagcttcttaaccaatattctttaactggcttccacatcacagttttacttataatgactttacactccattctcacagtattattccaaatcactacccttaaagaggtaaaatattatcgcccatatctgtcccagctaagctaaaccagaattacttggtgattgtacaaattcccaagttcctaccctctttcacatttattaactctagggcagcagttattcgctctttcagccaggctggagtgcactggaacaaccttggctcactgcaacctccgcctcccgggctcaagcgattctcccacctcagcctcccgagtagctgggattacaggcgtgtgccaccatgcccggctaatttttgtatttttagtagagacagggtttcaccatgttggccaggctggtctcgaactcctagggcagcagttcttgaccctggatgcacttgagaatcatttgaaaatactgattttcagattccaccctagatcagttgcatgagattctctagttggcgtcacttgagtgtgtttcttaggattggacaagttgggaagacaccagaaaatagttttgcattttaaagattgtccaaaaaaggtgttagactattaatagacagttttatttcagcataagcctgtaggattatgtaaatcttcatgaattgttatgaatgaattttcctttaaaatagaattattaatgcacagtttcattagagattactcattgaaaaccttgtgtgagctctccaatgagtcttgttgctaattcacaaatgaagaatatggacaatgtaggaaaagtatctggaattccttggtttatgcatttaagctagtctagataatttattctctactgttttggaaattataccataaaggatacttcttttaaaataaggaggaattgtatcactggaaggcatgtccttattttttaaagaaagaaactaaatacgttggcttagtgacaatctacatttcaaaggttctctggactaaaagcttattcttcatttaaatgacttcttctcagccttattaagagttcatctaggttataaaccatatctccagttattcatgctgttccagattgggtaaaacaggtatcaaaagtactgaagggtgaagcaatagcttaagcacttctcagtttatcttttatctctagatgtagatatttggagaaatgcagctgtttaatgagaactgtagtggggcatccatttacatctcttaggattggttgaatagagtatggcctattgaatatacttttgatgttgttgccagtctcttttcaaatgtacacgtgacactatctgaagaaatactagaaacacctagtaaacatttttctaatatctattgttaagctatattcaggtgatcacattttgaggcttggttttctgcttggctatcagtgataatcaggtaacatatagggtatctgtgagctgctgactttaataggtcagcctgtgtaagtgtataagacctacctttttggagaccaataatgtggtagtttcctgtgcttagacttgaagggagcacttgttttagacctctataccatggtttgagaaatcttttccttagtatgtaatatccatttgcattcctgatgatcttaccctgtgtgattagtaatactttttgtggaaaatggctggtttctcttttataaaaatagtagtttaagagtatccggcatacacatatctcttttaacattttattgctttgcagttttgttcctggtatattagaacaaatagacaacaacaaaataacattgaacaattcaggtttttagtcttgttcttttctagttctttgaatgtcccaggatcttgtaattatttcatcactttttcataagccaagcaaaatatattctcatcttgcaaatgaaaagcaagatacccagcagcttgagcattaccccgaatttctccagaagagtacaaatatccaagtagactataaacccttgtttaattctgtttattaaatcaacaaattgaaaacattctgtacttaatacatcggtatattcacactgtatttggcagggagtggggctttccttcagtaaagcaatctctcctaatggttaaagttagataaataacttcacctaaaaatgtgaattctctaagaagcagagtttattttgtggtctgatagttctgtaagttcgaattagctaggcaaattctaaatggcaataaattttattatgaagggctggttcaggaaaaaggaattaaaaggtggggaaaagataactattggaggaatctgacctctccttaccaagtgacccagtaatgggacaaactgacattatgtgccttccgatggaaagcatcaacactcctgccatttaggaacattactgccaacaatgcaaaacaaagctggtcatgaggaaacagacaaacccaaatgtagaatgttgctctgaactctttattgtcagtgtcttgaatgacaacaagacagggggcgactcttctagattaaaggtgactaaagaaacaaccagagggctgagtgcagtggctcatgccagtaatctcagcactttgggaggttgaggcgggtggatcacgaggtcaggagttcaagaccagcctggccaacatggtgaaaccccgtctctactaaagatacaaaaaattagccgggcgtggtggcgcgtgcctgtaatcccagctactcggaaggctgaggcaggaggcggaggttgcagtgagccgacatcgcgccattgcactccagcctgagtgacaagggagactgtgtctcaaaaaaaaaaaaaacaccaccagaggtgggaggatccctccagcccaagtgcctgtagcgcgctaggatgttgcctctgtactccacccttggcaacacagggagaccctctttttttgcctgtcttctttgataatgttggtgatctattttatagttttccaaagaaatgttactaagtagtggtaacaaattaactagcatttggcaaataacaattaacaaaggcatgttttgagtgtggaataacatagttttatggactcagtggattccaggaaaccaacttaacttttttgagatgcaggtaattacagttctctgctcttttaatgttagtttgggccctgacataagctttaagtgactgttaatattgggtttctaatatagaacccttgagagctatccagattatttgagcctctgtctttgcttcagatttatgatgaaacgtgatttgcagaacttttgaactccatgaacaaaattgaagtctaaagtagtccagggttactcaaactcagaatcttcagcatttactagtatatacctatacaaatagatgaaggctgtggcttactttttggttcttgccctatgctgtactttacttttgcttgtctcccatcttacctgtctgtgatcactgtgcccacatcggctgatctattgttatttcccacaaataacatatttcttgtatttcctacaaatattatttcatacagatggttgtatttaacacttttacctgttaagaaataaaatgaacagtagctaggaagaaaattgtggcttccactttatactcagcctgatactaagcaacttctcttaaaattagggggaaaatatgaatattagagtgagagaatactaaatcttgctgtttaaatttcaaaagttttagtcatcttaaagtaagttaacaatatttaagcctgatttacatttaatttcagaattcagcattctttctgggtaaatctagagcatttaaagtggcatccaagataaaacctttaagggatttttgctgtaatttgcctcagtagtctgactcttgtccatacatttcaaagcagataaacctaggaatcaactagagccatctgttcttaattctacaccttaatgctacatgcagctcatctgtggcttctacttctgtagtaacttctctgttctattttttctgttcatagctatcatttttctattcaaacatatttattaactcctgatgctcacaggtagtcaccttagccccatatttagagtgcaatttaaacttttcagttttatttcccatcattccctatgctttagaatattcaagaattatatactaaatatacactgtacttgtttcttctctgcatttagctcacactattttcaccattttcagctgtcttatagtatggctagctctgtgttaaaagagtcctggctgaggccattgcactcgcgccattttaccctagcatgggcgacaagagcgaaactctgtctcaaaaacaaacaaaacgaaaaagagtcctgactggccgtacgcagtggctcacacctcatattccagcactttgggaggctgaggtggaaggatcccttgagcccaggagttcaagaccagcctgagcaacttagggagaccctgtctctaaaggaaggaaggggagggagggagggggagagggaggggaagcagagagactgaggaaaggaaagaaaaggaggggaaagaatgaatgaatccgggccaaatcaattgtcaattcttccgtgcttttcatattatacaaatggtattatgctatataatatactgttctgaaactttttttttttttttttttttgaggtggagtctcgctctgtcgcccaggctggagtgcagtggcatgatctcacctcactgcaacctccgcctcccgggttcaagcgattatcctgccatagcctccggagtagcaggaattacaggctcgtgccacctcacccggctaatgtttgtatttttagtagagatggggtttcactgtattggccaggctggtcttgaactcctgacctcaagtgatccacccgcctcagcctcccaaagtgctgggattataggcataagccaccgcacccagcctgaaactttttacatgtcatacattctagacagcttttctgattaacctatggctgagttatattttgtaaaaagctgtgtaatataagcttgtaatgtaagatttattgtttctggtcttttttgggggttttttttgtgtctattacaatgctaaaatatttttgtatgtgtggaaatatttgtaggattaattcccattgaaattgttcattcaaaagttatgtgtatttaatagagtaatggataatgtattcaccaaaatgccccccttttttttgagaccgtctccctctgtcacccaggctgaaatacagtgagtgatgtgatcacagctcatgcagcctcagcctcgaaggctgaagccatcctgacaccttatcttcccactacaggcatgtgccaccatacccagctaatttttttttttttaaacagagtttcgctcttgttgcccaggctggagtgcagtggcgcaatcttggttcactgcagtctccgcttcccgggttcaagcagttctgcctcagcatcccgagtagctgggattacaggtacccgccaccatgcctggctaatttttgtgtttttagtagagacagggtttcaccatgttgtccaggctggtcgcgaactcctgacctcagatgatccacccgccttggcctcccaaagtgctgggattacaggcatgagccaccacgcccagcctgcccagctaattttttattttttgtagagatgggggtctcaccatgttgcccagcctggtctcaaactcctgtgatcctcccacctcagccttccaaagtacagggattacaggcttgagccatcatgcccagccagtttgtagtatttttaaccatggaaattcaactttttatatgcttattttctaaccttgattggtgtatgtttcataagggccaggtctgcatcttattcatcattataaataatgattctcccttatctagcatggtgcccttttatagatgatcagtaaataatagtttagtcctcctgaagctgtaggtaaaaaacctctccgcccttcaatcattttatgaaagttaaataaattgaaagtgaccaatcacaggagtttcagcagtgatagttcagtaccttaaacaacaacaacaacaaaaaaaaaaaacccacattttgcacttagttattttaatcagttacattgaattacaaatccttgtaatgatgaggaagacgtttaacaggctaagttaaccactgcatatgtaatgggcaagtgatgtttgaatttcttgatgtgactttaaactctaaagcagtcctcatgcaaaaagagaaatcataaccagttaagaaaactaaaggaactttcttaagctaatcatggtcctctaaatttaagtatataaactatcaaactattagctaatcatagaagggaaagtacttttccccctcacccctcccctttctgttagagtgaatcagatataatcatgattgtgtcaaaagttcaaaagggaaaatggaaggtaaaatgagctgaattggcactcttctctcaacattgtacctgtaagcttgatatgttgtttcagagattaactttatagacttccgtacccagaagtatgaaaattcttaggggactcttttcgcaagcttgatcttaacgtatttgaataaagagagcagttaatcccctttgtaaagtaatttgagaggagggaattcagaatgtaaaatctcacctgcagaaaacactcaactctgtaaaggcctttttatctttaaggcatttacaaagacttaatattttaatgcggaagggtgaacttggttaaaaagccaataggtgaaattagagagaaataatccagtgctttctttctgggaattattctactctccaggggacctaattttattccctgtggggaatgagaataccctctgtacaacaagccagcatctttaaatataagcttgacttttagtataataagagtcttgttaggtgcaattttttccttagtcatttatacaatgaacaaatgttgtggttacctgggaaagaaaattcaagtgcttttaaatctcttgtgagatttggtttcatgcttgaaacctatacactgttatgcccaatagcatctgttgaaaattctgagctgtaaggtatacaacatagagaagttaatacacttaggaaaaaattgagaccactacaaaatggatttaagggcctgaattaaaagcttttcttgtgctgagtgacagctacttaccagtagcattaagcttaacaaataagtagaactttcttaggagtgaatattacaagatgatgtccctgtatacacagtaggaagccagtctttccttcaggtggcacttaacttttttcttccaattgtaaaacactttttagttctatgcaaattctgtgctaattagttcaaagtctgaattaacggacagaatataatctaagagaatatatagtgttgagtagtatttttggtagggtatggcattagttattatgttaagtcatttctgtctcctacaaactttgtgataatttgcacattttaaaatctttttggctgggcacggtggctcatgcctgtaatcccagcactttgggagtccaatacagatggattgcgtgtactcaggagttcaagaccagcctgagcaacatggtgaaaccctgtctcaccaaaagtacaaaaattagccagatgtgatggcatgcgcctatagtctgagctacacagggggttgaggtaggagaaatcacttgacttgaccctgccatgatcatgcctctgctctccagcctgggttacagagtgaaaccctgtctcaaataaaattctcaaataaaataaaatctttcttctcctttttttttttttttttttttttgagagagagggtctcatttgttgcccatgctggagtgcagtggtgcaatcataatcatagttcactacagtctggaactcctgactcctgggctcaagagatcctcccacctcagcctcccaagtagttaggactacaggcacatgccaccatacccagtaaatttattttattttttgtagagatggaatcttcttatgtttcccaggctggtaactcttggcctcaagcagtcctcccatctcagcctcccaaagcactaggattacaggcatgagccaccatgcctggcctaaaatctattcttaatgataaaatactggtctcataccactcctaatagtctttagtgtttttagtcataaaccattttttattggatttggtagcatcttttttttgttttgttttgtttgagtcagagtctcactctgtcgctcaggctagagtgcagtggagcgatcttcggctcactgccacctccacctcccgggttcaagcagttctcctgcctcagcctcccaagtagctgggattgcaggcgcccgccaccatgcccagctaagttttgtatttttagtggagacagggtttcaccgtattagccaggctgatctcctgcccaggctggtctcttgcccaggctggtcttgaactcctgaccttgtgatcggcccacctcggcctcccaaagagctgggattacaggcgtgagccaccacgccaggcctagcatattttttcttgttgttgtttttgtttttggagacggagtctcgctcagtcgcccaggctggagtgcagtggcgcgatctcggctcactgcaaactccgcctcctgagttcacgccattctcctgcctcagcctcctgagtagctggaactgcaggcgcctgccactacgtctggctggtttttttgtatttttagtagaaacgaggtttcacctgttagccaggatggtctcgatctcctgacctcgtgatccgcccgcctcagcctttcaaagtgctgggattacagtcatgagccaccgcgccctgccgcatattttttctttaaaggggatccagtaaaagataatagaaatctttcatgttactttttttaaatttagaagttgactgaagtggcaacaagtagcctttgcaatcttaaaaagaacagtctccagaaattttcttacattccagtgtaacttcaaagtactgggtgttatgttttcagttcttaaacttgccctccgcctttaaagctctgggtttatgagcttggtctactgagtacgatttaatttcctactaggggtaagacccatagacactgtatgcagcactttccctgcttttcttggcattttttagaaggccattaagaataatgttttatttaggtcttttattatgcaagatctaatccagtcctcataacaaaatattttggtttcatttagaagcagctaagtgggccaggtgtggtggctcacgcctgtaatcccagcactttgggaggctaaggtgggcagatcacgcggtcaggagatggagaccatcctggctaacacggtgaaaccccctctccactaaaaatacaaaaaattagcgagccatggtggtgggcatctgtagtcccagctacttgggaggctgaggcaggagaatggcgtgaacccaggcggcggagatctcagtgagccgagatcacgccactgcactacagcctgggcgacagagcgagattctgcctcaaaaaaataaatcaaaaaaagtagttaagtgagccagcacagtggtatgaccctgcagtcccagctacccgggaggccaaggcgagaggattgctggagcctaggagtttaaatccagcctgggcaatggagtgagaccctgtctctgggagaagaaaaagaacttctacatcaacgggcagtgtgataggcattgagacataggttagggttttgctatgatgaatgagcaccaagaaaataaaattttaaaaattaaaaggtaaggtatatttcccctatgaggactgtttgctgaggtactagctaagctggagaatagtcaagagctagccttttttcacccctgcttagttgacatttttaaagctcactgaaataataagaaaatgacctacatttatgtaaatatcctcaggcagaatgacatccaaaagcatgcatgcaaaggtacatttaaaagttgtgttcttgtgtaaatacttttaaagaactagtgggccaggcagtggctcaggcctgtaagcgtagcattttgggaggccgaggcagcagatcacttgaggtcaggagtttgagaccaccagcctggccaacatggtgaaaccccgcctctactaaaaatacaagaaaattagccaggcctggtggcgagtgcctgtaatcccagctacttgggaggctgaggcaggagaatcacttgaccctaggaggtggaggttgcagtgagccaagatcacatcactgcctgggcgacagtgagattctgtctcaaaaaaaaaaaaaaaaaaaaaaaaaaaagaactagcaaagttttattttgttatgggtaaaaggtcatattaaaaacatcatgatttcggccgggtgccgtggctcatgcctgtaatcccagcactttgggaggccgaggcgggcggatcacctgaggtcaggagttcaagaccagcctgggcaacatggtaaaaccccatctctacaaaaatacaaaaattagctgggcatgatggtgggtgcctgtaatcccagctacttgggaggctgaggcggaaaaatcatttgaacctgggaggtggagtttgcagtgagccgagatcgtgccattgcactccagcctaggcaacaaagggagattctgtctcaaaaaaagaaaaagaaagtcatgatttcttttgttttgccatacccgtccccccatttttttgaagtttccttaatgtgcttcaatttaggactaactttttttgtttcagacaaatcttcctattttcaagctgaaagaatctactgttagaagaagatacagtgactttgaatggctgcgaagtgaattagaaagagagagcaaggtaagaatgatttatgatgcaactttaaagcaaaacattccaagttttaatgtttaatatttctcaggaaaatgatattgaataaaatgggtaaaagcaaatatgatttctttttttcaaatagttcagtgtcattttatagaggtagagtctgtgtaaattttccttagaactctttctcttgtctgctttggcccagttgaggtctttgctgactcacacttcaataacacttcttagaaccttgttgctattacttccttcctttccctcatcgtcctattccatcttcccctctccacacacttaagccaagtttctcttcctcaatacattttataaatgtcagtgtatttccaattttgttttagtgacatataagtttttttcatcacatatatgttcatgtaacagaagtttcataaagcagtaatgacctcactctgtgtgatatgtgctgatattcttcagattagcgtttttaaatgatggccatgatccactaatgggttgctgccggcaatttaaaaacactgttacatgcctgatcttctcttagaatagaatttggtagctttggcatcaaaataaattaaagcaaggtctcactctggtgtctctcatttcagccctgcctcagaatgacatcagaggcaaggagtcatggaaggacgtggtgtgctcagaatgatgaaaagttattttgtgactagaaagtaggtaaaaaggtgtgggtatggtaggagtcctgaactagatgaaggctagtctgtactcatttctcaagtttaataagggttttctttttttttctgtttctagcctaagataaaagtggctgcatatgagcacaaaatatgcagatcatagcattccaacaaaaatgtaaagaaggccgggcatggtggctcatgcctataatctcggtactttggtaggccgagtcaggaggatctcttgagcccagcagttcaagaccagcctggggaacatagtgaggccccatctcttccaaaatttttaaatatgaataaaactagaaatacaaaatctgtgttaagaaagctctcaaactttaccaaaagaccagacctaaataaagaggggccaggtgcagtggcttacgcctgtaatcccagcacttcaggaggccaacgtgggtggatcacttaagccaaggagttcgagaccagcgtgggcaacatgcgaaaccccatcgctacaaaaaatacaaaaattagccaggcatggtgacatgcacctgtagtcccagcactcaggaggctgaggcaagaggatcactttgagtccaggaggcagaggttgcagtgagctgtagtcttgcccctgcactccagcatgggcaccagagccaggccctgtctcaaaaaaaaaaaaaaaaaaaaaaaaaaaaaaagtgtaatactgtattccttgtaatactgtattcctcgtttggaatgtttactgttgaagatttttttattttataaacattttagctcgtcctttgtgttctaggagttacaggtagagctatgaacaaattaaggtcccctcttttatggtgcttatatcctattaggtaaattgcgggggagggggttgttgaagagaaggcaggaaaaatatagtaaaatatatagatgtcagatgatgagaagctctaaaaaaaaaaacaaagctaaactaagggaagtaggaagtgccaggggagccactctcatatagagcacaagggaaggcctcactctaggtgacattagcagagacctgcatgaagtagagcagtatcttctaacttatttataaattcataagattgtagtagaaatttcagtagggctgtttataaagttgcagatttatttatgagctttagaatcagaaaaagctcaagaataaccaaaaaatattttcagtatatagtgggcagcaggttatttgttctaccagacatcaaaacatcttttttttttttgagactgagcctcactctggagtgcagtggcatcatgtcggctcactgcaacctccatctccggggttcaagcaattctcctgcctcagcctcccgagtagctgggattacaggcacccaccaccacactcggctaattttttttatatttttagtagagatggggtttcatcatgttggccaggctggtctcgaactcctgacctcaggtgatccgccctcctcggcctcccaaagtgctgggattacaggtgtgagccactgtgcctgacccaaaacatatcttaaggctatagtaattcaaacaatgtggtgtagtcatatggcacttaatgatgagaatacattctaagaaatgcatccttaggtgatttcattgtttgtgcaaacatcatatgagtatactcacacaaacccaggtggtgtagcctactacacacctaggctatatggtacagcctattactcctagactacaagcctatccaacatgttactgtacttaatactacaggcagttgtaacatagtgggaagcatttgtgcatctaaacatataaaagatatggtaaaaaatacagcgtggaagacttttttttttttaaagcatggaagattttttaaatagtacacctgtatagggcacttaccataaatggagcttgcaggattgaaagttgttctgggtgagtcagttagtatgtggcgagtgaatgagaagacctaggacattactgtttattactgcaggctttataaacactgtacattgaaatttataatttataaaatatttttcttcaataataaattaaccttagcttactttttaaactttttactttaactttttgactcttgtaataacacttagcttaaaacacagacacattgaacaaatgtacaaaaatatgttctttatattcttattctataagcttttctctatttaaatttttttaactttttcttaaaaattaagtcacaaatatacatagtagcctaggcctgcacagagtcaggatcaccaagacatctctaggcaataggaatttttcacctccattataatcttaaggcaccacagttattatcttaagtggtccatctctgatgggaaacactgttatgcagtgtatattgctttaggttgggcaaatagattagtggaatataatagagtttagagtttgacccatgtatttatagggaatttagttcataacaaaaatagcattgtcattcagtgggaaaggaattcagcaaatggagttgaaatatttgtctattaggaaataaagatttatatctcactatattacaaattacagatggttgggagattgattgattgattgattgacagagccttgctctgttgcccaggctgaaatgcggtggcgtgatcatagcatactataatatcctccaactcctggtctcaagtgattttcctgcctcagcctcccaagtagctgggactacaggcatgagccaccatgtccagctaattttaaaaaattttttgtaaggatgaggcttcactatgttgcccaggctggtcttgaattcctggcctcaagtaatcctcctgccttggcctcccaaagtgctgggattacaggcatgagccaccacacctagctgagaagtgtcttgatacataggctttgggctttgcttgacataccatgtggcacactggaaatgtttaataaacgtttgctgagtgtatattttgcttttttttgtaaatttatttattcattttttaaaaatttttagtagagacggggtttcaccgtgttagcaagacggtctcgatctcctggccttgtgatccgcccgccttggcctcccgaagtgctgggattacaggcgtgagccaccccgcccgaccgcttttgtttttagtaacagctttattgagatataattcacataccatgcaattcacccatttaaagtgtataattcactggtttttaatatgttcacagagttgtgcaaccatcactattttagagcactagtcaattttagagcatttttatcacccaataaaagaaaccctgtccccattagtagacaccactgatttctccccaacccttcctcactcagcctatggcaaccacctgctagtctcctttctctgtggatttgcccattctgggcatatgtaaatggaagcccacaatatgtgatcttttgtgtctggcttctttcacttaacatgttttcacagttcatgcttttctaacatgcatcaattacttcatttctttttattcctaaataatatcctattgtatgcttataccacatcttatttatacacttatttggtggacattttgttctactttttggctgttattggtagtgctgctgtgaacatttgtgcataggtttctgtctgcatgtgttttcatttcttttcagtatatacctaccagtacattgctgggtcataactctttttaaccttttgaggaattggcagaccgtttttccaaagcagctgtgtaattttacattcttaccagcaatgtgaggttctacttttctccacatccttaccaattgcctgtcttctttattatagctatcctactgtttgtgaaggggtattgcattgtggttttgatttttatttctctaatggccactaatgttgattttcttttcatatacttactggtcatttatgtatcttctttggagacatctttattgagagcttttgcctttttcaatgggttcatctttttattatagagttatgtcgagaatatataagactcttagagttccctatcagatacataatttgcacatatctcccagtctctgggttgtttttcactttcttgatgttgtcctttgaagcacaatacttcacatttaacattagaccagttaaatatattgagagttaaatccatgtgaaagttttactcgtattacagtattgcaaagaacaatgtaatcaagttattttgtggtatattagtacttttaactaagatctgttaaactaagctagaaattagctgacatgtattatggtcagatcttttagcttttattctagtttgctttagctttcaatatattgtgctcaccagatattctcctatttctcaccccacatgcacgcacatatctttgcattcatgactttttaattagtattagaattttttttttttttttttgagacggtgtctagctctcgcccaggctggagtaccgtggtgcagtcccggcttactgcaatctctgcctcccaggctcaagcaattctcctcagcctcctgagtaaaggggttacaagcatgcaccaccatgcccggctaattttttgtatttttagtagacacagggtttcaccatgttggccaggctggtcttgaacttctgacctcaggtgatccacccaccttggcctcctgaagtgctgggattacatatgtgagctaccgcacccaacctggtgttagaattccagttaggtgttttcagactgcttcagcaaaaataatttgatgtagaagagaatcttagctggatgagccatttatgatttttatagatcattaatcctgttgcctaccacctccccatccatttgaatgactagtttgaatatgttaggaagagtgtatctctacagaggataatgcatagctatccttttcttaaattcccattatatatgaaatttatatatatttaattatatatatattcttacattttttatcattttccttctttctttaactgacatccttgagctatccttttcttaagtttcatgctaaattctaccctgaattaatggtggtcatttatttaacacagtggttccagaattctttttttaaataataattgtgtagatacagatatttttccctgcccaccagatagccattctactggaacgtaatggttagcattcctttgtttctcagttatagaaggtccctgcagattttaactctcaactaaacagatgttaacatgggggtgagatctgagaatgctagcataaatttacggagacaaatccatagatatcttcatcattggtcatctgaggagagtaaatctaggaagggattataaagtttatttggacatttggtttttttgtttttattttgttttttgttaatctatatgaagtcgagttgctctttcccttttttaccctattgaattttgtttgaggataaacaactcgttgtagaaactatatcaagggtttaaagttttaatttttttgaatatgtgtaatttgtattattggtgaaaagaaaaatatgtatcagtttactatatatatttctccttgttctgattgtttgcttacacatttctctgtttgcgtttaaagtaaggatccagctaagtggttggtcatttaacagatatttgagcttctgttgtatgcccagtttttcttaaaataaccacaagaagcctaagacaggggtcttgatttgaagacattagtatgatagattgatggttttccaccaaaggcagttttatcccccaggagacgtttgacactgtctagagacattttttattgtctcagctgggggtgctatgttgtctagtgggcagaggctagggatgctgctaaagaaaagaatgccagcctggccaacacagtgaaacaccatctccacaaaaaatagaaaaattagccaggcgtggtagcacgctatgtacctgtagtgtcccggctatttgggaggctgatgcaggaggatcatctgagtctgggggaggctgcagcgagccatgatcgcaccacggaactccagcctgggtgacagagcaagaccccatctcaagaaagaaaagaatgcacaagaaagccccccagtacaaaacttatctgattctcagtagtgctagggtagagaaaccaaactaacctgtgaaatagctaggtgctatttaatcaaaacaagtattttgagctccagaataacatttttaaaaatttattttttttttaagacggggtctcgctgtcacctaggctggagtgcagcgacattttagttcactccagtcctgaactcctggactcaagtgatcatcccacttccgcctcctaagtagctgggactacaggctcacaccaccacacccagctaagttttttttatttttgtagacatgtgcccaggcttgtgtcaaattcctggcctcaagcaatcctcccgcctgccttggcctcccaaagtgcagggattgcagatgtgagccactgcacctggcccagaataatatttgagctccagataattcccagaagggagagatcagcaggagttgacccttggttaggctttgaaggggaaaatttgggatcttcctatagtgcgagaagggagaaatgacaggtctttgggaaaagacagcaggatagggcatttgggagaaagttgacttgtttcttaatttaggaaacagaatagtgacaactagagttattggtattttgtcatcacctcaaacacaagtaggaaagactgtatgcagatggtaagaggttgaagaaaccagaaatctttttttttttttttttctagacggagtctcactctgtagcccagctggagtgcagtggcgtgatctccactcactgcaagctctgcctcccgggttcatgccattctcctgcctcagcctccagagtagttgggcctacaggcgcccgccaccacgcccggctcattttttgtattttttagtagagacagggtttcaccgtgttagccaggatggtctcgatctcctgaccctgtgatctgcccgcctcggcctcccaaagtgctgggattacaggcatgagccaccacgcccggctgaaaccagaattcttacctaaccatgttgcagagagaacattaacgtttcttcatttaattgagagttgattttgatctctgcagtttccattgcaataaggcattgccttctccaagtggcatcacaagtgtctgaggggcatggtaacctttatttcagtgttgtgagtgttctctttgtatacctgggctttgataaggccaagaaaaatgatataagctatgggccctgcctttgaattaggagcttttgtctgatgggctattctgcatttgtctaaacatttggtcttttttcagtgtattttttgctcttttatatttcaactagtttgaccggacgatggctgtcatagtgaggacatgctttgtcttcatgttgtgctctataaattttcacaacccagtcatcatgatcaaggagtttctgtcttcacattttaggtcgtagttcccccgctccctgggaaagcgtttttgcgtcagcttccttttagaggagatgatggaatatttgatgacaattttattgaggaaagaaaacaagggctggagcagtttataaacaagtaagtgcttcctattcctcaaagtgtaggactactttaagtgactacttgtagtttagatgttaagctaaactgcactgttgccttttctttcagccatttcctaacttttcatatcatttaaacaaagtaaaagtatctgacaagttgaatatcatgtgataaatattaacacatttgagtgattgaaatgagcatctttgtgttgacctacgttttgtatttgtttttcttggttaatttatgcaaattacatttaaaattacggcatttaaaaaatacagttttacttatgattctttctgatttaaggtatgttctagcatgaacaataaaacttacaatgtacttgcaatcatcttgtttgattgcagatggaggtattagcatgtcttgtataaaggtgcatgtttttaattttcatggtaaaatgtattcttttgaaaatgtaagaagacttaggattgtttcttttttactttagaaactcttgataagctcaaaccaatatttttagcttttaattttattcccatttgaaatatagctattttgtaaaataatagaaagccagagtgttagaaagatttatgccaagaaagacctcactgtaattgtgcattggccttaaactagcaaaagtaaatcaaatcgtacagaatatggtaatgtgagcttacactgtaaattttatctagtgatttgaagatccatgagtggtaaacaggagagaaagggttacataaagcccttggttatctactgtagcactcaatattcattgtctgtgaatctgttttccttttggagaaggcagtactatattagatttttttttttttttttttgagacagtcttgctctgtcgcccaggctggagtgcagtggtgcagtctcggctcagtgaaacctccacctcccaggttcaagtgattctcatgcctcagccacctgagtagttgggattatagttgcgcaccatcgtgtctggcttatttttgtatttttagtagagacagggtttcgccatgttggccaggctggtctcaaactcctgacctcaagtgatctgcctgccttggtctcccaaagtgctgggattacaagcatgagccaccacgcctggcctatattagatatttttaaattctgaaataatagtccggttgcccagtgtggttttaagcaggcaaaaacaaacaaaatacctggatatttgtgcctgtttttttagtattttgggcttttattgaacttcattgtatttctaacttcaatcctgtatcttctcctctttaaaatagactctggcctggtacagtggatcatgtctgtaatcccaatattttgggaggccgaggtgggcagatcacttgaggtcaggagttccaaggccagcctggccaacatggcgaaaccctgtctctactaaaaatacaaaaattagtggggcgtggtggtgtttacctgtagtcccagctactcaggaggctgtggcaggagaatcgcttgaacctgggagacagaggttgcagtgagccaagatcacaccactgcactctagcctgggtgatagagcaacacttttgtctcaaaaaaaaaaaaaaaaaaaaaagattcttaggatcaattgacatgcttcacttttaacattaaaattaatttaagtttcttatgaatacaccagctatgatgtaaagctaattgggtacatgtgccacaagcagtgaaaaatttgtgattaatgttttcttaattagagttgtgaaccaaacaaaagaacatataccattagttgatagtgcatagctttatggacagtccagaataatacttattggtaaactgtacatgattctgagccgggcgcagtggctcacgcctgtaatcccagcactttgggaggctgaggtgagcagatcacttgaggtcagggatttgagactagcctggccaacatggtgaaaccccgtctctagtaaaaatataaaaattagctgggcatgatggcacacgcctgtagtcccagctactcagggggctgaggcacgaaatcacttgaacccaggagacggaggttgccatgagccaagatcagccactgcactccagcctgtgcaacagagcaagactccatctcaaaaaaaaaaaaattatacatgcttctcaactttaaaatatgtgttttgaactcccccaccttgtataaaatattggactaaatttatattttttattctcagggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcactgattgtgttgcctccagctttttttgctctctatgagtgactacttaagtcacttgttgagagggattatttactaattatatacttctcattcctgtaactccattccctttaaacagtggtgatatcaaatatacttccatccattgaatggggtatttttaacaacaacaaaagtgatatactaaaaaatgtattgcttaaggcttattgaatcattttgaagcactttgtgtatttgaaaactgctttataatctcatttattaaaaggactttcaaagataaaataccatttctcctatttttcagaagttttttcctagtcaactgagtgacttgtttaaacaaacttagcaagggtgtaataactcttcttagtcagcaggtttgtgctttctctttaatttggtttgggatagtagcacactttatcctctttaagagaagggcacagtcttctagcctgacctgcaaaaatgataagataccagaaaacacatgacttcttgctgcctaacttgtgttgtgttcagacctttcagccagaatgtggtctctagtttgtacaacttgcggtggtttggggacccattgtgacttggagttaaatcccaaagtaaagaaattttgtcctcctacagcagatgcgtctcctctgaagatggatcagtccatttaaaaggaaacaagcttgggtcttggccaaactaggatgtccaccaagcacatagaagtcataggaagaagtcagagttgccccataaggccttttgttgctcaaacagtatttcacagttccctaatactggatgtttcaattactgtaagaaggtacaaagctaaacaacatgtaaattttatttcagtgaactagagaagtaaagtcagaggctgtcagttttgggtatgcagaacagaataatggtagctctgcaaaaccaaataattctttaaagcagtggttctcggcaaggcacagtggctctcacctgtagtgccagcactttgggaggccaaggcagggggattgcttgaggcccggagttctgagaccaacctgggtaacatagtgagactatgtctctacaaaaagtttaaaaattagctgggcatggtggtgtgtgcctgtagtcccagctacttgggtggctaggtggaagtgtatcttgagcccaggaagttgaggttgcagtgagccaagatcatgccacttaattctagcctaggcaagagtgagagacccagtctcaaaagaaaatttttttttctgttaaacattaaaataaagcagtggttctcaaccagggatgattttgtcccccaggggacgtttggcaatgtctgaagatatttttggttgtctcaactagggaatgttactggactctaacaggtggatgtcagagatgctgctaaacctcttaaaatgaacaagccagcctcccacagcagaaaaatgttagtagtgtcaaggtttccactcaccgtggagtcttgattttgatcatttacagacaaggaatagcgtggtttaggatggcttgtactagcctgcccgcttttaacctctaccacaatttcctaagggcaggcatgctcttgaaaagtcaagggttttaaagtaggtgaaaagtttattccaggtaacgtgtttttgcctaatggaggaaggtgcttttcagtgttatcttgtaggaaattgagaccatggtttatagtgaaactatgcctttaacccgctgaagtaaaaatgcaggtgctcttaattctaactacataggagggggttccagaatcccttaagaatcttcctaaaaaaaaattaatttggcagtgagttacaaagcaatagatggataattctaaggaatctcaggctctgtgtccactattcaagtatttaattgccttgtctcaactcctgccagttataaagggtcaatatcagtggtaactttataacttacatcgaggattacatgtaaaattcatagga

SEQ ID NO: 15860 - DNA, 20875 bp, Human
  misc_feature (1)...(20875): n = A,T,C or G
caacctccacctcccgggttcaagtgactctcctgccttaaccacccccagtagctgggattacaggcgcctgccaccacgcccagctaattttcttttttcttcctttttttttttttttttttagtagagacagggtttcaccacaccacgttggccaggattgtctcgaactccggacctcaagtgatccatgcacctcggcctcccaaagtgctgggattacaggcgtgagccaccgctcctggcctgcagcctcccttctaaacccttgtttttgtctaacatcccctggctgctgtccccacatgacccaaataaacagatgatcatgtgaagccagtaaggctgtttgttttaaatagcaaacatctccactaagctctggagcagatggagtattgggggcaatggagaggctggcattcaaatctgtgttcactctactcttaccttctgcttcctcacccctgaagcgaacagtgtcttaagaacactgcctttcagagaggtgcctacttactggtatagagttggccagtgacaaagaagagtgtaaaaaattaaacctcagccttcagcagaaactccagggctgtatgagtgcatggccacctgaggagagcaggaagggacagctggatggagcactgtgcaccacggtgctgaccccacacaaaataagaacttgcccaaaagcattaactcaggtcacaatcatgtatagatgcagctccacttaggacgggtttcaccagccataatcccatcctaaattgagcgcatgctagattatcacttttacaaccattgcaaacttggaaagtcctgtgtcaaaccatcacaagtcagggactgtctgtatactgttgagagtccctgttccactgccgcctatatattatattgcctttgaattttccattttctctagttgtgcagaatgggccaggcccaaccatactggtggcaagtggcagacaccttaaaggaagcaatgttggagccagcacagatctggccctcccagcaaaggggcactcatcccatggagaagaactgggctgttccgttctaatccgcctttgctccagcttcatcataagcaaaatcagtggtacctacctggacatttgtgtgtgtggcgacttctgcatgctcagctctagatgctggggcattaaatgtgaaaagatcagaggcctctgtagactagtactggcaaacagcccccttcctctggttcacgaagttcttgatttccaggatctgtgcagatttttcccccctaggatgcatgacgatgccctcaaaggaaaggagtaaagccagcaaacattttgcctgctttctatgtttctagctgtcttccaaccagtccctaaaataggaacgctccgagggtgccatgtgatggaatgtattggcagggcggcctgcctctcagcctcatgaaggtttgctttcctggttgtgtgtgatgttgaagccgcggctgaggagttctaaacccactggcactgactgcccccccacttcttggaccggttagcaaagaatggagcctggggccagaactgaggggtactccccctgcactggcacagcacaatcgacatgctccgggacgctccaaataagctttcagccgcctggggtctatcgctgccgctgtaccagtggnnnnnnnnnnnnnnnnnnnngccagcagcgcaggacccgcccctcccttcgcgagacgccgcggccctgcgggcgggggctccggtccgggctttggctgtggccccggtgtagtagcgggggcggcggccgggggcagcgcggctccttcccttgttgtgtgtgtcggtgcctcctcgccatcttgttgcaaagccctttcttgtcggcgggactcccgggggccgcggggcgggaggcatcggaagggaggtagagagggaggggaagaagggaggcagtgccgccttttttttttttttgcatcccatttttttaaatttgcaattttatattttgcaaatattttgagagacattgatttttctccccgtgctcccccgttcttccctgcggagtgcgctgcgccgcccagccctgtcgccccccggaggtgatccctccctcctgcctgcccgccagcctgacctgtgcccggctcgcgggccgcagcctcggccccggcgcgcccccggcagctctcggcgcgatgagcatagagacgctactggaggcggcccgcttcctggaatggcaagcgcagcaacaacagagagcacgtggtgagcggccgggctgggcccctggggcactggggaaggggaagcgagtgaccccggtccccgaacccacgcgaaaccgcggacagggccccctcccgggcggcctgcggagcctggcagcgcacggctccccgcgagagccgccgcctggggaggggtgatgtgggcagtgaaattaattaatgaattcattaacatgctgcgagggacctggctcctgcgggcgccaccccggctgcgtggcacccctgtgccccttctgtggtgggctgcttttgcgtgggccagcggagccctcggtggcactgaggatgtgtgagccggggggtggggtgaggaatggtgttgcgtgggggtggcaggctcgcgtgtgcgtgcgtgtgtgcacgggggatgtgtgatgtgagcctcgggaagagcagatgaacggacgtgtacacgggcgtgtgtatagcacacgagtgggcgtgtgtgtaacggagtgggggtggggactactctacgcggagcagctcttcggcttccctggccccgtggggagggtgcggggggcgctcccggcagatctacgcgccgcttggggcggaggcggcctttgcagaatgaaatgacatcgcgtgtcttatgatcctggccagccccgcctgaccccgcctcccagagctgggctgggctgcgcgtccggggtttgggtgaaagccgggctaattgggcgtttgcgaaatggcccgcgggtcgctgggggtcagcccccgggcccccctcgctgcgccccgctttagccagtgtggaatgtggcgtgtctgcgcgttccaaacccgctctcgcctggaatgttgcgtgtgcctgcgttccgagcccgttggttacaccgggtggtgacgtggacgggctccgcccccgaccacgtgcaccggggacactcctgctggggacggcgcggcccggcccctcctcaccgcctcgcgctcggccgggggcggggcctgggcggggctggcaaggggccttgcgctgggttgggcctgggcccgggccccggcctctgggcacctcccagggagagcctttgccctgcgagggaggagccgagctcacctgtcggctctggcccctaacctcctgtgtttgatcccgaggcaagggaaaccctcagaatcgcagggcgacgagacatttagagctcacatttttccactgacccccaaaacgttccaactatgccccctggcatcagccggggccacgctggaatgagccaggatgagaaagggcaaacttcggcgctccctcgaaagggaagagactaatgactcctatcttcacgcgccctgttggtggtccctggcttcagggtgctgcagaggggctggcgggaaagacctcccttttccagggtgctgccagggcctcggctctggaacggtgtgtgtgcaggacccggggactcctgtgccctccccgccccccagaatcccccggcagggttggttgtgttggagagtgcttcgccctcctttcctttctctctgcctattgttgcttcgatgatgagtcatgcaggaggtagtagtgtgttgtgtgcgcgcgcgccgccgtgtgccgccgccgcggcgggcgggggtgggggaaggggggagcggcagcgggcaaggggcgggggagctgcggggccggcggcctagtcggggcgaccggcctctcaaggtcaagagtcactggagatatgtgaggctcagatgcctgggttttgcagaagtgatgggcggggacatcgcccacactccccggctgttgccttgatggtccagagcagggtctggcagtggagagtgcccctggtgaccaagaatgtcctacgtttgggcacaggggtcaggggaagaccgtgcacaaggttcggagagattaagtcacctgctgccgccatcaacacgttgcagttcgagtacgcactgtgtttaggccgagttcagcggcctggtcacgacttctgtgtgccggtcagaggtctttgtagatgagtgggtgcggaaagctagatctactcaaaaactcatgtacgggtgtccggaaccgatcccagcagtttctcctccagaattcattttcttctccctcttgaggttctgtcctctgagctggggcaggacgaatggaaggaagggcatggcaggtgaacctgctgaccagaacgctttcccgggacctaggaccagctctggacagggatcctcttgtcctttctccctttcaaccgcaagcatgggtttctgacctagaccagccagtttgctcacatgaggaccccgcagatgtgtgtgcctgtgagagagaggggaaagggcagagctatcctggtgcccagacggaaggcctggcctggtcatttctagtgttcatagaggtggctcagatgcaactcttctgccttgtttcgagggagttggttggagtgtccagaggctcctgaccaactctccaaggcttaccctgggcctgccttaggcaccaagcctcctgtttagcgtgcagatgggagaattcctgtggctgctggggcccaccagtgtggactcctccacccctagccctgtgcctgcagagcacctgggccacagtcacttgggaaggttgaagggagcacgctggctctgctcttgactgtgggcggaagccttggcccctgggtcactgcagaggggcatgctaaattctttgggggcagcctctgggtggagcccagggaagcatgtgagggggcgcaccctgtctggtggatgtgcagaacattcttttaaagagcctaagcgcagggtgctcctgagggagcaccagccaccaccagtttggtggttctccagtgcacagggagagggttgccgctgggtgggaagggacaggaagctccggtgggctggatctggccaggggcagctcctcttcctcaccacctgtggagctttttcatgctgctccaggtgtaactgggtccttcctggcacctgtgaggtgtaccggcgtggttctgggtgagagagggcaggtgagaaggaggttgctacctcccaggtgagctttgggattgctttaaaatatggggaatgggggttggcttgcactctagggtcccacatgtccttgtgactcagggagggccctgattgttcctctgcctataaagagtggagtccatgtctcaaggccaatgaaaagttaggtctgtgtcagccaaaggaatggaggcagggtctgtgttaggccctgggatccagagccttgtcttggggtaggggaaggggctggggacaactgaggctgtgcccgactgagaagggccctgtcactggaactcagcaggctgcttggccactgcggtctgtgggaagcgggagcgcagggctggttttctcccgggcgtaacctaaggcctccccgcactggagcaggcctgcaccggcctggcatcgccccttcccgaagggctagggagatctggaagaggcccgctggctggcccagcccctgaactccggctgctgggaaaccactgaggcttcccctcccaggacgcttccccctccgcttcctcctcggcctcttccctctgcaggagggcggggctgggagcaggcctggctcacactccagttgttgattggccaaagggcctgaggcctcaggttttctggggcgcctgagccagtaagagtgtgggaggtgggtgctctcctccccagggggccttagccgactccagtcccccacgccaccccttgcccgggtgtttggggcgtgtccacgagcccgggctgtctgctgcgttcgtcagcggagcggggcgggcgtccggggtcagaggagagggctgcttgtcccggcggctccctggcctggagtctgcagactccaagggcctgggccagccccgtagccagggaaccagaatggtggcgcctgggagaggacgaggcaagcgggagatggaggtgcctccccttcccctgttggcagccagctcctgagtgggccttgccttcctgctgggctttcagcagggatgctgagcgggtggtggggtgcactgccctgctcagcccccattgaagagcccagccccttcttgtttgggagaaatggtcgctgctgtacctcctcctcctcaaccgccctctctcacccagaaccaggcaggtgcactttccccggtgcctggctggagtggttgggtatttgtattgtctcaggctgagcggggtgtcactgaggatgtcagaggatgctttaggcctgaaggacaggacatgctggcgctgctgctggtggtggggatgttggggatttggggaaaatgagttataacacgagaagggtcagagagggacgaagtgtgtttgttgaatggtccctgaggaaaacaggcattgggacctagcctcggagtcaagagtgctgggctgtttccacatgtgtgaaatgagggtgatgtccctgtcctgcccatgatgtgacgtggggctcttgtgaggatccagggactgtcagcacttccttgtgagcacggcaagcgtcctccaggggtcaggaggcttgctgtgggacctgcagcgaatcactttgctccctgagcttcactgacttcatctgtgccatgcaggcactgcctgccctctagaaagtgcttggtaaacattgttaaaggccttccacggaagctgggatctgtcagcacacccccccctctggtgtgaagtcttgggtggctgggcctctgcccgcctctcccacctcggccctgtggtcccctgaccctcgctgccctcacccgccttcctcctcaccctgcaggctggcaggtggcctgcagcaccctctgacagctctgctccacctttccagggccgcctgtcctgcccgcagcccggactgtcagcccccgtgactgtcagcccccgtgaccgtcctactattccctggtggcggggaacaggtctgcttgatttgttcactgctgtgcccccggcactttcccccgtgcctggctgggctggtaggctatttgtggtgtctctcgctgagcaggggtgtcactgagtactgactgggctagggtcagaggacgagttagggctggagttctggggccccgctgagaccctcccccccttgtgttctctctgtgtagaggagcaggagcggcttcgcttggagcaggagcgagagcaggaacagaagaaggccaatagcctggccaggctggcacatacccttcctgtggaggaaccccgcatggaggcgccacccctgcctctgtctccaccggctcccccgccggcacccccaccaccacttgccacccctgccccactgactgtcatccctatccctgtggtgaccaactcccctcagcctctacccccacccccacccttgcccgcggcagcccagcctctgcccctggcgcctcgtcagccggccctggttggcgcccccggactcagcattaaggagcctgcccccctgcccagcaggccgcaggtgcccacccctgctcccctactgccggactcgaaggccaccattccacccaatggcagccccaagcctttgcagcccctccccacgcctgtcctgaccatagcgccacaccctggagtccagcctcagctggccccccagcagccgcccccacccacgctggggaccctgaagttggcaccagctgaagaagtcaaatccagtgaacagaagaagaggcccggggggtgagtggggtgtggcggggtcgggctggtgggggataggagaggtgcccatcccccgggctgtgtgcaagacaaggtgccctccccagcttagaagtgccccctgtatttgaacacgtcatcactgtgcccatgtctatcctgggaaggaatgtcccattgccccccgttcccaggcttctgtgtttcctaacgcagtccaaggctgaggcttatggcattcccaggcctctggacagagtatgggcctcttgggtgagggctggggtcaaccggctgcctctgagtcccaggagtcctcctgtctccctcctggtgggacggagggtgacaggagttgtgattatgagcacagatgtgtcctccagggggtgggcgcagcatggcacagggcgaacgtctcccagtctgctttaagacagtgttggggacaaacagcctgtggcaattttgcgggtggcggcgctggtcaggaaggccgtctaatcgagtcctcctccctgagcctcctatctgtctgggtttcaggatcggaaccagagaagtccacaacaaattggagaagaacagggtgtgtgtgtgtgtgtgtgtgtgtgtgcgtgcgtgcgtgcgcgcgcgacccgggccccggcggccctcggccccagcttccccggtcctgcctccccccgtcccagccccgccccaggcaccgctgaccggcgctcgcccctctcttcaggagggcccatctgaaagagtgctttgagaccctgaagcggaacatccccaacgtggatgacaagaagacgtccaatctgagcgtgctgcggacggcgctgcggtacatccaggtatggggcccggaggccggcgtcgcgcagcttcccccgccctccctccgccgcccctcccccggccgcgccccgccccgccctcacgccccggcggctcccccgcgcctccctcccacctccacgcgggcgctgagcacatggcccggctgacgtcagcggggctccctgcccgggagggcgcgcgtgcgcagaggagggcgcggctcccctcccgcgccgctcccgagcccctgcagcctcggcgtccccggggccgtgaggcgcgcgccgtgacgcctggtgcgagtcccgatggcggctcccgttcgcgcgtgttggtgcagccgcgggagggaagggcatggggcggcccggcgcctcctccccggccgcagagcctgggcgggagcccagattccgcccgaatgtctgtagctatctgcggggagggttgggcgtggtccccgtccacgctgcggcgcgggccgagccccgtttaccccaaaggaggaaggtcttttcggagcgcgcgtggaggcgccacggcccgagtgtggggttacgcctggggcggggaaaactccgatttgactgggcggcaaacagccccggggccgccgagcctgaaacacgtcacgctttccttcctcctgggctaggaagagggggtgtctcttttttcggggccctcccggctgcgcgtcccctccctttgggcgtcgctccctctgcagtgctcgggccgggggcgccgccacgtcaggcggttgccatggcggcctgagcttcggtttccctggaaaccggcggggcttccgcgcgccgggccggaggctgtgggggatgggccggcagccgcggagacgcggagccgtaggggatggagggacgtggggctcccagcccgcgttggggggggggtgggcggcgagccgggactctccctgtccatcctctgaggaagctccgggggcggcgcggcgtcacgggccccgtgggaggggtggcgaggagggtccagcgcgcgaggagccagccgctgggcgccgcccctcccccggcctcgaccgcggggtcacagccctgaggtaaccggagcctgacttgctgagggaggggctgaggcgctgcttcgcgactgctccaggggggcagctctctcccagcctcccgccaacgcgcccttccgcccgccctcccggccagggggcggggctggcgcgcctccaggccgcttccgggcagccgggaggggcggggccgggctcgcggattggctgcagcgggcgggggcggtgctctcgagtcgcggagggcggtgcagccggcgagggtgacgcagggaagccgcggccgcgtgggtgcgcgcgtgcttcggggtggggcctcggggcgccgagcgggagagggctccggaggccgcggcaggccggtggcttatttctggaatcgttttgcagaacctgggcttggttgtagtttagtcgcagggctggctgagggtgttcatgcagacacttcgctgcactcccgacatttgcttagctattatttttgagaaataggaaggacggcatggcgagttcctctttgcagatactacttgcagagggcgccttgcgtaacgtgtgggtttggaaatgaatcggaagaagactcagcagcagccgcagaaggaagctcttgaggagctgggcccggtgaagtaggagccggggtggtcctcactcaggctgtgcagaagggacacccattctggtgctggtcacagaagcaggaacctcaaaggcctgtctacaaaccatttattcatttattcattgaggtgcttttagcgaagtctctgcttctgggcgaatggtggcgagcaagtaaaaaagcctgggtcttgtggcagatgacgaacaagtcattctacagaaggcggccgtatgggcataatagggaccgggcggcgggatctgttctggggagggaggatagctgttcctgaggaaaggacctttgagctgagacctgcaggataagtctgggtggcacggagcaaagtggaggccaagagcccaggggcagcccagtttctccagcaggagggaacaggatgctttttggaaataaaagtgaggcacggtggcttgcacctgagtcccagctacgctactcgggaggccaaggcagtaagagcgcttgagcccagggagttcgaggacagcctgggccacagagtgcgacctccgtctctaagaacaaacacaaacatggtcaggaggctgtcactcagagacaggcagaatcaagagctggtcctggagagaccagtggggctgtgtagactgggagctttggttgtttgctgagagcaggaagctgcaggaagaaggcagtggtccccagccagaatacggagtggcttggaggtggtcaaaggtttgaagacagccacagtaaagtggacagagacaagaaaaataggtaccaaaccgtgcatccaggtagtcacagaaaggaaatgggtttagattgaagcaatgtgggttaaagttagaccctggggaaaccttgcaggggtctgtaggcctgtgaagaactggactaggtgagaagaagaagcttttgacccatgtcactccctggcccagaactatatcctacccacaggtgggttgagttcaggactgctgcttccagcccccagcagcaaggttcaagtgagagctgactcacctagggccccttgttagagcctcagagccaggtgaaaagccacacacaggctgggcgcgatggctcacgcctgtaatcccagcactttgggaggccgaggcaggtggatcacctgaggtcaggagttcaagaccatcctggccaacatggcaaaatcccgtctctactaaaaatacaaaaattagtcctgcctggtggcacatgcctgtagtcccagctactcgggaggctgaggcaggagaatcgcttgaacccgggaggcggaggttgcagtgagccgagatcatgccactgcactccagcctgggtgacagagcgggactctgtctccaaaaaaagaaaagccacacaggtgtgtgtgtaggggcaagggagtttcctactgtcttcctagcagaaaatggggagaaactgttaaagccagaatgagggagggctgtgtgtggcctgggactggcaacagaagtgtcaagctgccaggtttcaggccagtacagagcacggttctacctgggttatgtgttgccggcactaatggttagagacatctgtcactggtgagggcagaaatgtatgcaggagggggtgtgggaagctggcctcactggtgggtggggttggagactttgccaggcctggtcaggaaaagctgctacaaaacagcaaaactgctcctagtgcagcgatccccaacctttttggcaacagggagtattttcctggaagaccatttttccatggagagggagggcggggctggtttcgggatggaagtgttccatctcccatcatcaggcattagtcaaactctcctaaggagcacacaaaacctacactcctggtgtgcacagttcacaggagggcttctgcttctgtgagaaccaaatgtcccactgatgtgacaggatcagagcgccatcgctgctcacttcctgcatgcggccctgttcctgacaggccacggaccagtacctggggtttggggtcccccgccctaggggatgaaagaagggaaacctgggtctaatgggttactgtgattctccctgcgatgcagggaagagacaggacagaggtgggaaggaacatggtcaccaggagtcgggacagcactcttccaggtccttcccctggggctgagtaagcaccctgcgcgtagctcttcctggccgcctgtgggctctgggatctaaacggactatgcagccatcctcactttcattcacagctcggacagggacagtgtgtgttgaggcggaaagacaaaacatgtatgtgagagactttgtatgagccggttcctgatgaagtcctatctttcagcctcgtatttactgcccaggcagatggggctcttttcttcaccctcccgctttttttttttgagacagaaaacttaatagaaattttgtttgcagttcttacattctcagtgtgagccaatctgtgacccaccgccccacccagaagtggcccagtcctggtgcagggtaggaagggaagggtggagtgagaagagccccatttttcctcagtgccagggggctggagacaccacccccttctcctgcctctgggctccaggaaggagtgcagatggactctcaggcctatggttcctcctccacaccactgtcccccaggttggaggggagtgagagatacagggagagaaggggacagaggcaagaaaaggtgttgatcaagaaaggcaagaaccaggggtgagggctgacagagaatcaaagataaaacactagtaggccgggcgcggtggctcatgcctgtaatcccagcactttcggaagccaaggcgggcagatcacctgaggtcgggaattcgagaccagcctgaccaacatggagaaaccctgtctctactacaaatataaaattagccgggtgtggtggcacatgcctgtaatcccagctgctcaggaggctgaggcaggagaatcgcttgaacctgggaggcagagattgcagtgagccaagatcatgccactgcactccagcctgggcaacaagagcgaaactctgttggaaaaaaacaaacagtaaaaaaaaaaaattgagggagagtgggggaggggaatataaccaaaacccaccccaaatccaaaccagcctcgaaaaaaacggtgcggtgcctggaagggcttggaggcaggaggatgtggcagacagaaggacagtgggggaggtaggggctgagatgtggtcttggagcacgggcagataagatctagggggtaaagggaggaggatctgtgtgtgatgagggcagacggggttcagagaggaaaaccaaggcgggctggtgagttgtgtgtgtgaaaagcctgcgggccctgcacctggacatgaccagtaagcctgggaagctaggagctcgagagcaggccaagaaagggactcgggaggcagcaaggacacgtgtcggcgttgcctggtggacacattggtcatgacgtgcctgggcgaaaagctgccagcagggaggtctgtgagacttgaaagggtgggattgatgaagtgtcgggttggagcacgggaaagactgagtgtggaggggagctgggtcatgggacgcaacagccatttctcatggatcggtttagcccaagtacagggggcacgttcctaggcttgggggttgttcagcccagggagtctggaggggagtgggcagggtgatggggagcagcatgtaaatggagcctcgtcgagaagcgtcacaggcgggcacagtggagagtcgcctaggaggtcggggagcaggtgcagaccagcagccaggagggaggcgagtcctggagatgagatggggcgagggcgtgtcactgcctagtggctcatcgtgcaaggatgttgatgttaccagggagacaagtgaacggtgaggtggaagcgcaggatcaggttccttagagggtagctcgcggcagaagtgtgcaaagtgaagaggctgctggaggagggatggggcgagaggcggagaagcccctgaggatgaattgtggaggacagggaaggacctgcacacctggttgagcttgcttcagtggtgcctgtcccaagagcccacactccttgggacgctgggcctcactgggcaggggcatggaccacaacaggtgcggtctccagcagcccccgtcaggctgggcccgctggttgccacggacttgcctctgtgggccagctgatagggagaggtttgtgggggctttgggccccaaggctgctgctcagggtgtcctgctgtcccttactctgtgtgccagtccctgaagaggaaggagaaggaatatgagcatgaaatggagcggctggcacgtgagaagattgccacgcagcagcggctggcagagctcaagcacgagctgagccagtggatggacgtactggagattgaccgcgtgctgcggcagacgggccagcccgaggatgaccaggcctccacctccaccgcctctggtgagccccagcccccacgctggccccccagccctcagatgttacacctcaaattccagcctccctggccaggctctttcttgcctgctagaaaagatggccctggccccagccccatcacattcccacgcccccacgagcatctacgcctccagccacttgcttccccgcccttctgacctgctccctgccccatgttccccacagagggtgaggacaacatagacgaggatatggaggaggaccgggcgggcctgggcccacctaagctgagccatcgtccccagccggagctgctgaagtccaccctgccaccccccagcaccacccctgcgcctctgcctccacacccacaccctcacccccactccgtggccctacctcctgcccacctccccgtgcagcagcagcagccacagcagaagacccctctgccagcccctcctcccccaccggctgcccctgcccagacactggtgccagctccagcccatctggtggcgacggctgggggtggctccacggtcatcgcccacacagccaccactcacgcttcagtcatccagactgtgaaccacgttctgcaggggccaggcggcaagcacatcgcccacatcgccccctcggcccccagccctgcggtgcaactggcgcctgccacaccccccattgggcacatcactgtgcaccctgccaccctcaaccatgtggcccacctgggctcccagctgcccttgtacccgcagcccgtggcagtgagccacatcgcccacaccctctcgcaccagcaagtcaacggcacggccggcctggggcccccggctactgtcatggcaaagccggccgtgggggctcaggtggtgcaccacccccagctggtgggccagaccgtgctcaaccctgtgaccatggtcaccatgccctccttcccagtcagcacactcaagctggcttgaggacgaggccactcagaggcccccagtggggacagggagggggacctgtcccccactctctcacccaccagctccacacattccagccaggcccaggccagcccccccacccacccccaggcctcctaggggaagggggtgcaaagactctgagccaagggagggaagggccaccctgctgcactaggacttggtaagatgactctgagaaaatgcgagactctgatggaatgtgccacctgtccggcccagtgccagctccagtgccgctcctgcttcccctccctaccctcggaaatcagtgcgatgtggacgtcacgctccctgacttctcccccgccctgccccgccttcgtgtgctgctgctgctattgctgtctggtgaggtggcccaggcccccggctttcctccggagcctcatgttctcttcccaggcctttggaggggaaatggggaaagcagaactgaagccacttggcccagaaagctgcggattggggtgataaggggccttgctctgagcacaggtgacagatcataggaagtggctggtctggagtcccacccggacaggtggggcctcagcctggggctctctgacccggttgcagtcactgtgattcgttaccgtagatactacttaaaatgattctctaccaacaataaaccaaacccagccactgccaagcttcctgtgccctcaccccaatccctgccactgggctctggacctcaggagggcaggctgaggtggggaaggagggacttggctgtccttccccttccccgtcccctgcagcctgggtctggatgggaggagagccactgggcccctgtccccagtccccagtccccagccctgggcttggctcttggcttccagaaggcagcaaagaggggcgctgtcctgcgttcagcccctgatctctgacctctgctgagtgctgggcactgctccaagggacaggtgggcctggcggcctgtgggtttgggtgcctcctgcagtttgggagacatggaccagcatctggtcttgtttccaggagcatagaagccacatcgttgagacatcaggaaggtaaaaacccagcggcttagccaagccctaagcctgtccccagaccaaccctgggacctatacagaacagagggccagagctagggctgctgcttctgctccagcccctttgcctctgtcctcccatcccctcaacaccctgcttctcccggggacgcttttgagtgggccctgcccggggagctgcagagcagcagcacctttctctgagaagaggtccttggttgggtcaaggacagggctgagcgtggaagggggaggagtcaggggctctgtgttaggatgcggctttctctgcctctgggcagcctgctttggcctttccttgtatgtgggtgtttattacaagtggctttgtgtcagacacgctcggctccccacctggacacacactcaccagtggcctttcagtgtagcgggaggaagccggtgtccctggatgtgaagctcacactgatgggctggggcaggggcctgggccggcgagggggccggggggaggggacagagctgaggatttcctggagtgccctgcaggcacagaggaggtcagcaaaggtcttgaatagattttctctggaaataaagaatccttagatgcctaaaaattcccttcctgttccctcctggtcctggacacctcccaggggactgttccttatttctctctcctggtgtgggtaaagggacagttacaaaccaggtcaccatcctcagaggctgagccctgtacccaccccagcacagccacctccgccagaccccgtggctctgggagagccagctttgctattcccattgtgacagcgatggcaggcctgacccacggggcagttagagcagcctcgtggagctcgcccctcccctcagcctgcccacctctccctgcatcctgaggccagtggcccccgggcctgcacagatacctcatcatccacccgctgcccctccccgtccctgtcccccagcatcgggggcctgcaaatctagtgccgaatgactatgtccagattggtgacgatgggtgttgctgtttttcttgtcgtttgtgaacgctgtgatgctgtgtgcccaagtgggcagtcaccacccagcccttccttgggcgtctcccccagagtgctgtcgggaccacatctgtcctcaccctgtgggaccgcctggccctccctccctagcccttccagcctgggacacacacacacacacacacacacacacacacacacgcacgcacacgcacacatcttacctctcatgcgtgttttaccttttgatgttcagagtggctcactggctgggagtccttacctcggggagagggggaggttggttccttggggggccaaagaaggcagggaatgcctggagggtaactggggggccaccatgaccccttctctctccagaaacagctgcttctccccccatcccagggtcccacccccaacccccagaggtggcccttgtttacagtgaggactcggccactgtgtctctgtttcctgaaatataaactgtagcgaccccagactgtagagatttttatgtgtttggatacatctgctgtgtggaaaaaaaaaaaaactacaaaaaccctaattttgtacatactgtatttttactattgaactgtattctagtggctgttcatgctccaagactttagttaccgagacatgaatactatccatgtaataagcacttgcctggaataaaatataaaactgaaataaacctgcactgaaacctgagatggagctgccagcctgcagcatctgggtcattttattgcaaaaggaggctgaggcctgtagggaagcatgtggcaggagcggtgagatcacctgtctcgaccctgtctgcccagcatagtcctcaagcggctctgacccggtgcctccgccgctctgaaaatggcagttctggtcggtctgaaacttttgcaaagcttcgtatttcctcagaccattttacaagcattatcttgtttcatctttcaacagccaagtgaagtaaataagccagacttagccccattttggcagataaggaaacaggattgaggtggcccagtgacttgttgaggccacacggctagctggagacttcgttggagctgcagtcagacctctgaactgggtacagagttcttacccagcatctgccacccttgtggcacctggggccagtcctagactcggatccaataaaaaaggtacaggggagttgccccagggattgggcacagagggtgagagcttcctgaggggctgctctgggggtgcagttacaacaggtcagccggggagtccataaagctgtcctctaagggaaaggaacaaggggaagaagaggctggaggtcaggggcaaagagccgtgttctcagctgggctggaagccccttgtccctgtggctgtgtcttctctccctgggcaggctgtcatgggaggaggtggtgtgggaagtgaggtcagggagccactagctaggccttgctggagaccaggctgggcaagggggcccagcttctcatttccaccctgacagtacctgactgactcccagtccccacaggggagactgactctgcgtctcttcctgaggtggggtgggtaggggttatccttgaggaagggagtgctgtcttgggtcctgttttctgaaagagaagagttgacttcaaaaagttcaggccgggcacggtggcacacgcctgtaatcccagcacttcgggaggcttaggtgggcagatcacctgaggtctggagttcgagaccagcctggccaacatggcaaaaacccttctctactaaaaatacaaaaatgagccgggcatggtggtgcatgcctatgatcccagctactcaggaggctgaggcaggagaatcacttgaacccggggggtggaggctgcagtgagccgagattgcgccactgcactccagcctgggagacagagcgagactctgtctcaaaaaaaatttttttaattaaaatgaaagttcggaatccagccctccctactgagcctgccctttttacttgtgagacgcgggctccctctgctggtagctcctggaagagctgggtcacttccattagctcactaagcgacgctttagggaagggatagggtgagggttaacccttcctgggtgcatgctcagtgccaggccctgtgcccactgggaacacagatgaagaccctccccaggcagtgataacttggctgtcatctgagggctgtcactaaatctttaggcagaagctgtactcaaagctccccctcacccacagttctcactcacccatggctcagctggagcttataagaaaggggcctgtggtcaggataaagtatgaatccaggtgcttccatttaccagctcctgctctgtaagaggaagacctgactttccagattgcaaaggttccttgagatggtgtttggagagcccactgtgctgcttgctcttcccgccccagctgtcccatcgttttgaaaagctgtgggatcccctctggtcccaggatcccagtccagtagtcagggggagtagggcaggacggaagtgtgtgaagggttactcccaggctaggtgaaatttcctttaggtggtcacagcaaaggaattctgactcctccaggcaacagagtcggctggcgggtcgggggtgttcccctgaagggctcatcaagttccctggccccagagctctctctgcaccaactggtttctttgggtagctctggccactagttt

SEQ ID NO: 15861 - DNA, 101472 bp, Human
aagtctgaagtagtggtattgattcacttctatgaagactcttcatctaatttgtcaacttggaattgtacataaacctgatagcgtttgctggatagggaaagcaactcactttgtagccactgcatagacgacatcaaccaacaagcaagttgcaaacatgccaatagttagctgcttttgaatgaactgtatgccaaacgtccttgactttcatgaaactacacctgagagcatccacatgaggatccacatttgagaatgccacacaaaaggaggattatggcacatgaatcagcttttctttttaaatatagataagtagtgaaaaaataagtgcctgtcaagatgacatctgggatcatttaccagatgatccattgttacattttagtctcatagcatccaggctcattaaaacaaaatattttgcatgtcacggattgttttggctactctttagagacagatatgaatgttaaatctcagaatgctaagtatgaaagaaaccatacaggggtaatggaaaaattaggttagaattcaccttaggcaaaaactgtaaacaatccaaatattcatcaacagagcaataggtgaacaactgtggtatagtcattcattggactagtacgcacaacaaggttaaatatgttgaaagcaaaaacagtttgttgaatgaaagaagacagacatgaaagaatacatactgtatgatgtcacttatatgaagttcaggaataggcagaaactaacagaacagtaggaatgcccatggggaatggttattgaccaaaaggagtcatgagacaactgttttgttttagaaacagggtcttgttctgtcacccagaatggattgcagtgatacagtcatagctcactgtagcctcaagcagtcctcctgcctcggcctctcaaagtgttggcattctaggcgtaagctaccactcatgaccttgattggagtgtttcataaatggctatatccatttgtccatattcgtcaacttgtatacttagatttgtacatttcactgtatgtcagttttacctcagtggaaaataagaaaacaacaaaaatggcatactgagtagttccgtgaggatgagcttcgggagcacatcagtccattctcagagagtgagggaaagtttcccagagataataatctctctttttatccttttacttccacagttgatttatttttttcaactcttagctacctccccacaataatatctattcctatgactatttaatttattgtgcaaatgcagaatactttagggagcaaaaaggagtgctggtataaattacactcaactggtaaaaactatcattgtttgcttctgttctagtcagagggttgtactctactgcagtcatacctgaaggaaggcagtagtagagcaggtgtacctgagggtggaacaacctctgcttggcctcatctaaaagtagataaagggggccgggcacggtggctcacgcctgtaatcccagcactttgggaggccgaggcaggcggatcacgaggtcaggagatcgagaccatcctggctaacacggtgaaatcccatctctactaaaaatacaaaaaattagctgggtgtggtggcagatgcctgtaatcccagctactcgggaggctgaggcaggagaatggcgtgatcctgggaggcggagcttgcagtgagccaggattgtgccaccgcactccagcctgggtgagagagtgagattccgtctcaaaaaaaaaaaaaaaaaagtagataaagggggcagagttcagcaagaggcaagggaggaggtggggattttatgtggcatgggcagatgtgtttgttagttgggacttacatgtgaacttttgaaaaagatacattatttgttttatatatatttcaaaactgattcatgttgctgtatttgttcctttgaaacaggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaaggtgagtttctcagaaagatgttgaaatatgatttctttcaaaaataggtgttttttttcacaagagtaaggtctgtcttcttaatgaggtagatatttgggaaagcatatttctggtaagtgagtctgttttctcctgacttctttgattaaatcagaggtatgtgccctagggaaaaaatggtgccctatgataaaatcagatggaaatttagtgagcctttcattctttgtttttttcacatccctttgatcatccagttcttagcctttcattcttaagaactagctgtatgataaaatctaaacaataatgacattttaatttcttgtgccacattactaaagttattagtgtgtctgtgatcgacatgtcacaaagtaaaaatatgaaaagtgaatgtggagatatcagattttgcttttttgccttagcttctattataaagtctttttttaaagttttttgttcacttaaaattattgctatcatttttgtaatagatgctttaattctgtacacatggtatttatttctttgcatgcttagacataaactagacagcattacaaaatgaaagtctgagggaaaagtgactaggagttgtgactcgtttacagagaaggcatcattgtaaatacctgtttcagtcttcatggagactgatacagtctgtttttgtggaacttcactccattctcagagagtgaggggaagttttccagaggaaataatctctttttattcttttggttccacaattggtttatttttcaactcttagctctcttagcacagtaatatcttattcccatgatagatgtccacaatttttagtttaataagtatgcctgttaaacagttcttctgactaaattaaattttgtaggtgtcatttctgtttactttagactgaaaatgttcatgaataatttatattctatgatacatggctaactaatgccatatgactaccatccttctgggaaccttagaaaaacaaggtggatctctcatgaggtcttttcacagagaaaactattctgttactgtaaataacccagggactgaaatgcataatgtataatgtgccatgttagaggaggccagttaaagataccctcaggacaggaaagacaaagtgtttctggtttttcctcttattagcaggtacctatttgtacttaaaattcagtacatgtttaaaaaaaaaagctcagttactttacatatttgaaggcttttgatttttgtttaacatattttataagcacagtaaatcagaagaccaaaatgaaattgagagtgtatttcctaggtgtttatatatagttgttatgtatattttgttgtattcacaggtgacaaaacaattcagttcaattatagaagaaacttgatttaagtggatatactttttcatattttaaatattttaatatgctttacactcttattcaggtacatatgtagaaccaataaaaactgtttacattagggagtgatataaatttcatggatctgtagataattctgtgaactaaagtgtacgttttttccacaaagttttttttgaggattaacaagttctcagagattacctttaatcttaattttcctccctactttctgatcaggttcttaataaacatactgctgtaataaccagacagttaaaaagatccttaagagaagcaatcttttgcttagctcattcattgcctagagataatcagcttcaaaataattattaaggaattaagtacataaaggggtggactggtcatgcacacctttgtgcagtgtgtgcgcagtggaagtacagtggaagtgtagatgagggagtgaggaacatgtcttgatagcaatggcttttcaaggtttttgtttgtgacccatagtaaaatagatttcacattgcattagctatgtgtatttatgtgtgtgaatttataagaaataaattttacatttcaacaactgtgtgtgtagtgtttgtgtgtgtttacttataaatgaaacagttgatcaaaagaaacattcttagcacatgctatgcattttgataatttctaataacttttattcttttaaaaatgctgttttaggctagctgcagtggctcatgcctgtaatcctagaactttgggagtccaaggagggaggattgcttgagctcaggaatttgagactagcctgggcgacatagtgagacctcatctctacaaaaaatttaaaaaattagctgggtgtggtggtacatgcctgttttagctactctggtggctgaagtgcacttaagccagcaggtcaaggctgcagtgagctgtgattgtgccactgcactctagcctgggtgacagagtgagatcctgtctcaaaaaaaaagaaagctattttaatccactaaattggtttcatattctgtatttgcagcagtggtaagaagccgctctgaagccttgtaggctgaagccctaaatttatggcatagaagggtctgcattttcttttccctgtctgctttgctggtcttctgttgtgtcaaccaagtctccccttcatactcttactcttgtgtgcctctttctccttctcttctgcaagtattaagtccttaccataccccaggtgatgttatgtgctttgtgtcattgctaacattgctcctgcctggagtgccactatccatacctgctctttattttatttatttatttttgagttggagttttgctattgtcgcccaggctggagtgcagtggcataatcttggctcactgcaacctctgcctcccgggtttgggcgattctcctgcctcagcctcccgagtagctgggattacaggtgcccaccaccatgtctggctaatttgttgtatttttagtagagatggggtttcatcatgttggccaggtttttctcaaactcctgacctcaggtgatccacctgcctggggctcccaaagtacagggactacaggtgtgagccaccgcacctggccaatctccatatccttttgcttagaaactacttatttttcttttaagactctgattgaggtcaccttgtttatgaagtttttctacagatacccaatctctccctcccccccattcagtagaattgactgttgactactttttcctttgaggagtggtataaattcttagctttcctttactctttgttggagataattgtttactttgtctctccctccctactagactatgtaatcttctcaagtgcaggggctattttattctgtcattagagcttgatgctctgtatttgacttgtggtaggtgtttaatgctgagtgatcaagatatgtttttagcagaaaaaagcctccttcttctaagagaaaacaattaatgaaacattttaaggagagaggaagatggggtggtgataatttaaagaataaagaaggagggagagaaaacacctttcaggactccttactggccttttagcctgctcttaactttctcattccagcaactctttgtcattggcctcccctcatccccactcccctcatcatctaacttcttggaacctttttaatttgacatggctcctaccaggcagagctaaaccctgaagtctggggagcccgtaaccctcttgccatggctgtgaaagttgggcacatacatatatgacattagcagttatttctgaatgcattttcctatagaatcattattataaattgtggcttgttttatattaccattaatatacttaatgcacatgatgggttaattttgcttttgtggcctgtcctacaaacttctccacatttataacattaacaacatgtgtactgggttccaagtaattaacttccagagtttctatggcataacagttttctacattgggtgtgacttagaattgaggtagtcccagcagcgtggattttactcattatagttgtagctttacacacacacacacaaacacacacacacacacccctataaatattattttaaaataattgaaccatttttccctgcagttttctttgatacaattagaaacttcagccacaagagtaattgtcattgtttgagaagtactgtatcagcttataaataactgtgagaatggcatggattaaaatttaattctctttggatgtcatttgagatcatttgttctctcttatgagatgttatcttaattctgcagtgttactctagcatttaagtgataaaataaatataagtattcatggatacttgtaattttacagacgaaatattttttggtattttttatatttctgacagatttttgtacaggagtttgtgtcaaatatattttactgaaacaatagctattaatataaccctctggttatctgattgaatgttatttttttctgtcttttttttttgagatggaatttttttctgtcttttttttttgagatggaatttcactcttgtcttccagggtggagtgcaatggcatgatctcggctcactgcatcctccacctcctgggttcaagggattctcctgcctcagcctccccagtagctgggattacaggggtgctgcatcacgcctggctaatttttgtatttttagtagagacggagttctaccatgttggccaggctagtttcaaactcctgacctcggatgatccacccgcctcggcctcccaaagtgttgggattataggcatgagccactgtgcccggttactttttccttttttaaaacactgaaattgctgtatctaccacattaacattttatttaaaaaaatttgttaaatagcatatgtatgtaaatttaatattaatatacctctttttttgtccttctttaggtgttggagcctaggatacttacttactgatttttattgttgatttcatgtccacagtaatagtagataatatttttgagtaaagttattgttctgttttggggttaatgacttgttaaatagtattatctgtattatattttaataaagagcatattgttgccactattacagtgtatgcaaccaattaagcccttctattgttcttactatttaaaagccttgagtttaatgagcatttgttttgcttgttagacatttttggctctcataaaccaagtgtttcctgcagaagaggacagtaaaaaagatgtggaagataactgtaagtaccaagttaaaaattaactctccgcacagaaaaggagactgttcttttaaaaaaataaattagtggttatataactgatacactgtgcgggttcagaaacaatctagtcttttgacatgaatattcatgtgaatgaaggaactcgagtcctccatgttgtctcacatttgcattttggtgaaagagtcttgagtgttcttttggtgttatttgagttgcataaatgtggggaatggtaattactgtaaggcttgaactaaaagtctcttgttaacagttttgaaagttattgaaccttatttagagtcaggtggtttttattgtagtatatgtggttcagtaatttggaagttgagtcagtaggagtcatttaacatcaccgtttgaagcaaacatgcatttaaaaaaattctatataattactaattgaaaaattaatttcagaacaattatattaaaacacagcattaatttgacttataacatctttgcatgtttgatgaaaaaagctcttctcgatggaacaggccaatgtttattcttacatttttaagattaagcagtaatcatttcatattgggggcagcagtgttaacaattatgtacacttgtcatggatttcattaaaggtacttgacactaacaactctccatttaacaaaaaaaggtagtgttaacaattatgtacagttgtcaaggtacctaatactaaaaactctccatttgagaagaaaaggtaagagaaaggaatagatgtgttattattgattttctctggaattcacatttgagtaagactataaaacccccatatgtagaatggtggcagcatagactagtgggagtaatggggagccatggactgtaactgtagagttaggcaagcctaaattctgattctatgttgttaggaggctgtctgctcgtgggcatttcgtctctcttctgaaattctcatctgtagaatggaagtaatgtgtatgttgtatgattagagatgatataaagtgctttgcacagcatctaatgactcttaataaatggtagctgtttttattaggtgcaagagattgaggaaaaaaatgtagaattcccttcctttccaaaattgctggagagtttgtctgattaaataatacatttttgaatagcaatcagaataaaataataaggaatgagactgtaccatatctaaaatacaaatttttgtgctgttaaaacttgctagggtgtgcagaactgggaatcaatccttttcatttattaatgtgtatgtctctaaatgtgacaaatggttttgaatagtttttaatccatttcttaaattaatattttaaaacattctctctccatttgctttgtcttgctatgcttgtctaacttacaaatttttgcaacctcagtatttgctgcctctggcaggtggtttccttggtgatgccagatggcagcagtgttaatgtgtgggtgttaactattctcataagatagtagcccatccctactgaagacacttttctgaaaccacattattaacacaactttggttgttgagtttagaatgtagggtttccagctgcagtggttctgtcacttagtactttcatctgaggcatgccaccataccactgtcctctgctgaatgacacactgtaacacaaagctatagtggtagctttgtgttatacacttgcacacacacacacatgcacacacacacagggtctcacatgcatatttctaaaattcttttcttctttatattatggtaatgtgaagattaaatgattgatgcctgtagagagtgttctgaagtatgtgttgaaggttctactgaaacagaagtagtgccttaacagtgccttaacagtgtagcaacacttattacctacttttcggtctaaatttttttttttttttttgagacagtctcgctctgtcacccagactggagtgcagtggtgtgatctcagctcactgcaaccttcgcctcccgggttccagcaattcttctgcttcagccttctgagtagctgtgactacacgtgtgcaccaccatgtccagctaatttttgtatttttagtagagattgggttcactatgttggccaggttggtctcaaactcctgacctcagatgatctgcctgccttgggctcccaaagtgctgggattataggcgtaagccactgcaccgagctatagctctgagttttctatgtgaagggttttatatgtagaaattagtatgttaattttgctgtttgactgttgcttattgtcacaagaataggaaaattgggcgtgtgaagtcagtaattaaaaggaaaataatagcatttttccatgctgattttgagctaccatgactttcatggcacataatgttcttcgtgaattattgtctattagatgttgataataataaagtatagagtataaaattggaaagaaaccgggcgcagtggcccactcctgtaatcccagcactttgggaagctgagatgggtggatcacctgaggtcaggactttgagaccagcctggccaacatggtgaaaccctgtctctactaaaagtacaaaaattagttgagcatggtggtgggcgccggtaatcccaactacttgggaggccgaggcaggagactcccttgaacccaggaggcggagattgcagtgagccgagatcacgctgttgcactacagcctgggtgacaagagtgaagctctgtctctaaataataaataaataaaattggaaagaattctaaaagttgcctcagtctctttttctgtaatggaatgacttctacaacaacatatatttagaattgattgacttctgtgttgaagttgtttgtgggttctttttttcttttagtgagccagagctgtaatgattaaacaggatcttaaatgctcagataactctctagtcagatatctaaatttaataatgaagtcatacctaatcttcattagaaacttttgtatatgttatatatttatttattaaaacagtgtttataaagaaactaattgtttattcaaatattttgttatatgtcttatgttaaattgtttcaaaattttaatattcttttgggtatagttaaatctgttaataattaggcataaaaggtaaacagtttacataaagagttgcatgtaaatagccaagccaagtaatcctaggactgactactaggaaaggacaggaggaaggaattatttggtagagcaggaagttatttgtgaggcccttgtggacatacctaggtcatacctttagggagatgtaggcagttgggacttagcatttcacattctggcaagacagggttgcaaatattttcctctccctctctctttttctgtgtcttcttgaaaatggaatggcctgtgtggcatgatttcagaggaataccctcctgtccaaattcttattgtcatcagcagatacttcatcagttaggaatttatttggtttaataaacacacatccctgaaaaggtaggtggtgagtgtggaaggagtaaagataggagagcaagtagtaattcccatgtctgtgtaggcttatatgattagcgttcacaggggaagcgtactgtaggattacgagtttttacttagaggaagcagtgacaacatcatgcaaccaggtatttcagaggaaagtgagagagatggggagtggttcaacagagtgctttgggtaaagaaagaggaacgtgtagaccaggctccaggggacaaggatggaagattagggatatagaaaggtaggtgacctcatacccaaaccagatatattaatacctctgctgcctaaccctctctatatccttccttaattcaaaggaaagctgccattcagctgttaggagcctctacccacttcttactctcttttattctgccctaagtggcactagaaagcagtgaggtgactgaggcaggagaatcgcttgaacccaggaggtggaggttacagtgagctgagatcgtgccactgcactccagccttggcaacagagtgagattttgtctcaaaaaaagaaaaaaaaaagcagtgaggtgaaagtgaactggctgcattaaatgattatagatggatgggcagtctgtggaggtagttatggcaagaggctcttgtttgacaccattggttaggtgttgaatagtatgttagacatacatgcagtgtaggcacatgagcagtttcagtgagggatcaaacaaatgaatcaggcagcatcttgcccccaaggatctgatttagtagacaaaaccagatatgtaaaattatcataataacactggcagtgtgtggtaagaaccataaagaaattgcaaagatagtagttgtagtggtggtggtgagaatgggtaagtgtcatttgtagggtaacctttgtactgaccttaaagagtaggtaggtttttgacacctagaaatgtagaggatattctacatggaagccgatagatgaatgatacctgcatctaataaatagttcagtctgtctatgagttagtattaaggtgaattgtggaaaattatatgaaaaggtcatgaatgtaggtttattaagagctctgatcagacatgaatttggatgttgatagagacccagtgatgattttatggggagagagatttgatgagggctctactttagttaatgtgctgagaagtctggattagagaggagagagactgaggcaataggtaaataagaggctaccatgatcacaaaagaggtaatgagaactaaactggtattggagcagtagaaatggaaagaaaggagataggttgagagattcagattatgctttgagtacctgccatgagctggcactgtgctgtactttcttacatggcataaagatttggaaactggtttagaataaggagggagagagaagatgattttagtgttgactaaggtttacaatttcagtgacagagaaaatggtggtgctaataacagaaacaaggtggttgagaagaggagtggtttttgtctactctagcaaggcatagaaatggagctcaggagattgaaggacttggagaatagattgggagtcagttctgacacttcagtagagcagatgtcacacaaacaagatttatctgttcaaactctcccattaattagcttcatattctcagttaagacatacataatttctctaggagtcttcattatgtcagttgtgaaggactccctgaatgatttgatggtctgttcccattctaaaattttatcttttgtgttttatctgtgaaattctgagtatcagattggattggtgtcatcactttgttgtgtcagaagtatattaaaatcagagctatctattgtagtacttttttccctcttgaattgtgctttttaatcaaccttcattaatgagtactcactaggtttactcttttagttgaaaattcattacttaaaaatatcactgtaacacacatgtaaactgaatcgcttttaaatcagcttctagggtttacatcagccagggttttaaaaaagatggagttaaatgtaacctaacaattgatttttaggatgagtcaaagtgattcagattaagatagtattgctttattttatttgttttcttcaattctctaatgacatataaattttatgtcttaggttcactaatgtatttaaatgaagccacactgctccataatatcaaagttcgatatagtaaagacagaatttatgtaagtattttacctgtagtgtaagtttttgtggagataattatttcatgtggtactctttgattttgtcacgcttgaaattgtctaacagaaaatcatgcttgatctgagcctcttgaatagagtgtgaggttagtgaggacaaagatttttttctaatttacaactcgaactctaggagttaaagcatgcctggtacacagaaagcacttaatcagtatttgtgggatgaaataatgaattcagagtgtcgtttaatatcttttggacttaaaaatgtccagtttgagtatttttaaaagcactgtaatggtttttggttttgatttttgacttctggtatgtctgtagatatgtttgattcactttccacattgtttggaagacaatgtaaggcagcctataaggaatgtatattgaaattaaaaatttgaatgaggaaaaaaatgtaaatcagaataggaggtagtatctgaggaaatactaagaacacaggaatgctgaccatagagcctaaatagttgctgaatttcattagaccgtaggtactctaccttgaaagtccagaatattcaaaaatgaaagaaaatgctttcagtgtaaatagtcaaggtttacaccaaatcattcagatggatacttaacctagtatgttttaattataattattctttgggcatgcatgagactttattccagtatcacctaactgtgtagtcctttggtgactggagataaattaccccactgtagttctcctgttataaagatggggctgttcattatttttgaacgaagaaaacacatggcttctttgacacttactagatcaaatgacagtcttaatctattatatcactatcagtttgcctaattgtacttacttaattctgactaaattacatttagtctctgccatctgtccaagtagtgacagctgggagatagaacttatttattctattccaaaagagtatacttgccatcttctagttatatgtagttttaagacttttctccctgattttttcaaaatcaactaaataaagaacatatttaagtttaaatgtggctattcttgattagaaatatatttagaggcaaaatttactcaatcagctgactcatgttgagtatctaatatgtgctaaattccaaaattaaaagcaagcttaagttgctcattaaacatttaacccataaatgttctaggcaatggttaacatatattgtttggaagaaatctgggaccaaatggtcactacagagctaaatcaatccttggcattcagtgatagggatgggcccagaaggtgctacgagctgtattaaactccttagtagcagggtgaatacagtaggtaaggaatacaaatgactaaaacttagcggtaggagatttcataagtagagtcaacaggagaaggctgaatgagatagagctagagactcagatttctgtctgtggtgacttggtggtgatgccatgtccctgaggaagcacatggaaggataatattttctttgaggcagaggtaggtgggaagagataatcttgagtttggatatgccgaactaaaggtgcctatgggttggtaagatacaaatatttattaagaattggagaaatatgggtccctataaagatcagggaatactcagggaatatttaggactgatttgggagtcttagttatatagataattgaaattttttgtattttattttttctatgagctttgtttatctttaaatgaaaatagtaattggaatattttatgtttatgcttttcgtatttagacatatgtcgccaacattctgattgcagtgaatccatactttgacatacctaaaatatattcttcagaagcaataaagtcatatcaaggaaaatctcttgggacaagaccacctcatgtctttgcaattggtaagtgattttaaatgtattttaattcttgtctttctttatattgtacaaatttactcaatttttcttttggattaataaaagataccataaattgaatatatattttggagaaactgtatacctcttggatatatcaacattgttaggagcaagtattttacacagggtgaggaagaatacttttgtagtcaactaatggggcaggcttaccatacatcattatctgtgttaaatgcctgtgtcctctaagagatgtctgcccaggtgaaagcaggatataataaaagctgacctaatggtacttttagactttttaataccatcagctccatcttaaaattgtcctccttcacaattttgaggttctggccttcatctcttacccagctcatcccttatgagtgtgttacttgggctagatttcagctgtaagagcagacttctgggcatcatcttgcatcaggggtttataaaattaaaggattaaaagtagtatatgcttcataccactggagaatctatgtgggaagacagtagtgtctctttgcctttctcagcctcttttattttgaagtcctccagctctgagtcatagaggttggaggttttagatcagaatgagcaattacccctcttcccaccaaatgcggaggtgttagctaaccctttgcattcagacataaagcagctaaatgacatgtattggaactagttcgtagtgcatcctgtttctctttgggctttcccttcatgcttgtgttttggcctaaccagagttcacttccagatttggttgacctgtatgttgtctgctactaggtagagtgaatatggctgacataattactctaccagggcagcagcagatttacttttggcttgaagaagctatgacaggcatcgttgtgttgcagcctgcaaaacggtgccccatcccttagaacctgaatacgagcaaacatcactggagaaaagttacatgtttaaaatgtaaataaactagcttttatttttagctttttactgcgaaaaaacaagtgtttggaatgattctttaaaaatgtgtggaggatgggtgtggtggcttatgcctgtaatccaagcacttcggggagggcggatcgcttgagcctgggaagtcaagaccagcctgggcaaacatgcaaaatcttgtctctataaaaaaaatgaaaaaattagccgggcatgtgcttgcctatagtcccagctactctggaggcagtggtgggaagatcgcttgagctcaggagatcgaggctgcagtgaggtgaagtcatgccactatacttcaacctgggtgacagagagataccctgtctcaaaaaaaaaaaaaaagaaaaaagcgctgctgataaattggacaaagggatgtgtgcgctcttgtatatggtttgcattctccccttagagtaaaagccgtttctgaagtcttcttggcacatgtctgaggtgagaaatagttgtcttatagagccaaattgtgatgacctagttttgaattaaagttgtcttaatttgagactgctttaacagcattaaattgctttcaacttgtctgtgtagtcttaacatttaatacagtttatagcctaaattgttggagtctaatgaagatagttaaaaaatatatatgtaaacagaggcaaatctaggaaatttaaagctgttaattttgcctagttgtaaaatgttgacaaattgtaaatttaatagttgtattagaggaaaaaaccccacagatataatctaggaaatttaaagctgttaattttgcctaattgtaaaatgttgacaaattctaaatttaatagttgtattagagaaaaaaacccaagttgccattatgtatttttttttccagctgaatttttggttgctagatttcttaattggaagctcattaattcttgcttttcactggggacttcattagttatgcatagtgaccatttttttaatccctctgcagatcagctctggaattaggaagagatgagccacagcccataatatcaagacattctgtcagaaacttaagagttgtttatttggatttcatattacttaacttttaggataataagatagaacatttaaagtaaatacttttaaaatgatttgaacacttttgaatgactttattttaaaatttcattaacattgaatagacatttatgatttctttaagagtaagtggtcctaaagtgaactttctattattaactttatatttaatatattgctcatcattaatgtcttattttgaccctagctgataaagcttttcgagacatgaaggtgctcaagatgagtcagtctatcattgtatctggagaatcaggagccggcaaaacagaaaatacaaaatttgttctaaggtgagtattcagctaacttgaagtatttgagtaggttgatcttttttttccccccttgagatagggtcttactgtgtcacccagggtggaatgcagtgtcaccaccacagctcactgtagccttgacctcctgggctcaagccactgttccacctcattctcccgaatggctgggactataggcacatgccaccatgccctgctaatcttttactttttttgtagagatgaagtcttactgtgttgcctaggctggtttcgaatttctgggctgggcttgagcaaccctcctgccttggcctcccaaaatgctgggattataggcatgaaccaccatgcttggcaaccaggttgacttttttctggtaaaaaaatacttaagtaaaagttgtcaaccatttctaagtgtatagcatagtagcattaagtatattcacgttgttgtgcagccaatctgtaccatctccagaactttcatcttggaaaactaaaacttgacccatgcaacaacaactccatttatccactcacctagcaaccaccattctactttccagtttttctgtgaatttaactactttagctatttctcatgtaagtgaaattacacagtatttgtctttctgtgactggcctattttatttaactcaacttaagattcatccatgttgtagtatgtgtcagaatttccttccttttatttttattttttagtattttggatcccatccttcctttttaaggctgaatactattttattgtagatctgtggtacattttgtttatccatgcatttgtcaatggacatttaggttacttccacctcttggctattgtcaatagtgctgttatgaacatgggtgtgcaaatatttctttgagaatttgaaaaggttgacttttaatacctttgcatacttcatgacatagtttggaatggtgggctctatcctttttaagatacagacatcttatatggaagctagtctatagattactgaaagccagctctgacatgttattcacacgaggatcttggaggatactggtactggttagacaaagggtgatctagaaatattccttaagaatctcacatttacgttctgtctatatttctgttgttagcatggttaaaaccattttttaccttaagcttacgataatttgcctccttatttctatttccctatagtctgcctcctaatgtgttctctttgctgccattaaattaaactctctgcattgtgtttttttgtttgtttgtttgtttggtttggtttgtttttttttgaaaacagggtcttgctctgttgcccagtcacccaggctgtagggcagtggtgcaatcatagctcactgcatcctcgacctcctggggccaagtgatcctcctacctcagcctcccaagtaactgggacccacaggcatgtgccaccatcctggctaattttttatttttttgtagagacagggttatgctatgttgtccaggctggtgtccagctcctggactcaagtgatgctcccactttgacctcctaaagtgctgggattacaggcatgagccaccatgcctggccttacactttgtttagaattatagcattttaaaaatggaaggaatcataacactcattgtagtatagttcttttaatttacatacccatgaggttagatctagtggttgaactactgctaggagcagcatactcaccagtgttactcccacagaattatagttcttagttgattgctgcatagtggtactatgaaagtttgctattcattatgtaaatatgtatgctgttcagagttatttatgtaaaatcaattgaagagtttgttaacagctgttatatatatgtgtatatatacatacacacaattctggttaagtgaatgcttcccagtattcttggattctaagtgtttcaatttctttttctttctttcctgtatgtaatagtctatatgagtctatggttaatgtatgaaaatgaacaaaaagttaaggagttataaacttataatatgaacttacattttaaattaaggattgctctttattttgaaatgtgccaggcaaatagttatttctctgtgtttcatatttcagtgaaacaacatgaatagtgataacttcccagttgttcggaggcagattgcctcattttctgtagccaaagattgaattaataggctctcacaaaaggctttgacatctcctatagtttatgaatatgatatatttaaaatcaaatagttggataaaatcagaacattcccaaaacaatttaaaaaacaatgtcaattagatgttaaatgcaatacaaatagaatttatttttcatttttataatttcaacatttagattcaggccacacatgtgcaggtttgttatgagtatattttgtgacacagaggtttggggtgtgaatgatctcatcattgaggtaatgagcatagtaccaccaaatatatatatatatttttttgaaacggagtctcactctgtcgcccaggctggagtgcagtggtgcagttttggttcactgcaaccttggcctcccaggttcaagcgattctcctgccccagcctcctgagtagctgggatgacaggcgcatgccagcatgcctggctaattttttgtattttagtagagaaggggtttcaccatgttggccaggctggtctcgaactcctgacctcaggtaatccaccctccttggcctcccaaaatgctgggattacaggcatgagccaccacacctgaccccaaatagaattttaaataaatttaaaaagctatgacagaatagttgcatttaattacacatttgttataatgatgatctaggtttcagttttatatgtactagataattataaattattgtacaccatattattgtcatcaacattttttatcctatattttaaacagatacctgactgaatcctatggaacaggtcaagatattgatgacagaattgttgaaggtattgctaatttttcagttgttacgcgtgtactgaaattaatttacaagacttcttttagtggtctggaatgttcttctctcagagatgcaaaagactctcttatctcctactaatcattgctcatatatcatcttgttatttacctaatatcaattgtttctgcccccacccgcacctcatgaaaacactaagaaggcagggatttttgtttcatattccaaacccttagaatggtaactgatacagagcataaatatctgttgaatgaatgaaagaatacaggaatgtctttagcttccagtttgttttatggagcttgttttgtgtaaaggaaagaggaagaagggttatttggcattaggtgcttttttagagaagtcattttttaacgaaggccgtagtgtgtaaattgatttccttaagctatccatgcttgtataccttcttagaaagtcttcttgtacctcagtttggagactgctggcctagactaccattatgttgaatctcctgcatgatgccctcctgcatcatagactcctgttttgtctcttcacttagattcttacttctccttaatccagtctctgtatagaatttggaataatttctttttctttttcttttctttttttttttttgaggtggaatctcactctgtcacccaggctggagtgcagtggcttgatcttggctcactacaacctctgcctcctgggttcaggtgattctcctgcctcagcctcccgagtagctgggattacaggcgcccaccaccacatctggctaatttttgtatttttagtagagatggggtttcaccatgttggccaggctggtcttgaactcttgacctcaagtgatccacccgccttggcctcccagaatgttgggattataggggtgagccaccgcgcccagctggaataatttcttttgctttaaataatctgatggcttcatattgctctcaacatcatgccctagattcataacatcacccacagtgctctgtgtggtctggctcctgcctcttctgagctcacctggagtcatgtttcttctgactccttatgctttaatcacattgggctccttgtagttctttgagctgtcttaaacaggcttctctgaacactttttctccttctccctgtcttactttcccccactatgtactcagtaagcattttttaataataatggtggtaataacatatatgggatgtattaggcattatctcatttgtttaaaaatctgttatgtaatttaaatcttcacagaatgaattagaaactattttatccctactttaaagatgataatatttaaatatgctgaagctcatatagttcatcagttgtgaaattcggatataaagctaagcattttaactacatgccgtagtaaatgcatattttaacactctcttggcattttttgtttttaaattagagacagcatctcactatgttgcccaggctggtctcaacctcctgggctcaagcaatcctcctgcctcagccttgtaagtagctgggactctaggagtgcaatacacatgctcttgacatcttaaagaaaaatgttggttgaacaaaaacttattaggggccttgtatgttcatgcattttgctagatcatagcaaatgatatgtgcatttttcacaatgatgtaaaatctgcatgtagatcaatctaaatacaactctaataaacatttttaaagttgagcaccagtaaagtttttttttaatataaagaatttcctagtttcatttacagtttttatgtggtgttgtaacatacccagatatgtacttatcttgtaagtaatgctttattcacagtaaagtgccttactttagcgagggagtcgttcttaaaaactgaataaattaataaaaaagaacaaattatgggctacctcagtaaaagactaattagtattctgatttgctcacttgaggtgcacactcacttaataattggatatacacccagtttcttccccagtaatgtgctgtacagtatgtagtgtgttatagtggagacaagttggaaagtgttattccaagtgcttctatagcttcttttttttttttttttgagactgagtctcactctgtcgccgagtctggagtgcagtggtgtgatcttggctcactgtaacctctgtctcccgagttcaagtgatagcgctgcttcatcctaccgagtagctgggattataggggtgtgtgccaccacgcctggctgatttttgtatttttttagtagagtcggggtttcaccatgttgggcaggctggtcttgaactcctgacctcaggtgatctgcctgcctcagcctcccaaagtgttggtattacaggtgtgaaccactgcacccagctcaatagcctcttaatggagaatagtaaatgtaactagaagggtatagcgtcttttgatcccatccttaatagaagtttagttgctggttttggaatgagtatattattagtagcattaatatgattttctgttggagaggttcttatcctattttgggatattttacttgtattaaattcttcagcaaaaactagtagattatcagtaagggagttggggagacctgtaattgagtcctctttttgttaacacagccagttatgtggactttgaagagtgagttgaccatggtttttttttttttttcttcttgtttttttttgagttggagtctcactctttcacccatgctggcgtgcagtggcaagatctcggctcacctcaacctccatctcccgggttcaagtgattctcctgcctcaggctcctgagtagctgggattacaggtgcccaccaccatgcctggctaatttttgtatttttagtagagacggggtttcaccatgttggtcaggctgatctcaaactcctgaccccatgatccgcccacctcggcctcccaaagtgctgggattacaggtgtgagccaccgcgcctggctgaccatgttggcttcagtttttttatcccatctgaaacatgagggatatatgttaatatttcttttagttttaatgttttcttattttggcatgtgaaatggctggggaatgatctttaaaagagtttagagactagttaagcattctactctagatagaataggagaaatctgcttgaaaaggcttcataagaaatatgacttcatgtttatttttttatttattttattttatttatttatttttttgagatggagtatcgctgtctcccaggctggagtgcagtggcgcgatctcggctcgctgcaagctctgcctccggggttcacgccattctcctgcctcagcctcccatgtagctgggactacaggcgcctgccaccacgcctggctaattttttatatttttagtagagacggggtttcaacgtgttagccagaatggtctcgatcttcagccctcgagatccgcctgcctcggcctcccagagtgctgggattacaggcatgagccaccaagcctggccagcttcatgtttattataggaagaacatgcttcataaaaaaaattttaacactgaacatcatgaagcactttaagtttgttgatggagaatatgtgtgtaagattaacactaatttggtatgtttgtaattgagatttagatgagtataagagtagaatctagtaactcttatccagtcatgatatgtgtataggtgattataaaataacagtgaaaatattatatttgttcactaggattttaaaacccattattctgagagccttaggtaattctgtaaactcttaatttgttaaatttcactggatatacatgtaaaaatgttaaatatggagactattaatatgtgaaatgttttagaaaagtaagtcaaataatacatctcttgcctatattttctcacaagaggtttgctgttttatctaagtactgttgtgggcctgatatactagataaaacagtaaaatttttagggaaaaaattttaaagtctagttataaattttgtaacatagtggcttaaaaatttagtctttcctataacatttatattttcttgttatatatttgagaaattttcctatctcatggacttgaatagtgcctgagcatagtgggtagtcaataaatatttgtggaatttggcattacatgtgaattccttcatgttaattttttttttttttttttttgagacagagccttgttcttgtcgcccaggctggagtgtaatggtgcgacctcggctcatcgcaacctccgcctcccgggttcaagtaattctcctgcctcagtctcccaaataactgggattacaggcatgcacctccacgcctggctaatttttgtattttttagtagagacggggtttcatcatcttggccaggttggtctcgaactcctgacctcgtgatccacctgcctcggcctcccaaagtgctgggattacaggcatgagccactgtgtcccgcccatgttaatattttttagaacatttttttctagacatatatattaacaaatggagatatgccatgcatattttgtaatgttccgtcatgctaattttttgatggatttttttgtttctcaatagctaacccactcctagaagcctttggaaatgcgaagactgttcgcaacaataatagcagtcgatttgggaaatttgtagaaatacattttaatgaaaaggtaagtgagagtaagctttggaatgatatttttggggagtgtttgtgaaaatgcaagggtcagttggtgctgtatttgcacttaatggtaaatacctttaagtttcattgttactttagatggttgcaggaatatatgtgtccactatgaccatctaaaagctcctttcacaatctaaaacccagatgctgaatttgacttcagcattgagtattactgtatagctagtcatgtaagatattctagcacctgtgttgaggtacggtgcaaggtcaattgtgattcttaggaggctcaaaacttaacaggatttgggtagagacttaaatggggatgtttaaaatgaaggatgaccattataaatactctgtgcttacgtttagttatttgttttttcccctttatttggtgaatattataacctctttgatagacaaatgtgtattagaaaaggtaaataatttaacattggttaattatattttaagactttaaatgcaaaaatatattttctctgtgttttgttttttagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcgggtaggtcagaagaaaagaaatttcatatagccaggtgcagtggctcatgcctgtaatcccaacactttgggaggctgaggcggatggattgcttgagcctgggagttcgagagcagcctgggcaatgtagcgagaccctgtctctaaaaaaaaaaaatacaaaaaattagctgagcatggtggcactcacctgtagttccagctactcgggaggctgaggtgggaggatcacctgagcccaggaggttgaggctgcagtgagccatgattgtgccactgcactccagcctgggtaacagagcgagaccctatctcaaagaaaaaaaaattttgtataatttttgaaaatataattgccatcaagcctaatacttattttagtgaattttgaaatctacttgttgtgtgtatgtaacttacattggatcaagtataacatgttagaatgaccactgtactgagaagatctctattaaggtgtactgctgagtttatagtataacactgtatgaggaggcacataatggaatagataaaaggatagatgttaaaccctacgtcaatttaaactcaattagaaattgataatagctctgtaatactagctttaaagttacctttgacttatctgtaaaaatgtttgaacactaaattaatattaataaaggacacatgattgaatttcttaatttacttcaacaacaaatatttattgcttgcccattgggtgccaggcattgggccaggattaaaaagataaataatacacagtccctgctcttgatcaacttagatgtggtgggaaacgcacacacacacacatgcacacacacacacacacacacctgagcattacaagcgagtagagtttctaggagcggtgactggggatggtttggttaacacaattttcagattctcaggttagaaaacagtgtacttgtatggagtatgggaatgtagtttatacaaaggaatgcaatgtgagtaaggaatgtcgtctgtatagagttccccagctgattctgatagtcttttttggtcagaaagcctccatttgagaatcataacacacataattactgctctgtggttgtgtgtgtgcgtgtgtgtttgcagacagcttttcttttacttcaatttcttttaatgtgtgtttgcaaattttaaaagtctgttgtcttaaaacactttataaatgtatctctttatatacttctaaaatgtccagtcttttctagagctctccaaattaattggaatttgaagctagttgcccacatttccatgaaagtaaaggaagcatttcttttttactatggtttttaaaaaaggaataaattactaggaattacatgaaatataataatgatgatacggttttgtcaatacttagctgacaataaagtgatgtgactgttctggccttaatctagcatttcttcctgcttggaggcttgggagtatagtatttttgggtttcagaatgtacagcctttcctggtacaatggcaggcatcctgaaagggcagctattgaaatatatctggtcagaggatttcctgtttctgcagtgtgaaccaggaggcctgatttcctttcttacaggagagtccttgtgatggtaagaggaagagtaggggaacagcgttgcatacatctgccatcttgaatattcctctcatatgcaggcacaacacacccactactatatccacttcccccaaataattctgccttaaagtcacttgaaagtgtgttagtgatttcatcaggtttttctgtagtttagccctctggttataattgagagatcaggttttaaaaacaaaggggaaacctgcagtaggttgaacacttgtaaaattgttgaatttttttggtcactactctatcaaaattagtatgtaaagaattgtggatgtatacctgtctgtaaacatttttattaaccacacatatactttaaaaagtaaaaggtttaaaaatgtttgcatttagacatttcaaatatttctgcacatgtttctggagccaattgctgtaatcatggatagatccttgaatgtaaagaaggcttggatagaaaaagaatagatggccgggatagtgttctagttacagaaaaactaaaaggacacgtttctatccaaggttgtaatattaggccccactgtccagaagcaaagtatttgacaaaacaattggagtgaggagacaaagtgcttggtagcaaagaacatatttattttggctctacatgtttaaactattattctgctaagtaaaagagctcttatttgaaacagtccattgaaaatgcttaccaacattgtccctgctcccttctcttttatttttttcccaaagattctagggtggaagaaaaaaaaaaaccatgtatatagttgtcttgtttttactgtattttagcatttaattataatggagaaggaaagatagaggcattgattgtctaaaatattaatttatccccaaatcattcaaatttttataaaattttttttggtatgtgtatgatgaggtgtatttaatttgggaattcatgccatggtacaataaaatcatagcaacctgatttaagagaagctgagatgtttaaaaaaacttgtccatcctgttctctgtgtacatcctttctgatcagatttgcccaattccatctaaatgtctttaggctgtgtgtaattttcagaaaaatgcagtacttttagtctactgtatagcaaatatgttcattcactttttattagaaacagtttttaaatgaagcaagccttcaattgtgagactaataaatgggagcagtagattcttgttgataccagtagattttctttttttgaactactcctcttgttctatattttggaagcatttagcttttgaaagcctttggtaagtgaagtaaatcactgaaataagaaaactttaaattatttgatccataaagcataaagcaagtagtgtaatttatgtacagtcattgttagctttcaataaatgtgaaaagcatgttttaaaaaactgactctaaaaatcaaaaattaagaaaatcaaggatagaatttcttaacttctcagaatttaaaatattacttgaaaaattaaaccatactatcggttcttacttgagattctacatatttagtaggaaggtgattttcatgattttatacactatgtttagatttttgatactgaaaagatataaaattgttgccctttaaaagtagaaaacttttatgtcattgatttttaatcattttatttaatctatgctcagagattaggatttttaatattcctggttttattagtaggaagaaaatgcttataaaatatagaagtattgatttgaatggtgagattatacagtactcaagttgtgtttagaaattcttcatggttggcactatttggtaagttgtgttttctcctgtattatttccctgtggatcatatatgttaattatatttaatttgttttgtcatagtatttaaaccgaggctgcactagatactttgctaacaaagaaactgacaaacagattttacagaaccgcaaaagtcctgaggtatagtagaccattgttcataaaatctttaacttaaaaaaaaactcatgctgaaagatgtgttataatttttattttagagcccaagtaagagttctaacttttaggcttatactttaaaaaattaaatattcatctaagtctctgtcacagtgtaatactttatacctcttgttgttatctagtgaagtgacaggttctggttcttctggttgggcatcactgcattgctctcctctcattctgttttcaagcatgaaggtattaaattgcctaagaatcattctcttctagcatttttgaaacttgctcttatattacccacttgagcttaagtatatgtcttttacaatttattgtctatttcaaggctgacgtgaggtttgatgtagacagtaaatagattaagcgttcttgggaagaaatgcttataggctaggcgtggtggctcacacctgtaatcccagcactttgggaggccaaggcgggaggatcgtttgaagccaggagtttgagaccagcctgggcaacatagtgaaaccccatctttacaaaaaataaaaaaaattcactgggtgaggtcgtgtatgcctatagttctagctacttgggaggctaaagtgggaggattgcttgaaccctggaggtggaggctgcagtgagccacgatcatgccattgtactccagcttgggcaacagaattaaaaacaaacaaaaaaaagctggtcaggtggagtgggtcacgcttgtaatcccagcactttgggaggctgaggcaggtggatcatttgagttcaggagtttgagaccagctcggccaacatgatgagaccctgtctctaccaaaaaattacaaaaattagccaggtgtcgtggtgtgtgcctgtaatcccagctacttgggaggctgaggcaggagaatcgcttgaacccaggagatagaggctgttgtaagtggagatcgcaccactgtactccagcctgggcgacagaacgagactctgtctcaaaaaaaaaaaaagcttatatattattgtagttctgtttaaaacatcatatttatgtaatatattatgaaaaatttatatattggtttcagtaaattatatttctaagaataattagatataattataccattaagtattatttttaacacattaagttcttaatgtaaaaatttacaacccttataaattttaatatgcagtgtttaataagtgatattaagttacacgtactcaaggggcttaagttatgaaatactaaagtaaggattaatgatagatactggttaatgttacttttattaattttattaaatatttaaattgagtaatcgaacaagtttttataatagtcagtttttaatgcttctacatttgtaagcccgatattttttactcttcttaaaatgaatgagatgatttatatttttagcatatttatataaaaggatagaaagcaaataaaatattccattatttaaaattctaagcagacaaccctacagttaatttttgtttaatttggcattttatatatcattatagatacagaatctgaattacaaactataaactttgctatagccatggttggtacttttaagaagcaacattaatatttattattgtatctttctttgtcttgataagactatgtttttctgagatatcaaaatatagtagctatattcctttcactaagataatggagacctttcctagtgggacatttcagcagttctgaaggggggaaaaagatataaatttgatcatttgccatggaaaaaaatggagtagagaggaaagaaaacgagtttactctccaaagagtagcatgtactctccaaagaagaaaattgccctcttattctagagtcagtatactctttcagaaatcttattcacattgagtgtgcgtttatatgtacagttaaataatggattaatatgtttaaattactttttatgtcttctttatcaggaggatgaggtgatcattttgactaattaaaccctttgcccaattccatctgaatgtctttaggttgtgtgtaatttttagaaaaatgcagtatttttagtctgccatacagcaaatatgttcattaacttttgattagaaacagtttttaaatgaagcaattctttgactgcaagactaaaaattctgcatgatgtgtgttttctgctgaacagttttggctgcatgtgattgtttcctttgcttcttttaagaataaaattgaattttattgtcttagatattttccagaaatgttacacattcataattgaacattttaaataattttgtggaaagacaattatagcttgagctgggaatcatttgtttactgggaggaaaaaatatccatctccaggaggcatctttaatgatcagttaatcatgatcctgttatttaatgtttaacttgtatattctcaagttctggaaaatttctagtacaatcttttcgtgtccagtaacttttatgtttctccttctagtttctgcagtcctgactttcttctttttttcttctgagttggtatagagtctaacaaatgagcacattagatgcaagttcttttaggagagaaaacaaattttcttctcattttttctgaaatgttttaagtcattgtgtaaattattagagtaagtataatgcttactaatatactttaccatatatatatatgcatataaaaaggtttaaaaaagaattctaaggcatgaaaattgtatcagcctgacccctatttactacaacttaatattggtgcagttggtggcagttaacctaaaggagtcatactgattgtcacatttaaattttttattgcaccttttaacttactttttctttttttaattaacaagaataatgtatatttatacagtacattggaatacaatgtaatgtttgatacatgtatacattgtggaataattcaatgaatatatttatcattacctcatttaaaaaaactgtaatgttgattcaagtattgatattccctcctttttcactcaatttttgtctttttctaatatgctaggattataagactttagagcgaaaattgtaatttaattgaaaaacatctaatttcattattttaattgaaatttttacggataagtgtagattcacatgtagtaaatagtgaaatagaacagagagatcctgtgtatacttttcatggtcatttagtttttgaatgttagaatagtaaagattttcccattgacagattttatttttgcatgttatatagtgcattaattgacctggtgtagtagttttagtgtacttaaataatgtaacgatcagttaattggtgtcttcttgttttgtagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtttgctttttatttttttaagaggaaaaaaattaaatagaatttctgttatttatttgtcatatgaaaattgtctctttatatgcagtttgcttaaaaactttaagaagtatctaaaatatactgagttacatgttgaatctcccaaatgaagaatgtttcattatcagtcattctgagctctgttttgaacaaatcagtgatattgcttaggaataaacctctcatttttgaaggataaataactgactattttatcctgataaatttagggtaatttttagttaaattttccagttatattacacttttccaataggtgagaagattaattctctatcatctattaaggcatttttgaaaattttcaggatcattgggtgaattaattagggcaatttaatatataaaagcccatgtactttattaatgagaaatgaaaataaatgaaaattttaatcttatgcagattgaaaagagtatttaaatacatggcaaaagcaacttttcaactccagtgtttcagtctgtacatgaacagtaggactttgcataattctaaatttgatctacgaatacagggaatggcaaactatgaaccacagcccaaatttgacccactgcctgtttttgtaagtaaaattttattggaacaatgccacacccactcatttatgtgtggtctataccagcttttgtgctagtgtcagagttgagtagttgcaacagaggctatatgtcctgcaaagcctaaaatatttactatctggccctttagagaaaaagattgtcaacccctatattaagacattattgtacgatcttataccaaggatgagttaaggaaaacctacagcaccatttaatgtagtagtcaataatgggctttggtgttagatcccagaggctctctgagctttggtttcctcacttgcaagattaaataaaccatgagaaggacttttaaagtacagccagtacctagtgtaatgctaaaggttcttgccttagccatgccaaagaattggtgtggtggctgcctgcagtgagtgatggagacagggaccaagagaaaaaaaagccatagactttattgagcagagtgacagtacaaagctttcacagtgtggaaggggtcccgagtgggtagccagagttagattatgcagtttccttttaaactcttcaaggcgggaaatacgtgcagggggaagatgttaccagagcgagaaacaaaggcagtaaattattttgtgatgtgttttagattttgaggaaaaccggaattgcaacttaggttttatttactttatgaccttgcagcggcttggcaaaggagacgggaatttacgggactttacaaagtatgtttacaaggagttggaattaggagcatagataaggcccactggtcacagaaaaatgggcatttaacatttcttttagtttcaggggagggggaagggagagagggagagaggacatagggaagcttatggcaaaatttttgctgttatagctttcttggggaagaaaacacatgcacaaatcctggtgttaggaatattttaagcacatatctttaatattattcatccaggaccaaagtaagtcctgatacaggaaatgagtgagtttcacagcttcctgagcccctactcgacccaggaaggccagcgggcacctcctctcactagcaatagtgtgcatatagggaaagagcacaagaagacaggaaaaaaaagaagattaaaaaaagtgttatatgcaagactcttcttattctgcatttcatcataaacatcgtaattgtaatctgtatatcataaatataatgaggtaggggatattatctccattttacagaagtggaacctgtgttgaaatgatgcatgtggttattgatgaagttgtagatgtgagagctggttctgctcatgtctgactaacacagaggcttgtgataattgtcccttctttctcccaggccactgaaatttgtcatctatgaatgaacagactaaaacagatgtcttaatgattttcagatctaatgttctgtaatgctgtgaaatcaataatgtgagatgcaacataacatagtggatgggagcacgtgctcctgatccagatgctttaccacatactgtctgtatgaccttaggcagggaacttagccttttcgtgtcttagtttcctcactgtaaactgaagataatagtacctacctcatgttgtaaagaggaatacgcgagttaaatatttgtaaatgatttgagtacttgtgtctggcacatagtaatcattataagtgctttaaatgagtaagtacaattaaaatacagattgctcccaatttaaaatgaaaaaaaaaaattcaagcaaaattagatatgttcttaatgtgcattaaaattttttgtttttttttgaaggattggaaaatttgttttgaaaacgtaatgaatgttagcatacatttcatttgctctctagcattgttataccaaaggagcatatgtgggagattctaacacaaaaaaaagtctttacaataattaatacacactttagaaatgttgttagaagtgataaatggcatcttcacacctcttattattaccctgtggtagaagatgcagttgtatagagtattataagtgttgcatgatcaagttatttgaagagtatgaaatgcccaaaaggtaatgctatttgcattatctcttatttttcttctctaacttccttctattgagggtaaagtgaacagaaatcagggaagattggaaagagacagggaatcaataagattaatatgtgattcaattaattattttaaaagctaagattttattatatttgtcttcatccttcctatgactcttcctatagatccaaatggtttctttctaattagaagtgatttcttttttccctagggagcttaatttggcatgtcttagcaatttgaaaaaatgttggttttggcaggatatggtggttcttgcgtgttatcccagcattttgggaggctgaggcgggagggttacttgagctcaggaattcaagaccagcctgggcgacatagtgagaccccataaaaaaaaaacaaaaaaacccccaaaacacacacacaaacgcacacacacacacaaaataaattagctgggcatggtggtgcatgcctgtagtcccagctacttggaaggctgaggtggaatgattgagccctggcggtcgaggctgcagtgagccatgatcgcaccactgcactccagcttgggagagtgagaccctgtctccaaaaaaatttggtatttttataattattctactggaaagattattctccaataagcacttataggactcttaactgtcataaagaagtttttgcatgatgaaaatgcagaaaactgcattgggactgcctatgtttttaaaattccacataacagataaaatgttattataagaaactttaaaaatgtttgaagaagttcttttttggaaagaagtgatatgaaaactttacatgatagtattttgccttttaagacttattaaaaatcctgttttttttttttatcttagccttacataatttttggaggtgtgtaagaaactttgcgatatagtaaaaaagaagaaatatttaaatgaattatttgatggtcaattttttgagagctatataattttaggcaatatgtatatgtatagaacctacacgagtaataagcacattttcatagaatgaaacattcaaaatattctcaaagtatctctcttttttctttttttttggtaggagctttattgagatctagttaatataccatacagttcactcaattgaagtgtatatttcagtggttttcagtattttcagagttgtgcaaccatcaccatagatttagaacattttcatcaccccacaaagaaaccctgtacccattagcagtcactcctcattgcccacttctctcaaccctaggtgaccactaatctacttcctgtctataaatttattctggacatttcatataaatggaatcatacaatatgtggtcttttgtgattggcttctttcacttagcataatgttttcaaggttaatccatgttatagcatttagcagtacttcattttatttttattgccgaataatatttcattgtatggatatactacattgtttatccatttgtcagtttctagacatttgggttgtttccatttttggctattatgaataatgctgctgagaacgtttgtgtacaaatttgtgtttggatgtgttttcatttcccttgagtaaataccttggagtggaactgctgaatcacatcatggtaaactctgaccttttgaggaactgtcagactttttcaaagcagcttttccactttacaaagctattcccatcagaagcgtatgagggtttcagtttctccatatcctcaccagtactatgtgtatgcttatagcaatcgtacagggtgtgacgtgttatctttttgtggtttttatttgcattttcctgatggctcaagatgctgagcatctttctgtgtgcttactgaccatttgtatatcttttttggagaagtgcctgttgagattctttgcccatttattaattgggttgtctttttattaccaagttgtaagagttttgaaaatatattctaagtacaagtcctttatcagatatataatttgcaaatcttttctcccattctgtatgttatctttttactcatttgatagtgttctttgaaactcaaatttttatttcagtgaagcctaatttatctgttttttcttttattgcttgtgattttggtattatatcaaagacatgaagatttactttgtgatcatgaaggtttatacctagtttttttctaacagtttaatagctttagctcttacatttaagtctttgattccattttgagttaatttttgtttatggttgaggaaggggtccagcttcattcttttgcatgtggacatccagttgttccagtacctttattgaagaagctgttctttcctcagtgaattgtcccaacatcttattattgtaaggtctcatttttcacatttttttctcatatatattctaagattggtatgttaagtagtttatgaatttgtcataaaattgtcatgattttcacacattctttgtagtttttaattaggtagtcttagaatatatcgtttattaatattaatctgaaaatatttgtaaaatgctattttttattataatgcaaataaatataaagaatagttaatcgttagtactttctctgtaccagacactattccaagcatttcacatacataacctcattaatctaaatagcaaccatgtaaggtaggtaaagtaattatcccagttttatggacgaagaaactgtgcacaaagagaataagtaacttattcaaggtcacatagctagtagttgtagagcctgatcagccctgagactaaagcactttctttctttatagtactttttaaagcagcccttataaatagaaatctgtagatatgatgtactaaggcaaaaatgacctgcctggccaccttctgctgcaatatatcttttcctcacatacccctgtgcaagcacacaaaaaataaaatggcacacgtgcaggctggatgtgccaatggcagatttctcaaaatgcccacatgggtcaagacctaactgcattgcttttttttttttttttttttttttttttgctattctctgctctgcagtgtaaagatattgaaaatgtcaaaaaggcttgcagatacccctaagggtaacagtaaataaggaaaagaggaagcatttgtactgatctctagcacagaaagtcaagctgttggaggaactggacaggggtatacatgtatattagtgtgtatatgaaacataaatgaattttgtgtttcgaattcagctcatcatgtatatgcagttattccaaaactggaaaaaatctaaaatctgaaacacttttggtcccaagcatttcagttaagggatactcagcctgtacaggtaatagtaaatgtctcttcactcccttcgaccccaagcaatatgagtacatgcttattacgtatatgcataaacacatccatagacagatatgtacatccaaattgatctatttaggtgccttacagcgtttgcactaaaattactccttgaaatttcttgaagtcatatgaattttaatgatgagatactctatttctctaaagagttaatatattgaaaaggattataatctatcagtgtagtttgcttatagggtcaaaaaaaatgaaacagtgacagtttaatattgatgtgcttaaaggattataccatggacttccccaagggaggatcttctgttgatcttagcagtacgggtgtttgacaaggatagtgaaaaagtgaggtagatttaaaagttacaaataagccttgcctattatatggttttttgtaagtgaagtataattctaagaaatgggtcttgaaaatctggtttatataatacttattaatttcaatgaaaatatatttctattaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaagtaagttccttaagtaattgcactgcaaaaattttgccttgcagtttgtcaaggaaaaacataagttacattctgtttaaaacctgagcttggtagatcaaaattctctacatctcagtgtagtaatccaccatataaataaatggagtttaacatagctcttaaagttgttccttgctgatatttggaattcataaggtaagagagaggtttacttttctacaactatgaaaatatgagctgatggtataaatcaatatatgacagttttaggcaacagatcattttactttaaaagtaatttttttatgccaataatgtgtactaaaacacatctattaagcagatctcacttcagcaaaatacttagcaaatgacactttccttatgtttaggattctttatttgggagaaattacaaatgacgagaaataagggcttaaccaagattttaaaaatcagtaaccaagaacttctagattgtacctggatgtttttatacttttgtctccatgtcctatattttatatatttttggttttggtactgtagaataaaattgacattcagccttgtcattctgaggcactgcaggatcttcatttgtggagggaagaagaccctttatctcttactaataagataggcagtgagctctagtgacatatttccgaaaaagttgcaacaaatttaaacaaagaattttttgaaaaagcttttagcctctcagaaaattggctatctcttattcttttgaaaattttagcaaggtatgcttagcctgattctttgctaagcaaattcaaaattgttcttgttataaagaaaaactctggaagaagtttgtagagtaccaccctacagtctacagttacttggttccttagagatatctctgcggcccaagggaaagcccataaatgtgcaggtgggtggttctcaggcattgcttcctccattttcccattttctccttgttccaaagcagttttttgttgttgtttccttttttcaatcaatgccattccagaatccaaagcagctcttttatgtactctatatatagcgtgtccacatgaaacttcaagaaagggttccattgcagaaaatataagtgagaaatcactgtttagagaggcttaagtatcaaatgtcaggctgatctgaatgacttataattctacttccaaatttgactttcttttttttttttttgtgctctcttggtaccccatgcttatctttatgatagtatttagcatggtgtttggaaattctcttctgtgccagtctctcttcatcagactatcattttcttgaggacaatggctctgtgtctgtacctgcaacatttaatactattataccatatagtcagttatattaaatagtagaatgggacagttcaaattttaagatgtaaacattttatcctaaacagtgtaaagaagttaccaaactttaaagttatcctgaattaaacactgtttcctttgcatttaaggaaaaccaaaagggaggttattcctttgaataattttgtatgtattcaggatgtaaattaaggtcaaaatgattttttaagcctaattttttttaccccaataatagacttttgatctaattttaggtaattccattagttttcttgtagcagttttctacttagccccatttatctgtgcctattctcacatgacctttggtaactctttattttgttcttctctgtgggtatgtttaggtgcactctgtggcattttcacagtgcactattataaagaatttttactagcatagttttcttttatagggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttggtaagtagagtttcttttgtgagtatatatttgtttcatattttttcacacattagaatttgttcttaaatcttttctcctttgtaactcattttacttgatgtatgtgtaattatatgtccacactcacatttcataatatgacctagatagggagctgatactttaaagagaagaggaaagactcgtggggattagttttgatgatactaatgctaaaattaaaacattgattgaaactgctagagttaaggatatctctatactctaaaaggaatacaactgaataaaggtaaatccttgtgtgctactaataaagataatacattcactgattaaataacaaaaaaagataaatagagtcactaaaaccatttactaatttgtagagctggggataggttgacctaacttacaggccaacctcattactatgtttagaaattcattgctgttgctgtcagcaagtagctatattttccatcaaattaataagatatcaaggtaagtagttaaacaactgtagagctgttcaaccagaaatgaaatgggtcaccagcatgtgaatgctgctttgctctgagtgacaaaaatataaaaatcttgaaatgtaaatctaatgggttttgtattgggctttatcaatgtgggcattctttctgactgtgaaggagtagtgtcttctttgtggtttttgccaaagaaatgtatgagtgtttacatttggggagggatggagttttgcttttgatgtaatacgtattttaaactttataattctctaccttttgttcaaaggtagagaattattattattattaattttttttccttttctacaacagttttagcataacacatacaaaggattataaaattgtaaagccgagtgtatcttagacatcatgcaatataatctcttgattttagaaatgaattggtatccacagcatttttgataagtaattttacagattatgcagaaaaaaatcttctaaagcacttgtattttaagtaatttttgtgcttaatttagattgctttaatacctgtgctttaaaaaattgttggccgggtgcggtggctcatgcctgtaatcccaacattttgggaggctgaggccagcagatcacttgaggccaggagttcgagaccagcctgggtaacatggtgaaaccctgtctctactaaaaatacaaaaattagctgggtgtggtggcacatgtttgtaattccagctacttgggaggctcaggcatgagaatcacttgaacccgggggcggaggttgcagtgagccaagattgtagcactgcactccagcctgtgtgacagggatcctatctcaaaaataaataaataaatagttaacatgtggcttacattttatatcttttagtatacaacatttatctcatttgagaaacaccttatttgtcaactgaagcagggtatttttaatacttttaatgcctataaagttttgtcttgaaatgagaacatttgggaagtatagaacaaatatatataatatacaaatttaacctaattttaaattaagccattattacaattacattttatcctatgataaatttatatgaagttgatctcataatgactcttggttctggttttatattttcagagtactttgagcataacagttttgaacaattttgcatcaactattgcaatgaaaaacttcaacaattttttaatgaaaggattctgaaggaggtaattgccattataagtttaatttaagatctgcataaagctattttaaattttaaggaagagatatgctgcagttaccctgattggtgtggatggatggtgtataacggaaggtggctcagggaatctgggaagcccagcagaggccccggggctcaggcacgtcagaagtgttaatggttcagctgaagtttagggacccgataaaaacccttaataggggcttcctcagaagtgaacatctgtttttagtagtgacttttaatggacttgaagctctgtttctttttatgattttgttgtctctacttcttttttttttttgagatagagtctcattctgttgctcaggctggagtgcagtggtgtgatctcggctcactgcagcctccgtttcccgggttcaagcgattctcctgcctcagcctccccagtagctgggacaacaggcgtgggctaccatgcccaacaaatttttgtatttttagtagagacagggtttcacaattttggctaggctagtctcgaactcttggcctcaagtaatctgcctgcctcatcttcccaaagttctgggcttacaggcgtgagccaccgcgcctggcctgttgtctctacttctaccacaccaaacaaccttctacccgcatccctgcctttggcatctcccactctttttttttttttttttttgagacgaagtcttgctcaggctggaatgcagtggcgcgatctcggctcactgcaacctctgcctcccaggttcaagcgattctcctgcctcagcctcctgagtagctgggactacaggcacgcgccaccatggccggctaatttttatatttttagtagagatggggtttcaccatgttgaccaggctggtcttgaacttctgacctcaggtgatctgcctgcctcagcctctaacagtgctgggattacaggcgtgagccatcatgcccgactgtagctccccttcttcaggtctctctgcttctgcctactctgctgctggctcacctttccctgtctggcagcaaagccatcaagtcaggagatttgatgcatccattgtcctggagtgcctctgggcagtactttccttgtcatgccaccttttggactgtcagctgcttctactttatctgggctgaaatgtgcaatcattttatttcctatttccatcctttctatcttttcccacattttaattatgtttatgtttttgtgggcttcccagcacattctagcttttgtacattttacttacattctgtagttaaatgaattctggcataaacaaacaggtaaaacaagtacttaccagtaagataatttctctgaaaacgtttatccagtcacattagttctattaccatgtgaagttttaccttcatgcctctaatttaacataagctaatccttcccttctacaccaacctaccaaaaaactttatctagaaatattgtaaaaaggagactgtattttgatttatgttcacctttttaatatactttaaaataaatgtgaatttcaaattgagttgtgtttaagtggacagtgccttctagaatgtcagaaatcttttctagtatctcatgggaggaaatatttaaacactcaggaaacaatgttaaaacatatttacttaagttcattgcatagtttatccatctatgataaaatccctttaaaaattttaagaagacacaagacatatttgaggactcaaatttgatcatatattgttcttctaaattacacttattttccccaagtgatgtatcatatatattatatcactgtgttggtattagagcccatttgcagttaattgctatttccttacctttagtgcctgtctgcaagtgttcaaaaatctgttatgtttttggaaaaccatttaaggctataccagtttgtataaacctttgcattctaattagcaaatgttatgttcagaaacagtgcaaaattcactattgctcagtattgctgtatctatgattatgattatttcatttttaggaacaagaactctatcaaaaagaaggtttaggtgttaatgaagtgcattatgtggataatcaggactgtataggtatgtgttttttaactccacctttgaaaaatataggaagatgtagtgaatgtgtttagtgctttttctgtgctttttaattgacattacttgttatatgacttgaaactggtatttgagagaaggttacttctgtattactgcctggaagttattttttccaccaagacttcaaaggtatctttgttggaagttttctataatctcttctatttattttgaaggatgttttcctatttaaatagttagcatgtgaattggttaagggggaaacttaattgcctagtcagtaaagacatttattcacctgaggaagtccatagttaggccaggctccaggcaagtttgtcagggtttgccctgcttttctgtgattctcttgtttctgctgtattctgtgcattgacagcatcctctaactggttgcgagctggcttcatgtgtcacagccagataacactgcgcagcaagagaatagaggctctgctttcattttagtggtaaagaaacctttccctatagccgcacagccagttttcagtcttccatttctttcccaccccatctctaaaataaactgttgggcaaaccttgtttttaaaacagtttgataatcctgtcagtaactgatgtgctggatttgaaaaacatagtataataataatactactttacatcagtataaattttcaaagcactttcacatttcacttggtccactccacatttccttaacacacggaccctttctaacctctgagtctttgactgtgtggtttgatatggctggaactcttccccttccatttgtctttcaacccactttcacctcatgctacatctatcaaaatactcccatttgtagcttagttcagcatgcccctcctgccctaccactaattacccaagaagcatcattttctcactaatgtagttagaatctttctcttcctatgtcttatagctttgttccacttaatcattgttatatactgtattcaagcagtttacattttatagttagttttggacaggaaggaatttcaaacgaatggaaagagcgtaaaaatgtgttgttacagattttgtttgaaagcgtttacatcagtttctaaaagtattattaaaaagctatgcatgtagaagtttctgtagttttactttactttgaatatagctgtcatttcgaaaaggaggaatttccaattccttagcctcttctcctggtttacaaatggaatggttattatagtcatttgctttctttatgtagtagcttttctaaaacctatattaaatatatactgttacttttttataaacggccagatttgaaataaaaatccgtcagctctctataacttttgagagaacacatatagaatcacatgctatgttgtttctgatcagtccttgaaatctgtgattagtgaattgttcacatatctttaaaatgttatgtttttacactattgtgagtgttttcattttttgaaatagatttaattgaagccaaattagtgggaatactggatattttggatgaagaaaatcgccttccccagccaagtgatcaacactttacatctgcagttcaccaaaagcacaaggatcattttcgactcactgtgagttttgccattctgaaattgagactatggtgggacgagacattattaaaaaggtgcattagctattagatattactagataattagaataaaaattatggcgtgtatagagcaactatattatatccagcacagtatcttccttagatggatggatatttatatatgatttttatgtagtcaagagactttttctctgatgaaaagtacatttcacctgtctaatacgtacaatgtgcctgtagtctgagatactagggaagctgaggtgggaggacagcttgagcctgggagtcgaggctacagtgagttgttagcatgccactgcactccagcctggccaaaagagcaagatcctgtgtcaaaaaaataaaagtacaatgagaattacctgctgtcttcatggtctcccttctgagctaagtgggtatcagttgctttgttttgtgaccttaatcacattccaggagttggcactcggagtcgcaagcagccatctgtctgcttatttgtaagaccagcagttaaggttgtggcttagaactcttgactggtgcaggcaatacaaattagataatgatcagccaattcattttgaccctctttcctaaggagttttgagtggaaaatacactcagagagggaaattgaatctgaagcaatagagagattaggtagagtaaagagaaaagcagacagacagcagtagaaacaaatgagaggtgcactctaaaaggccagaagacctggtttctgttttcctttcttttttttttgagacagagtttcgctattgtcacccaggctggagtgcaatggtgcgatctcggctcactgcaacctccgcatcttggtttcaagtgattctcctacctcagcctcctgagtaactgggattataggcatgcaccaccacgcccggctaatttttgtatttttagtagagacggggtttcaccaggttggccaggagagtctcaatctcttgacctcatgatctccctgccttggcttcccaaagtgctgggattacaggtgtgagccaccgtgcccggctcagaagacctggtttctgaactgctgttaggtcgcagagctgtgcttgagtctttagagccattttccatgagggtggactgtgtggctattgagatgtttcctgtgttcacctcttctgaacctgtcttttcattcagccattgtcacctgaggtaataaaagcacagctccatccttgtacccagaaagagcctggctagcacagacaatgtgctagccacacaaatggatgtcagtttcaaccacaaagatagttgctgcctcatctcatagacaacatcattaacaacaacaacaacaacaacaaacaggagagtgaaaaagaaaagccgtttagagttgcctagtggaattagggaactaataggcaaaattgcctctcaaacaaactgtatattattttgagattgtaacatagtataatgattattgctttgatgaatccagaaacttaagtgaatggtaacaagtagttttgtttctattcatcattaacaaaatcagtggtaaataggtgaattggatttacctgaaaagctcatgtaattgtgttaaccttcactagggactaaaatctcacatccacctgctccattgacttgcaattcttctgtatccctatatatttcttgtaatgtggaatctatttctgttacttcagtggagatagaaataaaacaatatgtatcctcaacaaaacttctgctaaaattgaagatatatatccaatcctattccttaatagctcgctggtctttgttatgaccagcctatggatgcatgattacctttaccaggagttggcacctagagtcataagcaggtgacttaccaggggcactaattgctagtcaacagaattgtcacgagtgtctcagaggcatgtgacttaaaagacagtaaactgaagcatcaagaatggaccttggctgcttttgtcaaccaagaacaagagtaaagcagtaaatcctattttatataggttattccttttgttgtattttttgaaaataaataaaataatcatttattgaacacttagatgtggcaggcactattctaatgtttttacttgaattatttaatcctgttagatgtgtatgctacagatgagacatacaaggagaggttaagtgacatgcctaatatggcatgtaaagaaatggtaggttgggagtcaggctaggcactttggctgcagagccggcactctgacttgtcctggtgtattgcctcccacagggaacagcctctctgttctgctacctctttaaccttgagcaagcctctaaggttcccaagtcagttttctcaattttatttttttgatttttctttttctttttttttttgtagagacagaattttgctgtgttgcccaggctagtcttgaactcctgagctcaagcaacccacccgcttcagcctcccaaagtgctggaattataggcatgagccaccgtgcctggccagtactaactgggcctgaccctgcttagcttttgagatcagatgagattaggcgcattgagagtggtatggcggtagactctcaattttaaatgatgtcttttttttttttttttttttttttttgagacagggtctggctctgttgccctggttggagtgcagtggttctttcttggctcactgcaacctctgcctcccgggctcaaaccatcctcccaccttagcctctcgagtagctgggactgcaggcctgctccaccatgcctggctaattttgcatattttttatagagatggggttttgccatgttgctcaggctggtctcaaactcctgaactcaagcattccgcctgcctcagcctcccgaagtgctaggattataggtgtgtgccaccacacctagcccaacatcacttttcttacccttaggttatttcaagggtcagatgtgatcttgtaagtgaaaacattttagaaactttatgatatacatgtgagatattatgattaaatggtacaacctaaaatgatttagttttcttgaaatagattcaggctccttgtgtaaatatgttaggctatattatttgaaacggtaggagagtccctttgctgatgtcaggtgtttctttgactggctgcacatggaaatgatttgatataaatggtatgggctttgggatgtttaaaagttctccaggttgatccttttgtagttcataagcctgatgattggattttcatgctcatgtgtgcgatcttcctccctcagccttgttaatgtgttggcacattactcatctgacgtgataaagatagatagattttaaaaagttatccaggtaattctaatagagcaccaaggttgagaaccactgctttagaaataggtggttaactctgtaaaatgccaactgggttttgcatgtgcttttaaaaaaaaatttttttattacaagcatgttcttttaaattgtgtttttttttgggtctctttctctccgtctctgtctctgtctctgtgtgtgtgtgtgtgtgtgtgtgtgtgtgtgtcttacacctattttctttcctaagagattataccaaatatttgctagattttattgatactttaaggcatactcaatacataaaagcagtataattgtgaaaagtgtgaaaatttcctgtataattttaagtgttttacatctcagttgttttgtaaagaatgattatgtaatatatttttgatcatttaataactcatatatgtattgtttttcagattcccagaaaatctaagctggcagttcataggaatatcagagacgacgaaggcttcattatcaggcattttgcgggggcagtgtgctatgaaacagtgagtataacttttacaaggagaaaaccatttcatgttgaagctgcactgtacagtatgatagcttctagtcacgtggttattaattatttcacgtggttatttaaattaagtaaaattacaagttcaattcctcagtacactagccacacttcaggtgcccagtgtccacactgactagtggtgactgcgttggacagtgcagatacagaacatttctgtcatcacagaaagttcctttggacagagccatgttaagtgatgttatcacaagatggacagaaacattcctgtttgatttatttttcagacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaaggtatttgtgttatttaattttttttttactatatttaaaatgaaattattgttttatattctaaaatggataatgtagatcactgtcagaaatctcacagtgaagttcaagagcagaccctgcattgttgatatttgtatgtaaaatatcataatgtaggcctagtaattgaacatacagaaatgcttgtaattatctgaatgtgttcattcttggttcttaacatatctgattgcctctcctaatgttcttgcttctgcatactgtctggttgaccttcaaaccttctctttcccatgtgttttctgtttccttcctcattcagcggttttgttttagctggagtagtccagctcgggatggctagagaggactagttgagttgagagaggaaagcaggcacagccaggggcttcaggtaaatgatcgccttcatggactcctatttataaagtggctgccatgttaaaaagagcccatctgaagttaatgattcagtttgtaattcattttcaatgtgtttctctcacaatggcattttgggtgtgcatattacactaaaatttgattaaagcttttaataacttctgttaaagataagcacttaggtgtggcaaactcttcaaactgcttatttaacatggaagaatatttcatttgttttattaattttggatcaggaatttattcttcaaggtctgacatggaatggcacagggtttgtcttagaacactactaattggttctagttattgaggagtgtagaaaaaaaatgttaaaatttgtgaagttatgagtttaatgaatgacaaactatagtatgtagaacaaaaaatgtatatgagagaattaatttcttatatatttctacagagtattattgttatatttataataaaactctacatttgcctttcactatatgtactttaaatatttaaaataatgtaattaggaaaaagatttaagtgtctgaatgttatggtactgataatataagcctccccaaatttattttggattgaaatgggctctaaataactaaattgataaaatatttataagagctagtttttttttaagcttaaacataaatatagggaaaaacctcataatacatttttaggtaactgaataaaaagccttgaattttgttataagttatattcattattatgagtttctgattcagtgaacaatcttttttttatttgagtattcttctatttctgaatcgacatttgatagcagattggtttaaaaatagtatatttgcctatatgaaatggatgtcattcactattttcctactctaatattattgtagtattgctgataagagcatacttgaaattttagaaaatataaataaagacattcttacagtttttctttggattacataatcttttatgttgagccttgaaacttcttataattgcttatatttaatacaatgtatttttttacattaagccactgaaagtgatagctgaatgatactaataataaaatatttcacgtttttctctgagataccttgaaatgaaataggaatagattcctagttttaaatatagtagaatagctcattaaattaaaattgaagtatataaggcaataaacacaaaacaggctatcatttacagcaatacttcagttatccagcatccctggaaaccagaaattttctattggaaagtgcctttttcaggttattgaaacataaaccctttactgttagtgttttagaaaaagtcatcctttttgatggaaacataattctattataagaatatttgtatgttttcaaataaaaatacaaataaagcatgagttgcctgaggctttttactcttaagccttatggtccttggctgttctttgatagttgactttcttccctcttttctcagctgctaagagtttattttgatgcttctgttcttttgactttatctccattttttttttttttttttttttttttggagaatactgtgcttagtctgtggatgaaggagtctggactttgcgacagttattttctttccaaattagtcactttaatacttttcaggcatggtggttcagattgattacggttgtcagaactctgtcagtgagataagtgggatacaactgtatttctttaattcaatgacaaatccattccattttaataacttaagcttctcagtatatgtgatgtatactgtaatagtatcactcacaggagaatgaaatttggtgtcaggccgatgttggaatcatgactttgccattattagctccgtaacctcgggcaagttatttatttccttggattgtcatgttctatccttaattagatcaaacataataactcctgtgaaaagctttgagcagtacctgacttatagatgacattcagtaaactatacttactaattatagctatgattaatacaatgttagtttaaaaattaacattagtcttttgtaagtagtttaataaatacctcagtataaaatccagatagaaaaattttacataattaacttattttgcagagtagtaaggcaaataaatgattttaatacactgaaccacaccacatcataatcaatgttataaaaacaagaaagcatagtaacttgtaatgttcattgtgaattttttttgagaaaattgtccaagcatttaaaaataactgaaatgtaaaatgttttaaaatgttaaagaggcagggtgcggtggctcatgcctgtaatcctagcactttgggaggctgaggcgtgtggatcacgaggtcaggagatcgagaccatcctggctaacatggtaaaaccctgtctctactaaaaatacaaaaaaatttgctgggcgtggtggtgggcgcctgtaatcccagctactcgggaggctgaggcaggagaatggcgtgaacccgggaggtggagcttgcagtgagcctagatcatgccactgcactctagcctgggcgacagagcaagactccgtctcaaaaaaagaaaaaaaaaaaagttacagaggatttctatagctaggcaggacaattttgtttacactaagtgttccataaaacaatcctaatatatactattagtgtatattttaaacatgtcttcattcctaatgtgtgtgacacaaactacagtttgccacattcaaagactgtgctattgatctcttattaaatgcatcctcactattttcatttacttccttcattgcctgtacattttttcctcattcattccatctgcaaatatgtgtgtatgtttttaatattgctaattttcagtcttttaattatacaacttctgtgtaagttattgttcttgcattacattagccattttgcatgatgctgtctgttaaagaatttgtgtaccaggaggttgttaaactggaatgtgttgtatttggatgttattgcatgttattttattccagtactggagagctaatattaactcatgacactgtgtactttggctttttgaaataataaactgatttcctttctttcacagacacagttaaatttgcttctggataaacttcgaagtactgtgagtatgcttaaaaagaaaacaggtttttatgggtcatctaaaactattattagtaattatgcaagtaggcatagtaaccctgtactaattaaaaatacattttaaactttattctcttattttaaaaaattagttttttttctgaagaaaggtcaaatatatatgtgaagtcagattattttataaatatatagaattcttgactatttaaaaattaagattatcttacagtttcaagaaagtgaaaataagtggtaatagtggagaatttttcttaggattaaagattagttatgaaattcaatcttattttattactcttacagtaacattctccagacatggcaatgttgatgtggaaaaaatggacaaaatatttttgtgccctgctatagagacaaaatttattagaagcctgttttttaactatacattttagtaattcaccccattttcttaaatgagaaaaacatcatagaaagaaattatatgtggtttatataaatgaagcatgattccaaagtaagacttattttttacacaaatccacagaacttgaaattttgtttttgtttttgagacaaggtctcattctctctcgcccaggctggagtgcagtggtgcaatcacaactcgctgcaacctccgcctctctggttaaagtggtcctcccacctcagcctcccaactagctgagactacaggcatgtaccaccactcctggctaatttttgtattttttgtagatatgaggtttcgccatgtttcccaggctgttcttgaacccctgggctcaagtgatctgcctgacttggcctctcaaagtgctggcatttcaggcgtgagccacggcacctagttagaacttgcgtattctttttcaaatagtcattttgaatagctagacatttattatatcagtattattgttgcttaacttactgttagattaatttttggaaccattaaaaatctttttaatatcctctttggctgcaaatatctatctcttaaggccatgtatatttaaaaaccaaatctgatgaagagagtatttttatttcttagatagggtgctgctctaaaattatgagattactttgtgatttatagaaaaaaaagcatttctaaaacgtgttctagaagtgtctgtgggccgggtgccatggcttatgcttgtaatccccagcactttgggaaggctgaggcaggtggatcacctgaggtcaggagtttgagaccagcctgcccaatatggtgaaacctcgtctctgctaaaaaaatacaaaaattagctgggcatggtggggcgcacttgtaatcctagctacttgggaggctgaggcagaagaatcacttgaacccaggaggcggaggttgcagtgagccaagatcacgccactgcactccaacctggttgacagaatgagactctctctcaaaaataaaaataaaaataaaaataaatgaataaataaataaaagtgtttgtagggagcttcattgttgaaataattatttgcaaggtaactactttgaagagaaacagttatttggatgtctattagcttcagtactcaacaatacgtttcattgtatacataatcagtattctttctacctcattcagcataatctgataattgattccaaatgaatgcctttaagctttaaaaaatattgtttgacaaacaaatgttaaaatgtacaacagtgcagcttagggacctactgtatgtttttgaaatagaatgattgaaaatattgttttgttttcttttacactttggcctaagtcttaaggggcataattttatttactccttttgtcatagggaaatttccttatcatagaaatatggcatacataaatacatttaaatatagaaaaaaatcacatgtacatcagcctgcaaagtgtgttgtttaaatatgttaaacaattaaatgtgttaaactttacagtgaaagacttctctttttacagtttttgacattcaaatctaaaatgtagtatttttgtaatattattaattagtaattcaaaaagtcattgtaagctttaaagcagaaaaagtatgcttgtaaaattttgagttttttttttttttgacggagtctcactctgtcacccaggctggagtgcagtggcgtgatctcagctcactgcaacctccacctcctgggttcaagtggttctcctgcctcagcctcccaagtagctgggattgcccaccaccatgcctggctaatttttgtatttttagtagagatggggtttcaccatgttggccaagctggtcttgaactcctgacctcaggtgatctgctcatttcagcctcccaaaatgctggattacaggcatgagccactgctcccagccttgagttctttagtaattacttttacaggttcatatgttaatgttaatatgctttgaaagttgcaggtattcatagaaacagaaaactaagaatgctatatgtattgtaacaaaaagtacctttattttcctagggagcaagctttattcgttgcatcaaacctaacttaaagatgacaagccaccactttgaaggtgctcaaattctgtctcagcttcagtgttcaggtattttcataatctctgtcagtgtgtgttagtagtcatagctcaaatacaatttaataggttcagtattttcaaataattcaccattatcttgattattttacagtgcaataaaattttcatcttatattttctttaattataagaaaagtatagagccacatgtggtggtgtacacctgtagtcccagctacttgggtggctgaggcaagaggactgtttcagcctgagttcaaagtcagcctgggcaacatagcaagatctgttttagaaaagaaaagaaaagaaaagcatagatggcaaattatttgagcaatattgagatgttgtttattgtgaaataaacaatttcacattaaacatttatgaaaactctctaacagcaaaactggatcttccttaagtgggcagctttctcaatccagcagtagttcatttctcattccacacatgatggtcagaaggtaggttttgttgtcctttcttcccactccacgacttgtaaagaaaatgaaacacgattccctctgcatctgtgacacttcatccatttgcttaaactatcacttcctacccctcaccctgccatgtctgaccttgctcaggcaccaggcttgctctgtttgctttatgccttgcccatcctcccttctcaccaacactacccctaatttttcccaaggtatcagccttctcctttcttgtttaccttttgatccaactcagcttcctgacacttccttaaactttcttctctgactccttattttgctcttttgagaggtagatttactatgaagctaagattacttaagcttcagggtccttcatttaaataaaccccttccaaagccctgcatgtaattttctgcttcgctaaaggcctctccccaactatataagcttcagcccccgcctcacaaatctagatctacccttgacctctctcacaaaaccatagctattgagaaatctaattctgttctttcttattgtctgcacagggttggtagacaagacaggatggcaccagttaaattcatcgtcattatctttaaagggctctcaaacctgtcctgccaagttttcctggtcagcatgttctgtttctcatcagagactggtcagacccatcctgctttcctcaaatctctgcgcctctgctgtcagatgggcttacctccttaactaaatatcctaaagcttctcttgtctgctatcaagcacttctgcctaccacttaaccttccctcctgttgagaaagtaggggttgcctctctgcctggttgaggcttatagttctttgaaagccatctcttcctagtttttcatggatcttcagcattgtttatgtttgtcatactattccctttcagatggatctttcccattaccatttaaacatgctgaaatctcatctctaagccacatttctcttacagctacctcttcctccttatttttctccagttccttttctctccaagaataggttattgttgctttttcagtttcatgcattctacttactctttaactccaggataatttagctcccaccttgatgaggtcaccagtgattgccttgttctgaagcaaatgtcccttttgcagtccttattttagtggacttcatagccacatttgactctggccaacccttttaacatatccttttcttggttcctgacatggcgtatgcccctgcttttcttttgaattctctgaccattcctgattcccctgcaggctcattttcttctacctggacatttgttatcatttttcaggatttaagttaggcctctttttcttctcattctatgtcagtactgtccagaagacctttacatgatgatggagattttccatatctgtcagtttagtagccatgagacacatttgactcctaagtacttgaaatgtggctaagaatgagtgagttactaaattttaaattttgtttaattaaaaatttttttttggttgggaggggcagggtttattctgttacccaggctggagtgcagtggcacaatcatggctcactgcagcctcaacctcccaggctcaagtgatccttctgcttcagcctctcaagtagctggaactagaggcatgtgccaccacgcccagctaattaaaaaaaattttttttgtacagacaggatctcactgtgttgctcatgctggtctcctggtctcaaactcctgggctcaagtgatcctcctccctcagccttccaaagtgatgggattataggcatgagctgccatgcctggccttaattttaatttttaaaaatttaaatttaagtagtcttatgtggctagtcccgctgtagagcatgtggctagtgactgccaagttgaacagcacagatgtgtattcccttaggtaggctccccagttctgctattgtaaccttctaaatagtgagtcctgatagtctctaatccaagctgtcaccatctcttacctggatttttgctgtagcttcctaagtattctcctatctcttcagtctgtttttcacatgcatccagaattatcactccacaactcatctctaatcatcatgtccttttactgcttaaaatgctctaatggcttcagatgagtattagggtgaagaggtcccatagagcctggcccgtgtgtccctagcttcatttgtttacactctctccctcccttctctccttcagtcaccctgactttcattttcattccctaaatgctgcatatttcctcccagcacaggacctgtgcacatgctgcctcctctgtttgggatgttcttgctatactttttcctttatctttcacatctcagctctgtcatcacttcatatgaaagcttttcttgatattcctgacatggaggggagcctgaatttggggtgctgagctcaagtgcctttatttcacagttgtagttacaaattttatacatatttgtataattattttatttttccctcctttattccataagccccatgagggtgggaactgcatctgttttggcttacacatacattcctatttccctggcatatactagactcagtaaatatttgttgaatggaatgaacagtgtagaaaatatgaagatttatttgtgactaatgctaacaaatactggaaaattaagtaattcatgtctgttgtattcttccataaagtagagatgtatttttgtaatattcaagtccatttttttccccattggaattcctctttatttcctaagtgaacacctagtgtcctggcaagttgcacctgtttagatttagctatatatgctatcagattagtggagagggtataggctactgatgaatgctttagctaggattcctctttcaataagcagtatatttcaacatcttaagacatgttggcactttaacagataataccaattcattatactttgatttttttaagtatcaataatagatatcataatagtaataatgataatgatatagaatttgttccagtcatgtagctaggtgatgagaaaatgcaaaaatccataagttgtagaaataaaaatatttacgaagctttctaaaataaagatatttaagatttgaattgtactttaactttccattttcattttaaagagaattaataaatttaagtcaccttttactaaaattactatttttttttttgagacggagtttcgctcttgttgcctaggctggagtgcaatggtgcgctcttggctcaccaccgtaagctccgcctcccaggttcaagcaattctcctgcctcagcctcccaagtagctgggattataggcatgcaccaccatgctggctaattttgtatttttagtagagatgggctttctccatgttgaggctggtctcaaactcctgacctcaggtgatccgcctgcctcggcctcccaaagtgctgggattacaggcatgagccaccgcgcctcgtcttttttttttttgagacagagtctcactctgtcgcccaggctggagtgcagtggtacaatcttggctgactgcaacctctgccttctgggttcaagtgattatcctgcctcagcctccccagtaggtgggattacaggcgcccaccaccacacccggctaattcttgtatttttagaagagactgaatttcaccatgttggccaggctggtgtcgaactcctgagctcaaatgatctgtttgcctcggcctcctgaagtgctgggattgcaggcgtgagccaccatgcccggcctaaaattactatcttctgattggcaaataccagggcaaagtaggggaaggtgaaagaaggcaagttttcttcttctgtaaccttggggctgtgctgcctgtcttgtagcaaagaggggtgccagctctgcaccgagaagccactcatcaaactccaagagtaaaagccagttcatggaaatgtttagaaggcagagtatttgccttagtggttaaaaaaaaaatttaagcttcaaaacatcttaagagtaaactagctgcaagtgctgagaaagcagttgtaggcttggtaatttgttaagcaccatgaaattcttaatgaactgtgagccagtttatagtttgcagctacagggcaagccaggagacttagatgcatacatttccaaaggtacttgtttatttgatacaagtgggcaaaaactgtgatgatactaaccaaactttacttttctttctccaagcaaagcctagagctaaatctagttctggagattttttttccccatacgaatgatttctttaatgtgtttcattaattaatattgaaaattcacagtaacagaaattaaatagtacagaataatataagtaacaagaaatctcagctcttaggggtgaccacttaactctacgtcttgggtatattttttatgctggttagattaagctctgctttattcttttaaatatgtcatatcccatcatatggttgtaacataatcaattgagattttagtttttttctggttttttttctattaccaacagtgacccagaggacatctggacattgtccacatgcatatctttgcccacaagtgtgaaaaatcatagaatagatttaccgagccaaagggatatttccaaattgccatccaaaattgttacactggcttacttttctactaagaatgcatctgtgtgttttcctacactgtcatcagctctgagtactagttgttatcttatacctttgccagtcaaatgggttaaaattcaatctgactgtctgtaaaggccatctttcctgtgagattactttaaaataaaaattcactggtttaaaaagtcttagagtttgttttaatttaaatttttggctagcaggaatttattttggtgtaagaagtgagacaaggatctagtgttgtttttgttttccaaatggcttgccgtttgtcataatactatttattgaataatcttactttctccgttgatttgaatagtcccagagactgaaatctaggtcttgtaaataaaagtcctggcatcacttatagctcagcctttccctgcctatctcacactttttctgacctgaaaagctcacattgactcaagactcagattaaccacttactagagttatactgaaaatagatatttatccaatagactaatcatcccagtagtctagttgctttgagaagtgagtgaaaggcagtctttatagtgaaacagtgagctcttctttcttttccatttgccttatgcactgatgataacttgggaatgtatctactttttggagtttctttcaggaattttgttctaaaattcacctcaggcctttgaaagtggtttaatgcagggctttgccttatatactgtgtttgtgacacagagtcttctaacagaaaaaaagatacaaactagacttgatctttccttagttttgttttgttttgttttgatacagtgtctcactttgtcacccaggctggaatacagtgtcctgcaaggctcactgcagcctccacctcctttggctcagatgatcctcctgtctcagccccctgagtagctgagactgcaggcatgcactagcatgcctggctgatttctctattttttttttttttttttgtagagatggggttttgccatgttgcccaggctggtcttgaactcctaggctcaagcagtttgcctggcgtggcctcccaaagtactgggattataggcatgagccactgcacccagttagacttgatctgtctagagaccaataatttgcctctagaaaagagtcttattgggtttacaggaaatttgactatagtagttttaggtggtggataagttgggacataatgagcataaatattttcctatataatatttagttgctgataattctcataaattgcccgtttctaaacagtatcttacaaaaatgatcattcacaaattattttggacttccgaacagtgattgacagtgctttgtgcttgttcgtgaatctagggatggtgtctgttttggacttgatgcagggtggttacccatcacgagcttcatttcatgaactctacaacatgtacaaaaagtatatgccagataaacttgcaagattggatccaagactattttgtaaggtataaatgccacccaaattgaaatttcttagctatgaacttgtcttttctattaataattgacatttaactttttaacttttatttttcaggctttgtttaaagctttgggcttaaatgaaaatgactacaagtttgggttaaccaaagtattttttagacctggcaaggtaaatatacattttttactttaaactgtaacatcatgaaaacaaatagttggggttagtgaatatcttaaagtatttaataatttgtattattcttgaattatatggtcactaacaacatgaattgctattttccataccatttctcagaaaagaaaaaaaagttgagaggaagataattatatataatgttcataatttgtttagctttactcatacatatttattctaaactccccatttattttagagcacaggtgtccagtcttttggcttccctgagccacattggaagaagaacagttgtcctgggccacacataaaatacaccaacactaatgatagctgatgagctaaataaacaaaacaattgcaataaaaatctcataatgttttaagaaagtttatgagtttgtgttgggcctcattcaaagctgtcctgggccacatgtggcccatggactacagcgtggacaatcttgtcttagagctttaataattatttgagaactaatagtctcatagagaaagcactttttcttgtttaaactcctgaaaaattagaaatatttattgaaagcttaagacaaagatttaaatatcttttctctcgttatgttacctttaatttaattttgactataagaagccgttatattggttgatgggtttttgacattcttaatattatagtgggttatttggtaaaggattgaaatcattatggaattttgtggtatatagtggaaataatgtattttattagttaagaacctactagctgttttatttgtgttgtctgtcacttagtagcaaaaatttctcatctctgtttaaaatggaaatgggggttgggcgctgtggctcacgcctataatcccagcactttgggaggctgaagcagtgggattgcttggttccaggagtttgagaccagcttgggcaacatggcaaaacctcatctctacaaaaaaatacaaaaattagccgggtgtggtggtgcgtgcctgtaatctcagctacttgggtggctgaggtggggaggattgcctgagcctgggaagttgaggctgcagtgaaccaagattgcgccactgcaaaaaaggttgggggtgggtaatgggagttaggagagacagaataattttggcggtacctggtattatatagctaatatgcacttatcaaaagctccataaggatatctgagaatgtgggtgagccaattcagagatacagtagtcctttttcattcttttcttaataaagtcttctcgctagccatctgtaatttaaaagtcatcccccccccccacttttgttattgaatatgctacctagcattaagtaacctccttacctccaaaaaagctcctgaagaaagaaaggaagcaaaacgtggccaagtgtgtttgtgtttgttgtattctctgccaaggcctatgtaattgacatgtgaccattttcagacagttagattttggatttgaattctgtttacatcatgtctttatgtgttcaaatgcatttatattttaatactgatactaaattatttcacttcctagtttgcagaatttgatcagatcatgaagtctgaccctgaccacttagcagagttggttaaaagagtcaatcactggctcacatgcagtcgctggaagaaagttcagtggtgctcactctcagtcatcaaatgtaggtgttttcctttacacctataggatctttcattgtttcaagatggtttgtggagtgttgtaaagctgtctcagaggtgatgctgagcaacagagactgagacttgttcacactgggtcccaggttcctatttgtagatgttctttctttttttattttttgagtgtatgatatttattttctttattcaaatgtgttataagagtgtcagtttcatagtgtcctaacaaaacagaattcactatcttgatctctcgtccccgcacccctcaccatcccctaatctctcagacttaaaccagaacttttctttctgcctgcatggcatctacaatacacataccccgaaaattctaattgtaattgattttcctttcttatccctgaaatattgtcagtcaccagatcctgttgattccttctccaaatactgtacattcctttctttttcttgccagtgccttagtgaagtccttttccaccttttgcataataattccattagctcccagactggttttcctggtttcttagagatatctctctaaactagaagccttttataactttcctttcataaaaggtgaagtctaaattatttgatgtctttcaagatcatgtaaaatggtgtgtcagttttttgtttcagtctcttcccccaccatcccctcttaaatcctgttttttgaacggaagtctgtcataatcctgaaagacactgtcttgaacaccataatcccaaatgttgaaatcttaaaagatgaaagtcccaaaactaggattctgtaaaaataataaaaaaagatatttatttacattttaaaaaggggatttgagaaacgtataaaaacatgacagaactcttcataggccacttttcacaataaaataggcaataacatatatataggcaataaacatatatgtttattgaaactataaacacatatactaacaatagttgcatgggtataacaggagcagacaaaccgtattcataaagaatagggcgaaaggtgaaatgcataaacacatattattgtggttggtaattgtgcacccagctttgttactgcagtcatctgaaatactgtgatgatgaacaagctgtcttttgatgagatcagtcaaaaaccatagtgagtcaccactgcatttgtagttgcccagagaactgaaatcttgagaaattttatcttttacaagtgcagatgtatgataaaggacatctgttcattgattaagtttcagtgtttttatatacatacacaatgtttacccagaaagtaaatgttgtggtaatgcattttcatggagttaaatttgcaaaaaatgaatacagtaaattagaactctccaaaaatttctacataattaaaaaatgctaacaatttaagatagtgaaaataaaaacaaagaaaaaaaaaacacccaaaactaaaaaggaagtttgacataaaaaaaagtgtatcacagggacagattataggcagttgcatggagatagtccataagagctggctgtctttctcagtcattaactatattttgaagtcttgtaccacgaataataggtgctttttttcttttaggacatggttcttggagaatatgttcatattcattttcttcatgagattgctctttttggaattcttctgtgattcctctgattgggatttttaggatttttgatgttagggattttaatctaggaattttgatcttttgggatttcaacatttgggattatggcttttgggattaggaattcaaacccctttgacatactgggctaagctgcttttatgtgtggtttggccaggtcatagcagctacatagctggcccaagacaaaagtgagggacagaacattttggggttacctaaggatctgtggcaaacctttaattgttgggagctgtgtaggaatcagtaacttgattacatttacagttgccccttatactcatcagagtacctgaaatagtgctaggtacatgaaaaggatccagcgaatttttccttatcagtagaaaaggaaaattcttttggcctaatgaaaaagaatcatgctaacaaagattatttttgaggtattttgttagacaattgtgaatatagataaaaagagaactattaatataaaaagaaaaaagatagcagaatcttttccccatcattttccaaataaaatacagaaacatctttattactgtagtttaatacgttcagctttacacattgcattatgataggaaacacattatagtaaactcatctgttacaccattcatttgtggactgtgttctacagtggtaccgaagtcagtaaccgggcagggatctttgcagaatgttaataggaaactctgaaaaaaaagttcaaggtcagatcatcctaggaaattgtgagtaactgaagttaagtagatttctttgctgtaggattctcagaggcttcactcagtatgttcattgtgaacctccatacagaagtatagtgtacagcttttcataaactcatttgacaggtaaatccttttttcaggacatacctattcacatttcatagaacaaatgttgcctaagacagtttgggaggtagcagtgtagcatactaaggaaataatgcatttaaaatgtaagcctaaccagatacatgatattgtaactgcccagtgggttctccttgcccactacccagacagagctgatttatcaagataggaattgcagtagagagacagtaattaatgtagagtcggctgtacgggacactggagttttatgattactcaaatcagtctctctgaaaactcggagatctgaatttttaaggataatttggtaggggcttgggttggagatgaaatcatagggggtcaaaattgagtttttcttgcttgcttctgttcctgtgtgggagcacagaactggctgggccggattacctatctaggtggcatcagctggtgcattggaaggtctgcaaaatatctggagcactgattttaggtgttacaactgtgatgttatacctgggagcaatttgaggaggttcagattcatgcagctggaggctgtgtggctcctaaaccgtaatttctaatcttggagctaatttgttagtcctacaaaggctgactggttccccaggcaagaagggggtttattttgggaaagggttattatcatgtttgtttcaaagttaaactttaataaactaagttctttcccaagattagttcggcctacacccaggaatgaacaaggacagcttagagattagaagcaagatggagttggttaggtcagatctcttttacataatttccttggttgtaatttttgcaaaggcaaaattacatctttcaacatctttttatttttaagaagaataagaaattatagaaatgttaaaactggctgggcgtggtggctcacgcctgtaatcctagcactttgggaggctgaggtgggaggatcacttgaggtcaggaattcaagaccagcctggccgacatggcaaaaccctggctcgaataaaaatacacaaattagcccagcatggtgtgtgcctgtagtcccacctcacctactcaggaggctgaggcatgagaatctcttttttttttttttgagatggagtcttgctgtgtcacccaggccggagtgcagtggcacgatctcagctcaccgcaagctccgcctcccgggttcacgccattctcctgcctcagcctcccatagctgggattacaggcgcccgccaccatgcctggctaattttttgtatttttagtagagacggggtttcaccgtgttagccaggatggtctcaatctcccgaccctacgatccgcccgccttggcctcccgaagtgctgggattacaggcgtgagccaccgcgcccggccgagaatctcttgaacctgggaggtggaggttgcaatgagccaagatcatgccattgcactccagcctgggttgagactgtcaaaacaaaaacaaacaaaaaaggtgttaaaactttgtttttgatgtctgatatataataatatggtcgtcaagatttcatgtttcttgagaattactttgtgaaaatgagtttttttaatatatgttagatttaaactgaataattttctatcattttattttactcttacacatagtgaaaaacaaaataaaatatcgagctgaagcctgcattaaaatgcaaaaaactattcgaatgtggctttgcaagaggagacacaaacctcggtaagatgaatagttcctaaaaagaactctacaaaacctagttactgtaatacaaaatgacaataaagtcataataaaaagcagtttggatactcaggttttctcatgttctttgtaaaatgatgtattagtcttttatttgtaatatttatttgaagttagttaattcatttattaccttattacttgcctcattctataaaaggatttgaagtggcatacaaaaatgtgtaaagactataaaacaagaagtaagtagttgagagaagctcttttattctgattattttagttatttgagtttcttgataatgtcaaggtgacattttttaaaaaacatctcactaatatgtttacataattttcaagattatctgtaggaattacattgtcccattataaattagtctatttcttatttgaatctttcatttttaatttacacttttaaaaattggaagtctgaatatctctattgatccatcacaccttttcaaagagactagattaatttcctctgtgatttgaattctcaaagttgtagaaggctttaatcccattgacaggcatcagtgtcattcacactcatatttgattttttttagccttcaacaagagatctgaaaaagagaatagtagataatattgaaaacagaagtgaaataccctgtttagcattttataaatgaaaaatctgccaaaagtactaaaggatgaaattaagctctaatgaagtattatttttacagcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaaggtatgtaatttcaacccgaatgactttgactttttatgtaatttaatatattttgttattggtattgaaattgtatagaaaacgtccttagtttttcaaaattacaaaatgtgttgagactcaatgatggcaagtacatgctcatcattattacctctactctttatgtttgaaaaatttcatagcaaaaagttaaagaagacaatttttatgccatttcttctgttgctaagaaagatatccctcgcaacttaatacctaggtgatgggatgatctgtgcatcaaacccaccatggcacacgtttacctgtgtaacaaacctgcacatcctgcacgtgcatccctgaaattaaaataaaagttggaggccatacatggtggctcatgcctgtaatcccagcactttgggatgctgaggcggacggatcatgaggtcaggagatcgagaccatcatggccaacatggtgaaaccctgtctctactaaaaatacaaaactagctgggtgtggtggcatgcacctgtaattccagctgcttgggaggctgaggcaggagaatcgcttgaacctgggaggcggagattgcagtgagccaagattgtgccactgcactccagcctggtgacagagtgagactccatctcaaaaaaaaaaaaaaaaatgaaaaaagaaaactaaagttggagcaaaaagaaaatggccgggcacggtgggtcacgcctgtaatcccagcactttgggaggccgaggcaggcggatcacaaggtcaggagattgagaccatcctggctaacatggtgaaaccttgtctctactaaaaatacaaaaaaaaaaaattagccaggcgtgatggggggcacctgtagccccagctacttgggaggctgaggcaggagaatggagtgaaccgggggggcggagcttgcagtgagccgagatcgcgccactgcactccagcctgggtgacagagcaagactccgtctcaaaaaaaataaataaataaaaataaaagtggtggggcatggtggctcctgcctgtaatcccagcactttgggaggccgaggtgggcggattatttgaggtcaggaggttgagaccagcccagccaacatagtgaatcgccgtctctactgaaaataccaaagttagccaggtgtgatcgcacgcgcctgtagttccagctacttgaggcaggagaattgcttgaacccaggaggcagaggttgcagtgagccaagattgtgccactgcactcctgcctcagcgacagagagagactacgtctaaaaataaataaataaatgataaaagtaatataatactataaaaaatttggaggccagatgtgatggctcacacctgtaatcccagcactttgggaggcccaggcgcagggatcacctgagctcaggagttagagaccaacctgatcaacatggccaaaacctgtctccaccaaaaatacaaaaaattatttgggcatggtggtatgagcctgaggtcccaaggaagctgaggttagaggattgcttgagcctaggagatggaggttgcagtgaacagagattgcaccactgcactccagcctgggtgacagtgagacccctggctaaaaaaaaaaaaaaattggagaaaccaccaaaaacctcttaatacctccacattaacaaattcagttagttactgttatttttacagtataattttacttgtttttactttaccttacattctcttttatgcatacatttttacagttcttatcataatatacatttcaatttctatctctaccattgttatatacttgtccatgttaatacattatcttcatagatacgataatgtaattaattttgtgaaaatagcaatttcctctccaattttgtaggaaaaaaatgggatcccttattttgttttgatttttatttatttgattactagtggagttgaagacttttctatatgcttgttaattatatttcatatttcattaattacatttcatatcttctcattatattttagagttttaatgctttttctcagtttcataggtcagtgcaagtatgtgggatataatgaatatcttaaagtgagcgttttatattttctgcagatattttatgtaaacaatggcaatcttggaggtagaaaggaaaaaaaagatctggaggaaaatgaaaatgctataaatagactcagctgattttataaatctgtcaagggccatctttgtttatgtggtatcattataaattaaaattaacccacccacattttttgaaggctaattttagaaatccaataattttggatatattttgtaatttttaaaatattctctaggtactatttgaacattattctaaaatagtagtaaactattgctaaattagctgatcattacttaagaaataattctttttgagataagaggcttgctctgttgcccagtctggagtgcagtggtatgatctcggttcactgtaacctccgcctcccgggttcaagcaattctcctgcctcagcctcccgagtagctgggactacaggtgtgtaccaccatgcccagctaatttttgtattttatttttataagagacagggtttcactatgttggccaggctggtctcgaactcctgacctcaggtgatctgtccaccttggcctcccaaagggctgggattataggcgtgagccactgcacccggcctagaaataatttttaactgcagtatattaccttatccacagattacctgtctaattgatgtgtaatacttgtgtgcagagataacataaaacattttttgaatagtatttaatgtacaaacagtatagtaaagataacggacgtattgcttaccatcttacctagtttttgctgtatttgcatattggagtagttttttattttaaattgtaaaaaacaataaaaacattaaaatttatcttagccatttttcagtttataattcagtattgttaagtatattcacattgttgtgcaacagaagaaataagcttttacgtacctatttattttattttttaaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgtgaggcatttatattattttgaataagagacttaaagaaatagtgaattcttggtattgacagtggttaatgacaattatttgttttgttttgtttttgtgacagggtcttgctctgttgcccaggctggagtgcagtggcgcgatcttggcttactgcactctgcctctcgggttcaatcgattttcctgcctcagcctcctgagtagctgggattacaggtgcgcaccaccacgcctggctaatttttgtatttgtagtggagacggggtttcactatgttggccaggctggtctcaaactcctgaccacaggggatccacccgcctcggcctcccaaagcgcttggattacaggcgtgagccaccgtgctcggttgacaattcttaaaactgtgttcttattttaatgaactaattttgtaataagtttgaaaattgagagaataaggtcattttataatagtgataccataaaataattttaactataatctgaatttgttagcctcttacacctgaggattttcttctttttaaaactatgatttgtttattgttttctaagctagataaatgacacttctacttttctgcagttttaaaactgataacattttgaaagattgccatgatagggtagagagaacagatgagttgttgacttggagagggactagagggaagcacctttaatcaggaccttacagccaggctttgtaaccacattcatctagagatgttaaaagttatagaatataattatatttgttttatttaagaattattgtcaatagagttaaattttattttattcaaaataagttgatgtatgtggccaggaggttaatttgcattcccaatctgttacctttgtttattattaaataatagttaaattgccttctgaaggattctttattttctgttaaatttttgaagagttttctattttttattaggaaacttgagatggaagcaaagagaaaacaagaagaagaagagagaaagaaaagggaagatgatgaaaaacgcattcaagtatgtacttactgggttgaatttctattaaaatggaacctacaggctgggtgtggtggctcatgcctgtaatcccagctctttgggaggccgaggcgggcggatcacgaggtcaggagatcaagaccatcctggctaacatggtgaaaccccatctctacttatacgaaaacaaattagccggacatggtggtgggcacctgtagccccagctaattgggaggttgaggcaggagaatgatgtgaacccaggaggcagagcttgcagtgagccaagatgacaccactgcactccagcctgggcaacagagcgagactccatctcaaaaaaaataaaaaataaaaaataaataaaataaaatggaacctatgaaagaagtgaaaatgagatcttgatttgctagataagctgtcactagtttatcctagagaccaaaggccagtttttgaagtggttatgggaatggactttggagctagggaagtgggttcaaatccaagatcagtcactgacagaaattgtgacattgtacacattatagtgaggaactatgggtcacagttgtctctctgtagaatgtggataaataatagttgcaagcatttgacagttaatacatgttaaagcattgtgaacactgtgtagatcaataaatattaataattgtttttatacctaggggaaagtcaaatgaaaattcacttaaaatgttaagttttaaaatatcatataactttgtagatactggaattaataaattaggattaagagtctctctccacccctagtttttaaaaagtcccatgttgagaataaattgctcatgtatttgaatttctgtttgtcatggctttcataatatatcctaagcataaccaaaactttaaattcctgacatctgctctctaggtgttagtgttaatgggatgcctaagatactcatgtgatgtttgggacactaatatttatagtcatagagttatggagctgtggttcttctaccttctcttggtcttgggaaagaggcaaaatggggatgtgtttgaagcattaatcataatagagaagaaagtagagactgaagagatctgtgcttaagcaattctttagtaaagaacttgtatgggggcagttatgctttccctttattttaagtaataaggggagtgatcaagtaaacaagtgaagaactcttggtgaaatagctttctgcccttgtcaggctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggaggtactggggcccctgggtggggtatagcgctctctcctttgctttctctacctctctgcctctcatttccatgcagaagggaataggagaaaataatattctgaaggccctgatatatttgagctaaaataattttaaaattatttgtatcgactttcatactcaagtgaatgagataattgatttttcatcatattattaaattgttgacaaataagactaaaatttcactaatgagtactctattaagaaaatatatcaacctttaccctgaaattgtttaagagtatagtatattaggtagacacctaatttctaaatacctgtcatcaaacactggcattgaaataagtgactgtgttatataatgcagtgtaatgtatttgtagttgagatttttctaatgcaaaaaaatttaatgtattaaatatcctgtcagttgaaatgagaactctactctgcaatgcctcagaataaatgagtttccctttacaagaagggagggttaaattcattgaaatattttggcttcttgggtttctgaattatctctaagcactccactatagtggagtgtataggaatgtggaagctcttattaaaagttgcagaaaggtttaatagattcagtttaaaaaaatttagtatgtagaggcattaattattttgattatttataataacaaaactaatttgtaaggttcctttgtatgtaggtatatatatgttgtatatatactgagaggcacatagacacatgtaaccatgcttttccgagcttaaaagcagtttatgacaaaatatagagtacaaccactagatggcgatgtttccttgtgaaaggatcaaactgcaatgtaatggaatatttggcaaaaaaacaaaagacggggaaggaaaagggcatattgagttgccttcatgctttttctattaggttggtgcgaaaataattgcggtttttgccattgggaaaactgcaataacttttgcacccaccaaatagtatgtgattgtattggggagctctgggactgcttgtatatgaaagtacattatattgtaaatgaactgaatatggctatatgaacaaaagatgttataattattaagctcttgggtttgagtccaatatttgggctctttattaagatttcactgtaattaaaatattttggcccagatagggcttttataaatgcagactcagctcagctgctgttctgttccttccacctgtgttgcatcagaatgattgggagtctttatgtgtaactgactagccgcctagggcaggctcttaaacgaaccaaactcttacagctgctatccctgatgtctgtgaggaagtactgcagttgacagagttgattttattatggcagaagtcaatttctaagggacttgttaatggagtcattgttggtactcatcatcaagctttatatttatgcacttgaaatgttaagctgtatccagtgccattccatatactgtatacaagatactgtctcatatgtggaccccttcccatcttcagaaaggtacatgtcttccaggttgagaagagtggatcgtttaggacctttaacataaacaagttacctgtaatttaaattaagcagaattagctaggtaatgggaccatattaagtaatgaggagatattcaaacccttatgacctgaaaggcagaagagctagttttagttatgtggttcaggcctaggggtggtatgaagaatgcccttcaaatcctttctgtcagctctccaggaagctttccctgaccctcaggtcctcatgagctccttcccttctggtcgtcgtggttattttatactgtgaactacaagcattagcacttcattatgaatgatgttctatacagatatcacatgtttgatagtttaatcttactccatgggctatagctaaatgtttttgaatgtttattttacctttgttagcactgagttttttctctaacaaatttatgagtaagaactaagtaaactgttcttaatctatagcatgatgttgttgggttctatgctgtgttaaaaaatgtatatattatagatagattctgcttcaataagcaattttaagttacttttccagcttggattcctatccggtaacttctaagtaagaattgttttctatgtatgtcatatgttctgaaatataatttcaatcaattacacatatgattcttgatgcaaagagatggtttcaaattacctaaaattgtaaaataatatccagattctattaaaaacaaacctcacaatatatgaattttctaatctagatgtaatgtatttgctctttaattttcactgcatgccttattttccaatcatttttaatgaatacttaaaaatatattaaaattctgagtgatctcatgttgattacaaataattgagtttttaaaatcaatgagtaaagtaattgaaacacaaatttgcacaatccagattttcacagttcacaattggttacgatattaactaaaatatattcttttcacagaaatgatggaacaagacccaaaatgacaccgtatgtcacttacctttacctttttaaaaataggttgtagatactttttgggagtagttttctcattggagtaaattttaaattattttcttctattgaaaggtaatgagataacctttttcatatttttcttgtctaggaaagtttaatgctcttgtatggtgctcaatcacagtagctcatgatttggtttccttctttgtattgtctgtttaaactataatgtaacacctattttgttttatgtatatatatgaattttttttttttttttgagacagagtttcgcttttgttgcccaggccagagttcagtggtgtcatctggggtcaccataacctctgcctctcgggttcaagcgattctcctgcctcagcctcccaagtagctgggactacaggcacgcaccaccacactcagctaatttttgtatttttagtagagacggggtttcaccatgttggccaggatggtctcaatctcttgacctcgtgatccacccgcctcggcctcccaaagtgctgggattacaggcgtgagtcactgtgcccggcctgttttatgtattttttttaaactgccccttaccttacttctttatagaagcaggtgtggaggcataaataataataaaatatttgattttcagtatatatggtagttcattctgctatatctaaaataattcatcatctgaaattgtatatgtagtgctaactttggtgctaatgtatctttttcatatgaaaatctacccacaaagaatccaggtaacatttggaatatacattttgtttatataaaatataaaacatattttgtatgtatgttatgtatactacatataaggattttggaatatatataaaatctttattttaacagctttaaggactccaacttaacatttatgatgaggattctcaactctatcaggctccagtcccaataacaattttttaataaatgatgcaacctatgtaaacaactctccaaacaatatatgtaaaggagaaatacaaggatagtcatttataataaaatgtttatttaatatgaaagtgcttctgcataactgcagtagaagacatgataagcgatcagatgtttttgcttacgtatagaatcaccacgaatgctgtatctacaaatacaaattgatataggaatgttgtgttgggcattcacatgccatgaaattgtgaacaatcctttgtgaagttctgaacagagccaagtacaatattctctcaattacacagtatttgcgtaagccctagacaaattctgtgaatattaaaggcatgcaaaaaatacgttgtttacatgtataactttgtttacatgtaaaatatgtgtttgtatgtgtttttcacctctgtatgtctcacagacatgttaaagttaaatggggcatggagtagttcttccttgggtaggacatttggcattcctttccccttacctcagcagatgccaggagtatactcacacattgttgttaccacaatactgccccaaattttgaaaatatctctgagtgggcactcttgccctccattgccacaactgctttatagttaccatttgagcttgaattaaataagcccgcaatcagtgtctaaggtgaaattatatttgcatatagtttggtaaaatcagaaggaagaaagcacctgggtgcaggaaccatttctgtctggcaaatttgttgcagtgtattggtctaggtcaggtgtatcttgatgcagggtcagggaggataatgcatcagtagagattgccatccattgtagtgtcagagcatgcagaaaaacacctgtgtgatcaacagacccagtggtaatgagatttgaaagtccatagactcccttaaaacctaccatgggaaaagaaatggaggaagctttaggagaaaaagatggtaaaaacagatgctcttgaatcctgagacaaaaaccttgaggtggagtgataatagaattaaacatacttatcaaaatctgctgcatttaaaagtgagacgattctgagaaactactagcttgaagagagattgataaatgtattgctcaaaagataatttttattagattgtatttgtgttatattttgtttttgctgtccttcactgtcagctttgaaagatatcttgttctctgactgtgctttcatagacctccatccatacataattgtagacagtgttcattacgagaaaagaggaatacaggagtgttctactcctttagtcagggtcccagctcttggcaggcattcaggaaattgcacctggaagcaagtacacccatcttcttttcttatgattttactgatttggaagggtttgaggttactagagtttgatgagtagaatgaatgagaaaataattacgaaggaaaagagcaaatagggaaataagttaaagaagtgttgatgaacactatgaaacttcattctgttttaaagaattaaacaaaatttgataaaagttacactcttctgggtaacaaaagcaaaataagttttttgcctttggcaaatgtttatccctggaaaatcagaatgcctcagatctttcattagtccattttgatattctttttcttaaaagcatgctttgatttggaatttttagagctttgaatacatcagattctttttaaaactctgacgctgtcaaatacatcagcttgtggttttcaccattgtgccttatctaagtaatatttactaagcaactctggtgcaaaaatcctcatatggaatctatatcttgccaagtttcctgtatggatttagaccatgttatttgtattctatatggaaaagaataccataaaagctttcctgagattttatctaaaagttgctactgcaaaaatggagagacattcaaataacttgaactggatttaaacaaaaatttttctgtgtgttacggctagatttgttgaatagtatattctaggcattaacaaagtaaaacagttatgaacagttgttaaataatattgaaaatatatattttaattatacttttagatcttttaattaatttatgtagtatgacttttatgtaaccatattgtattatcgtttttcttgtagggaacaaatggccaaagaaatgtcagaatttttgagtaggttagtgcagtgtaattgggggaaataagtgttcacctcaaaatcatatttttaaattacttttgattatttggaccagaacctgttacatgagtagcctagtctttctatgtaaagtgatatttctttctgtacaagaaatatcacttctccctcaccccacccaacaaagaaaaagttaaaaaccagtattccttcaaagtcatggggataccattggcattttgaatgggacagttcccttggcagtggaactctactgcttatctctggcctccaccaactcagtctcagtaggggacttcttcccctcatcatgacaaaatgagtattttgcaactctccctggggtggtgctgcccctaatttgggcaccactgtgcgtcgttgaagaggaggtagaggaagaacatgactcttgaggggctctgcactgtggcacatggtttgaaaaccactggtgtaaattgagccaccagcaggatctggtccattacttttataaatggatatgattcactaacatgttaattcttaattttgaagttacaaagataattaaaagtgttaatatattaacacttaaaaatcagtttgctactattgtattctttacatgattgtctttatagcaagtctgaataatcagcaaattacccctttactattttagtaactccagagatgggggtggggaaacatttaaatgtgttgcattgatgtacttctttggatgctatgttttttagtagatgtacttttgtttgaggtaataggaatgaaaagttagggatattaaaaccatattttaagcaataatcatttgaatttaatgtaatttttaaaagtatcaaaacacattttacatatattctaataccttatatacattctgacaattataaaactgtatattatgtcaatttacctcttctttcaaaagaaaagataacaacaaaaacaaaacttaataattttcagctgccctcctagaaaagactcccagaacagcttaaaaataaaaggattttttttgtttattgattggtagtttagggatgtagaaaagacaaataatatttgaataaatataaaagcataatttattgttaaggaaatgagagaccttgctgatacacagctggccatttttgagcaaagcaattaagaccaaaaagctacatggaaaattgccacttagaccgcttatgaaaagtatagattctgcaacaaagctaaaacagattttaatcataaaaatacaggaaggactaatggccacacattattcttttttttttttttcttctggaacatttttttaaaaaaattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccctacaacagtccccagagtgtgatgttccccttcctgtgtccatgtgttctcattgttcagttcccacctatgagtgagaatatgtggtgtttggttttttgttcttgcgatagtttactgagaatgatgatttccaatgtcatccatgtccctgcaaaggacatgaactcatcattttttatggctgcatagtattccatggtgtatatgtgccacattttcttaatccaatctatcattgttggacatttgggttggttccaagtctttgctattgtgaataatgccacaataaacatacgtgtgcatgtgtctttatagcagcatgatttacagtcctttgagtatatacccagaaatgggatggctgggtcaaatggtatttctagttctagatccctgaggaattgccacactgacttccacaatggttgaactagtttacagtcccaccaacagtgtaaaagtgttcctatttctccacatcgtctccagcacctgttatttcctgactttttaatgattgccattctaactgatgtgagatggtatgtcattgtggttttgatttgcatttctctgatggccagtgatggtgagcattttttcatgttttttttggctgcataaatgtcttcttttgagaagtgtctgttcatgtcctttgcccactttttgatggggttgtttgttttcttgtaaatttgtttgagttcattgtagattctggatattagccctttgtcagatgagtaggttgcgaaaattttctcccattttgtgggttgcctgttcactaggatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatgactagccagttttcccagcaccatttattaaatagggaatcctttccccattgcttgtttttctcaggtttgtcaaagatcagatagttgtagatatatggcgttatttctgagggctctgttctgttgcattgatctatatctctattttggtaccagtagcatgctgttatggttactgtagccttgtagtatagtttgaagtcaggtagtgtgatgcctccagctttgttcttttggcttaggattgacttggcgatgcgggctcttttatggttccatatgaactttaaagtagttttttccaattctgtgaagaaaggcattggtagcttgatggggatggcattgaatctgtaaattaccttgggcaatatggccattttcacgatattgattcttcctacccatggatcttccatttgtttgtatcctcttttatttccttgagcagtgatttgtagttctccttgaagaggtccttcacatcccttgtaagttggattcctaggtattttattctctttgaagcaattgtgaatgggagttcactcgtgatttggctctctgtttgtctgttattggtgtataagaatgcttgtgatttttgtacattgattttgtatcctgagactttgctgaagttgcttagcagcttaaggagattttgggctgagacaatggggttttctagatatacaatcatgtcgtctgcaaacagggacaatttgacttcctcttttcctaattgaataccctttatttccttcttctgcctaattgccctggccagaacttccaacactatgttgaataggtgtggtgagagagggcatccctgtcttgtgccggttttcacagggaatgcttccagtttttgcccattcagtatggtattggctgtgggtttgtcatagatagctcttattattttcaaatacgtcccatcaatacctaatttattgagagtttttagcatgaagggttgttgaattttgtcaaaagccttttctgcatctattgagataatcatgtggtttttgtctttggttctgtttatatgctggcttacatttattgatttgtgtatattggaccagccttgcatcccagggatgaagcccacttgatcatggtggataagctttttgatgtgctgctggatttggtttgccagtattttattgaggatttttgcatcaatgttcttcaaggatattggtctaaaattctcttttttggttgtgtctctgctaggctttggtatcaggataatgctggtctcataaaatgagttagggaggattccctctttttctattgattggaatagtttcagaaggaatggtaccagttcctccttgtacctctggtagaattcggctgtgaatccatctggtcctgaactctttttggttggtaagctattgattattgccacaatttcagatcctgttattggtctattcagagattcaacttcttcctggtttagtgttgggagagtgtatgtgttgaggaatttatccatttcttctagattttctagtttatttgcgtagagttgtttgtagtattctctgatggtagtttgtatttctgtgggatcggtggtgacatcccctttatcatttttgattgcgtctatttgattcttctctctttttttctttattagtcttgctagcggtctatcaattttgttgatcctttcaaaaaaccacctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgcgttgaatgcgtcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgaattctagtttcattgcactgtggtctgagagatagtttgttataatttctcttcctttacatttgctgaggagagccttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttccgtctcgttgatctgtctaatgtggacagtggggtgttaaagtctcccattattaatgtgtgggagtctaagtctctttgtaggtcactcaggacttgctttatgaatctgggtgctcctgtattgggtgcatatatatttaggatagttagctcttctttttgaattgatccctttaccattatgtaatggccttctttgtctcttttgatctttgttggtttaaagtctgttttatcagagactaggattgcaacccctgccttttttttgttttccatttgcttcatagatcttcctccatccttttattttgagcctatgtgtgtctctgcacgtgagatgggtttcctgaatacagcacactgatgggtcttgactctttatccaatttgccagtctgtgtcttttaattggagcatttattccatttacatttaaagttaatattgttatctgtgaatttgatcctgtcattatgatgttagctggtgattttgctagttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtgaagtattttatttctccttcacttatgaagcttagtttggctggatatgaaattctggattgaaaattcttttctttaagaatgttgaatattggccccaactctcttctggcttgtagagtttctgccaagagatccactgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattgggtaagttctcctggataatatcctgcagagtgttttccaacttggttccattctccccgtcactttcaggtacaccagtcagacatagatttggtcttttcacatagtcccatatttcttggaggctttgttcgtttctttttattcttttttctctaaacttcccttcttgcttcatttcattcatttcatcttccatcgctgataccctttcttccagttgatcgcatcggctcctgaggcttctgcattcttcacgtagttcttgagccttgattttcagctctatcagctcctttaagcacttctctgtattggttattctagttatacgttcttctaaatttttttcaaagttttcaacttctttgcctttggtttgaatgtcctcccgtagctcggagtaatttggtcgtctgaagccttcttctctcagctcgtcaaagtcattctccgtccagctttgttccgtggctggtgaggaactgtgttcctttggaggaggagaggcgctctgctttttagagtttccagtttttctgctctgtttcttccccatctttgtggttttgtctacttttggtctttgatgatggtgatgtgcagatgggtttttggtgtggatgtcctttctgtttgttagttttccttctacagacaggaccctcagctgcaggtctgttggagtacccggccgtgtgaggtgtcagtctgcccctgctgggggtgcctcccagttaggctgcttaggggtcaggggtcaggggcccacttgaggagacagtctgcctgttctcagatctccagctgcgtcctgggagaaccactgctctcttcaaggctgtcagacagggacatttaagtctgcagaggttactgctgtctttttgtttgtctatgccctgcccccagaggtggagcctacagaggcaggcaggccttcttgagctgtgatgcttcccagttggagcttcccggctgctttgtttacctaagcaagcctgggcaatggcgggcgcccctccccccagccttcactgccgccttgcagtttgatctcagactgctgtgctagcaagagactccgtgggcgtaggaccctccgagccatgtgcgggatataatctcctggtgcgccatttttttaagcccgtcggaaaagcgcagtattcgggtgggagtgacccaattttccaggtgccgtctgtcacccctttctttgactaggaaagggaactccctgaccccttgctcttctggagtgaggcaatgcctcgccctgctttggctggcgcacggtgcgcgcacccactgacctgcgcccactgtctggcactccctagtgagatgaacctggtacctcagatggaaatgcagaaatcacccatcttctgcgtcgctcacgctgggagctgtacatcagagctgttcctattcggccatcttggctcgtgcctccacattattctttagctagtcttatatgtaactaagaatcactatgtcaaagaattttaagtatgtaggatgaagtatgctattttttattttctagaatgaaagcatacagagaccttttaaagaagcaagggcaccttatttatttcattgttaagcttagtattgaaagaataatttcctttacttcaggaagaaagtgacatattctcagacatcatttttcaattaagtatgtgtcttcactgcttgccaggatggctgttatctttcaaaatgtaaaagactgagaaaatacatgtttattttcaggtattatatcttgatcaatcctctttaagaggaagtatattttaggtagtaggtggataatggagaatttccttgtgtcacacctaagaagcaatatttttgttctttaatagttagttagtttaatattttgtgccaccttcttttcatgtcttgaaatgtgatgtatttaaacgcttctcgttaccttgagcttaaagtcttgcagcttattctgagtgtctgctatttgcaagtgtaatcttttgctgaaaaataagtttattattacagaaaagaaattgttcccatattttctgattaatgatctcaaattatatgcataaaagtcttaaaggccaggtgtggtggctcacgcctgtaatcccagcactttgggaggctgaggtgggcagatcacttgagctcaggagttcgagaccagcctgggcaacatggcaagaccccatctctacaaaaattataaaaattagcctggcttgttggtgggtgcctgtagtcccagctatttaggaggctgaggtgggagaattgcttgagcccgggtggtggaggttgcagtgagccaagattgtaccactgcactccagcctgggtgaaagagccagaccccttctcaaaaaaaacaaaaaacaaaaaacaaacaaaacgcaaaaccaaaaaagcaggccttaaagcactgcgtagcactgttttgaaaaagttgaatttatttcattttattgactgctttggattttatttctttcctctttccccatatgtgctactaaatgagtcatgatacagcacttgtgccctttgaaatctctgttatttacctcatgagctaaaacctcttgaatttactagttttcttattacttatgagggtgtgttttttgtgtgcttatagaacttttctaagtgttcttatagcagtgaagcctacaaagtaagagtttccagattccatccgttcttttagctgacttgaatgactctaatgcagtgggttgcaggtttggctacttacctatgtactctgtaaacatccagaggcccagggatattctgagccactgtgtgtgaatggagtttggccatctgtagatttccgcagtctctccaggtgatcgcactgtgcagcctcattgctcataaacaaaactttaatatgcttttaatgatctttcaagtgtgttgaggatttctttcttgattttgaggaatatatgtcagtatatttttcaactttaagtgttcgtatatatattagtaaaaacattgaaactgaagtctgggggaagtttgtggaactagaatattagaatcaaaagtttggatttaaaatctaatgtgactatcgagtggcatgctggaaatttttaatttatttggccatcttttagtatgccattcttaatctcatctgtcaaagaaacaaaaattatgtttttctagtagctgtttccggttttcaaacttatgcatgctttcttgcctctttagtcaatgttttcttcatgtttctggtttaaacatgcaaaaatgtgtaataattacagaggtcctgctgtactagccaccaaagcagctgctggtactaagaaatatgatcttagtaaatggaaatatgcagaactacgtgataccatcaatacttcttgtggtaagtgtttggagaagatcaaaaatagaaaatgttcatagtgataggtgataaatacctagattagggtgaggtgtgtgtgtgtatgtgtgtgtgtgtgtgtgtgtgtgtgtatgtgtgtatgtacatataatacctatattatctgaatcttttggtccatgaatgcacagtaacaaatggcaatgcagtgctttctttttaaggctatttttcttcccacagaacaattagagtaaaatactatatccagaggatcccacatagttatgttcttatttaaatcacagtgtttgagttcagaaaactatgagtaggaacgatgaattcagaaaactatgactagaaacaaaagtatcataattgtacataatttctcactacactttcctccattgagtatatctgcataattataaaaaatgtcttgcttgtaaatctagtttgtattttatcacagtgactttttattctattgtcaagacttgttgccttcgacaaattgcttaatgtttctgatgcaattccttcatataaaagacctgtttagttcagagttcttctgtggagcagatgatataagatagtaacactgtgtaaagaaatgatctgtgaatttgaacaataatattataaaatgcttatccttatgaataattagcttacttttgattttgtaccattaatttaaaaataaaaaaatctccttatgcgacagaataattatatcattatgttagacgaataaattaacatgtcaattttttttttttgctcaatgtaatcaatagatattgagctcctggcagcttgcagagaagaatttcataggagactaaaagtgtatcatgcttggaaatctaagaacaagaagagaaatactgaaacagagcaacgtgctccaaagtctgttactgattatggtaaagagaaatctgtacttttgaacgttttaaaatatatgtatataaatgcatgtatctgtacttaagacatgggtaaaatgtcccatataaattttctcctattttagaactgtgagccattgaacctaatacagccttgatggcctatcttttatagcgttatttttatgagtatgtctttaaactcatacttgttaagatatattgaatttactataattgagacaagaattttcttgtctgaagagggtgtgcatgcataattttcacacacacaaacacgtgcacacactcacaagattaaatgtgaaaatgtcaggattgccatgcatcttttaccttacatgtgaaatgaattttacatatgaaaatgagttgctaaaaaggatgatggttagtttttatttttaaattttctataatttttattttttaaataaatagagatgaggtcttgccattttatccaggctggtctcaaactgctgggctcaagcaatcctcctgccttggccttccaaagtgctaggattataggcatgagctactgctcccacccctttttctaatttttaaaatttaatgtagctcagtttttagaaatagttccctgaaatacccaatattgttatcttttttatttgtaggtataagtacttttctgttgctcccagaatagggttatagcctggaaaaagaaaggaattgattcatgcattgtccatttacactctaattcctttgtttcaaaaataattttactgcaaacattattttacaatactgcaaatatataaaagtgagaaatattaccttgcttcagactagtgttttgcctagatcaagatttgattttttgattgggatcctgaacatggattttgttactttgttatgcaaaaggccaaggtgtatacttgaaattggaaagtagagtagaagagatgtaacctagtacaagcatgcatgagctttaacattaactgagaatacgtgtgatatgcgagttgtaatttcaatctttaaagcaataattggacttactgtgttcaaattggcacaatttattcgcttaattctggttaacatcaaggtgacagcagattcaatattttgtgtgtttttttcccctaagcggtatattcccaacagttgatagtatagtttagcaatgcaggacccaaattgacttaaaaaatgagttcttggttatattttgctttcctcactaccttccaagtaaataaaagcagtgtttaaataaagtcaatttaatagtggaattctagtgtttctaagttgttgcaaagaatagattgagtgagggcaatattattattaataggggtaatattagtgccagttattgctccaggggtgtcagtcagaatacaggactatgcaagggcagtgggagatcacttgtaaccaagaagtggcaggtggaagccccactaaatattgtgacactgctctcttctccagtttcatatttttcctcttctaattgaacacaacaaaatgattacattagctgttcactgtctgtgtagtgagttctgaccacagattacctttgttttgcaaaaaatgacagtgagctgttctttttagctgtaaatattataattactaactttagcttgacagactttcattatattgtatttcaaaattaatacatctgagtgatcacacttcttaaaaagaggttcatgttgtaatatttggcacacacattttaaattaatgtacacatatttattgtatttgtgactcaaactttgataccttattcatctagctttacccaaaaaagttgcaaataatacgtggctcaccttgctggttcaactactgtttctgtttgtaatatattatttaagaaaacaaaagagtagattaggaaagcttcctaagggttctatcaaggtttatggacaaatttaggaatttatgtgaacacaaccccacacatacatattaagccttcagagaacttgattatgagtcattttcaggatatattttatcaaatgtaacttctgctctgaaaagtacttttttttgcttttctctttctctttatgttcttcctcatacaaaattcatcttgacacaggagcatagctaaaagcaaaggttaaagagcaccaagaagctcaattgagaaaattctatacttaaatgatttcctaatgtggcagctaaacaccctttaaaaggaagtgctgtgtagtctaatatttagaaggaacaattcattaatttgagaaaataaaatgatgacaacttatgattaacaaaaatgtagcttcgtattgttgacttaaagagtaataggttgacagctaatggtaaactcttaaaataatgcataaggagcctcagaccctcttcctggtacagtcctggatgagcatactttcatctcatttactgcagagggagattttttagaaataattttttggtcagtggcaaatcacctagtaaatatttatagtaattaattgtttaaaacaatgattttggaaagtagttttattttatagtttataaaataaaaatggcatgagtttaagatttagagagtttaaaaaaagcaaaacatactgttaccaaaacgtagtaacgtttttactcctgtaatgtatataattttttgatgaattctcattattttctatgaaaattctagtaatgtatgaaaggtactataatgtctattaagtcattgtattaggtttttgtttggatatgtgttccaaaaatcacaaatgaagtatgattttttaattttggtcctctttatatgtgcttcaatcagaatttcctaagcctaatgagtcaaaatagccttttaaaaaaatcagaaagcagcacctgcttttaggtaattctgagaatatttggcttgtggataggatatttacttttcagtcaccacctcgattggaaggctttataaattagaaaaatgctcatttaacagttttggcatttttatcttttcttcaacataaaatatttgttcacagattttgcaccatttttgaacaattcacgtaagtcaatgggtggtaactcatgagctaactggaagatgggttaaaatactttacaaagtactaacttctattaaaagttgttttgctacaattttcagtggaattgtagtgtgttaaagttgttatatccatactaagatatattttaatttgagatgatgctttatttggatcactccaatatgtatatgtattacaaaaaatctagtgaaattaatgttttatcaaattacttgcattaagaaaatgactagcattttaaactgagagtatgtacaattcttattgtagcaaaactcttaacatagcagctgaccttttagaataaagactaacttttaggtgctggtttttggttactgtattttcaaacactgatggtgtctgcatttctgccaaaggtattttagttttatagataatgtgatagtgtataaaggtttaataatgatacctccttaaataggaagaggagattattctgttacgtttatagcctcttatgatacacattctttgataatttaaaagctttgagtcaccttagtgcacagtaaatctcttgtagaattagttgattagtaatgatttggatataatgtcacattcatttgccaactggttggacctgatgttttgaagtgcttcttataatttataaggctgtatttgaagattacacaattgaatgtgaaggaaagttatttagaatattagtttcaagcttttaatgtctgtgtctttgtgtttttccagataagtattcgtttctagtcttccccaacaaaatttcagttctcctgttagtaagaaaagctatcaaagactttctatttagtttctgaattttatccagtatcttaacttacaggagacttacttcaaattaaaaagtaggttaattaatgaatgactatcagtatcatggtaaatttcctgtaaactggacattaaattctaattcactactttagatggagggaaggtttttaaattcttagttttgaattagtacattttcaacaatgtagggagttttgaaaacttaaaagtagaaacactgaactgtaagtagctctgggaaaacaggagcaaaagaatagataagcagatgtctgttaatatgtgatgcagcttttaaagttactaacaaaaccgggcctctcgttccttcatagggatatatagctttgctaactgctttttgctttctctggtttgcaaagaaataaattcaactgctataaagcttttgctatttcttggtgtaaaaagtagagtaagagtattttcatcctttcagtatttgcaaattcttacagaagccatgtggctcttcttggctttatatcatatgtacattttacaatatttctttgacacacttggattttcatagtgagactcttaactgagctgctgtaaatggttgttccacttttgaagttctgtgagtataaaacagattaaacaggctaaccaaaattatgctgctaaagatgtaaagtcattgccccagggaaatgtttacatttgcagataaaagaaaaacctaattgttaagtaatgaaaattgagctaggaatgaaagattgatatgaatgaaatgcccagtactagtagaaaagcaaggatttttcttttcttttggcaaggagaatcaaatgttacatactttgcacttcattggattttattctaagagaaatctgatttcagagtaagtaaatatctttaagggaaagtttatgcttactgttataaggttttttttgtcatatggttgtctaaatgttgttaatatctatgtcattgtggtcattttaaatcctaaaatttgttggcaaaagaaaaaatttttatatggcttctactttttgtggaaatagtgattaaactgacaaatgtctacatccttcagatttttgaaattactgtttattttgttctatcataaatagttgaataaaagttactgtacaaatttgaactctttacaggaagaatataaatctagtaaataatagtagtttgttttcctgccgtgtgagtttattttaggttactgttacagtgatttgtgggaatctgacaggggtttgttgctggtagtggtggtggtagtggtatgtgtgtgtttgtgttggcaatgctaagaaacatcttaagggaaagacaattctaagaagtaacactctgaattttattaatttgtaggcaataaatattttcattttgttttaaatttactattagggacctttcttctttttaaaaaattattggggtatattttaggattaaaggctcttttcttttcccttgagctgctggtataactttccttgttctgtgtaatagctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtgtgtatgattcacatggaaaacaaattatagaacaaaaaagatcataaactctctgaatgaaacattctaatgtataatataataatttattacatttcagggttgagggatggagtcttgcggttaaatcacatttccagttcagtgaggattaactcatttataatgtgaaattgcttggattaaattatgttcttagcacatagaaacttgtctgtatcctaaaaacctttccatttgtgtttcatcatatccattgatttgtagtggcttgaggaaatgtagcatttttattaactctggtaacttgtttgatcaatagcagtgtttattaatattgaaagggtccttgatgggggacaaattttaattgtttctggtgattttattaagcagatttccatcttagagaaaaagtcttaggaagttttcaaatctatgagaattaataggtatttcaggcatacaactggtaagaaatggtcctgaagagagagatggtaattttctgatatctcatgaatacaggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagtaaaatgattctctgtactgctttttcccccagtttttagagaccctaacctttgaaatgaaattccagtgatttcttttttccctagaaagattacctcagttagggaagtatttcccagctgactagtgtttgtgagccacagacactgtcttcagaattgcttctctcatgtcttagtagagaaatatttatttattatgatacattcaaatgattgtcaagttaaattaaatggttgtgtctgtgctattgagaatgcaaatgtgattatcttttgaaggctgtattactgcatagcttcacccaccctcgggtcatttcgtccctgtgattggggacagaaggtgtagctactgaagtaaatgacctattctctctcttccatctctcgcctttaactggtgtttttatttgtgtaggatagtgaatgataagcttttttcctaaccagtagtgagtaaagttcttgaacaaaatttagtagccaaattgttttttaatgacatgtctctttagtacaatagttttgtgtatcttttagatacattaataggcactagatggaaaattaaagagttaaacatatttaaatgagagaatctaatgtttcagaaatttgtaagaaatgtatcacagcaaagggttgttataagtccttagtttttgactctaatagttaatacaattatagttaatcttaagccataatgtttctaatcatgtcacacagctgtcctagaacttatctatttaaaatagtttcctgagttaattttggccagc

SEQ ID NO: 15862 - DNA, 22965 bp, Human
ttctactacaataatctattttcatgattggtagaaatttcatttttgagaaactctttgacaaagaagcttagttttgtggtcatctataagagactccattgagatggtcggtattttgaattcagttccaaatatgaaaagggaggatttcttttcctattttttttgtcacaagtcacattttaagatacgaattaggccaggctcacccctgtaatcccagcactttgggaggccaaggagggtggatcacctatggccaggaattcgagaccagcctggccaacatggtgaaaccccgtctctactaaaaatacaaaaaattagctgggcgtggtggcaggtgccacctgtaatccaagctactcaggaggctgaggcaggagaattgcttgaaccctggaggcggaggttgcagtgagctaggatcgctccactgtactccagcctgggcaaggcaacaagagcgaagctccgtctccaaaaaaaaaaaaaggaattatttaactaaaattcacataggaaataagattgttccagctataggtcatactttaaacagggacattgatggcccaaagggacgtcatcagatgtgagcagcagaacaaattaccaatgaaagggaaggtcaaagagaagacggatctgtcccactagaattcaaacaaacagcaattcctccgtgttactgatcgaaaggagaaagtaaggggagaacaaagttgttagtggtgaggctaggggtgcaactggacaaacgttggaagcaggagaggaaaactgagaccacatctaagaaaatgtccatagtaaatgatacccacagagaattcccaaaagaagacgtacaaatggacagtaaataaactaaaaagttaagctttaccagtaagcaaagaaaagcaaattaaaagatatgtttacaaagtcactgaattggcaaaaattaaacaagatagtggtaggggcaggcacagggagttcctgctggaatgcagacacaaaacctttctggaaagaaaactgacatactctttgaccaataactccactgctttcctctctccctctctttttctgaggcggggtttcgctatgttgcccaggctggtctcaactccccaggctcaagcaatcctcccgcctcagcctcccgagtagctggaacctcaggcgcgcgccacaactgcagaaacaccaaaaaaagaaaaaaagcttgaactcacttttgtacagaatcttactacaatgtattccagaaaaacaactggaaatcagtggtcatctctgcgtgtgaacgcatgggtgatttttatttacagccgggcgcgcatctccattttccaaaatatccgatatacatatttaaagtcacctgtgttgcgctgctcctggcccacaagcgctaagggaccccagcacttaccttactcgtccacgccgcctcactccctttcactttgtggctgtcagcaaccacttctcggaagagcccgggcgcggacagctcctttcatcagccccaagccggacaggaccctaagaccaagtcacccaggggctgttgcctagcaaccctcgtggccccgctagcgggaaggaaaccgaacagaaaacgcacaagcgcagaaaagaaactcctggccgtcggtcggcccccgctcaacagcccaataaacggaagagcttctagtcaccgcccaccttgctcggctctgaccggaagctaggcgtcacctccgcccgtattaaagatggtcgacctttttcccctccttttcctgcccccagactagaggcgggatgtagtctcttaggctaagagtgattggtcacaaggagactcggaagtgtctgatcagagccccagaggaggccttgagagcctgttggcgtaccgttccacacttggatccaggaatcgggcgtgttccaggctgctctctatggtagctttgggcggatagagggggcgcgcaaagtattaagggacaataatggccgctttcaaggtgtggattttggctccttgagcctgtctgagcgaggggtggcagcgccggcgccccagaatccgggacagaagggtcccaagagtcgcgcttggtgaggtgagagtcccttcttccttcctggcctgcccttctgtaatcatggcggctctaggcggcggatattggtcccctgctcaggtccgggccccagtttggggagttcctctgtcgtccctgtcacccaccttgccttactcacctcagggatgctgcatccgtcctggccgccttggccttcctccttgctctggtcaaatcctgctgcctggagcggcctcgctgagatccagggatgctgcctggagtggccttggtccctctcccaggcctccgctttaacccaccccagactgtcaccgagcccgagtaggactccttgtgtcttcctctgctctctcacagtgtcatttataccaggcaatctggtgggcgatctcttctactagaatgtcagctccaggtgggcggggatttttgtcttgttctctgttgctatcgccgagaacagcaattggctcagggacaccctcagtgaataattgttgaatgaatgaatccaggttctttcttccctggctttctcgtacgccttgtagtttctttgccattaatccttctcaagaatcttgctctttagctccttatttgttcgtctcagcagctaatgaagttctctctggctgtctccttgtcctgtgttgctggaatcttcccttgctgtctccagaaatgtttgggttcctgtcctcctttaataagtttaaattaattcattttttaatttatcaaacgcttattttgctagacattgagctacagcagtcaacaacacatccagtgttctctcaactgcgtagaatggcagtccagggtacctttcctagtttagacaactattgagtagagcctgtatatctttaccttcttgtgtggatttcctcacatgcgcacagatgtcaccaatatgcagctttctttttttctgttctgcctgatggcattttcaaaatgtaactcttgtttctgcattaatattatgtgtccagtctgtttggcaatactctgtagagctgtgcatttaattagagtttggtaaacaattctggattctggtggcatctcctttgctttgctaacttgttggaatgagaggaattatccaagcatccagaactgatatatgttgatgagtggcagatgtgtagtgagaggtaaagaggagcttgttccaacttgagtgccagaagtcttgtagccacttaaatacttctcagtaacaccttttcctaacctggtgtttctcataaatatttttggtgaacatggattgttattaaactgattttggctgctgtgagtaaattgttttctgtaaaacgcagctaggccaagaaaagccactaaagtatggagaacatggacggtagccttctgccccatctctgtgctgctgtacctgttgtttaaagagaggaagaggtagaactcatgtaaaaaaatgggtgagggaccaacagtatataggaggatagcaaataatacaatgtagcagttacatttatgttaactgttatggttacataaagagctactctttatggtttcacatacactttttgtttgattctcacaatagcttcatggattagataaggtaaaaattttttccatttaatagatatgaaattatggctaaacaaagattaagttatttgcttaccatcatacaggtagaaagtgtcaagagcctggtttctaattgaggtttctgattcaaatttagtggtgttttccctacatccctgttacagctgctgacatcaggctctagaaagtgtcccttagtgagactttttattgcctcttggatctttgtgggggctggggaggaatgtatggggtgtgtgtgtgtgtgtgtgtgtgtgtgtatctattttggtgtttattgggggttggaataggagaatctttggagataggcagtgacttgatggaaaggtcttggagagagggagcaaaagtagtcctggtcttaaggggagatggggaaggttaatcacctacatataaccataactgcatttattgtgggatatagtagagctgagccttctctagtaccaaatggtttgccttccttccagagaaatcccagatcctgtgatgggggacaccagtgaggatgcctcgatccatcgattggaaggcactgatctggactgtcaggttggtggtcttatttgcaagtccaaaagtgcggccagcgagcagcatgtcttcaaggctcctgctccccgcccttcattactcggactggacttgctggcttccctgaaacggagagagcgagaggagaaggacgatggggaggacaagaagaagtccaaagtctcctcctacaaggactgggaagagagcaaggatgaccagaaggatgctgaggaagagggcggtgaccaggctggccaaaatatccggaaagacaggtaaaggccttagtatgggttagcccagagggaagcgaacggaggctggaaaataacagctcatgtttatctctcagttttcctgttggagatttagagctttatgattttattatgattctgtaatactgaaggtaggtaggaatttgtggggaaaaacaaaggtgaataaagactagatggtagaggttagaaatgccttgggttgttgccatatgtgagcctgcgtcccagggagagaaagtggaaaaggacagatcacttgtttggacagccaaaggttttagggcagagtttttctcctatggaggggcctttaccagttgctctccctgtttcagacattatcggtctgctcgggtagagactccatcccatccgggtggtgtgagcgaagagttttgggaacgcagtcggcagagagagcgggagcggagggaacatggtgtctatgcctcgtccaaagaagaaaaggattggaagaaggagaaatcgcgggatcgagactatgaccgcaagagggacagaggtaaactgtccagcacagttcctattgtccattagcattcgaataaatgtgtcagcctttttcttgttgcaggagtttttgcaacacccatttgttagggagtcctatttgcatgatgtccgcctgagtggttttgaccctgctgggattgggaatactagtttaagaaaagagctgttgcctgtaacatagctgctctccttgagtgtgtggtcttcgttttattatgaaaattgatgataaaggagataatgggtaaatatgtataagagaccagcatttctaatagtattggtgatagagaaaggacagtgctatggaacaaagctagacaaaaaaatccaatgctgtccttgctcagtattaagttttatagctgatagaattgtaactattaaaaaaaatgattcactgtaaactcgcactagtattttttgaattcttgctggaaaataactgttactgtgggtttgaaattttctaggcagtaactatttttcccccttgggagaatggggataggtgagtttcaggagtccacggatcacattcgagcagtgcaggttgcacctgtgagtgagtgggcagcctgtcctttctctagggtgaagatgtgtataccttaggatgggatgcatgtttttaagcttcgtgtgactcttcatagatgagcgggatagaagtaggcacagcagcagatcagagcgagatggagggtcagagcgtagcagcagaagaaatgaacccgagagcccacgacatcgacctaaaggtagactcactgttttggtggcttgtgaggattcaagtgtataaaaggcagagtgagtgactcgtcttcagtgagattgctgaggcattgagtcagaattcccgattctaccatgaacatcttgggatagttggttctgagtcaggtgggcacagctctgcacttggggtggatatggttcctgtaaggtgagaggctggtttgctgaatggccagttttccaaatggtaggaaagaatagggagctggaggtagaagaagtgtttattaaaaagaactacttatatccaagaagggtgtgtttgtagagataaagtaaatatcccttaaaatgttgtcataaacacagaatgcaaactggaccattggctaggtgcagtggctcatacctgtaatcccagtactttgggaggctgaggcaggcagattacttgaggtcaggagttcgagaccagcctggccaacatggtgaaaccccatccctactaaaaatacaaaaattagcctggggtggtggtgggtacctataatcccagctattcggtaggctgaggcaggagaatcacttgtacccgggaggcagaggttgcagtgagccaagatcacaccactgtactccagcctgggcgacagagcaagactttgtctcaaaaaaagaaaaaaaggaaaaatacatcctggaccattaaaaattgagatatctttaaaaactgtcaaaaccgatcttaaccgttatagatacatgcaaggtttagaaatagtaaaaggagtaaatttggggaattgacttttggcaactggttctagaccatgtcatggttaagtgagatgtttcctgtggatgtgtcttttgtggcccagatgcagccaccccttcaaggtctacctgggaggaagaggacagtggctatggctcctcaaggcgctcacagtgggaatcgccctccccgacgccttcctatcgggattctgagcggagccatcggctgtccactcgagatcgagacaggtgatgttctgggcagagcagcccagtttcgctgggtgggcggtaaggagcctcggcagggagagcagatggtggccaggaggacgtggcttagctcagtgacagttttgtgatgctggtgctgctgttcccaggtctgtgaggggcaagtactcggatgacacgcctctgccaactccctcctacaaatataacgagtgggccgatgacagaagacacttggggtccaccccgcgtctgtccaggggccgaggtgaggcctgtggggcagcaggcagaagagcaggcttgcttgccctagcgaggatgagcaggggctgcccttctggagctgcatggccctgcagatctgtctggggccgctggggacaggccagggcatggactgacctgcttcctgtgctcctccaggaagacgtgaggagggcgaagaaggaatttcatttgacacggaggaggagcggcagcagtgggaagatgaccagagggtaaagttttatacctctgaggggctgatcggggctggtggccgtctgtagatgggtgaccctctagcaggactgggctttgatgagggtacacctgagccctgttcagacccaatgccctggagtctctttgcagaggcatagacggcacggtgaaccctgtcactcactgcagtaggctgacctaactgttctgttatgtgttggtgccaccatgtggtaaatctaagaagtgctatcgtgatgggctgccctccagtcctgtgtagttgcccactgtggttctccagatggcatgtgtctgcagggaggcctctcctgcacccctcacaagggtagctccactgcagtagtgacttcctaccaagcgtcccttcttctgttggccatgtctcgtgcataaacttgatctgtccctcactcccttgctttgcctcctgccctgcagcaagccgatcgggattggtacatgatggacgagggctatgacgagttccacaacccgctggcctactcctccgaggactacgtgaggaggcgggagcagcacctgcataaacagaagcagaagcgcatttcagctcagcggagacagatcaatgaggtgaggctgcctgcagaagttggagcagattcagagctggaggtagagcacgtggggaagcagcaggttatccccaagtgagggcagcacagcttgtcccctgattgccgagaagcccagatcctctggaggtggaagaggagtgggtgatgagccttttagtagcttaaggaaagccccggctcgtacttctctcttttgcagtacttccttgaggggaagtactgttgatgggaacaggtgcattgggacctgcctctgtggtctgtgttctttgtgtctctgatgtgggctagggacacttaccatttgtgtgtccctctagaggttctgatttagatgaaaggtgctgctgcttggaacaaactcctgcaggtgatttgggatcagcacctcttctgtctttggagctgtgggtagaggcctgtgacatctttgcagctaccagtggccttctgtcaggacttgatgtgtggacttacctcataacctttcaggacgacctttggggtggcaatttgagtgtggctcccattgtgtcctcacaggataacgagcgctgggagacaaaccgcatgctcaccagtggggtggtccatcggctggaggtggatgaggactttgaagaggacaacgcggccaaggtgcatctgatggtgcacaatctggtgcctccctttctggatgggcgcattgtcttcaccaagcaggtgaggctcctctgtggccagggacaagacagctcagagagacctgatgtgggccaggtgcagtggctcatgcctgtcatcccggcactttgggaggctgaggagggtggatcattggataccaggagttcaaggcctgcctgggcaatatagtgaaaccctgtctcaaaagtacaaaaattagccgggtgtggtggcaggcacctgtagtttcagctactcgggaggctgaggcaggagagttgcttgaacctgggaggcagaacctgcagtgagcagagatcacaccactgcactccagtctgggcgacagagcaagactctgtctcacacacaaaaaaggcctgatgtggagacagaaagaagagaagggagaaaatagccctgtaccatgagagggtagcagtccctttcacaagtagggatcttatgaacatggccttcttgctgattttaacgggcatcgctctttctccccactgctgcagccggagccggtgattccagtgaaggatgctacttctgacctggccatcattgctcggaaaggcagccagacagtgcggaagcacagggagcagaaggagcgcaagaaggttggtttcttggtttcgtggctgggaagtttatgtgtatttttttcttttttcttctcttcataagtcttactaggcccacagatagaagttaggagtcccctctatcaagtccttaggcccgacagctgcggggcctggtgttgggagagctggaggcttgaggattggaatgtggctcggtgccaccagcactctgggggagtttaccacctgcggggtgaagtctgctctcccgtgggattgattttccattgctcgcagtcatgtggcaggatggagcagactgacctttttccttttcaggctcagcacaaacactgggaactggcggggaccaaactgggagatataatgggcgtcaagaaggaggaagagccagataaagctgtgacggaggatgggaaggtggactacaggtgggcagcctcagccagcagcacatcagccttgctccaaagatgggggcccatgtgggcagttgcggcagaacccatcgactttgtggctcctgagtgggagactcttaggatacctctctgcatcttccattctctctggtcccttcctcctggtctcttcactgtcctccacttttcctatatgtgattcctcctccctcacactgcttcctctggtgctggtgttgtgagaggaaggaggcccagggaggttaagtaacttgtctgaggtcacccagcttgtcagtgagggagttaggatcagacccaggccgtctcacatcagagccactctgctgaagtacctcccaggtgttcagcatgggcagctgggttttagtcccttagatttgagttcactataagaactatttttaaaagaggttccaaaatagaaagggttatcttattggccagtgacttctctgctcatagaggcatctaagcagatgctgagttgggattcctgcattgggcaggtggctggacttatctgtcccttaagatcctcatccttcgaatgcccttatgttctactgaacggtcatctgagttaataattctctccactcctgtgtgaaatgtccatacgagaagttggtactattgatcagcccttattcatctctagttaacttaattcctcaggtattagttattgggtgaccaggagggactgggtgaaattagaaataggaagctcagcagagcatggggcggcacatcagacaggaagtctctggggagggggttggggaggggtgtgtggactgtgtggagcactgaactggtgtctttttgccgggcagccttgagaaagtgacagtgctctgcatctcgggtgtgtacatgtgtcagacattgagagctttcagtagaggttgcaggttactgtttagtggggctgttttcacagttctttgaaaacaaaaccgtacagactatgctttcctgctgtcctgccaagaggagggaggaagtttgacccatgtcccgtgctctgcacccttacctcctcacaaggcctgtgtggctattttagccctttagacgttgtgctgaaattgcccgagggtattttctacaagttagtgacctggggattgatttccactcctcttctgctcactctgttttggttagagggtttgctaatatggtgatctgtaaatcctccgatccatgttcagctagctctgttggaccctgtggtgtcgagtgtgttgtggatgatggattctcaagtagcagtttcagtcctgaggtcgatgagaaccatctcagattccctggctgctttggtgtctcagactcttgccgaagtcctcattcctgagcgtaggaaggagggcagcaacccaatcaggaaggacagcatggggcaccatgcagggtgtttaggctgctgtgtgttcctaggacagagcagaagtttgcagatcacatgaagagaaagagcgaagccagcagtgaatttgcaaagaagaagtccatcctggagcagaggcagtacctgcccatctttgcagtgcagcaggagctgctcactattatcaggtaacttcacccggggcccaggaatctagtgtcaagtcaggggtgcccttggtctcccatgtttacccaggagctctttttcttttgtgcattgcacccagtggagaagggaaatacttttttcctctgacctcatgcctggggtacactgcacaaagtaacgggatggcaccattttgttttagctcacctgtttaaacctcaccgtattccagatgtttcaggtgttatctcagtaagaggctgttgtcccagtgaaattctcccttctaaaccggcatgctccctggatagctagtcatggggataggaggtagcggagtcttcttggaggctgggtgttggccttccacttcggctgataagccctttgcctgcttgtccttgtagagacaacagcatcgtgatcgtggttggggagacggggagtggtaagaccactcagctgacgcagtacctgcatgaagatggttacacggactatgggatgattgggtgtacccagccccggcgtgtagctgccatgtcagtggccaagagagtcagtgaagagatggggggaaaccttggcgaggaggtgagtgggcgtgggggctgagccatgtagttattccctagtagcttccacccatttttgctaaagggtgtgatctgctaagactcggaccccagtacggggtgtgctggtggtgagccggtggccagggcatctgagccatctctctgacctccaggtgggctatgccatccgctttgaagactgcacttcagagaacaccttgatcaaatacatgactgacgggatcctgctccgagagtccctccgggaagccgacctggatcactacagtgccatcatcatggacgaggcccacgagcgctccctcaacactgacgtgctctttgggctgctccgggaggtgagggctgtgtggtttggtctctctgcgcatggggtgttgaccagtgcaccaccagtagctagtgggttgctccaggtgtgctgagggggtctctggtaggccagaggttcctgaggcctctggttgcagttcagactcgggttgtagttcatgctgttcttgctctgctgagggtggcttggggttttctgggcagtggctccattgcttcagtcttcatgattggtaagaattgaataggcccatttgtcagctttggcttgtgtttcctcgggggtggtgctgatgggactgggggacaggagccaagggtccccaccatgggggcctccgagccgcctcttctctcaggtagtggctcggcgctcagacctgaagctcatcgtcacatcagccacgatggatgcggagaagtttgctgccttttttgggaatgtccccatcttccacatccctggccgtaccttccctgttgacatcctcttcagcaaggtattgaggccaccatgttacgaactgacccttccatgccacgcacttctctgatgcgaagccggctggagggtggagggtgggtaggggactgggttggagaagatttcctggggaccatggggcaaatggggcagcctgcagctctgggactcggggacaaaggactctgctctgggtgaggttttgtttcattatttctttgaggctgaagtacagggcccagggaggcactgtgccctcttgtagaggcctcgcagtcaggcccatgtggaggtgtggtggccctcaaagtccatggctccattccagagcagtgcctgggccactgggctcccaggagatgcccggcctgcgcttctagtacctccctctgactgtgtccccactgctgttgcagaccccacaggaggattacgtggaggctgcagtgaagcagtccttgcaggtgcacctgtcgggggcccctggagacatccttatcttcatgcctggccaagaggacattgaggtgcgtgccttggtcacgactgtgatgagcgggtgtgtcttgcatatgagaggttagggttccagtgtctcacagctcctccctgggctctcaggtgacctcagaccagattgtggagcatctggaggaactggagaacgcgcctgccctggctgtgctgcccatctactctcagctgccttctgacctccaggccaaaatcttccagaaggtgtgtcagcaggaatgtccaggagtggctcttggagttctctaaaggaagcgagaggggatgtgactgtcctggcagggggtgggctaggaggtaggcttttccccctcgcggagcctttcctgtctcgagggactcatttttccctccctgtatgtcctgctctaggctccagatggcgttcggaagtgcatcgttgccaccaatattgccgagacgtctctcactgttgacggcatcatgtttgttatcgattctggttattgcaaattaaaggtaagagaagacacgggaggcaaggcctgggtgttcaccagaagctaacttagctgcggggtgggaagccagggcctcgctcctggccctgggatgtggggagcgcgtggaagtggtggtggtggtgggaggctcacattgactcactgtgcttggtttgtttaacccttgtaatactcgatgaggtagataatttaacagtagagctcagagagctggtgtttgtggggaagacttcttcaggtgttcatgagaacatttctagagcctcctggctcttcctctgccatgtgtagcaaccagggcttgcctttgtctcaggcctacttccactttcccctcactctgtccttcgtcagctctttgccgtcccctcctaggtcttcaaccccaggattggcatggatgctctgcagatctatcccattagccaggccaatgccaaccagcggtcagggcgagccggcaggacgggcccaggtcagtgtttcaggtaggagccctgtgctagcctgctttctggggcagcgctggggttgctgagcgtggagcccgggcgggggcgggcaggatgctggctctagagctggtccccaaggctggaagctgctggcagggctgccacttgttagtcctttcatcctatgctactgagtggaaggaaggagtggctttccagggatttcagaggtctgaggccaacctacgtggatgtaggtacacatgcaggtaattacagcctgcctcccttcagagggtaggtctggacagatgatgccattggttctttttatttctattgttctctttccccattttctttctttcttttttccaattagagacagggtcttgctctgtcaccccaggctggagtgtggtggtgcaatcacagctcactgcagccttgatctcctgcactcaagtgaacctcccacctcagactcccaaggggctgagattgcaggcaggcaccaccacacctggctaatttgttcatattttgtagagatggggtcttgctatgttgcccaggctggtattgtgaactcctggcttcaagcgattcttctgtcttggcctcccaaactgttggcattataggtgtgagccactctgcctggctctcttccccttttttgttccaattaaaaaaattaatgtattcactatagagcgttagtgaatatagaaaaatatcaagaaaataaaacccagccatgattctagtcccaggcccattggttctagaaatgaaacagatggctgggtgtggtggctcatgcctgtaatcctggcactttgggaggccgaggcgggccgatcacaaggtcaggagtttgagaccaccatggccaatatggtgaaaccccatctctactaaaaatacaaaaatcagctgggcgtggtggcggatgcctgtagtcccagctactcgggaggctgaggcaggagaatcgcttaaatccgggaggcagaggttgggcaacagagtgagactctgtctaaaaaaaaaagaaatgaaacatgtaagaggctccagaagaagggctaaattggcagattggagttttgaataggtggaagtcagtgattcactgaagtagtgggtggggagaagaaatgagaatttcctccctccctgtgggatttcatctgtactggctgctgtggggtttccttgtggtgagaagatggggtcttctccccggcaggctctacacccagagcgcctacaagaatgagctcctgaccaccacagtgcccgagatccagaggactaacctggccaacgtggtgctgctgctcaagtccctcggggtgcaggacctgctgcagttccacttcatggacccgcccccggaggacaacatgctcaactctatgtatcagctctggatcctcggggccctggacaacacaggtgaggcggccccgggagcctcatgggtgctggcgcttgacttccttctttcctctactgtcccgtcaaatatccgggtttgctcatctctcctaggtggtctgacctctaccgggcggctgatggtggagttcccgctggaccctgccctgtccaagatgctcatcgtgtcctgtgacatgggctgcagctccgagatcctgctcatcgtttccatgctctcggtcccagccatcttctacaggcccaaggtggggcagcggctggctcccctctccccggagggctcgaggaagtgttggggaggggaatggcttctctctgtattactgaaatggaacagagggcagaatcagagtttctgaagaatgattttgctgttctcggttaagcaggttggggtaggggaaaggaagggctgggccagtggttctcagggaatgctttggaaatttgcaagagcattttttatcttctagtatggttgctcttgagccctcatgttttagagtagacctttttaaaaattattttaatttttctcaaattgtcagggcaacctattgacatgtttgaagttctatgtgtgggtaggtggtagtgttagaacctctgggatgtgcttagtgggcctggacccccctgtacttagagtgaaggttctttttcccttcctagggtcgagaggaggagagtgatcaaatccgggagaagttcgctgttcctgagagcgatcatttgacctacctgaatgtttacctgcagtggaagaacaataattactccaccatctggtgtaacgatcatttcatccatgctaaggccatgcggaaggtagagtggtggatgagcaggatgttgggatgaggggagggtcgagaggaaaggagggctccctcctggtgcctccgtctcctgccctaggtccgggaggtgcgagctcaactcaaggacatcatggtgcagcagcggatgagcctggcctcgtgtggcactgactgggacatcgtcaggaagtgcatctgtgctgcctatttccaccaagcagccaagctcaaggtgaacccaggagcccagtgagcccctcccagcctgatacctgtataagggcaaagttcttcctttgtcctggtgtggttctgcagatatgggcttccgccaaaggctgtgtcaagagtgttaagggatggggtcgctgcccaaatgggtgttgttttcctgatgtggctgcctgttgtgtctcctccctagggaatcggggagtacgtgaacatccgcacagggatgccctgccacttgcaccccaccagctccctttttggaatgggctacaccccagattacatagtgtatcacgagttggtcatgaccaccaaggtgagtcttttccaaggcacttgcataatgcaggccccctgtctggccaggctttgaaacccttcactgcgttctggcatgagcttttagcctgggagccttgaggccacatgcattgttttgcggggcatgtgaggttggttttcatttggggacttggggaagctctgcacagggttgacctctagactgcattgacctcagctgcatgggcacgattgttccccacttgctgcttgggatgagcaacccctcttggtgtcattagaaggattttcggaggggttgggccttttcttttagatactgggggcattttctcaagtgtggaggagtttggatgggagtatctggggtttttcctttccttttttcagccttgcagggccagggattgggcccttcccatgtggctcctaattgtggaaccactctgggagggacattggccctcctgtgaccctcgcctccctgcccttctgcccgcaggagtatatgcagtgtgtgaccgctgtggacggggagtggctggcggagctgggccccatgttctatagcgtgaaacaggcgggcaagtcacggcaggtgaggattctgtgctcttcgcaggggtgctgtttgcctgtggggtcggtgttccctccgcttggtattgaagacttgcggtcatccaacccacttacttctctctgcaaacataaaggctgtgatccagcaggctgggtctgtctgattccccaccacccactccagttgtttggtaggctgagcctttaaaaacaaaaccaaaaaactcattattgaaaagtccaaatattcatgaaagtgggaaaaacagtacaacaggccaccatgaattcgttgccttgcctctataattgtcaacgtttgttcaatttcactattcctaccccactccacacacatccattttttttttctggaatattttaaagcttatctcatacattattcatccataaatacttgagtatgtgtctctgactaaaaggacttaaaattttaaatataacctctgtgccgttatcactcataaaaaaatgaatacttaatgtcacctaagtctccagtccgcatttggatttctccatttatctcaaagataacttcttatgatcgatttgcttgaattaggatccaggcattgcaactgcttatgtgtgttaactgtttcattctagaacaggctccaccccacgctttttttcatgacattgatttattggagcagccaggtcatttgtcctgtcgaatagtccatatgatgtatttgcctcattgcttgctcacagcggtgtttaacctgtgcctgtgtttcgtgcacttgctgtaagctggcgatgagtccaaccgctcaattagatcccggctgagctgcgtgtggcagagatgcctgcatgtggcactgtgaacctcctcttagatgccttcaggaggcatgtgaggtctggtggccccacctttgctgatgggaggatggatgaggggccccagtggtggcagcctgcctcttccctgataggtttccactgctcctccatcttgaggttttagcgtctgttgatggccattgcctagatccatatttagggttgcaaaatggtgctgggctttggcttaccccttttcgtagcataattctccccacaccaggctcccttgcatcttatgcctgtctcttccagccagcaggtaatcacatcttccctgtttttctgtacttcctagcatagttgtgaacttgatttttcaaaaaagaaggaaatgtaagtacttcctggactgagggatgactgagttaggactgattgtccagtgtcttgagtcagtgaaaaaagcaggcctcagctgcagaagagaaggcggctttggtactggggcaggcagccatgtggagcactggcctggtggatgcagcacctggtttgtggcagggacttgggtgccgacgaggcctccttccttagtggtccccagtaggctcagccaggtctgtccctcttcaataggagaaccgtcgtcgggccaaagaggaagcctctgccatggaggaggagatggcgctggccgaggagcagctgcgagcccggcggcaggagcaggagaagcgcagccccctgggcagtgtcaggtgagctccggccttcgggctctggctggggtggcacccatcccaggaggctgccagagaccaggccctgatgcagggtcaggatttatgggaaggtgcatgtgtgaaggcaaactggtgacagaagttgcttgtgcatttggtggtcacatggatgtgtgggaggagttcctgacagctttaaaggagcgacagtacacctgcagggattcagggcctgaggcagcctggagtagcaggatgggtttcacagctttactcatgagcgagggggttggaaaccccagtgcagtggtgagaagtgcgccttgggcttctgcgtctgtgctggtccctggagttaggccagacttgacaggtcgcaggcacaggcctccgtgagaacgccctcacttcagataccagctgcaggtgtagacaccatcctcactggtgtccccatggacccctgcaggttcagtatttgctagaatgactttcagaactccggagagtgccgtacttaccattatagctttattataccaaaaaggtacaaattagaaccagccaaaaggagagatgcatagagcaaggtctgggagggtctcaaatgcgaagcctcgtttgtcctcaggaccacgtccccccgtggcacactgatgcatgacagtatgacaggttattgctagccaggaagctcacctgaacttcagtgtccagagttcttatcattggggttctgttacttaggcatgaatgactgaatcattgtcatgtggtagagctcagcctccagtcccccctcctccccagaggtgaggctgatagcacgtggctcagagcaccagtgctaaccccggggcagagaggccagcctgccttgagtcatgttgttagataaactcaaggggttcaccaagagtcacctcattagcataatctctcaaacgagggctgaggggcccccatgaatagcagacactccagtcacttgggaaattccaagggtttagagttggctcctaggcactggggacaaaggcaggctgctacacagttggagtggcgcacgtgaggtggagggaagctgcttttgtagctcccctagggactgtgggaggagttgttaaaatccgatctaaagcatatcggaatgagtgagcttccttgattacatcgccagtcgaacatggggacggcagaggagtgagaatgtgccggggaggagatccctcggcccagagctccccaccatgggttaggaacagtaagtcctggggctctgcatcctcctgccctcctggctgtgggtgagggcacggtgtttcctgatctctcctgctgtgtctccaggtctacgaagatctacactccaggccggaaagagcaaggggagcccatgacccctcgccgcacgccagcccgctttggtctgtgagctgaggctgtccccagagaggatggcagcaggtattgggtcctcagccttctggcgggagccctgaggctgcggacaaagccctttcatctgaggactttcatctgtgcatatcacggccccccagggcagttcctgctggaccagactctctggcagaggaggtggagttcttccatgcaggagcacggcatggcgggagcggggctgcagagtatccgaggtgctgccggggcagcgggaggtggctggacccatcgcatctaaaactggcccaggacacttggtgtatgcgtgacttggctgtggctgtcttttttaatccttgtgtaaagcagcaaaaaagacctaaagggaattgtaatttggttataattcaggatttggaaataaatttattatttgtaaaacatgactgcatgtctgactttttccttcaccctcttaaatcatgtaataaaggtggggggtgcagaagcctgccctgacttcctttgcatgggtcgtcctggaactctgcccttatttctgcacaaggcagaccaagctctgagggtgcccagctgctcctgaggctggggggcactggcaggtctgccttgatggccaggtcatgggagggaagtgcgcaggagtccaccccagccttccctggggtggtttggctgcttgaaagaggtccatgtgattgctctggatggcagagggtaagggttgtccattgactgaaaaacagtgtaaaatgttgcttattgattttcacgtaaaaggtgacccttacaccagaatcaccagtcttttctctttttaagcagtctcttaagtctgctgaggtggctttttgggtgtttggccctttccactaaccatggtgtatatgttgtgattcctccaggctgggcttctgccaggtgtgctggttggcaggttctgtgttggggttgagtcacagacaggattggggctcggaagcaccttgataccaggccagtgccggcgtgagccctgtggtgcgtggcctgctgtgctgttctgatccctttctccctctgttcctgggatttgcctttccatgttttataactcaataaatgttaaaatgtaagtcaattttgtgggtgagctcagaagcctagctttgccagccagcaccagctaccacctctgcctccattcttccctctagcccccttgggggaatgcaggtggaaatgggcttctcagggctctgtagtgaagagagggctgccagcactttgcctaggaagcattctaatcttggccctaggttggaggactagaagttggctgatgtgtgacctatttacagaatcaggcaatggagtaggaaaaagattgaggttctacttaacagttattattaataagctgtgaccttggtcacaaactcactaagtcccttagataaaaaaataaggtcagagaggctattaaaacaatgggtccaactcaaccatcgtatttacaagcaaggaacacctggtaaaggatacttggtacatgtgggtgctacaagaggaatggaggggtcccctgcccacagcagctccccctgaatttgccacggtactggagcttctgctcaaggctctgtctcttcctgtgtttccagtgtttttttaaattacagatcctttccattccgatcttccttaaagttccttcgagctttaatattctgattctcactgtcttttcttcagatggcaactgattgtttttctagaggtacaaaagcatacctatgacatggtctctagcaccatggccccgttgtggactcctgagtctggctgacccttgttattgtctgtatttttttagtgtaaccatcctaatggctggtatctcattgcagttttgatttgcatttccctagtatttagtggtgttgagcatcttttcatgtgcttattattggtcatttgtttatcttctttggagaaatgtctcaagtcctcttcccccccccttttttttttttgcattagtaactttttaaaaatttttaaatttcaacttttattttagatactgagggtacatgtgcaggttcattatatgggtatactgtgtgatgtggtaggtttggggtatggatcccatcaccgaggtagtaagcatagtacccaacaggtatgttttcaacccatttccctctctctattcctcccaaccaagtagtccacagtgtttattgttcctatatttatgtccctgtgtgctcaatgtttagctcccacttataagtgagaagaagtagtatttgattttctgttcctgcaagaattagcttaggattatggcctccagctgcatccatgttgttgcaagggacatgatttcattcttttctatagctgtgtagtaccccatggtgtgtatg

SEQ ID NO: 15863 - DNA, 96340 bp, Human
aaagcactcagggtgtaccggggagacacagaagtaaacaacgagaaacgtgataagcctgacaatagagacatgcagtcagcaattcgcaggagccaggtagggagcaggtgaccctcacctggggattagacacatggtagtactggctgagttaggtacctctggtgaggtctctcagtactggtatttgtccattttggaagaacctcctggagcacaggttacagattttggcctcatctctttggatgcctctgagtggtcaccaaaacccagattatgaagcaaatctgtgcacatggattgatttaaaatgttaggaggttatgagagtgtaggctgaaaattgcctaaaatgtgagtcagagaaaaacacagacctatcatctctggagtttttttggactgttgtcagctgtccccatttccaaaatataaaattgagaacagcttactgtcttggaggcacttgttcagatttagctttacaaaataaatatctccagatgtgattgttttatgcaggcgtctccatggcaatgcagctgaggctggaatatgttgttaaaaatatacactttgcatgatcacaatactattagtggcatgattttattttcaggaaatgataatcacctgaagtagaatataagtaaacattttatatcagacttaaagcagagcctctaataaagcttattaacccgattattcatctcatacctctttacattctgtccacaatacctgtgtctgtcatggtttaaaattgggattcttctaaggaaattgcaagtgcgtgtatgtaccgacgtatttctatcttttcatgtgatgacaattttacataatggaaattgaagttgggttctaatttcaactttgtcctagcgtgttataataaatcttctaattcagtttccacatctgtaaatggggatggcactacctatcttgaaatgcttgttatgatcattaaataagatgatcgctgactgtgcgtggcacctggtaagcgtttgaacacgtggtagcttgcttcctttccagcttttatcacaggcttggattcatttccttccattttaaaagttaatttttatgttagaagtgaactacaggctgggcacagtgtctcatgcctataatcccagcactttgggaggctgaggcgggtggatcacatgaggtcaggagttcgagaccagcctggtcaacatgatgaaaccccatctctactaaaaacacaaaaaattagctgggtgtggtggcggatgcctgtattaccagctacttgggatgctgaggaaggagaatcacttgaactggagaggtggaggttgcagtgtgccaagatcacgccattgcactccagcctgggcaacaaaagcaacactttgtcttaaaaaaaaaaaagtgaactacaagaatattttgttgttgactgttctttaatgtgacgttcaagctttaattgaattcaaaaaggagttctttaagattggggcttaaaaatcagctcattcctttattctgttctgtacaaacttttttttgcgcggccgtgtgtccttgagaccacgtcattgggagctctcagcctccacggtcttaggtctgacacctctaaataagaagcatgacatttgggtagctttgcaaatatgggtgttgccctgttaaactaatccccgagggagtcaacttcaaatagaaattaacaaagggcaaaaagtataggtgacattgttcactttttgggctgagtaacacttgggatttgttctactcaaggatttttttttatctatttgggcaggggatctgcaccctaagtggaactgcatgacagccccatgaaaaccagtgcagataagattgtgtccgaaggacagggcaggcttcgctcataaacaagtcaagatgccagaaccatctccatttgcatagtgccctcgctttgaaagtgttcttctatttaaagaagttttcttttccttccagggtggctgtgctggctctggctgtggcaaatgtgactgccatggagtgaagggacaaaaggtgagttgccgaaatttaaatcacaacatttctttgtgaattggacagtaagtactacattaacagtaaccgaataatcagcaattcaggtgaaagccttattactgttttgataatttccccagagcaatacaaatgaagccaaaccaggcttgacattacttctgagtagtaatattattataatagctcttctccaaagaatgtaatagtatgtggcaattaatgtagaaaaacatatttggtttattttcctttttgactcttggtagaaaatctgttgaatctatcgtactttttcgaattgatgtataagaactaattttaacatttttccggaaaaagaaactagttcctattctacttgaggaccttctcttcaaattagtatttttaaaccatcttttaatccatcacatgcttgtctagatttatttataaaaatattgcttgggaaacttagtgtttcccaaatgtaaaattaaaatgtatttctttgcaagcaaactgttcccctccctttcatttaagaaccagggctccagataaagataagtttctctggaaggcaagttgaatctgtgcatttcagttggttggaaagagggtgcctggctgtttttttatccagaaaacagtgcagcatcctggtactgtctgtgggtcaccgtggaaaccaggtgtggctgtgaggaaatgccaccaccttaagccactcagcctttggtgcaggtgcgcacagcaggttgggaccctgtagaatggagtggatactctgtaggatactgtttccagaaagctgaaggtgtcattctggctagcgtgtgaattcttacttccctccccggcatgccagaggttttatggggccacagactgatgctttcgaaattcagcaaattctagtttacagaaaattctgtggtttctttttgactatttgctgaaatgccaacattattattttaaaaaatatgcctgataggtgatggcactagtgttacctggatagtttttgaatgaatggagtatgtaaggaaagtttcacatcttttcatatcaactctaatttatcttcatgctctgctctcttactttggatttttctagcgatttccagtgtgcatgctcaagagttattttaaagtagacgcaagtgtttctcatgccacagacattttgttaaaaacctaacttgaaatatacaagtgagttcaccaaactcataaaaatgtccttaaaatgataaaatggagaactttggggtcccaacaaagaggaattaaggcctggatcatgattacctctgttttccatgtgactttgaaagcagcagggctggagccaagttggccctgctccctcctagggacagcagggttgatgtccacctccatttccatttgcttctgtccagccggcaggccttggcggcccctcctggctctggagctttacatactttcttattctatccgcatctataaacttatatatattttttaggccaggcatggtgggtcacgcctgtaatcctagcagtttgggaggctgaggcaggaggatcactggaagtcaggagtttgagaccatcctggccaacacggtgaaactcagtctctactaaaagtacaaaaattagcccagcgtggtggcacacacctctagtcccagctgctcaggaggttgagacaggagaattgcttgaacccaggaggcggaggttgcagtgagccaagaacacaccattgcactctagcctaggcgacagagcaaggctctaactcaaaaccaaaaaccaaaaaccaaaaaacttgtaacttttttaacgtaatttatttcagtttttcccaaaaatccactcatcaaaacatgacaagggagaatgatagggtgtagccttccctacctgtcaactgacatctccacaacctggtaacacccctcagagccaagccgcttccactccgagtgggctacacatgtgtggggaaggcaggggaggcggtgtccagcacctggcctgaaggaaaggggccgccaacatttcatctcaacattgcccaaggaggagcccttgctgggggtggccccctctggccaggcgaggtctgtgcctgtcctggcttggagcctgcgtggggcttgcgccctgcttaggacaggaaggcagagaagtgtggggccacgtggaagttgtgtcccgagggaggctccatgccagcttcctacaggggccagctttagccttgacactgggagtcagcagagcccgggccaggactgggatggaaggagcaggatcctgctcccctccttgtgtggccttagccaggtttcccaccaagggacctaggccagggagcccagcacctccaggacttttttggcctgacctgctcctctacactcctgtttctccattgccaactttggggttcttactgtttttttttaattttttttaattccataaagaacatttaaaataaaatgctagcaagctctaccttagaccattctgaatttgtgatttaaaaggcaatgatgattgaatggattcagaagacctcttgaagtctaggcctaggacaatagctaaatggtttagtattatatcattttaacaaaaatggagaaggtctatttttttctcatcttgagcataaacatttcaggtcctatggttcacacagcattgagaaggggaaagaacccttcctcccactgacagaggaaattttaaacaaacttccccttattgtcttggaagtcctgttaaaataatcaatttaatgatgtgaaatgcctcagcttcactgagctagggtttccgatctggttccctttctctcatcccaaagtcagctaagaaagaaatgtactctaggctggcaggtcaagagaagaagtggatcttcctcagtggctgccaccttctaccttctgcacttcctgccaccttctgcatattcagagcgtcccagccctagaaatgccgacctagtgtaaaaacaaaatgactaaaggggttggaataatggaatacaaatctactggtttagatcactagtctgcttatgagctgcaactgaacgccttctatcctcatagaaattattttgatattctcaaatgtctacacattaaattgattttgattggttgttctttaaacaggacagtaggaggcacagctgagatgcagttaaagttaccaagctgggtcagaatgtcacagccttagaaatttggaaattattacttctaagacatattttcccacatctctttgaggagcactttgacactattatttgcaaaccatcagtatcctcaacagaaactggaatatctccagtacaaatctcttttgactaagttctgctttctatggcgatatgacagaatggacaaaatgtcttatattctgtagatactataaatacattttagtgcaacagatcattgctggcgttataatctcatagttttcaagtaatcaataaatactagatagcttgatctgagttcaacagttaaattcagcaggtttctactggatttcagagagtctttgctgagttgtttattttcccacttgcttggaaggccactcatatcttcagatgttttctgttaggtaattaatttggccttgcacacagtggctctgtgctcctccagagactgcggcagtgtgggaatgctgtctgcttgtactgattagggttttgaatgcttgccttcacagaaatagccaaaagttaagctcttcttttgagtgataatttgattttctcaagtatttaagatagtaggaaaggcaacacattcccagaagttactgctatatgctaaggaaattaaccatttatgttttgctaaaatagagtttacacaagacctctttcaaataatctaacctgggagcccacgtttccataacactatcaccatagtctgtgaccctgcagtgtccaaaaaagggaatttaaagttaaactagagatggaagactggtgtacataaataacaaggcgagagtaaaccatcacattccaggagaagctgttgggaaaacaaatacaaaagtctttctgagaaggaagtgatccctgggacctggagcataaaatcaagggacagcttccccaattcagcaggaccccagcctctcatgtcctcactaatttgccaggcttgcttagatatagactaggttcttctgtcacacgtacgtgtgaagacacatgttaattgaactgcattaatcagagaaaacagctcttgggaccagctgataaatgctgtcatagcaaagatttgacggtttctactatagtgactccaaaaagggacattcccaagccacagtcttgtgagcagagtctcaattaagtagaattgtagcatttctagtgagtagtgacaactgtgtggatatctcataccttcttgtaatactttaaccctgctgatacccagatcctcagcaaagatatagagaagcagcacattatcctgttattactaattagattgtctataaatcacagctcctgtccacattggctctgcattgcaataatattgtcatcagatagaacaaccaagactgctttccaagcagagaactttgaagatggcattgctatctgtctgtctaaaatgtgtatcttatctgatttgaaaaggctggagaagtctgtggccagtctggaagtgatttcattgctggcccaggaaatctgggaagagtttaatgtcgtgtatggctgagcttgtacaggataccctttcttttgttatggcaaacagtttgtagctttaccagccatttagcgcctagatatttgacacaatcggtgtatgtccatgtcacacctttgtataaacctgtctctctgcatctcaacatttggctatagctgctgcttttacacaacggatctaggctaggatagaaaaatcctggcttgtgagtgtcagagcaagaaagagaaagagactgtatcttgggccaggcctggggccgagtatgttttatgcacattattgtaatatctattatacagtggaagaaaccaaccagcccgggctttttccacttggtggtattgacagtttgagtgggataatttttggttgtgggtctgtcctgtccattgtaggacgttgagcagcttcccagcctttacacatcggatgccaggagcacccccaccccagcagtcgtgacataaatatatctccagctgttgctgaatgtctcctggcggggggtggggggtacagactcaccctggatggaataccgctgaactaaccccatcttctatagctaataaaagacaaataacaggattcaggcactaaccagagtacgactcagtttctactccttcagataagcagaccctaatctgagggagtcgggccagctgaagacacggctcagaatatccgaagtcttgagcaagttcctttcctcttactgactctgtggcggacccactgcgccccaggccacctgccaaggacagcaagccttctgaagcctttctctaacgggtcgggacggggaggactgctggaggaccacaaagaaatgagcctactcctctggggccctgggcagacctcccagttcctgttctacaggagtcaacgtgggcctccagcccggttcaacaactaacccacagcgagcccctgtgtgtgacaaggggcaggtcagccagtcagcagccactcctgccccattgtcccctcctgagacaggttaggggtgcccagcccatcaaaatatgcatcccaccccattctggattgcttttccctgtgcattaggaataaaacctctctaaggggaaggcattttgaagtaagcctgtttcaggcctgtgagagggctgcagaaacacccccagcgtgagcactgggtcaccccacagcccctgcctttcggaaatcctggtgtagagtccgctccacaaggagctccttcctctgtttgaaggctggtcgtcttcactgtgtctccgcgattacccaggacgtgggcatggccatgcttctcacacgtcctctctttgactcaggatcatcgacttgtgcctctgcctcctccacatctggaagaggcatcttcttttcccttttcacaggctacttagagctggagagggattgtgtctgtcaatccttagatacatgattaattaatcaacgcatgtttttcagttgttactttgctgggcactttgagagatgcaaaatgagcactcttagtatatttctctcaaggacatacaaaataagaagaaaaatattatctgtaaggaataccataaatctaatacctaaatacaagaagagaagaggacagattttccagtctgttgaattagatgtgccattttacattgattgttttttattagctcccattgccagagacattgcaatgtctacgtgataaggagtttaggcttgagcttgcatgctggttttaaacacatcatctacaacattctagtcgtttttgtgctatattgtaacaattgtcaaagtgccttagaatctaacattacctttaaggtatgggactcactttttcctaagatcataaatttagggtattttcatagttgtaattaaatcttagatgaaattcctttttgagacagggactgtactttatttgtatttttggagaattcaataatcttcaatttataaatatatttatttccatgatctttcctctaatttacacatgggtaacaatagacatagttttagccatgttttcattatgaaattaaaatatacaaggacagagtgctttaaatattccaccatatagatagatggactggctcttctcctgttattccttgttattcctagtatctgtgtagaatatatttgcatctccagtaattattaaagaataataattaccttcttgtatgattatctttcttgcatatcttcttttttttttttttgagacagagtcttactctgtcgcccaggctggtgtgcagtggcgtcatctcagctcactgcaagctccacctcccgggttcactggttcacgccattctcctccctcagcctcccaagtagctgggactacaggcacccgccaccatgccaggctaatttttttgtatttttagtagagacggggtttcaccctgttagccaggaaggtctcgatctcctgaccttgtgatccgcccgcctcagcctcccaaagtgctgggattacaggcgtgagccactgcgcccggcatcttctttcttttattgctgtttttaacagaatattaaaaaatttttcctataaattatattaaccattgttttaaacgttaaaggtgttatgcttcttagatactaaattctttactcaagcacatgaaagcaaatatttttgtgtagactctttgaaactttggataagttcattcatttgaactaataatggtgagttattaataataacagtaatttattaagtacttaatatgtgagacgcactgtgccagatttgacttagtgagaatttcaaatctagtctatttaaaaagaaattcaattttcttacttataaggtgtgaaatatataccataaaatcaaaacgcattaaaaagtgttccttagtgtacaatactagggggatttaaaaaataaatataagctttgtttaggtagtgcattaagcatatttgagattactaattttttgagatcaattgaatgcctttgtttatacatgttttgaatattcctgagagacaatagtgtctagtttagcctttcccaaaatatgatcatcagaccatctttaggatgtcaacagatgtttcctccgggatggaaacgggaagaggttccaaggacacaggcgtttggggaaaactgagttcaggttaaatggacatttgttgttttgccctgggatgtctcagagcctgtaataagatagtgtatcatctggaccttccgtgggtgctgcgtcatatacagttccccacacttatttgaacgcccccctttttttttctttttcttttttgagatggagtctcactctgtcactcaggctggagtacagtggcacgatctcggctcactgcaacctccatctcctgggttcaagtgattctcacgcctcagcctcccaagtagctgggattataggcgtgtacccccccacctggctaatttttgtagttttagtagagacagggtttcaccatgttggccaggctggtctggaactcctgacctcaagagatttgctgtctcggcctcccaaagtgctgggatgacaggcgtgagccactgtaccgagcctctgaccctttttatttctgaagccaggaacggcctttgtgaaagagtgcatcagtggataaaaccttgattctagtgtaagttcccccatctacccactgtttttcaccaagttgttttgaccaagttatgccctgacctggaaattccccagagttgctaaaagaactgaatgggggatactgtacataagagcacttaagcaacttaaaatgtcacatgtagggacatatgcgtgtcatgtgaatagcagctgcattttgaagttgcaataagtgtgaggaaaatgtgcttgttagctcagctctagacagatccatggatagaaagacatagacatggatccccatccagctaagtatttgcaatccgcaggtgaagcctggaaacccagagaaatggacctgttccatccgtgacagaagcgctcccaggacctaaattaaagggatgttagaatgttttgagaatcttggcagggccattaggtagtgtttgtagcttttggatgcttttggtggagggaaaatgagatgggctcacttgggaggtctgcctgcagtttccatccaaatttctaatcaacgttgtggttttatcatccatttccggaatcattaccccttaaaatgtgaggaaaacgactctccttttcttcaactccccaacttttccaaataccgctgcgagtttttgttgccaacagcttttcccaatgtgcgtgtacttaccaacgtccagactcctccctcccatcggccagccttgcttggtctagctattattcaaaggggaacatgcgtgagatatcactttgtttttgccatctaatggattccaccccccaaagtatctgactttgacactcaggctcatctgcaggacccgagggtgtcttccctcccctcccgttggctggctaaatgggttaatagaatacattctcttttccttttccgtgttttgtctggcgtttgcaatgccaagatttttttccagatgtcccctatttcctatttccacataccgcacatgaatcatcatctggcagaggaatcgtgagaatccatgtgatcagtgtgcgttcccacattcacctacttttgtcttttttgatagttctttgaaaacaatgaatttttttaaaaatatgcctgaattcaagggtaaaatatcaacaatgtaccctagaaaagcccctggaagcagatctatgctaaatggtttattttattctgcacacgaggcccacccgtcgctggctcccctatgccttggacgtcactgatacacacacatcccgttcccgaacagggagagtgagctgcacattctcgtttccagctccacttcctagttctgcccaccgtaaaatctgcccttttgccatgcgctgtgggacctgttagactcaggagagaccatcatacaaattgatggctcttgatttgcagctgtatctggagcttaccgaatctagtgcagctttaaaaatagggagccgattctgtttccaagttcagaaggagcagcagaaaatgaagtatctcgaatggcagatcacatgccatgacttttaaagcccagagcactctccaggagtacaggctgtcattggtgtggcccagcaccggcagcctctgtcccgactatttatgggaaaaaatatttttttgtaaatatgatcttgacaaaacattggctggcaggaaaatagctttcttttcaggggagcaaaatgagagtgtatattttaattcaagatcaaagacttaacataaaacaaaccctgacaaatgaaaactgggcaatgggattttcctcctgtttgttggtagaatattttgagcattcaaacacgtttctagacagcaagttgtgatgctagataattaggtagtgtgggtgtggagaactgcacgctcaaaaatggtattaacagaccttcatccttgtgaagtggtttagcacaatgtgcaattaaacaaaggaagaattagtcagagttaacgagcaaaccagatggctctggggacgtggtgcccctttgtcagatttttcttcctttggcaaatccattaaacatggtaaaagtatacttcatatagcttagctttggttcgtcacatagttttatgagtttaatgctaactggccccaaattcaatgattctggatttcctcacatgagaatctgacacgagaagctaacagtgattcctggctaatttctaaaaagctgtagtgaaatcagaagggttaaagacccttggtacggtttctcctttattagatatttggacaaatacctgaaggtaatgaatgatagatgtgaatttcttacacacgtcttgctagagcttgaggacttaaccagagaattttctgtgggcgtcccgctgtagcatgttagggccttaggttagtttgccctcctaggtgagaaatccacaaccctaagacttgagtacccaagtctgtggcatgtggtgacatgcttgattttgaagtggttttccctagaagattggtaaaggaatgacatctgtctatagtagagccagtaaattccttgagctggagaaccaatgtccactcatcccagtgcctccttgtcctgtgggctcctgctgtacccgtgggcctgggtagtggccagcggcagtcctggagcctgccctacaggttcatgatggaagatgctagccagtaatagcacaactgaacccccaagtgaacactctgctaagacctccagggagggagaaggcacggctgcgagaatggatgtccaatgggaagaaattgatctgcagggggcagggaagggcaaaccgaacggtcattcgcaggccccaaaagctcaggcagccgctcaggtgcggtggcccatgatttacgcctccaaattccatttccctgtttgacgtcaggtttttcccgatttggaaatgttggtgctttgagaaatgtccatggacaactgtgcctcctcacctcccccttctcacttccacatacaagactccagaatgttaaaggacacatctccatgagtgtgaaactgtttgtcgctgtttgactctctgtgtccccatgtggggctccccagtctcatcgatatgtcctgggcaagggcaagaggcacctcggtggatcttgttcccacactgactgtctcctcaccacgcgggctggaaatgctgtgtgtttttctgagtcagggctttgggaggcagcaccctgtctccaggttcttggagttttatggatgcaacgtcattaatcatcctgacggggctgatgtgggtggcaggtgttgggttctgcctcctgattgggaggaggggctgggtgccctgccctgaatctgaatgtagaggccctgggtaaacgggtgtgccctgtcctgcctggaccacacatcaggagccctgggagcagaggttccgggcggctggaggcctccttgcttccgcctctgcacgtggaacctgcatttcttcacaggagaccgtggctccacaggtgtcctgcctgtcagggcagaggaacataccacggggggacttccagcaaacgtgaggaacagcacgctggcgtgactggggcagaaagcagagtggtgttttcttctttgggggcctttgatagggacctgggcagggtgtggtgggggccggaggtgcagtggcttctgcaggaggctggggaggctccccgtggtcttagaggaggtgcaccatcccgtcccacctcactcgccccctttacccttctttcctttataaaatttctgccctttctgttcctcccaccacaatttcccatccacttttcctttctctctgttcagggctcatgtacacctgtgtgattttccagggtgtcacgacgagccctgatgacccgcgcctgccacctgtgtgctttgtcctctctacttcacatgtgtgcatgcacacatcacgtgcatgcacatatcacatacacgcacacaccacacacatacatatacacgcaccacacacataacatatacacacaccacacacacatacataccacacacaccacttacatatacatggaacacacaccgtgcacacccacaccacgggcacacactcacacacacacgcactttcttcaggaacctcccagccctccccctccaccacgtggcctgaatggagccctcctcgtccacctgttttgggcttggttctgctcctttttcctgagtgggggattttggagggcgctgcccttgggcactcagtgtggatttgatgctgtggaaggggacaggagagctggtgggccaagctgggagggcagttaccgtggagtgagagccaaggccagccggcagaagtcacccacaagagggtgaacgtcggaagtggggcccaaggaaattactgacattttacagggcagaggcatagggctttttcttttcctcttagtctccccaggatgctgtaataggataccacagactgggtggtttcagcagcagaagtgtgttcctcccgtgctggacgctggaagtccaagatcaaggctccagcagattcgaggtcggctgtggaccccttcttcataggcagcgcgagggcgggggctctctctggggtcttttttctaagaacactaattctgttcatgagcctcatcacttcccaaggccccacctccatgccatcaccttgggggttagaatttccacacaggaatttggggcggggcatggacattcagaacacagcacttttattatcctgggatgcaggacacgtacagtgatgtgtggcgacaaaatgcatcccagctgtgtttaagtaactgtgtaattggctggaaatttctcaatgtgaaaaaattcgagtcattcagatttaaagttgaaaacctcctaagaggaaagagttgggactctgacctctaaaacccttctaaatgttagtgtcctctgagttgagatctttcctgtgaagctggaggtacttcaacactctactgttactggcctttctagagcaaaagctattttactgaaaagaactttggtatgcagtacatgtcagaactgtccactcatttgaagtgaaggaagatcaggcccataatgggtgattacttcacaagcagacatttcctcagtgtcagctatgttttcggtgatgtattctgaggaaaggggagcggtgactctgcagtattgagccaatgtgccttcatcctccctgtctcttcacatctgctgatgggaaaaccaaagtttgtggaatccccaatgccatctggttttcctcccctttttcttttctgaaaaatcacgttccaagttgaagcaatcatagctgggaaattttgttacattttcctcactgtctgtggttttttccattcgctaatcaatttgattctccatattttattcctaaaatcattttatctgggcatgtgaagtggacgctagtacttgaagtcactctatttaaatcttgcctgactttcttaactagctgttctgatttctgtcctcctctagagacaattgaccagatgccatttctttgggcttcctattggataaggccgtgaacccaaagggagggggaaatagatgataatttaggaacatgggagttggtataagcatccgtttcctttcctgtctcactcatttgcctttaggaagttatatcgttaatcctaaatgtgtgtcttccctgtgtttcaaagaagagtcccccagcctggaggctgctcattcgcattctgggtcacgtgttcccttccaaggcttccctgttctccctgccacttggagggggcgcaggagccgcctgctgggtgcgacgggccagaagtgggtagtgacaggcccggaagtgggtagtcattaaaaacttgccttgcacggaagctactcagtatgtgcccttcaaaattggatttttaaaggaatctgcttcacccagtgacagagaagaacacacatgttcttttccatcctgtccaatattttgttcctgatgtagaccccccccccgcccccgcaccaccactcctcaggggcatcctgtgcttgatagcggggtgtcagctctggaagcatgtgggtgattttactgcagaagcacgtggcttggcaggtgctccgcgatggtcccgcccagctgcgcttcctgagtcctgtaaggcgcgtgtatgtccctgtgcatccctttcccacctgtcaccgggcacctcttgcccagcgagggtgacgttcaaatgggcacctgaggactgtgtgtgcagcgaggtgtagctccacccaggagggtgtatttagggaccgcagggaccaggaagggctctgggatcagctcctccacagcgggcctccccggagacccgagacagggctgcctccctgtccttgcctgatttgttatcccaaaattctgggcctaacccacggcaggatatttatgtggaatatcaaatagttgttaaaaagatgactgctttccctgtttcttcacagaacgtgctgattctccctgtggagaaccaagggtgggcacctgtaggtttagaattcccatgagagctcagtttccaccaagttggcaattgtatatttgggaatcaagggaaggccatttcagggtgcatggctgactggccctctcttgccaaagacaaattgcctcagtgatgtgtcccagacctcagaccctgggagtgggaggtctgggggcgtgggaaccaggtgcccccaacctgcctcttagtgaagcttctctctctttatgtctctctgtctctgtctcttcgtttctctctctctttctgattctgtgtttgtgtgtgtttgtgtgtgtgtgtgtgtgtgtgtgtgtgtgtgtgtgtgtctaccgtacccatacttggtcatctatcgcccaattgatgtaacttaaaaaaaaatccatatacgtgggaaagtgtaacatgtttatatactctacaatctatttttattagaaagtttatacctcataatttgcaaactgtaacccagttggtctgtttccacatcttagtttctagccgaagatctcaatattttagtctattgacattaagtagttaagaaaaaaaggcaggaaatgatactgtaagtttaatctttaaaacgtctacaaagtaggcatagtgaaaatggcattaaataaggtcttactgatagaaatttttaaataattgggccacaccttggattgaaatatatctccatattatcttttgaaaacaggcttgccaactttatgaagagcattgaggtgaagagagattagcagctcagggaagaccatttttaagtatttatgaagtagctatttattgtcttaattaagcaccggtattttgcattgagtttgcaattatatgcttttcttatctattcagttttaaaaccaagattttaagcaaaacacaaaagaaaaaacttcaagatgttggcttaatttctttctttgggtgactgtatatgttttaaaggaattaatggtgtttacttaaaagagattaaaattcagttatttattaatttagattgatctcactactgctttttcaaattaatgaggttaggctaatagtgggttttgtaaaacctccagctctgctgagattaccttgtattctatgggcaaagttggtttgtctagttttaacctggcaattgtatatctgggagtcaagggaactgttcttatctcttagattccaagtatgattaatggagtattgaaattattgcagcatgctgggggaaaatgttatcagtgataagatacagacaagtaacttgcttgggggtaaggaagtaatctggggatttcagaccggtgtatgtcgttagctacttccaggctaaccatggaggagtgtggtggctttactaagacccaggctgacctgacagaataaatggaatgttctatgcttgaactgcctgaattacagagatatttattaaggaaaaaacacaaaaccttgagtataagataaaggggggagtttcttgaaactgtcatcttttttaaatactcaagaaattccaattttcttatgtctgtcttagccacaaaaacaggaatgagatacttcctgggtcatgacttgtgggaacactagcagtgtggccttttcattctcttttaaaacattctgtggcttcagaggaaatgcagctggcttgttggacatagaaatcgtgagaataaacacaaaatatttacgtgtttaaaaagcagtaaagtcagaccagtttctttcagaaccatttgtacagcatttaactgaatacttgagcacgtttgatttttaaaataatgctgccaggtaaaacaggcaggtggagtcatccctgacttacagatgatggcaaagctgattttcagagcgtcccaggggttggcgctggagccagcaccagaattccaggcttaggttctttgcccatccatgcagtgactgaagagagagcatgaaaagcagggcgcccggagctccgcgtgctcacccggagtgcaggtgcttgtttttgcagtcatttgaaattaagattcctaaatctgcaccctcttgtagatttatatcattttcttgggatctttcctgagtcactcatgaaaatattttatttttgtttatttatttatttattttttgagatggagtctgctctgtcacccaggctggagtgcaatggcatgatctcggctcactgcaacctctgcttcctgggttcaagcgattctcctgtctcagcctcccaagtagctgagattacaggcgtgtgccaccacgctgggctaatttttgtatttttagtagagacaagtttcaccatgttggccaggctggtcttgaacgcctgacctcaggtgatccacccgccttggcctcccaaagtgctgggattataggcgtgagccactgcacccggcccagtcgtgaaaatattaattgagtacctaccctgtgccatctgttcgaagtgctggggggagggaacgagagggaatgccagtcactgcctgctgggttccagcatctcctggaggtgctatgtacgcggctctgcacaccctggcaagggaaccgcagggactacggaaccactcagaggatggggaccctggatgtcccctggcagggcacctgtaaaacccaattttgataaataattatatctaacacatttttaaggaaaaaaaaaagaaaggtttttcttaattgccaatgagcaattctctcaaggtttaaacctgaagactgtcttgcatgcttttgtattattaactataattcttatcttcagagtatttcatctgcaattttcaagtttacttttatcacagaccaaaaaaagaaaaaaaaaatccatcacctaccttgtggtgtttcctgcctttgctgtgtcctcgttttgttccacaacgctgccccacacccacatacattattaagttcacgttaataacatcctcggctgtctaagtacttaggcactaattggcatttttcaacatttctgttaatgtagaacatgtctttcgaaccctcaggggccttgctttggagctaatgaaaataaagcaaagtgtctttataagaaaaaaaattaggtcaggagcgttggctcacacctgtaataccagcactttgggaggccgaggctggcggattacctgaggtcaggagttcaagaccagcctgaccaacatggtgaaaccttgtctgtactacaaatacaaaaattagccaggcatgatggtgcacgtctgtaatcccagctacttgggaggccaaggcgcaagaatcgcttgaacctgggaggtggaggttacagtgagccaagatcatgccactgtactccagcttggatgacagagcaagactccatctcaaaaacatatatatttttttcttatacaaactcagaagagagctaacctcttattgatattttgttatcaattatttatgttcctgcagtctttcttcttaccccaaatcttttaactaagtcatgacctagaattgtgataaatttcatggaacttcaaaaaaaaagacggttgtgctggtgagcagaggcgtgatttcatgtgcagactctcagcacctcctaagtgtgatcattcctgcaatggctggagctcaagttggaagcattcatttatgccatgtgcatttctaggtctttgaggatagtattccatatatattttttttaatggagtaagtaaaatccaaaaccaaaagttaaccaaagtgttggcagtggtgactgggcatttcagcccctgccctgggttagggctctcttgagggacattcctcagttggcttcccaactcttggcaggtcagtaccaagcctctaaagtctacacggaggctgcctcttgcttggtgtgtcctgccatccttggggtgtcacccaggcaggaacccccagagagctctgtgcaacttatttggaggatggttttgctaccactgggctttttccagctttgtcatattagataaaggcctcctgctgtgccaacacctagcttcggtggctgattttggcctctgattgctgcagtgtgcaacatgcacaaccatccacaccgtccatagctgcagcaagtgaggttccaagcctgtagcataacacttgttttctgtactgtttttctcgttttgaagatatttttaaaaatatatatttgagaaacagaatgttaggtagtaggtttagaaagaggcatctgtgattttggttttaatgagtgttcatgctgataggttaagcaaaggagagaatgttatcatcttttttgggatccaaaaaactggatagatttttttttcttttagaattggcaaaactcaggagaatggactaaattaccttaatgcataagttttctataaacttatagtggaagaagaccaaagaagaacctttacataagttttactggcagtgggatgtttagcagtggtttcttagagacctccctgtgattacatttgtatctattttatgcatgctttgtagaatgtaattttttcagtattttctatttccatacagctattttaaaaattgaatttgctattttttctgtattgtcattagattcaaatactctcccaatttataaaatggatgtgaaaatgctatccagaaaatatccatcattctcattatttataggctgaccgcatttacctgtaacgcaatagcctcgatattcaggttactagtttttatatttaattttaattaaattttgaatcctaattaaaaatatttaccatagagttcttttaggccatatcaaagtgatttctctcactccgcccacagaatgtgttcaatggcactgaatatttaatattttaatagtaatatattactacaatgaatatttaggaaaaagccttaattctttttttttttttaagcagagtctggctctgtcgcccaggctggagtgcagtggcacgatctcggctcactgcaagctctgcctccctggttcatgccattctcttgcctcagcctcccgagtagctgggactacaggtgcccgccaccacacccggctaattttttgtatttttagtagagacggggtttcaccatgttagccaggatggtctcgatctcctgacctcgtgatccacccgcctcggcctcccaaagtgctaggattacaggcgtgagccaccgcgcccggcctgaaaaagccttaattctttaaggtccaccagggaggtttagtttatttgggggaaaatgtatagtcccagagctccctctagtggcgagcagctgcagcccacggagactcctcacccaagccctgattgaggccgttggttcctccgcccgggcctgtcacgggctggatccactgtctgccagagtttgggttttctccagatcattcagtgtctgagtacttcttcaacaagggggtgcttggctgagatcccatgggtgtgtctgaggtgccagggcccgccggggagggtgtgaatgtgcctgtttcacatgaaggcagcgctctcgaatgtgctgaggggtgccagggccctggggtgctgctgtgtgggtcgcaggtgcctggaggtggatgaagggtgggtgtctacggacgccccgaccaggagcttggcccttcacatgggcatttgaatgtgttgttgatggagcccggagccaggaaaatacaagtgtttccagagaacgcactgtctgctggtgtggtttgatgcgaaaacggaattaagctgttgatgacagacgcgctgcctgagcgcaggcacacgtggaatctgactgagcaggttcacaagcctttggaaaaagatcatcatcatatttttcttcctttccaacgtggaaatctgactgctctgggggactgacttaaaatggttctgtttaacaatatttgaaacggagtactgctttggagtaagaattaatgagagcattttggactgttttttctgaaaaaagataagaaaaaactcttgaagataatagttgcctctggagacctttgctgctgctcacagctttactgtgcgcttccatgagtgagtctccactttcatcatggacaaatgtctggaactttggtaagatttaaagacctttggaaatttttaagattttttttggctgccagtaatttatcagcactcagttctcctagaacatttttactggatcggggacgtcagatggtttgtttgcttttggatggctttcggggaacttttaaattgtttataagaagaccatactgagggcccccttgagttattcttgtgttgaatgatagttctttagaaagtattttctgaaggactctttttaattcatttttttcttttaagctgatgtgcaaagtggattttcatggatcagaaaatatctatggttttatttctttgtaaatgtggatctatcagaaatattcactgtgcatctcctttgtaaccatcgccttctagctttggattacatatgacttgagtgttcagctctgtcagtcaacttcatagtgaatgttaaaattcatattagaatacttgagcctagaattgtgccagaattcatcatgggctcagataatgtttcaacatcaggatttgtccaatagaaatctctccttgaacatggacacctggagacaattctgcattaaatgctatagctgcaggcaggctttcgctgagcacagggtggaccttcttcatcacatggaccttatcgtgagggcttgggattttccactcaagaatcctggggccagaagtccagtataaaagttgtagtccaggcttggccatacggaggaaggcattttcacttctagtttatccagcccagctcccacccctcagaccccagccactgttctttcggccaggagactccagcactgagttctctcccattcttcacacagatttgctcatctccatcatcggcagccttgggagtagtcagaaccaagctaatgatagtcagaaggaggacggtggaggcccatgaaatgaggaacttgcccaaacaaccccacgtgctttagaagaggcaggacaagtcccgaagtctcctagaaatagaacagctctcatgatatctgaaagtcatggattttgaaagatcaaaattcaaaagataaaaactttgaattttgatcttttcctgggctagcgttgtgcgataggcaactcttgcaatgccagtcaggagccacaagccgttctggttttcacttttgatacagaatttgataaattacacaagatattaaacactttattataaaacaggctttgtgttagaccattttgcctaacgtaggccagtgtttaagttttctgagcatgtttaaggatggctaggctaagctatgatgttgggtaggttaggtgtattaaatgtgtttttgagttaaaaatattttctattgggctgggtgcagtagctcacgcctgtaattccagcactttaggaggacaaggcggacaaatcacatgaggttaggagttcaagaccagcctggccaacatggcgaaaccccgtctctactaaaaatacaaaaattagcggcgcatggtggcacactactataatcccagctactgcggaggctgaggttgcagtgagccaagatagtaacactgcaatccagcctcagtgacagagtgagaccctgcctcaaatatatatatatatatatgtatatgtatgtatgtgtatatatatacacacatatatatacatatatatacacacatatatatacatatatatacacatatatacatatatacatatatatacatatatacacatatatacatatatacacatatatacgcatatatacacatatgtatatacatatatatacacacatatatatacacatatgtatatacatatatatatacatatatacatatatatacatatatatatatacatacatatatatatatattttcaacttacaatgggcttattgggacataccccatcataagctgaggtgcgtctgtatgtgctgctcaagctcttgcgtatacccacatagttgatggagggccactgcacacatttcctgatattcactgtctcaagctagacgtctgggctggagggagaaaatgagaatttcgggaagaagatacagatttgcagccacgctttttatgcatgattggtttaatctttgctgctttaatgttaaatatttaaatgcaagaaataatagtaatgataaatgtagctgctaagtgcaacaatccacactgttaaatttcattcacatacttctagtgaacacatatacatccttttaagagttcagttgtatgtctcatagagcaaaggagagtgagcactcacgccttcctcttagggaaagcagaccctctaggggatctccttgcatctgtcccccctcaaactgtggtggcagtattcctgccctgacgtcaagcctcatggtgtggagggagctcccggcggggcctcgccacagagttttccatgaccccgcggcacccaccgcagccttcccacccctttcccagcggcggcattcaggaaatggtcctgcagatgtctcttctgatgtctcttctgatggtggttgggctcaaggagttggccttgtggaatttcggaaagagttctgcagtcacccactgactgtgacccatccttgacatcatttccctttcactggatacttggtgagctctggcttcaaatgtgagggctttcattccctgaatgatttgcagtctgctcgtaaatggaaatctcgaggcgctagatgacagaaagcagcagcagggccatcgtggtcccgaacgcagcttgccctgcacctctcagccactgctgcggactccagccagtctggaatggtgcctagaatgcttggactgcaaaggcgacgggggtcctgtcctgcccagtaacctttcactacctcttaaagtttttaggattcgtatgtggaatcctacctcatgctgagcgtcatgttatgcaattggctagttcagcatcccatgacattttattgaattcaaacaccatgaatgaataaaacaatttcattgcctgtgaagaagttacagggttgaggtggagaaggaattgcagtttccctgataagcattgcttgtttcccttggatgcacccagcacatggaggctgccatacccagtacactcagtgctcagtaccaaacccggtacccgtactcattccgtgcgtagaggaagcccccgagagctggcagcatctctgtgtgtgcttcagtccattgtgaagatccgtgatcctaatatttcagattggaaaaatccattaaaattttgatttaaagatatggattccatgtcagccactgaaacaggcctttgacagtaagaattttgatgactgcttattctaggtatattttgtgttaacatcagtttttgttgttggtaattatattttccccccacatttagaagcttcatgctattttaacttcagctgtcctgggtatttgatttgtatttgaatttctgacttagctatgacggaagcttattagagtatttgctttcctgaatcatgaacttgtttctacaagcattggaagaggaagggaaataattgggtattataaaatgactttctatccacgcattttaaggattttttaaaaagtatatgcttgctttagataatgcattaagcaagaattttaagttgctccatgcatgaaaccctatttcatgcctaatttacaatgcctaattttggtgctaagattattctccatgttgtattctttcatctttatagacaatggcactttgttctccctccacaaattctgaatttcatcatttggggacacagcagtagtcatctccggctttggcgtatgattttccttttttgatcagtgctctgcattgcactgatgttcaggaatgagagcacaaggttcagctgcacgaaaactttctgtgtagtatttttcaagtttctcgtttctttcttccattttaaatagtctttgctgtgacagacaatggttgtggttttcatttttgcctgacatgaagtctgtggccgccatggatttttggaccttgccttgagcacaccatgggaaacagatgatcgagggtcctgttgctccctgactctaactgtgcacattctgccttgagctccagtggaagtggggggtcactgtggtcacgttagtagcattgccagttgcagctgcaaagtctggcttggaccctgctagctccaataacctttgcacaacatgtccagctctttgctcttcttacaatcctggtggaaatgtgctaaaatcttggaggaataatttggccccatactgcatgctggtcgccagctaactgtatagctgtttaagtgcttattctgtccgtttgctctgctctggttcccataataaccttggacagggtacagagtattagattattcgtgtgcacttttatctggacaaaagattaagaacgttaaaaaaatatgtggggaatggcaagaaccatgtccatggaggagtcacttccttcttagctccttcatttcaaagctctggggatacacagattgcttaaactttctggtgacatttgggaaagaatgtgttcttgcggtaaaagcaaggtctgggaatttggatttctgtgttctgttcccagcagcacgaggggtcacccagtgacgtacgacaagtcagttaagcatcggaatcttaatttccctatctgtgaaatggacatagaagggtcggtaccttgggctgacatgaagttggtgaattgtttgatgttctgctgggaaccggcttgctctagtgacccagaaaaaacagggactatggtggaggctgacctcatttctatttctggctgtagtgctgactcagtgagaaacttgtagaaatcagttaatctggctctggtcctcagtgcattccatggttaaattgagaattataaaatcttatcatcgctggtctcatggcgatactgcccatattaattaagtactaaaaatactccaccaaatgtattagaaagcttctacatggacctgcctttctcatttccttcctgtctgatgttgggttacttggggctacacaagtccatatttatttatttattttagccgctgtttggagttcagtcctattctggtttgagcagacttttcctatatccgaaaactgggtgccccagattggtgaccttgtgcactgtaactccttacagcaggattttctgccattgtgtcctggggccatcactgcagggtgtatttaaggagctcttcatttgaacaagtcctggtctgggaatgtttttccttcctcactgtcacaggcctcagggagaaggagccagccttccctgtcaaaccttgggatcagggccctcgtggagtcacgtctgtgcttctggccgactccctggatgctgctggcctgaaggggcagtgccacagtatggggcttgaggttctttaatccatttactgtttgattcaattctttagggtttgaaacaatctctcccatatttatccacatactgtgtctagactcctgacatatcctttcaacgaaacacagctctatggaggtgtggcggctgagtcccaggttcataacgtccttcctgcgtttgtaaaaatggagcaggcagttaattcaccagttaagtgccaggactggctgagtggtttggaaagaaggacgactttggatgtttatgttatgtggtgtgtagcttgtcggttgatttttactttcaactaatgcaactttgagaaaggcactgaacactaagtaatcctgcctgtgatctccaaactgtctgccttatgtttttaaatcagctaacaatggttactgaatctacccaattcgtatggtaaggctgcactgaagtccacatgctgtaaagtaaataggttttcttgatttcttacaatggttatgggttgttgttttttttttttttttgagacagagtctcactctgtctcccaggctagagtgcagtggcatgatcttggctctctgcaacctctgcctcccaggttcaagtgactctccagcctcagcctcctgagtaactgagattacaggcgtgcaccactacacccaactaatttttgcattttttagtagagaaagagttttgccatgttggccaggctggtctcgaactcctgacctctggtgatctgcccgcctctatctcccaaagtgctgggattacaggcatgagcgagccaccgcacccagcccaaaaaatactcttgaaagacatttctcattaaagcccaccatcaccccatgatggcccaagggaggctaagcatcttgcatgaggtgcacactgtggactctgcccacccacatctcctaatggtctctaaagaggaagacgtcttggaggctccatcacagaatctcagcactgaggctgttgctaacaagagagttccattgattgagcgaaattataaccagttcagtgaaaaacacctcgctatttgttactctatttacccaagaaattatttggcattaagtacatataaaggattgtgctaggaatgagatataaatatttcctgccctcaagagtttaaaacacagtagagcaaaaccacctgaagtagtcgttgctatctgtttccagacactcactgtggacttgcgcaaggctggatgctgcttagatttattatgggaagtggctcataggattatagaggctgaggagttccatgatctgccgcctgcaagcctgggaactcaggactcctgaagtgtaactgggtccaaggccagcggctggagagcccaaggggctagtggtacaagtccctgaatctgaaggccagagaacccagagttctgatgtccaagggcaggagaagatgggtgcccagctccagaagagagagaattggcctctcttctgcctttttgttctatccgggcctcaactaacaatgacacctgctcaccctgggtgagggcagatcttccttactgtccatgtattcaaatgcccatctcttccagaaacacaccctcaaaaacacatccagaagtcatgctttaccagctctctgattatcctgtgacccagtcaacttggcacctaaaattaggcatcacgggccaggcgtggtagcccatgcctgtaatcccagcacttttggtggccgaggtgggtggatcacctgagatcagaagttcgagaccagcctggccaacatggtgaaaccctgcctctactaaaaatacaaaaattagccagcgtggtggcgcacgcctgtaatcccagctacccgggaggctgaggcaggagaatcccttgactcaggcagtggactttgcagtgagccgagatcgtgcatgcactccagcctgggcaacagaatgagactccatctcaaaaaaaatatatatatagccatcacagttggtcaccaattccttcctctgttctttactgctgccttttgcctgactgatgttcctcttctgtagggtgaaagaggcctcccggggttacaaggtgtcattgggtttcctggaatgcaaggacctgaggggccacagggaccaccaggacaaaaggtaagcacggctgtgggattgggggtgggtggatgtaagattgcccgcattcttgagatagcggtgatcaatgacaatggcatttctattctgttccagggtgatactggagaaccaggactacctggaacaaaagggacaagagtgagtacagttgctactcacaatcgatgattccatgcgtgggacaggcccgcttccagagccgggcaccttttccctcctttctccttgccctcgtcctccatctcctctcccagctcacacagcacgggcaggcaggcgcgaggcaggcagtgaggagcagcccgtgactccctgagccccagtccttcccatggggactgtgcacaggctgagctccttagtccttggttctgcaaacttgctttcccccatttgttcttcttcaggaatctcttctgggcattttttaatttgggggaaggggcaattgatgatgtgtccacagtcattagacagagatgacttcatttaatggaaaagtcatggtattttcagagccagccttgctcttcctcctctccacctcttagtaatgatgaaatgggagcagagttattttgtgcatgggcagccttatgtttgaagggatcagcagtcagcttttaaaaacttatttttttgtttttttttatttcaattttttttggtacaggtggtgtttggttgcatgtataagttctttcgtggtgatttctgagattttagtgcacctgtcacccaagcagtgtacgctctacctgttacgtagtttttgatccctcacctccttccagccttccccccacctgagtcccgaagtccattgtatcactcttatgcctttacatcctcatagcttagacgccacttatacgtgagaacatacggtatttggtttcccattcccgggttacttcacttagaataatggcctctagctccattcaagttgctgcaaaagacatcattttgttccttgttgtggctgagtagtgttccatggtgcatggattccaccttttctctatccactcgttggttggtaggtacttaggttggttccatatctttgcagtggcgaatggcagtagtgtgctttgggtgtagcattgctcctgtaagcctgggccatctgccctaggctgtgccctctgctgcctcttgtgcagagtgctctgtctgctttgtgtgtgttctgacaccaaaaatgagggcatgactccattaaccggggagatgcaggaggaggaagtgaggcttcccggctcttcactgacacgcttttacttccgccctcacagggacctccgggagcatctggctaccctggaaacccaggacttcccgtatgtatagaaaacgtgctctacttcttttatgaaatattcttccatcaggcgattttctgcctgggttacattttcactttcttcattgcagggaattcctggccaagacggcccgccaggccccccaggtattccaggatgcaatggcacaaaggtaaatccagaaccgagaccctcctttttgtgtgtgtttacgtaatttttgcatattaaggagtcaggtagtgtgattctgttaatagagttttatttgccacaattggaaagttgcttgtcttaaagtttgctttatttagtaaggaaatacagttttcccatatttagtgtaccagaaagatataattgttcctttcttttttgtagacttttatcctaaaattgcatttaagcacgaaagttattacctataatcatttactacatcacgtaagaaaatgccattatgggcctttgtccctattaatgatactatcaagtctatttcttctttcataaagtggtacccagtagcacagcttgtgacaaactgtttttaggaaatgattttaaccaacaaatgaagggtagggcagagtgatgcatgcgatgtcagggctgatgtgtctgccacacacagtgcgtatgaatgatgctctgctgtctccccagggggagagagggccgctcgggcctcctggcttgcctggtttcgctggaaatcccgtgagtagaggttatttagggcagaacttctttcttttagttatgacttctctcttttcattccatttccttttctttctttctttgcttatgttttaataacttatattttatatataatattacatgataacaattttaatgctaatgatattttgagaaaaacaaaactaacaccaaaactttcttttttagggaccaccaggcttaccagggatgaaggtacattttattttattttgctttattggattcattacagggaatctgtttacaacaagtgccatagaagcacattctctttaaaccactttggctgatcgattgtttctgaacacacttccctaaactctgttacatgaaaagactgtacaagtaacccacaaactcagatctcagactctaacgttcagacacttggcacagcttcttaatggggaataagcagcggaaggaggcctggtgtggtggcgaaggctcacttcacccaaactggggaggcagatgggagaatggggctccctgggtgcctctcagacttcccaggagggaacctggggcagcttttcccaggcggggtgttgatgtcttggggctcggctgctggcatcagcccgacctcagactgtgcagtcatgtaatgtgtcggctgtgcttgggcacagggcggggacctcgggcatctggatgttgggatcagccttgtcaaagggaggcttacaggtctcagcagctgcagtagagataactgcttacctggatgaaggtgagagtccctgtgctcgctcctgtgattcagaacacgtaggaaatagatcctcataatagccctgtgtgttagcatgctccagagacacagaaccaggagcatgtgtgtgtgtggccagagagaggagaaactgcttctaaagcattggttctcatgattgtgggggccggcaaactcaaaacctgcagagtgaggtgggcaggccagacaccagagaaggggtggagttgtagtcttgggtctgaaggtggtgtgtgggcagaattccctcttcctccagggaggtcagtcttttatcctgtaagaccttcaactgatgggatgaggcccaccagcattatggagggccatttgccttattcagagtctactgatttaagtgttaagctcattttaaaaatcccttcacagaaacatctggtctggtgtttaacccaataatgtggcctagccaagttggcagataaaatttaccattacgccgtgcttttataaaagtattcatcctgagccttttctcaaaagagaattcttgttttgtgaggagagcctgtggtcacgcagtagtctttcaaccagagacaagggcccttgtctagagttgggggtggtcctcgggcagtgtggcagacccctttgctttgccgtctctacattcagtcccggctgcggctcagttgaccaggcagtggttaacgctggccattaagacggcaatcatgatgggagagatggccaggctattgatttccagtgtagacggggtctaaatcccagacttaggctagtcctgtaacactaatatatgccaactatcaaagagttttcagcttctttacatgaatgtcgatatttgcaactttctattttctttcttcatcctctagggtgatccaggtgagatacttggccatgtgcccgggatgctgttgaaaggtgaaagaggatttcccggaatcccagggactccagtaagcatttgctgaatcattatgaacatgtgccacctcaccctcccagttcgcatctgaactcatttctttctcatgcattctagggcccaccaggactgccagggcttcaaggtcctgttgggcctccaggatttaccggaccaccagtaagttttgggggctgtctctccgaggcaatcatttaaaaaacaactatattgaggtttgaaaataaataataatttagtaaaaactttacacagttgtggtcgctcttaatttggacatggcggaatcagcttccctcttactaaacgtttggctggcatcccggtacccatatacccagagctgtgggaaagggatgatgatagtaccataaactgataccctgaaacaaataatgcagtcatggttgaaggggctggcggggtactgctgatagtcacagcctgtgggagtgagttcaaagatggacagacaggctgtgccccaggtgacttcaccagggagcaggggagatggattggtattggtatggtcacacctgagggtcctgcacctgctaggagtggggagggaggggaagcccaggaaaaatatttcacaaataaattatcatgttgaccagagaatcttaagataacgtcagcctgaagaagggcttaaagctccctagagttctgaatcctatttaattaaaatgctgtctctcccagggtcccccaggccctcccggccctccaggtgaaaaggtaaaagttcttttcattttttgttctttggcattagtataaggctatcatgaaattgctatagctcactcttcttattctttcagtctctaaaaaaaagttggaaaattaacactatatctaactatacctttaagtatctatcatatatcatttattatctattgattatctatcaatatattgatcttttctttcatccatcccttagtcaatactttggaatcactgatatttcccttagttttctaatgcaagagtttaaaaactgtaaatttttaaaaaggtctttggaatttttgatcagtcatactttaaaaactttttcatagacattgaattcagcatgatcgttactttccagaaaattttatgagagttatgggacaaagctattgcctgaaatctaccatcttattgcattttgtgtgaggtttgtagaatgactttgaacgaagtagacaaatctaataatgagagcctaatttttaatccacagggacaaatgggcttaagttttcaaggaccaaaaggtgacaaggtgagtgcatattgctctggagtgctttcatgttgaaaaccacagtcctcacctgacagttcccacctttggatcaatgtctggactcttacaagtatagttactcttctctgcatgttcttgcatttggtagttagtgttttccttaaaatgccagcattattgaatttattctagcttattcagtacgctagaatttatggaagtgctctgtgatctgacaagcagagaacaacgagactaactccaattatctgtacaaagagttcaaactcttcttcgtcagtgatgaggtcagacctaggatttatgagtcaaatttaggacttgaccattagatgagtaaccctgtaagccctgcagagcgggagtccaccgccaggaaattgggagtagcacggtgggcagcggcccctcaccaccggcctctcttctcagaggcgggcatgtccagggccaccaccaggagaattaggactagcacggttggcagtggccccgcaccaccggcctctcttctcagaggtgggcaggtccaggaccaagtgggtgtgggaggagatgcagtgtggagccgggagggcacagaccacacagcaggtggcttcatcctgcagagaggaggcaagtggtgggtccctgatcctctccaggagtttccctggatcagaccaatgaagcaggcactggctaagaagggatgcctgccattgctgtagccagcctgtggaaggccagattctcctctgacatccaagctggtggaggcaattacaaccagagcgcccaatacagtggggcctggatggatctggatgtgcaggtggcctctgcttgccacccaagattttggcccagtcttttcataaactttgaaatatagtgactctgaaatgtatgcagttgtaatttttaggcgtacccggcagttaggatgcccgaggagggagactcttgatggttgtcttattctggggttacctaaaatgccttcttttttctcaagctctattaggtagtttgtattcctttcctccgtgccatcagaagccagtatacactatacaggggcacgcaagtccggaggtgtcttgcaggtgttcagattccatggttattcctgagctagtggccacccatagaagaagtgaaattctcctcctgggtttagatacttgttgtatcatcttcctattgaaatttgattttctgcagaggcaaggatgattagaacagaatagagtataattacattttaaaaataggtgttttattttaggcttttacctctctctgcaatttttcatgtctgcataattgttttcatgcctaattaattttacatttttatgtcgacagggtgaccaaggggtcagtgggcctccaggagtaccaggacaagctcaagttcaagaaaaaggagacttcgccaccaagggagaaaaggtatgagtgggcttcatcagtgaatactgattttctaattttggacaaattccaaaagataaagagaaaatgggtcaaaactcagtttttccagctacattcaatcctggtctggaaaacagatttatagactgttcagtccataaaatacgagcccctttgagagcagagacagctggaactggattggtccaagcctgatctgaggctcaccccgctggatcagggcttcttaaatgtgccccaagttggagatggcttggtcaggaggagggagctgggctggggggcaggaggggggcagggccagtcatcatgggtcaagcatgataaaccctgccctgcttacatttataccagtcaatgtcaagtgagtgctggagatcaacatgaatttctttgttaatatatcagaaaaaggttttttttttttctgctgtgtgtttaatgcagcatataacaaatgatacagctgtttgatagtgctgatctgtctctcgaattctttcagggccaaaaaggtgaacctggatttcaggtcagtactcagtttctgcctatcatttttaggtcaaagaccataaagatttaagtttcaagtttttttcaccttaagtttaatatctatctaatttaaattttgcttaaatagacgaataaatctctttgtctttttattcctttaaggggatgccaggggtcggagagaaaggtgaacccggaaaaccaggacccagagtaagtgctttccaaagtccttttatcataaaacaattctccttccatgcggaaaatcgcagattcacagaaacacaagaacagaaaaggctcgtagggacttctagtttatccctttcatgccccgaagggcttttccgagactctcctgagctatatcagttgcaaggcttcccaggcaggcgaggtccttccctgtttaaggatccagcactgaaggtgccaccgccggctgttcaaagaggcttctgaagagccctgggccatccctgaaaccttcggtcctgctctgagagcagcaggttggttggactttgccacccagaacaccagacagtgtttgcacagccacaagcctgagaggctgagttgcttttcactttagggatggtggtggcgtgagacccaccccactgccagtcagctgggatggttctggtttctacctggaaggagcatgcagaaacctgcattaaatgaagcatttgcataagcttgcaaatactcagctgccaataggcaaacttctctaatgttagctttgctaccaagatacaatcatattttagaagacttgtagctcatcggactctgctctttaaaaatggagttctcttatattgtaactgtttcataattattcatcatatacaatattacttattattgtggtattgtcaacttacatagagccctcatttaccttgcttgtgtttcataggagagacaacatattaagctatctgaatcagagctttggtgttatatccgttattatatatatatacatatatatatatttgagacagagtctcactctgttgcccaggctggagtgcaatggtgtgatctcggctcactgcaacctccgcctcctgggttcaagtgattctcctgcctcagcctcccaagtaggtgggactacaggtacctgccaccacacccagctaatttttgtatttttagtggagacgggatttcgccatgttggccaggctggtctcgaactcctgacctcaggtgatccacccacctcggcctcccaaagtgctgggattacaggcatgagccaccgcgcgcagtctattatttattaaatactaacgtttacatctttattctacagggcaaacccggaaaagatggtgacaaaggggaaaaagggagtcccgtaagtgtttctctgtggtttttacaagcaggctcactgttcctaccactggcctctgacggttactgcttctctcttcggtttcagggttttcctggtgaacccgggtacccaggactcataggccgccagggcccgcaggtaaacgctggcactattgtgagcctttatcttcactttccaattcaacccagaagtctgtttattctttcctagaataaaggactctgtactcaagggaaaaaaatcatttatgcttcttctgggtaaaaacacaatttagtggtttcctttatgttcatgattttttacaaaataaaaatatatgaaatgtgccattcattcaaatttttatatctttttttggtagtagattatttttttcctgatcataaagcaatagaaaatacagaaagatatcacgaggtaaagaaagcttacctaattttttctgttacctgttcagaagtggccagagttcgccttgttcctatgtgcatacacaagcaggcagtttttaaaggtgatagtgaacaagacatcttgctttttcacgtaatgatagaaggaggatctatttcaatggccgtcagtgtaattatgatgtgaacatccatgccttttgttgcgtggtatttaggccatttccaaatttgtatgcttacaagtatttttgctcacttgtctggtcatttctctgtcaaattcctaaaagcgtaatattggggtccacagtcagacacttgttttgaaatttttgccacatgcaaccaaattgccccagaaagtccttctgccagaccagggcccttttagttggggaactaactaaaaaaaaaaaaaaaatctaaaaaatatttgtcaatctgacaggcagaaaaaaaaaacctcattattgctttatttttctctcttaatatgagactaggtaatgtaagtctttactaatataagagataattttggaatagtcatcaccaaaggcgaatggaaagctgcggggagggcctcagtagcctacggttaatttattaaagccagggacaaaaggaagaaacccttggctgtaattttttgaggaagtaaaatcctgtacattttaaatggtagatatatttagaatatagtggctaagatatttatgtcctctagatatttctaaaatcttctggtattcatataagaaaaatcaaaacattcaattcttgtttactgccttaatttaaaaggaaaatatatacattcatggtaaaatgtacatatctttggactgtttaaatcattacgatgacgtttatataaaaatatttgatatgaaagggttaatttctttgagtttttcatctactatggatgagattaaaccttaaagtgatcagaatttatccactaatgttttcagttaatattagattttacattatgacctccaatgcaaatttgagaaaatcttcacctaaaaacatcatataaaatgatttatttaagaaaatgtatttggaaatcatgcttttatattattttatttcatttctctttttaaaattgaaaaaccctggttgccagttccgctcatcaatgattctgttttccgaggaagtgtgcagttgatgggacaagtatctgggcttttgtaaggagaataattagcccccaacttatattttgcagagatctttattttcatgtgtcatgcgtgtgcaaagcaaaatgaaatctattcatttttgttgtaatcgtcacagaatgagagatattaaagagagaaaaatagttttaatttactgtaggcacactctattttaccagaagaaatgtttaatctgctttctgcaagacaatctttatagtaagaatatgcaaggaaagttattttttcttttgtagggagaaaagggtgaagcaggtcctcctggcccacctggaattgtgagtaagagtgctgtccctgggtctgtgagagcgctgggggaggaaggagaggaccctgggtctgtgagagcactggggggaggaaggagaggaccctgggtctgtgagagcgctgggagaggaaggagaggagatgcagggcacacacccacagctgtctctagaattgcatttgttatgtaaagtggttcatgctacttgaaatgattttctaatttgttgtacggagtttagtgtttattatttttattatattttgataatttctgcacatctttaaatcactgaaaatgaaaaggtttccacatgaatgagaatattagcaacatatttgactcctttttttttttgaaatggagtcttgctctgttgcccaggctggagtgcagtggtgcgatcttggctcactgcaacctctgcctcctgggttcaagtgattctcccatctcagccccccgtgtagctgtgatcgcaggtgcctgccaccatgcccagctaatttttgtatttttagtagagacagggcctgactatgttggccaagctggtctcgaactcctgatctcaggtgacccacccaccttggcctcccaaagttctgggattacaggcatgagccactgtgcctggccttgacaccttttttaaaaaaacgtggtccattgaggaaaatttttgtaagagaaacaggtcatctgtaatttaactatcctggtaaaacaatttttatttttgcaaataacattttactactggtcaacatacatattttgcatacttgtcagtgatgtgtgtgacatttaaaaatgggcattatcatgtttgcacatatcttcatggtgatcattttcagtgtcctatcagagagttgtgctttaatttttttagccattttgcccccagacttttttgaaataatgaaaatgttaccgttctctcctttgctgccttccttgcagtgccacaggtaatgcgttcacacagcccattttatttatagatttacattgaagggttttactttcattttttaactgacaaaaattgtatatatttatggtatacatcatgatgttttatatatataacttgtgggatgactaagtcaagctatttaacattggcacattttaataatatctattaattgatacaaaggaattatagttcaaaggtaatatgcaaaagttgactttgccgcttgtcttgaattccattaatttagaatcagggccagtgaattttctccttgttaaggagccgaaagtgcctcttcttgtcttgcgaccttaaggaagcgcctactttttttttttttttttttaagagtgttcctctcataatacgttgtaaagtaaaacattctgtttatggctagtatgtacaattagaaattataaatctaagcctcaaattgatgttactccatctttacctcactggagtgttacaaaagctgctgccaggcaaactattacaaaaggaagcagaaccgcctgcctggcaggatcctttgcagggatggttgcagcatgtttattccatatgctttcgttgttgttgctgtttgtttctttgtttgagacagagtctcactccgtcacccaggccggagtgcagtggtgccatctcagctcaatgcaacctccacctcctgggttcgagcgattctcccgtctcagcctcccaagtagctgggattacaggcatatgccaccacgcccgactaatttttgtatttttagtagagtcggggtttcaccatattgaccaggctggtctcgaactcctgaccttgtgatccacctgcctcagcctcccaaagtgctgggattacaggcgtgagccaccgcaccggcctgtcccatatgttttagaggcttatccccttcctccttgtccgctaccattgctgctacttcactttcatatttcttgaaataaaaacaaatatgtacatttcttcactcatactgctttactatacaggactagccattcccatgccacgggatgatcaccttttccttctcgattcaggttataggcacaggacctttgggagaaaaaggagagaggggctaccctggaactccggggccaagaggagagccaggcccaaaaggtagctttcttgcctttttcccccctcctcctactccccctccttctctcctcctcctcttcctcctcctcgtcctcttcctcctcctcctcctgttcctcctcctccttcctcctccccctccttctcttcctccgccccctccttctcttcctcctccccctcctcctctttctcctcttcctcctcctcctccttctctctctctccccacgctttctatttcttcccctctttttgtctagttttgacctgtgttcctccatattttggaagcatctgcaggccttgcaggactgtctgtgaccaggtctcctccaagttcctatttcactgtcacaacaggcttcaggagcccttcgctgtagctttgagagcaatgcatttccagagtgggggctcgggtggtctcccgctctgttttctacgttccctttggccatggacacttaccaatgcaccaagcaaggctttcagtagagaaataagaagtgtatacaaacgggtgaactgttctgtttgatccaacactctctttctcttttcaggtttcccaggactaccaggccaacccggacctccaggtgagactccttaactgatttgttatagcatacttgcacaccttctgtgctgtttatattctgaatatataatttatcacgaatgttagatatttgcacacaatcggtagcaatcttacgacatcttttctagtgatgaaagcagagtagacaagtgcttgtagataagtatcttgtcttttgtaagtgaccacttagcatgttaatgaacatgtacacccttatgtctctcctggggatccagatctattctgcccagctctgatgtaaccccaccagagccagcctgcccccctcttttcccacggctcccactgagcaggtcctgtctttccacagagccccgattctagcacagtcaggcgccttcctcctcagcgtcctgaccactttcccctctctctgggatgtttcccagctggagatcagactccaggacaaaaccccttccagctgctgtgcccagccccagccttgcctccctggaccccggggctcctcagggtgaagtcattctccagtcactccagacgtgccaacctgtgtttcctggcagactgcgctttgcagaggctcgctgttgtctctgtccatatgcgcagatgcacgtgtgtccacgtgtgtgcgtgtgcacctgtggtattctcccaggtcccagagctgacccgataagcgtctgatggaaacgctcacgtgccctagcattggcacacaacggagtgttcgcagcctttacgctttttgctttgtttttgatgtttacatttatttttgtttttatccccgtttattattttatatttgtttcctttccagctggtctaagttcttgcagagcccccttttttcctttattgggaacagacgacaccccacacagcccacgcctggctcagggcagggccttcgtccactcccactttctctcttttctgtaaaaactctgactctacccttaaaagcatcccttttgtctcttcttaattcttggattctcggaaatgtgtgacttcatgtctcctcacagaagccttgtttactgtctacagccttttatctaacccttagtggtctcttaacccagacgcttgataaaaagccattgaagttgctctggctggaggagttacccacgtccccctcccaaagtcgctgcgctcctctctgtccagtcctgccctgggctcgcctgtggccttgaccattgcctctgcccgcccccagctccctgaccgtcctcctcaccctgagggtctggttggcctcgtgcccgggtagttccttcattttcctctccattagacatgctgcccctcattcaccactcaggaagggcacacagtattttgtggaagcccacaggggccgcccctcggggctcttggctgccttggagcacgttgtgcttgtggcttttctccccagtgacaggctggatgtctcaggctctgtgcccctttggtcagcgctcttccctctcctctccatgctgctcttcattcctgccaagtcttcctgcgtcctgtttccctcgactgtcctttttctcacactctcctcatcatagcctgatgctgggagcagaagctggtgcgtccctcacagaagcagcagagctttctccatgcagcctcctgcaccaccactctctcaagccctgcgtccggcctcagctctcccaggggcacatggtcttacccttacagagttacagtggctgaacctgacctgatatgttcacacctaatggctactctgacttcaaacccttttacagaaccatcttgtgtgtccttagttgtgattttctgctctttcttctagattgccaacccactgaccatccctttgctccaggtccactttagctttgttgaatgacatttctatgccctcattggccaagtagaaatgcagtgcaccctctacagcctttttaaaatatgttgggaatactatttgcactgagagaaattcacagattttaatatctacgtaatgagtccctgttctttgaagttaatttgtaggaaacatttgactgtcagcatgaaatggcaagacacctgccagcttaatttggttttacatgtctaaagcagttcccttttcagtgatggtctggttggatttttaccttgaacagagttaggagaatgagtttatgctgtagttgctaagtggccctgaggttactgatgtgagcttctgtctggttgcaggcctccctgtacctgggcaggctggtgcccctggcttccctggtgaaagaggagaaaaaggtgaccgaggatttcctggtacatctctgccaggaccaagtggaagagatgggctcccgggtcctcctggttcccctgggccccctgggcagcctggctacacaagtgagttccctcagaaatggtttaatgtggggtgcaagcagacgccagggtgccgggcagacccaggttgggggctgtgatagtcccccacagccagagtgtaatagaaaggcgtggattcttctaatcatccatattcctctaagggaatcttcagagaatgaaccatgctacaaaaagcaatagttaaaatttcaaaataaagctggtttaacggagtaaataacacgttaaccacctctgagactcctggcatctaaagttaaaaagcaaaactgttgagttatgtaatttttattgaaaacagaatgcattcttcttcatctagagatacaaatgaatactaggacacacacacacacacacacacacacacacacacacacaccccagaaacaaggaagacaggattacatgggtaaagattacattagtaaagtccagaaaagccagcttttattccagaaaaggtgaacatgtaacatggaagtcttgactcaattaagatggccgtgtggtcccaatacaataccaaagcaaattcgaagaaaatctccaaggatttaagccaacctgtgcaatgggagtgtgttcagatacctggagccagcctttggaacctgctggatcaaaaccaacgtgtgctctgtggggcccctgaaacacgaatcctctgtggggttgattgagaaaggattcacaggcttcaagtcccagcaagatttatttgctagaattcaagcaaatctttacgaaagggagttctcatggatgaggccactgttgggggctgggccaggactagatggagccatggattccagcctggcagcttcgatggggaatgtgatctacatgaatttgggtaggagaaagaacagatcatgtgtgactttggggaacttttctcctctgctcttgtgattgtgtgaaacatgggaaatgaagataaaatattgcagtcctggagacactcaatccagaggctccttttctctgtgtgtctgagagaaggttgtgagctctgaccaaggggcctttgggttccagattcattcagcggggaagggagtgcctgggaggcagagatctagcagtggtgacaagactcaacagatcctgctgtcctggagcaagtattccatggggctgacaggggttacccaagacaagggaattctcatgaatgcaggagatgataagtccagggataaacttaagcaggagagtcaacagagggttctggggtggggggtgggcaggggattgtggttttaagcagagtgatttacaaagacatgaagggggtgagggagccaatggtggggaaatctgggaaaaggacattcttttggatgttcgtaattttgcaagtgatgaaatataaacacacgtcatgtaaaaatatgaactttacactcttgttaattgaatgggatgtgttagctgagcacattgtaatatttactattccaggttttctaggtggcctttttagtccacgtaaattaagtaattctcaatcacagagtatcgagtaataatttagaaatgagatttgtactaagatttataatgtatgttaaagaggctacatcttaaagccattgctacctcaggacttatcgatagagcattaaccacacaatgcagccatttgtgcatgtaagttctgccactgcattcttgtctcaagtgggtacagccagctctaaaccatctgtggctgcagatacccttgatgagaaggcgttgtaaaatgtaaactctagatttgcactttagaactcctcagaaataatcactgcataaaatgaatttaaatggactttggtgaggatgtactattttttttttgtttgtttgttttttgttttttgtttttttgtcagggatatgaagggattctggttgagctgaagcaggcaggagttatgctctggaaaaggagtataacagttacatgtctctcaatattcttgagcatacatttctagagtcaaggaattagtataccctaggctcacagggatgagagatgtgggttctttcagtgaagtaatttaggggctgctctttgaagcataaacatggagtccactttgtttaagacgatggtgccagctgcaccaatgtcgaagggctaacgaggagccaggcaggaccagagtcaccaggagcaggtccctagcagtggctgtgggggacccatggtgaccccacttgggctttcttgcctcctgtgctttgtggggagaaactcagggaaagacacataagcacataagcaacaagcaaagcaaaagcacctcccccatagttcctacacagcggaagctaacttgttctgctgagctctaaaccaagtcatcaaacaaggtgtgggatctttttaggcattctggttctagctggggtgggcgagctggagagttgaccttggttaatatattcaagcccgagggagggccccacagccccactccacaccctggggcccttctatagtctgggactcagggcgtccaggtgacagctgaacagagactgcccatgactttgtcattaggtgaagaccctgtaagggagaggggagggccttcagtgctggtgcatgagtgttagggttatgcctgggcagggatgctggataccaagttgttcactgtgtcttttttcttcaaggatcttggggaaggaaatataaactccatctcagtgtgtatccaaatcataaaacaataaacaatactgatattttttactagaacctaggacagatggtgtgtacattactgcagtttatttttatgcctctttacataaatgatgctcagaattgaatgtgaacaatttgaggcatttcctcgtgggcagtctgcagctctaaaataatgattagttttgctgtaaattgggttagagggggaaaaaaggaagaaaatttttctagtctcagctttgactagatgcatgaccctggacaaatcacttacctttcttgagcctcagtttcttcatttgtaaaataagggtgatggtaggcacttcgcaagatgaaatgaaatagtatacaggacagggctgatgcacctacagatacttcagaatttgtgaaatagaaatgttggcagtgatggcttgggatggtgagtgggtggtgggtggtgtgtggtgattatgttttgcaagtggtggatagcctaagatgattttgaaacaaactaaagctgaatttctaacacttgtcaaatagcctaaaatattttggttttataatagaggttgagttaggagagggtaaaaacacctagctatgatcctataactctgacaactcaatttcagatggaattgtggaatgtcagcccggacctccaggtgaccagggtcctcctggaattccagggcagccaggatttataggcgaaattggagagaaaggtaagaaattttgatttttttaaaatggtggttgtgtctttgcgtatgattttttcccacatacttaccggctttggagccaagtgggggtgggcagagttagggcgtaggttccttttatttggaaccctcttcacaatctcttcctagaataagcatcttccggaacttagttgatgatctgggtgggaaaggtggagacagccctgaaagtcagagttttgccccttctccctttccgaggaccgtgaagtcagtcttgctacagtgggcgtggtcagcagataaaactcagactgatttgttaccgcaatctttccattcagtgtttgagaagagacttctgttaccaaagaatgctcttccctccttcaagccaagtcaaaaatctgcacatggaatgctcaccaattcttccagtggtgtttgcatcatcagtgtgagcaaatctaccgttgatgcattaaccagcttcactctgggctctcggttccatctttaatctttccaagtgtttgccttactacccgcacaggacacttatttatctcttccgccatcctagacacagaggtggattatcactgcatcaacagtcctgccttagaggggaataagcaatggatattctgatatttatatgcctgttagtaacccgagagtaggacaaataggaggctgtccctcaaatcaaccccactgtgtaccatttctgcctgtgaactgtaaacatgttttagtcttcaaatgtgtaagacagaaatgatgcatggaaaagtttcagccagcatcttagaattctgacagccacatacactgcaggacctgaaatggaagcgatcttgggcatcatcacaggggtgccactgatctgagtcagtgtacagtttgggttttaatgagtctgtctgctctagttaccaggcgctcagtactttgtgagatgggctcttccattttatgacagatccagcgtccagaggttcttcacactgcaatcttagctatccatcccccagatcctaggagaagcatctgtcttctcgagtcttcccattcctctttcgactccatcgtctgctgggaatgcaccttgtctccccacccacctgaagccttgcgaacagacacacccacgaatgccccagtgcccagaacttagctgggttctcagctgtgttgtaccgtgccccttccactgatgggctcctgctctgcctcctgaaagagctcgaaatgaaaccatgtgcctgctcccacacttcgggggcatggcctacctgcactggccctgttttacttctgactgaggggcatcccagggcagagtgggcaatagcagtgcccgtgtgcggctgccagccagggcagggatgggaagaacatggccacgccgcctcgatgtccctggcatgggcttctctgcgagcactttttgctctgtattatgcctgatttgtgcctagaaaccagacatttcaatatttaagacacaggaatagctaagacaatgtaaggtctctgagcttggcttgaaaatcaagacttcagatgttagaatttccaaagaagagcatctcctctcctttttcagggctgcagtctctctcctcttctgtcctggatcacatatgtgttcttgcttttgtggcttcttattcccaagtccaccaaccagtgaagtccatgaactggactaagcactcaaccaaagagaaaggggatgggtagttttcacattacagacaaattacaaaagtcaagtcttttcaggctgataggcacagttgaatttctggaccactttttactgaggcagccctgtcttttcgctgggagaagaacttggatctttaagcagtgcgtctgtggtcacacgtgacgcgtgctgggggcagtgggcccgttcattgacagacagggacgtgcgtttgactgcagtttccacccattagcagagagctgtctggaggagccattgccactgagcaaacctaagtttggatgtaatatgttagtgacagccttgcctttttctgttctctcagtgcactgcggagacttctggtcacatgttacacgtaagcacctttgtgttttcttttttaggtcaaaaaggagagagttgcctcatctgtgatatagacggatatcgggggcctcccgggccacagggacccccgggagaaataggtaagacccacatgtgaaaaggaccaggtcagagtttgctttggtgtgttggcatctttcctgtgaaagggatttcactccatagaaggcctgattttcggcagccaatcctaaagcataatcagaagaatgttgggccccacttccaggatttgtccacattgctgggaatgatcaagatggcctcataaagatttcctaataaaagacagcagcataacagttccctccatgccacagattctgttatctcacaagcagttaatggaattcatgtttttcctttaagtggtccctgggtgtgtgggcaggggggcaggtgtggggtgctggaagcattcctgcttccgggtgtacatgtgcgtcgggtcacctattccctttctgagtccgtcttgggcattttagttattactctctttggattatccaagcaatcatccacttcctatacagatttttatgcttttgagtcttaagaaaaggttttgagaagtgtctcatgaatgctgtgttgctgtctttttccctctctctcacgaaaggtttcccagggcagccaggggccaagggcgacagaggtttgcctggcagagatggtgttgcaggagtgccagtaagtaaacctgtctgagttcatgtacatatcagaagttgccaccaagcacgtggacagagttgtgtcgttttgcatttgcaagcatggcttctgccttgtgtgggagctggtaagtgttgctgtgtcgagccctctggagtgactccatgcggcccttgtctcaggagaatgagcaagactgttacccacagagcccaaatcacagctgcctttcttctcacctggtcaacattttttcggctgctgccgacctgtgttcaggtgtggctgaatgggagtgtgtccttccctcagggtctctgggatttctggaaacaaatggtgtcacaggagccacccccacacagccacagtgcagagccgaagtgccgtctttctgtgttaccagtgctggtaacatcatatcagatcatctaaaagctggttagtcagtaggttcagcatcaatagtttctatgaaaagatcaaggaaagcagatctgtttgcctctgaggattagaaatatgtttttattcttcttcttacagttgaaaatttctgttacaacatctattgtgcagttgctttttcaaatccataaatgaaatatccggatcacattgacatgaaacctttcaatggaacaaaataccagcttcttagcttttgtagtttgttttaaaagaatccactaaatagaagagcataataataatcttgaattttgaaggacattattttcttgcatataatgacttctgtttctgaagttttgaaatctcaaggcattgttcctctcgtattttctttgttcttctgagctttgcgagcatggactggtttccacaattcctttcattcctttttttctttttgtaagatattgaaagtcaaatttcagaattattcatttctgatgtagcccttcaaattttttaatttttaaagatattgctggaagcttctacaaaagaaaaccagggcaaaagcgagttgaaatagcaatgacccagctggaattcagcaatcattttctgcttttgaagttagatcttgggcttttgctctccagaacttccctggtgcctggggagctgagttagaagttgcaattgtttaagatatatctaaataaattagaagttcaaataactgggtagccctgactgtagtggggatcaaagacagaagaactttgaaggaagcagaaaaggacgtttttaacctctatgcaccgcttcatctcctgggctttcctggtggacttcctgcctcaactctggctgaaactcagtctagacatatctaataaaagacggaaaaagaggaaagaggtgagaaagaaggaatattgaggaaagatcataatatagaagaaaagaaagaaaacatacaaccccaattctactccttatgccttcatcaggagctcctttctttccggagttggaaaaagtctctaaaaataaatttatgggtaaataattcaattgagaagttagtaattttccttttattggaagctgtatttgaagctccgtgatttaactcgctcagaaatgtggttctcttattttgaatttggctagaggctaaaagagatatccataaacgagcacacaggagagtagattaaaatgtgaaatgctctgatttttcatttgacttagatagcatttctgtgacatttccttttgaaagacaagtatttgattttggggaaagaataatgaatcacaaaaggccgactccccgagcggattgatgatgcccaggttggtctgagcaggtttcatggttcctggtcactgggaggatgaattgaaaccaacactccctgactttttccacagtggcaccactttttagaggcagacagcgtaggtgtcagattttctccaattaatgcagccaatgctaaattttccaggcagtagttgaatcctcagcatttattttcagggagacggatcaaaagacctttgaactacttagaatcaagaagttctgtggcaaagaaagcacacgagatgtcctagggtcaccaatgtcactgttttaaaaacccagatttctcccgtaaatagaatgatggcaggcaaggtcatcattgttaaaataaaaaattatattttctcaccctaagatcacagtattggggagctttatatttttaggctgtgagtaatcaccataaaataatataatgatgtttgcaggttgagaaaaatatacattggttataatttcttacactagtattttttaatggatgaatattgccagttcagtgtatacttcctccagtatctcttttgttctggatgccaaggatacaaagataggaaaccttggtcctaccctcagagccctgaaatactagtggagagacagctctgcaaatagactgtcctaatgaagcaaagtgatttacagaatgaggaccagaaggcagcccgagcccacaagaaaggccgcatagaggaggctaattttagctgggattgaaggatgcataggagctaatattaactcaagagaaacagtttaaaaatcccacaacacctttcaagtaaataacaaattttccatgactctctgctacaatttctggcaggtggctcatagaaataatttgttgcctttcctgggacccagagcaaatagactgggtgtgttccacctttcctgagtagatccaagtgaagtgtcccaggtcataaggggcattagagtgcggggccagctcagaccactggtagtcgtccatgagaagcttctgccatgacaggagcgtgctacgtcagtgccatctgatctggcagctgctggccagtggtggctgttgagtctttgaaatgcagtcactgctgggtacggtggctcacgcctgaaatcccagcactttgggaggccgaggcgggcggatcacctgaggtcgggagttcgagaccggcctgaccaacatggagaaaccccgtctccactaaaaatacaaaattaactgggtgtggtggcgtatgcctataatcccagctgctcggaaggctgaggcaggagaatctcttgaacctgagaggcggaggttgcggtgagccgagatggcgccattgcactccagcctgggcaacaagagcgaaaatctgtctcaacaaaacaaaacaagcaaaaaacaaaacaaaacaaaaaacaaaaacaaatgtagtcactgtaatggaggaactgcattttttgtgttatttaatttaactttccaagtcatattgaacagtgcagagagttgctgccgactctctccatacttctggaagcctgcttgatgggattgggccaggagtcagtgcatcgtggttggtatggaagatggaatgggaggcagagcagcttctcccgttccttagcctgcgatgtttcagctgttaggaagcaattcaggcaggaaagcaagtctgctccatttaggttagtcccacatttgctgtttgtttgactttgagcaggacacagaagtccttcaagccccacctctccccctgtgtaatgggcagattttactcgctcatccctaactctccttagcactccagaggcacaggcataaggtacaagttttgcagctggaaatgcataaatgtggatcccagttccagcactttctggctgagtagtcttggatctatcagctcacttctttgagtatcagcttcttcctctgctatgtcctggtttccatgttttccttgcagagctgcaataagggtcagagatgctatagaatgggtcatagtgcctagcaggctggtaaccaatgctagccatattttcagtctaaagattgggcaaatgttggtctgtccttggttgaccaacttcttcctttgagaagcacatagcatctgtacacacagaagcgtgtgcatgtgagggattcatacatatctaagaaccttctgcaaggaagtttatgaaaaaaaattcacattaagtgaattgtgccagagttaaaattctgccaagtcgacagggagtctgaagatgcctttctcaggcctaagtgaacaagtcaatgggacaattgttggaaacattttctgtttttcttgtgaaacccaagtctcaggatgctggaggagaagccattggtgggtatgggtgttctttgcagttttaactttccaggaactgagcaacgttctagtgtgagtctcttgggaaagtcaatttgactctgctgactcaacataactcattttagagctggcccagtgcccactcccagagtttcatctctcactggtgccctggaagtccttatctcttctggaattctgggcatgagcataaaaggaagcctgttcaatatgcacaggagtattcagcactggccaggaggtgctgacgggtagctcagtgggcccagaagctggagaaaaggcttctgcgtgctgccggtggggctgaggcagcaggcagagctgaggacagcgattgttctttgagtctgtctgttactgaagctgcacaatgaaccacacatcaatcagaacctcctgacaggtgctgtgtgttcctatgaatgttgagcagttgttagggtaagaaaactcctggaggagagctgggtgcccaaagccacactataactccctctgccccatccaggtctttgcttgaaatatctaattaagataagtgtttttaagaaaaacacaagaagtgcagcagaccagggctttgtcacagagctcctggcttgcatctagaaaatcaatgatgaggcatgaatgcatgaccattttcaagaaggtggcttcttgattctatggttgcttgtgttacagtcacactggtgtgcttcatggatgggttcttctgtggatcacaaggctttgttcttacagggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccggtatgtttatctccagactttgaatgtgcattttacagtgtggatctgcaaagcattgagaaatgagtaatttgaatcatattgatgtatttctatctccttgatgatggcacaaatgaacttgtttcatgattcatggttcatggaacaacttaagtctataaacctaggcattgccagttattattgacaaataattaggtgataacagatcagtgtcttctgatgcatttgggggaactgaacagatgtgtttgtgtatctttttgctttggatgggaggtgaaatctaaagttaatagtattcatgtcattgttttcaaaagattccaggtatcaacatctcattctctaaagtatctccctaagtagatgagggaggaagaatgctcagcttagggagaagaatgctggtttcacttattaactacaaggtggccctcctgggagggtagatgaagtaaataaatagtgtgagccagttaactctagtacttattgaccacaaatgtcagaagaatgcgataaggacagggtgttggtgtgtctctgataacggtgtctttttcttcttctcacatcagggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtgaggcctgagaaactcgtgatgcagcatgaagttgtaaacggaggttagggcaggcacctcgggtgcacacagaggcctggggttcgcataggccagggcgcacacttggctttgattcttccaggaattggggcaggacctgggcaagccttcagccttttgtgcctccctttcctcatgtatgtgatgggccaggtaatatgcaggtggagaacttgggtttacagtcctcataagtaagtacacagcacgcaccagctaaagtcagcctttgtatagaagtcacaccgaggtcaagtcattttcctctccttacccatttggctttccccgatgagcagcccattttggcttctgtgcatcccgagtggtgtgatctccacctcttcacagtcggcagacgcctgtgaatggatttagaggtcctacagcgcgatgacgatttcattccatggtggttttagttgtctgctgtttttggagtgaatcacgcgccaagctctatgctgagcattgacaacacatggtcaaaaccacagacgtggtccctgccctcctgcacagcctgttcagaggttttccagagaacctgtagcagggatgagtgtgggctccctcgtcgttctcctctcccacgacttgcttattttcagggccagcgggagggggctgtggcgctaggccttgcacacagcaggtgctaatagtttattatctgactgcgattcccagtagacatggagcacgcctgttcttccctagaaaatcccggaatgagaagaggagaggctaggaatgccttgtgtgtagatgagggaagtaaatgcgcgttgctaggaaacattcaaaagttgtaaaagtgagtgaaaggacttaaggtgattaaaaatatctaactagtaaaccttaaaaaacatagttatttataaagtagctggggccaggtgcggtggctcacgcctgtaatcccagcactttgggaggcagaggctggcagatcacaaggtcagacattggagaccagcctggccaatatggtgaaaccccatctctactaaaaatacaaaagttagctgggcatggtggcaggcacctatagtcccagctactctggaggctgaggcaggagaatcgcttgaacccgggaggcagaggttgtagagagccaagatctcgccactgcactccagcctgggtgacagagtgagactccgtctcaaaaataaataaataaataaataaataaagtagctggatatttgaaatacccaacaataaccacgttggagcaattacagcatgccgttctggctcgcaagtgtgctgattatgtcaataaccatattgagcctgttttatgaattcctattcccattagggactaatatttccttattaatatacagtgtataggctgggcacgctggctcatgcctgtaatcccagcactttgggaggccaaggtgggcagatcacctgaggtcaggagctcgaggcctgcctggccaacatggtgaaaccctggcatctgtaatcccagctacttgggaggctgaggcaggagaattgcttgaatccaggaggcggaggttgcaatgagctgagatcgtgccattgcattccagcctggatgacagagcaagacactgtctcaaaaacaaacaaacaaacaaacaaaacacacacacacacacacacacagtccagttcctaagcattccagtatgggaaatgtcagccagtgtttgatggaagcccaggtgtagtgtgctaacataactgttactcttatccttctccctgttggtataatcagtgagtacttagcatcaagttctgactctgttgatggttgttctttgtttagaagcgtcccagaaatgtctcttttatgactccattagaggtaggggataccgggtttgatggaggaggacttcggtgagccaggcatagggacttccgatcactttcccttgggtctcttgattccacaatcaacaaatcaagtgctgtctttgtgcttgtgacatctgcagatttccagagctgtcgaagggaattagcttttcttttggcgagaaactaccatcagagaaaccaactggagtactcacaaatataccctagcagatggggaagaaggcttctggggagggggaacagggctgttgatcctctctccccacagctgtagggctccttggccatccagagccaattagcttcgagattagaaaacagatgtctttgatctgccagagctgtgtgtaactgtggtaatcataaaagcctggtgcccagggtgtgtgtcaccaacagcaggcatttcctagggtcgttcagttggcgtttcccacagtctgtagctaaagaatgtgctggctgttctagggaggccccacatagcttgaactcttacgaggtgtacgaagattcagtgcgtgcattcttggaggggaagcctttggtcctttcttaacagcgaaaccctgacactccggtggctctcctaggcatgagtgcccagagggccggggctgtgcttcctggcttgggaggaaggatggttttgcctgtgttgctcaagtgagcgcagagctctccagctgcaccattacagataatggatcgttcgtaatcacccgcggatcatgttgtttggataatttcccaccaaacgaccgtaatttaggtcaatctcaaagcaacttagactttggtaaattgagagagaacagcaaaagtattttgactttttgagaccggctcactaagaaatcacctagagccacctcacatgttgttgttgtagatttttcagcttcttgtgactcttaattgtggactcttaagggattcttgtgtccaacaaacatcttggtcattttggacatgcaaacgcatggggagaagcgtagctctctgtgaaagatcctagaaacaccaagggaagaagtggagaacacaggcagaggctctgctctccgggcactcgtggtgctgggtaggatgtggcgtgcagcccacccactgcgtgtcctccctgtgttccgtgtggtcctcattccttcatcgtttgtctttgctctttttttcctctaggtccaaagggtgaaccaggaaaaattgttcctttaccaggcccccctggagcagaaggactgccggggtccccaggcttcccaggtccccaaggtacgattggaattccagctcaccgggataccacgagagtttcctcacgtttttctcacgctgactgttggtctttctcaccacaggagaccgaggctttcccggaaccccaggaaggccaggcctgccaggagagaagggcgctgtgggccagccaggcattggatttccagggccccccggccccaaaggtaaccctgccagacggacccgagcctttggtccacctgtgacttctgtgagaaaagaggaggtggtagacatcaaaacaccacagaagctggtgaccgctgttcagggaggctttcagaagagcccaagcagtgctgagcccagtgatttcaggagcttctaggcaatagctgccttgcagtgtagggtttggttgggaagatgggacgctaaggctgtgcaagctgcatgggcactgccaccaatggtgcccgctgaaacccaccctccaggtgtttgctttttatccgtgaggaagactcgcagtccacctgaacacagccagggtgggttgggagttgggggagcgcccagggggaggtgcaaggagtcgcagggaggggcctttgctccgaggggaggagtcctaccggtgttagagccgtcacttcctgctgaaaactggaaggaggtgaggagggaatttcttttccccctgcttttcacatttcttaggtctacttgtccctcaggtagaccttgatcaacacacttgtcatcacagaccttctgttcaggactgaggagaaggtgctgtgagcacaaaagggacgtgttgtgtaaggaagtttgtcttcgtacaacacaccacgcagccacacttaggttgaaatctcctccaggctcccaggcttcttacccagaggctccaggccccatccaccctcactgctgtaggctgctagcttggagaacaggagacggcagcccctttcctctgacagccacgcaacgcccacccacaccacggctgcttccctcaggctgggcgggcagcagagcatccctgttcaggagggccaggcgctgaggcctcgtcacactcacaactccctcacattccaccattgcctcacacagtgcctccttcacctgaggccgtgacccatgtgacatggagttgcttggctttgtggcagtgaggaggacagaccctatctgtgcagcagcctcacagaagatgtgattcgggtgtgtgccactgcaaacttacaaattactggacatcggagacctcagtgttgcatacaaagggtctgaactagtggctggccagcttcatagcccatcagagcttccagagcggggcccagacagtgggcaggtgtccttcagtgacagatcctgtgggatcttgaaaagtgggcctgccttatagacccctggggtctgcatttctaatgaagtgatggtggtgacctgcccccccaaccacaccttgagtagatgaataaagtgcccttctcacctgcaggcgccaaggggtatatttgttttgtttggggagagtaggatgggaaagaaaagtttgaagagagcagaagaaaaggaaaggagagagaaagaggagggcagaggtgctggaagagacagcaacgcacctgacccctctgccgggcagtctcccctggcctcttccagccacctcggaaggcctccacagttgaccttctcagatcaggtcggcatctctgggcaagactaaaagtgaagaaagtggggaacggcattgtaatcgcaatgattgtttgtttgttttttttttttgactctttaaaacaggtgttgacggcttacctggagacatggggccaccggggactccaggtcgcccgggatttaatggcttacctgggaacccaggtgtgcagggccagaaggtgagtgccaagcattccctccatgacccttctcccccatccttgttattagttggatggaaaaaatgcaggttgtgaacgtcccaggacatgttgggccagcagatttttgtttttgatgaaataacatagaatagaaagtatcagagaacgtagcacatggaagtaagtattttgaagggaaacacttgttttgattttatgaaacatttgtttcaattttatgaaattttatgacagacattttcttgcctgtgtaagctgaaactcagggtaaaatatgtttcttactgtgagaagcagatgaaggctgtttgaaagccactgtcctgaaagaaagcatagtcacccaggatggtttctcagcctcagcactactggcattctgggttcaatagctcttttctgtggggggccaccctgtgcctttgtagggcttttgacaggagcagccctccctccacctatgggtcaccaaaagagcatcccccttccacccagtcacaactgaaaatctctccagacattggcaaatgtcactagggcgatcagattgccccggcttgagaactgttggtacagggtgaagtcaggattctccttgccctcaaatattctgctaccaacttgcctatacttgaaattctgctcagcaaatgtgagcgactaccgattagatcctttcctgtcctgattgtaaggaaccaatgtgaaattgccagaaggcattggtaccaaacgggagaaagggccaacggccatcgataaacgttgccagtgatggacccaggtggggcctgctccctggccctcaggagagggcagatgggcaccacaggggccgtgcctctgggatcccaggggggtttcttccggagaaatacctgacagcagggtgccctcctctggtggctgaggcagaagagaaacctttggacctttgtctttgtacaacccgccaccagcttcccctgataacctacgttgcatttgaacatttagtcaaccgcggcaacttgcggatcatcttaaacttagtgcaagactcaggagttagtaaatgcctaatggaatgggaatgaaagatttaatttatgattaaaaataccatgctttttcaagcatccccttgatggagtttgttccattttgagaatttccttctgggacaagtagggaagttaccactgcccactaatgtccaaatcctccctctctggaaatatcatttgcagacaggggacaccggtggagccctgtgatttcatggccacctgcttgctttggagcctcacatctatgcctaaatccaggctgtttccaaggcaccttcaccctttattttaatcatctgtatctatcaaagcccagtgactcatgccatagtttaaaatgcttaatttactgtgaaaccttcattaatccaaaaaactaaataactggtgtccatgctagccctggaaccttgccatctcttaggaagaactccattaactactcacaaatcatatttggcattttaccggttactcagggccagtgctttgtcacaggcaccaggctgcagagttgaggggacaagctcaggtcagaagacttgagaaaaatgtcatttatccgtggggagccttgcttttcctcctttgtaaaatgaaaacaatgaaagttacccacctatggggcttgtggtgagattgaaaagatataataggtatgaggaagctttgcaaacgcttgaaaagggttgagcagataatattcttactaaatgcattggcagtatctgttaagtcttcacttacgctattggtttgataaaaatactgactttgcaaatcaatttgcttctctgtgctttggggattttcagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtaacttcatgcagatcagtctggagggtttcgaggacaggatgtgcttatttttgcattcccagagcccctaccgagtatatttgatatgtatttgttgaacgaacgatgcaaatcttagaggcctagagctcgtggctttccgttgctggggccattcgtgtgcatgggtctcctaggccgggagacgtgccactgctcctgtacagcttactctcaatttttcttctccaggtgaaccgggacctcctggattgccaggctccgtggggtctccaggagttccaggaataggcccccctggagctaggggtccccctggaggacagggaccaccggggttgtcaggtgagtgacatgcttctagaattatctgttcccaaaagcatgcttttctgaagcatgggggatgaggccggggtccctataaagtgaagcttagcacaatgtatgagataaaaagagaaaaaaataaaactcgagtttgtgaaaataggtttgattgtttgcttaaatgtagtcccagattcttctcccacccactgagatgatgtgccaaacaaagagacctttcctttattgtgtactccgtcacgtttcacattttattctaactgatgtctctatattatctttccataggacggttaattagtggtggataatttcaactaattgagtccatgtctagaacctagctttgcctttgatcataataatcatagaattaaggtggtgcatggaaattagagcaaaactagccctagtcctaagtactgcgacaaggcagtggtggtgcttagggtggccttgctgactctcaatgacaggaaaggggagtgcttttcttttagaacaagagccatttgattatcctgatgaccccaaacaccaacacctaacagatgatccattcaagttcccagtgtgggcgtgctcacgggctttctgcagaaagtcatagttaaacagagcactgtacattgtagatcattctgtaaattctgctaaaagttatttgtgtttcacccaactgcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggtaagtgatttttgaacttctgcctggatccatcatgaagacatgggcctcaccttattctttttatgactcagcatttactgtcagcattcagagcaagaaaatgttcacagtcctttcctttggccacaggttccaagggagaaatgggcgtcatggggacccccgggcagccgggctcaccaggaccagtgggtgctcctggattaccgggtgaaaaaggtaggggagctgataaccctagaagctcattttgtgtctatttctcgatgccacttgggaaattctcaagttgtcatagatcatatttccctttaagacgcctacaaaagaagttaggaacatcaagcagaaggctgggagacccccttcttccagtaggattcctggtgctcaatgcacatggggttgaaactgtgcttggccaagcaaatcagaaagaagctgggctttccttcttggcacagatgagattcttcttgtgagaaatggtggaatcttcagccatgccaagatacagggaccgagtccttaggctcagattaacaacctgcgcaagtttacaaggcttcgtctttatttcttatcgttatttgaagttgttccaaaataatgtcttttacaaagaaatactgtaaatatgacacatgaaaaggtcatttgttttgtagaatgataaaattcctgttctattattttgtatagaactgaggggcactatgaataagagtgataaagatatgtaggaaggagagaaatgtaagttatctaaacctgaaagccaagtcacatgcagtagagttattagcgaataatgaattgtagaaaatggctttttactgctcatttacctggggttggattcttctgtgtctcagacactggccattaatgccattttggacaagttatgagtgctttgtagcctttttgccagctgctgtccctgtcaacaagaacgtgagccttttgagcacctctgtgacactggcccaggctcaccagtgccttctctttcctctgcaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggcaagtccaggaggcttctcatggccaagctcggaaccacaatgtgcctttcctgggttatcgggtcctccataaataataaccaaaccaacctgcgtttctgcagcaacttgcttgcaagcaaatgcgggtcattgctattttcttctctgatgtgtaggacaaattggaccaattggtgagaagggatcccgaggagaccctgggaccccaggagtgcctggaaaggacgggcaggcaggacagcctgggcagccaggtacagtgtggagctccggtccccagtgtggcaagggctcaggatgaggcctgtgttccccagctctttctgtagatgtcaacctgtcagactgctttctttatggttctaggacctaaaggtgatccaggtataagtggaaccccaggtgctccaggacttccgggaccaaaaggatctgttggtggaatgggcttgccaggtaaactggatttagaagaggattctttagcatgtgtgcgtgtgatactggtagggcatgtctgcagaatgagatcctcttcagctgagacggacagaatccaggcacgtgtgtctttcacatgaattcacatccccagctctgaatggtctcctgctcagggatggatgacatttggctgacagaatggccattgctaagaaaactcaccatctaatggaataaaacatgggctgtatacagtcaacttttgatgatctccaagtgaccatccccttgtctaggatctccctaagagacgacggcttctccatccaggcttgtcagcctgagtagcttatggctccagagccctttgtgttagttcagaagaattctccggactcctctgctccaatcccggactagccttaatgctttgccatcagtgtctattgtagtgagagcagccgggaagaggaggagagtgcgggaagggctgggtggtgatggtcctcagagctcactcagaaagggggagagttcagatgggaagcccatctttccatctcctcttgagtcttgaccaggtgctgttatcactttaattaaaatataagcatctagattgctggtcatgcctatgtgtgaataagcctggctaccagcatgcatcacagaaccgagtgtgcacagactccggcctgcccgcctcatagtccctgtgacgtctggctgatgagagctggctgtataataaagaacataagatccatttttattctgttgagaaagtaaatattctaggtagttaatgtatttcttccctgtcttataacatgatggtcttaaaggacgggagagacatttcctagcgtggctctgatgtgatctgggtgactgacgtgttctgggtcatgagccgattgatacatgagggatgtgcattcttgtatctcaatcttggctggttgtgggggattcacgttcttgtatctcattcttggctggctgtggaggcactttttcatttgtaataccagcactagctaagcccaaatcaagtttcaattgtttgtgtttataggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaaggtaaccagcgctctgcgtggaaaggtccccttctcccagctcagtggagatgctgcctgagaaatgctcagcaaatatctcagcacactcaatgagccataacacacagggagtcccataaggcagcacaagtcgcctctccttccccttgtattcactacctctcccccaaggaagaatctagagactggtgagaggctaaggtgggagacagctgtcagtgggataaaacagagaggatggaggacgaagaggaatggcaggtagaaaccagatggttggctctactgctcttaagttttcctctccattcagaagtggactttgattctttgatgagaaatctggaaatggagttttgcaatgcaatattcattgcaccaaaatgtataccattatctataacatgcctacagatgcatgcccatggacaaatgtaaagttaatatgcctgacttttacttgcagggagatcaagggatagcgggtttcccaggaagccctggagagaagggagaaaaaggaagcattgggatcccaggaatgccagggtccccaggccttaaagggtctcccgggagtgttggctatccaggtaggtgaggggggcttctcttggacttggggaatctaagaaatcaaagaaaagcccaaacttatggatgttctggtgttttgtttttttctttaggaagtcctgggctacctggagaaaaaggtgacaaaggcctcccaggattggatggcatccctggtgtcaaaggagaagcaggtagagggccctctttgggacacagcccgggcacatagagaacagtggccaggggatgggaggccccaaggagttcccatcacagacggggagcagggaggccagctgtcctgtctcccatcttcagatgggcaaactgagtctagtgcaggttacaggatctttctgaggtcttgtcactagcaggatctaggacctaaatctccaaactgtttttgtggccatcatggagtttttgtcaccagcttttgagggtcagggtttggtggtgttgctgaaagcacgcagggtcctttctgaagggaagtcagaactgacctcaggaaaaccaggtgtgcttgggagggaacagctcccttaaaggatgtcagcaaagggccattttgtatggcagctagggtgctgtgagaggttatgcgggtgtctgatgtgacttttctctttgaggtcttcctgggactcctggccccacaggcccagctggccagaaaggggagccaggcagtgatggaatcccggggtcagcaggagagaagggtgaaccaggtatggcccaacgccccattccctatcagaatcagcagtgtccactcccagagacctgcagactgcctgtgttcagtgaataaagctgggcacagaatggcccctagactgcacatccctgcaactacttaaacactgatgtggatgtgtggagtagagtgggatgagtggaggggaagaagggaaggggtatttattatcccataaatactgagggcatcttcccctgaaataacctgagctctcagtggtgagtcagagacacataaaatacctgctgttagaacactttccatttcccttgtggttgctatgacaaaacaaagcaaagcaaaacaaaactcttttctttgcccagcatttccccatttgaggggaaatggttggaaatattggttggcccctgagtctgctcctgtcactggtgggctttaacttggccataacttggacaaaagtgcaggtgtgatgatgacaatcacatacacagtaatatttgtatttaatgcaagagagagataaacacaccatttgaagcaggttacccctgacttggggggacactgggaggaccaccaagagcatccacagctattggtgctggctttcttttcatttttttcattccataactttatattctatacatttgtttttctatacaaacaattcataaaaatacccctgcactcctttcccccgatttgaatcttccctcaagccctttgctgacgtttgtcatctccccagcatctgctgccccaaatctctttggctttccccacctccctgagaatagcaattagtggatggttgtctgagaatcccatttgcttatctccagacggcagcaggaaacaaatactcatttgcacagatcatttgtgctaaatgccgtggtggttctgagctgaaaggtacttaggaaaaagtactaaattaggaacattcagtcaagggtatcttataactgtaggaatatcattttattacaagggtgcaattaactaatatctatgtactccacaatatacgtagtattattgcagagttgatagtgctttgtgttgtacctgcagatggattgtttaagtaaagagaaacgtggcattttaccctcatcttataggtctaccaggaagaggattcccagggtttccaggggccaaaggagacaaaggtaatctttgctcactgtgctcttccttttcaaccaaccgctgctgcctgattagcagaacaaggggcagtgtcttcaggatgaagccccatgcctgttggccaggcagcaacgggatggaggatgggtgctgagcccagagggcaatgcctgcaagacacatgtggttcccttctaattaatggatcaaaatggcgtgcagtacactcatgatcagaattatcttttacttggactaattttgtaaaaatccagcagagaggcgagacccctgtcatttttatgcctagaaggtcatcagaatattgaaattctgactttctagaactggttatacttatgtgaatgcaggacagtatgtagcacacaccacgagacaaaaacatgccctgcgcagccacgatgtgctcagtactaagtgcagctgagagttggccaggagcttgggaaggcagtctcttctctcagagagctgagcatttcatgggaaagcaaaggggacacagaaaatacaaggcatgtgagctgcacgacactgaagagaagccacaggtggccgcagccaggagctcacacacagcatccatgggcatgcttatggcccgtggctgggctggctgagtgatcccactcagtgggaggattcagaaagccctggaaggccttggacttcagctgagaaggagcaggggcacggaggtgttgtttctcccaccccctggttctccccgagaccagcccagagtgtttccttggcaggcatgtagtctgacactgggaacccctgggttgagaaggatggcctggtgccgggtgggctgccttgggaatggacacttccctctcccttaactcacagaatccctcaaacacagagccccttgcaaatgcacctgctcaaggggtcgctgtgggctgttcctgccctgcctttcctaccttgccatgtgatcccgcacactcctttggacatgctgcactgcccttgcacaaactctacgcagcaccttgcgttttccactcattgctgtgtgaaatagcagggagaatccccaggagaagagaatcccaaatgaccactttaggtcttgaccctatttcattcccttttcctttgttttggaaataaccttagaattttggcatttttattggtaagatttggatactatgtttaaaactaaacatagaatttctttttcctacaagctgttactttttaattttttaaacctgctctattgaagtttcactgacaggtcataaactacaaatatttaaagtggacaatttgataaggctgacataggtctacaccatgaaaacatccccacattctagatagcaggcaaagccttcccccaaaagtctcctccgtggcttcataatccccccctcctgccctctccccattccccaagcaaccgtccatctgccttctggtcctctaggttagtttgcattttccagcagtttacaaaaataaaaccatacacttcgtagtcttttcagcctgactactctcccacgacataattcgtttgagatccagcccagtggttgctcacttctttctatggctgagtagtgtcccactgcatggatataacatgattggcttgtccagcccattcatgtgctgatggagtgaggctttcgtttagcagtgcagttgctgcagatgtctttaaacacaattcagatgcctttgccatagaacacgtctcgtgagaagtatgaaaacgatagctgggttcctagcattctgagctctttttccagccaggccatggtcggattctagtgtgttattaaagagaaggagggatcggagcccttgctgcagtttcctgtggtgtccctggaagctccctctgagcggtacctacaggatgaggcacgcctcatcccatctctgccgtccacgctggagattactgttctgctgctgcgtttcccatcacctcaaactgtttttcttgttcaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggtaagggcatctcgccaggggccagggctgaggactgggacagaattcacaaaaggaaatagcgtaaaagaaatagttaaattctcaattgggcttttttatttagaagtctgcagcatttattacagcttgaaattgtgtttggcccccatcgagtcaaagcttttcttgtatcctttctgtcaaggaatttaagtaattagggagatgcaagaaaggaaatgattggacaagcctggactcgtgccccgtcggtggcgttggacttaaaccagcgcagcacttgggcccacttgtgggttctggtgaagacccccgtagtggtagcacagatgcccgggcaccactgaccgcaggccattttggacacggagacagtggcatttctatgtctgtccttccttccttccttccttccttccttccttccttctttcctcccttcctctctccctccctccttcccctcccctcccctcctccctcccctccttcctccctccttccctcccttccttccttcccagaccttcctcaatttctgtctcaagggttcacattgtcggtccagtgttttatcagagatagtagtgtttctattccctccctccctccctccttccttccttcctggacctgcctcgatttctgtctcaagggttgtcactgttggtccagtgttgtatcagtgaggggccgtgggtggcagtattgatagccccacagcccagggacacttgtgcatatttaaccccaaatgtgtggctttcttctcttccattaggacttccgggacccatggggcctccagggcttcctgggattgatggagttaaaggtgacaaaggaaatccaggctggccaggagcacccggtgtcccagggcccaagggagaccctggattccagggcatgcctgtgagttattgatttgtagatttttatttttaaaggagtcttttctggccagaagtattcatatgtgtctatgtgtgtatgtattttgtgtatgtatatatatgtgtgtgtgtgtgtgtgtgtgtgtgtgttacactcccacatccccactaaatcagttctttctttctttcttgccagtaacccacatctttattggcatcagagtaggaaactattgtaacatttttttacaatccagttttccaagaaccataaaagggaaatgttatactgctggaaattatggctcaatgcctaaatttaagacctatttacaaactcaatgtaaaaagcaagccaatgttgttttgcagagaacaattctgtaaaactagcccagccatctcttaggactggcaggaggacagggaattgcagttgaacagttcaagtcataaaagataaccagcaatattccatctttctttactgacctgatccagatacagagtctaagtggtgacttagacaagccttcagaagagcacatctcagggtgcaataagtgaccagcagccttgtgtatttctgtgtgtgtgtgtgtgactttggctctttgctgcacctgaatatatagcccttcttagtggtggtcatggatctttggtttgatttttagcttaaccatgtccatggctaaaggattgtgtttacgtggctcgctcattcaaatagctggattagcagagctttattctctgtgtctgtctctctgtttcctctatctgtctccatctgtctgtctctctgtctctctctaacacacattaggagaaagagagagtatatcaggggagatcaggaataggagggatttgagacagacctctgcagttatgttggagcaagtggggttcttctgtaagtcaacacatgttctcccttaaagggaaagctttgaactgctcatcagcagcagagacatatcttagagtcatcagactactttctcaaggatggatacagaatagctaagcttgctgggtgcaaaacaatacgtggtgctgatttacttctgaatcagtaagttatgaaatgcttataaataattatgcagaactggctataaggagtagcaacagtcatgtttacccattccttgtcctcaaagctgtgtatatctccacagtatagcaaatgtgtatgtgaatgtatttttgggcccctattgctatattgcagttttccagtaatgtaagcctaggtaatttgtcaaatatttatgtattctcatttttattcctcagtaacatagaaatataccccattcccggctgggcctggtagctcacgcctgtaatcctagcactttgggaggccgaggtgggcagatcacctgaggtggggagttcgagaccagcctggccaacatggcaaaaccctgtctctactaaaaatgcacaagttagcatggtggctcatgcctgtaatcccagccacttggaaggctgaagcaggagaattgcttgaacctaggaggcagagattgaagtgagccgagatggtgccactgcactccagcctggatgacagagcgagactctgtctcaaaaaaaaaagaggaagaaaaagaaatacaccccattcctggtgccagtcagtgtctgtctgtctctgtatacatacttatgtataaatatgtgtttgtatatatgtttatatacatatatatttgttcatgttattttggtttgacacttttaaaataaggctaagaaacaaatctacgtaagaaataaaacaacttgttacatgttgctgtccacgacttgagaaaggaacgacttgttgaaatggaaagaaaatgagcccctattttaaaatacacgaatattgccacagtataaaggaaaatactcgttccttagcatttcttaattttctttgcatatttaaaatcagttttcagataagacatgaaactaattctaaagaaaactgattgcacttgaggattaaggggaaagttttcagaaaagctcgttggctggtgctggatggctatgttgccgtcacaggtgttgagggggccctggctctgtctatggcatcgtgctgtgagctggaggtggcaagggcaggacatttgcctgctcctcaggcgcttcccctgtggatggacaagcagaggagatacatgggagggaaacaaatgcttctactttccagcttcccgattgaggcacatgcaaaggtgttgttattctgtcatttaagaaaccacaaggcaccatttgttcacaaatgtgctttccagaacattgaggggctgtttccattttccaactagcaggttactggagagacttaacctacatatcctgagcaattcccaacctcctctttgcgtgtctagggtattggtggctctccaggaatcacaggctctaagggtgatatggggcctccaggagttccaggatttcaaggtaagacagcacagaccttgctgcacagcctttgcagcagcagatgctgtgtgaagagcttgctaacctcgggcaccttagcactgatagcaccgctgccattatagcacgagatactgttctcttcaaattaaaaatggcacttctgtgtggcagcccaatttgtataatcttatggatgccagtgtaaagacattctgattttcttattaagaatcagtggatcattaatatctcaataagaagtcatggatttgggctattcattaatttattcatatattaaacacacatttttgggctgcttaccagctccccaggcactgcagtttttactgctgagtcagatacacgtgaaaggcgaataaaacaggtcgcagcctcaaggtgtcttgtggtccaactggggacatgtgtgaatcagatcgggaccaaaaacagtgccctatgcccctccactagttggatcattttacagttggctgcatgcttataaaaatgtagcttctgggttctagaaaaaagagtttcattaaaagttttacacacgtgaccagaaataatgctgttttcttccttgaagataaattggaaatttgttcactgtctatgtgtgcatatatgtgtatatatgcatatatgtgtgtatatgtatgtgtatatgtatgcatgcataagcaggtgtatgaatgtgtatatatgggtatgcatatatgagtatatgtgtgtgtatatgcatttatctatacatttgtgtacatgtatgtgtgtgcactagagagagatatatacacacacatatttgtatatcattgggaattctgtgcaagacagtgctttccctctgcttttaggtccaaaaggtcttcctggcctccagggaattaaaggtgatcaaggcgatcaaggcgtcccgggagctaaaggtaggagagtttgttgatctgtggacaccttactggtgctttgtgaaaatgtaaaagccaggaatgcacagaattggggtgtttggtttttcatatgtgaaatgactcaaaaatcattaaaaacaattgatagggaattctttgcagcaagtcaagattcctgtagttgacattttaaccagcgacttgtctgaaagtagaatctgataaatccaggactgagggaactccaggggaggggtggcccaggttctcactgacaggctcagaattcagaaacttcccaaggctctcaagttagcctgaaatcaaccactgaaagttataataggaaagaaaatcaatcttgcacttagagacggagtgcattcctgctgcacagtaaagaattcttcctgggaaaggtgctgttggcttctccaccggtgggagcctacagcatgaaagtcgccgaaaaccacatcatctcaaaagggaatggtttaagcacagtattcatcctgcttcctctttacagcagaccatacttctagggcatcatttaattttccaaaccatgttttgggagagagaatgagaaaccacatgccctgagaagtggaacccaaggaaggagaggggagggagggtgtgtggaaggtgagggagggtgtgtggaaggggagggagggtatgtggaaggggagggagagttgagggtattgggctgaaaacggggaggctgaggggaactcgcactttgtgtggttcttaccacatgccaagacttgccatgcagaagaaggattaagttcattcgtcactcaaagatcaggaccagtgtgatactatacagtaaggcaggtttcagatgagtgtgggaaaaatgtcctaatcgcagagtggcactctccacgtcagaagcgggggctgcttgggaagaacaagcttctctccctgctgggagggctggcatgaggctgcagggcagttgtcaggggtcccagagcccagaatgcagtgggaagttacgctgatgccccaatgcctttgcccgagagttcaggatttcaggttaaataataaagatgtgcagattggacatgttttgtgaagatctgattacctgggttttgataatgactttacctttgagaagtacgttccatttggatagcttcacccgggattctccttctaaagttgtttccgccccagtatgtggacagtgaaattgatcaatgccttccctattcccacaggtctcccgggtcctcctggccccccaggtccttacgacatcatcaaaggggagcccgggctccctggtcctgagggccccccagggctgaaagggcttcagggactgccaggcccgaaaggccagcaaggtgagaaggcttggcctgtgcagggcggtatggggagcccagaggggcagtggtcagagttcctcctcacccatgtatctaaaataagtttctgggtaatgattatacacacacatatgaatatgagtttcttacctcccttcaatgcatatcaaaacctatgacatttttaaagggacctaaaaaaaatccagaagaaaacccaggaaaagctagaggaacacataacaacacatctgtgttcagttagaaaaacatgggctcaaagaaccagatcattacctttccccctcctgcctcccgctccagatgggggtggcatgtagcaatctggaatggtaaaaatcggtgctctccatccatgcccccaggagcgctgcctgattggcactgtctgtacaattctctgttatttcctgaaaccctaacatagtcttctgcttatttgagtgaaacatctcctatttgaagagctactgataaggagtgggtgggaagtaaaggagaatgaaaacattttaaagttgaaagcatcaaagaaaatttaatgatacttaagaataagctagccaggctcactgggtcacacctatgtaatgccggctttttgggaggctgaggtgggaggatcacttgagcccaggagttcaagaccagcctgggcaacatagggagagtctgtctctacaaaataataatgataaaattagccaggtgtggtagtgcatacctgtagtcccagctactcgagaggctgaggtaggagaatcgcttgagcccgggaggtcgaggctgcagtgagcggtggtcacaccactgcactccagcctgggtgacagagcgagaccctgtctcaaaaaaaaaaaaaaaaaaaaaagagagagagaaagaaagaagaagaacaagctatgtacatgaaaacaaaaaaactatccatgttggtatatctgttgcctaaaaattgagaccccagtatatggctgagagggaaagttatccagtctctcattccctccacatcacctgccttttccaaaccaatctgccaaacagcaagaaaccagggagaactcagaacgaggtgcccaaacacacacccccttatgaatatccagctgcttctgcaaagtctgtactcgactttgtgggaagcaactcctggctgtccgagaaaacgttctcatctgcagtgagactttatgcttggctccttgaacactgaaaaggacatttaagaagggaagaaagagatacagcttactgccatacaggatcataaattatttttcctctgcctcaggtgttacaggattggtgggtatacctggacctccaggtattcctgggtttgacggtgcccctggccagaaaggagagatgggacctgccgggcctactggtaggttgcgaaacttccaacgtaattacccttgaccaggatctttgggatagaaggagcagaaccaggcatggggaaacagcagaatgaagttggatatatcacttgacagatttccgaagaagtctgtttcttagaagaaatagaatcaaatagaagagctgaagaagtgttcttttttctgtgtagagacagatattgatcaaagtgtacgtttcccagatgttgttgaaaggcagccaatagtggtggcccatgtggtttcctaagtgggatgtgagctgcagctgtgaaaattctatttcagcaaaggacaagggaagtagaaatgaaaataatgccagcattggcccaaaggcatgggatgaacttgatctgcttccttaggagaaggcacactcgagtgtccggtgaaggctatgatgcaaaaggctgaggccactgactaattgaacaaagagctcagcccagcagacctgggcacagtttggcacgtggcacagttagagaggggacagaagcaggccttgcctgcgaggtcccttactgctccatttccatacgcaggctttgggctgctatggaggaagaaacaccttaagatgaggttgtttaataattctatgatagtcctccccaacaggagccccacgattccgtgtgaatgacatgcacagagtcacgtcattcatttattttcatttattcatatatccattttcatatgtgtcatatattcattgaactaaattgttcaagcatctgctctgcaccgagaactgtgcttataaaaatatcttgaggtggcaggtaaaaagaaaaagttaagacaccatgaaggaggtaggctgctgtatttagttagccatgcattctttttagacttttttggtaacatgaataggtaggatactttgtggaaatataaaatattaaaaactctttggagaaaatgattttgaaagcctttaggggagcgtgtttgtaattagggaaactaatttgtctcctatcttccaggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggccaggacttgggtaagaagcctgcagatccatgcattcattcagtgtaggtgtgttgagtgccttcggtgtgcagtgctggactcgcctctgctgctgcagtgagggcagtagcgagtgaaacactgcgccatgagggcggtagccagtgaaaaagcagcccggccccatttccctccattgattacaaataatcggttcaacagctgctgtattactaatggcaagccaagaaatgtggagactgaatcttcgaaaatctttaaattaataaaactttagatctcatcttcaaattatcaagtaggatcaagattcctggagtgcacttaacaatttgcattgatgcggcttaaccattgctctttgtaaaaaaaaaggtccatgttatcctgtctgaaattctctacagctgctgagctctgctcctctagtttagatcagcagaaagctacatatctgtcctcattatcttaatctgacccagatatcctccaccaaactgtgttttaattttctctgcctttaacttttatcagggttagaatcagcaagctgctatagaaagagcatctgcattttctgcaaaactgttgtgaaagacattgcccaatttgttactatccatcgtataacgaaccatgtgttaagttccttctagaattcagctttaggaaaaggtttctttgtgctggtaaactggttttgtttcctttcatcaaaaatgtcctacataatcctttatacatttccatttcagtgattatgttgattatatgtttttgcttgttgtccagctgaaatccactttacatagagatagattgtgaattataaaggaaacatctcacattgtcttcttccttgtctaggcacggctggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgagtcgagcatctgtaggaacaaatgcaaaattgaagaggaaaagtctctagtctggacaagcatatgttttctatttttctccaaaacgttgaatccattgccatttagcttattatttgtgatattcgagttttgtaatggaaatctaccataaaaattatttgacataaaagtcagttggctgggcacagtggctcatgcccgtaatcccaacactttgggaagccgaggcgagagggttgcttgagctcaggagttcaagaccagcctgggcaagatgacgagacttcatctccacaaaaaatacaaaagttagctgggcgtggtggtgtgagcctgtggtcccagctacgagggaggctgaggtgggaggatcacttaagcctgggatgttgaggctgtagtgaactgagaccacaccactgcactcctgcctgagcaacagagtgagaacctgtctcaaaaagaaaaaagagtcagctattctcttttaaaattgtggtgcaaaaccatggtgagataatgccaggcttgcagagataatttatattttgcctgactcactgtggtggttgcctttcctcctgtgagcaaggtgatgccactcgattcttcagcaagcgttggaacagtgttgctcaatctttctttttaaaaagtaacagcttccccaaggagccttttaagacattgttttctgaatcatccctgcccctatgaatttttttttttttttttgagacggagtctcgctctgtcacccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccccctatgaatttttttaaaagttatttttaattttggtaaaatggacataacataacatttaccatcttaataatttttcagtgcacagtgtagtggcattaagtacatttgcagtgttgttttaccatcaccgccatccgtctcctgaacttttttattttcccaaactcaaactctgtccctgttaaacactgactccacatccctcctgccagcctctggtgaccccccattctactttctgtccctgtgaatttgacccccgtagacacctcatgtaagtggaatcatacagtatttttccttttgtcactggcctgtttcactcagcataatgtcctcagggttcatctatattatagcatgtgataggatttctttcctacttagggccaaataatatttcattgtgcataggtgccacgttttgtttctccattcctctgtcactggacacttaggttttgtccacacctcagctattgtgaacaatgctgctatgaacatgggtgtgaaaatatttctttgagagcctgcttttaattgttctggaggtacacccagaagtagaattgtgggatcatgtggtaattctatttttagttatttgagaaacctccatgctgttttccacagtggccacaccctttacattcctgccacagcgcacagggtcccagttgctccacgtcctcaccagcatgcgttgttttctgcgtttttgatagtagccatcccaatgggtgtgagggggcccctatgaaatcgtaataccgcagacatactgtgtatctcctctgtttgtgtattgtatgtatatctgtgctttatacataaaattatacagatttatacataaaaagttatacaataatacacacactcccagttccaccaatttttgctcccttgggtgatattgtacccatcgaaaatgcatgtgttggactgagcgatctcccttgagtgtttatccgcactaatatctgaagtacgttttcaggccccaggagcctccctgataggaagtaagatggaaaactgaaattattaccactgaaaataacatgactgtcctctctttgcctctttccttctaattaaaagtttattgctggccaggcacagtggctcacgcctgtaatcccagcactttgggaggccaaggcaggtgaatcacctgaggtcaggagttcgagaccagcctggccagcatggcgaaatcccatctctactaaaaatacaaaaattagctgggtgtggtgttacatgcctgtaatcccagctactcaggaggctgaggcaggagaattgcttgaacccagcaggcggaggttgcagtgagccaggatcgcaccattgcactccagcctaggcgacaagagcaaaactctgtctcaaaaaaaaaaaaaaaaaaaagtttatttcttagaaatattcagaaataataggaaagtggccagtgaacaaattcatttgactaagaagctattccgtaattttactttttacatattaagataatgataaaaaaagatacaaagttttttatattccctttaaagaaatcagcagtctttgaatatgaagaaagatgtagcagtatcaggtaggaagtgccctacattcaacagaaaagggaaaagggaagcaaatgcttggagtcacccctggagctcctgcccagctgccccaggctgtgcctttagcccaactcctttcattagatgaacatgccctgtttgggggaagaccagggttacgtgccaggcaattcctggcagatgacaatttagtgagagagctatgccacgtgggaccatggaccagagggctggaaggtgcctcctatgtaggaaaatcttagatctttgatccccttacattaaaatatctactgacagttttctttgattttttttgagctataagaaaacttattttataggtcttaaaatggagaatatcattcattacacttccagaatggcacttttcagaatgcaggcaatacttcacctgtgtgagtggctgccagatattgactgttttgagacttttcttgctcagaaccatgcctgataactagaaggaaaagtaacaacttttgtgggtttctttttttagcttcttttacacaacaggtagaaaaagactattcattgataggtttcctgtttactttcttggcaatgttgacatttgaccttgattcagagctccttgacaggagctctggcatgccctggtggtagtccaaaaacaggtctcagagaagctgtgtgtctgagaccagcatttctgtgtgatgcattcctctcagtaaaacacccctggtctttgagcaccaagagtctaagtctctgtatgttttgatcctgagatgagcttctaaagccaacggggaggtgctaaaccttagagtctaagcaatggggcacagcatttcccacttaacatgtcattggaccagaaagtcctgaaatgtcccaggactttacatttccagatttttatgtcttcctgttagttgacacatcgaagctcagcatgaagggaccttcccaggcatgtacttgaagctgctgcttttgcatcaagtctgcctctacttccctctcgtagagaggctgcccctttgtccctgtctctgagcaagcaggtttccacggttactgaacttagtggtttccacgacttctcaggacttacaggttccttctcagctcttccctttagggaggtccgaaagctaaattttagaaacagcaaatgacacaaaagccttcgttttgagcagaaaaggtggcagttttccagctttcatccgatagtagggcacaattttctaagtactttctagctttctgcagacaagactcacgaaataaatactgattgctaattgctctgacgaaaagaccgctggattgagagcaaggagaactgcattttcgttctgtcttggacacagctaaccctggccttagtttcttcatatgcaatatggagaatttggccatgtgaattttaaggaatcacacagctctttaagcctgcaatggggcaggacccttgaatccctcagcccagagacagtctgaaaaagacaaaacccttccctccaggctgtatttctaggtctcgtgtctagcaaacagatggtggcagatgtataaggccaatttcagtcactgttgtttaactgaaccttttaattcatctgcatttgggtgaataaaatagaaaattgcacacaccacacatacacacacacacagacagacacacacacaagtccatggaaaatcaaatgactcattcagccctattcccccttctgatccacgttcatgcaaatgtcccagtataactaggtgtaattattgacaccatttatagtcatttatcagcattgttaacactctgttcattttgtgacttgaatgtaattattcactgttggcgtttaatttttttttaaacaaagcattatcccaccatcaagggttcccttcattgagagggtcttagtcagaacactgtgctgttttaatgtgtttctggtgcagtcccaaggctgagctgaatcagcctggcttgggaggcatcctgtccttgggagggtcctctggaggtcacttcagcggcagtggatgctgacagccttggaccttggacagctgagccaagagggcagaccaaaaagacaagtttcccgcaggaggcccatgtggacattcagccttaagttcattaaagcatgcattatttgtcttagttactcaactcactaagtgcatttcttatactaaagattattaatagcttcaaactgttgcattccagaaggagtagctcttggatttcaccagcattttttctgaagcatttattgtgcttgtggaaatacgtatgcattgttgaaagattggaaaacactcaaatgcccaaagaagaaaagttgcctgtaaccccagcccctccaggagagccactgttagagctttgccttcctattttccccttctacaagacagacagttaaataactcgtgttggatctattttttaaacaatattttaggggcaggtctcgctatgttgcccaggccggagagcagtggcccacaggcaggccgagcatagctccctgcagccttgaactcctggcctcaggcagtcctgcctcagcctccccagtagccaggactacaggcctgtgtcctgctctaattttttttttgagacggagtttcactcttgttgcccaggctggagtgcattgacacaatctcggctcactgcaacctccgcctcccaggttcaagtgattctcctgcctcagcctcccgagtagctgggattacaggcatgtgccaccacgcccggctaattttttgtatttttagtagagacagcgtttctccatgttggtcaggctggacttgaactcctgacctcaggtgatccacccgcctcggcctcccaaagtgctgggattatagacatgagccaccgcccccagccatcctgctctatttttgaattgaatgttttaatactgagacaggcttataaaaccaacggggaggtactaaacctcagagtctaagcaatgggcacaatgttttctacttaatatgtaattggaccagaaagactgagtgaggatgttgagtgtaggtaacggggcagtgcatggagggcggcctctgccctgcaccccggctgtgctgagtgtctctgctccacttccaggtgtgctgtgtgtgaggcgcctgccatggtgatggccgtgcacagccagaccattcagatcccaccgtgccccagcgggtggtcctcgctgtggatcggctactcttttgtgatggtaagtgtctggggagacgccatatttcccgggaagagccccactcacgccccatagtcgcctctgtctggtgcctccacaccttggagttctctgcatctcgctgcttaagcccctccttcttcctccaaccgtccccttccaaagcatgcctcgaagcctggcctgccctgcctggtgacagcaggggtctccagcaccagccagaaccctcccctgctcacagccaaggtagctgggatgagcatcttcctggaaatgcaggcccaggcctctgcttccctgtggctgctccactcaggtgctctacgggtctgttccagcaccagcaatatgaacagcttctctatacaaccagcttctccatacaaccagcttccctatatgagcagcttcttcatatgaccagcttctccatatgactagcttctctgtatgaccagcttgttcatatgaccagtttctctatatgaccagcttccatctttgagcagcttctctatatgaccagcttcccatatgactagcttctctgtatgaccagcttctccatatgactagcttctctgtatgaccagcttctccatatgactagcttctctgtatgaccagcttctccatatgactagcttctctgtatgaccagcttctctctatgagcagcttctgtatatgaccggtttctctatatgagcagcttctccatgtgaccaacttctctatatgaccagcctctttacatggagtggaggcctctttcagggaaaggaggaagagagcctccacgtggggagtacacattctactacaacatgcacgagcttgaaagcagaagcttgagttagggagagaacacccgagggctggccgtggcctccacgaaggccctcctggggcagtgccgcctgggacccttcccacagggcaaggactgctctcctagccccagggcttccctttcccgcaaaagccagctgaaacagaaaacaaggcccctgtttgatacactcattgtagcttattttattctattaccccagttggcagtattgattgaatatatacaagccgtgaacttgtaagatcagagttatcccggaatttgccaattcccagtaaatgaccctacacatacatcggcaccatcattggaagtcctagtcccatcttcatactgtcaggaatgggcaagttgtacatttgacccacagatgaacattatttattatctgattgacaggcttcatagctattttcttctgtaaattattccaattgtagaaaaaattggcgggaaagcatttttttaatgtttgagtgaggacgctgagggtagataacaaggtaactcacggatggtgtggcgtctgccctgcgccccagccgtgtggagggtctctgttccaccttccagacgtgctgtgtgcgaggcgcccaccattgccatttccttctactggttttttcttgtgcttttctacacatttttccaagtgtagaaaaagttggcaggaaagcaatttttaaaatgttcgtgcacgtgtacaagtttgattgtatgatttgctgggttgattgtactgcagctacactcttcatgttgcaaccaccagattaacaggttgttgcaataattcgaagtgctgcattgtaactactttatcgagagagccagaaaggttgaaaatgctgtatagagaaatcaggacactaacaatgatgtaagcttgccatgttcattaaaaggtagattggattcgccactccataatcataagaaatactgagtggaatctctgtgtgtcagagaaagcccacagttgcattgaggacccacaggaaagctgttgtcaccaccaacccttgtccgggtgtcaaaaggcctgaaacagtgattgcccataatttgtctaaatcaggagcaaacgaaaatagtgacgttctagagaacagtgtcttccagcacctcctctgagttctcaggacggtggctctgatctggaggtctggagaccccgtccttgcctctgctccgccttgaagctatgtgatcctggtcagatccgagaatgtcctcagctgggaatcagtggagttagccttgtcctcaaaggtcccttgtgtctccaaaattctagagttcacatttcctatatctgaaataatagtcacggggctctgttgtaatgtcttagtcaagtttgtatgtcattcattttaaggtcttgatttctgagtacaggaaggtcctacttaaacctgctagaccaaaatgcaatttgatatagtagtagctatttttttctctttctcttgtttttctctctttttaaagaaaaaaaattgaatgattattctttaccttattataagataaatagcatctaatatagcaaatacaggaatgcatttgtaaagtctgattccacatcagttgtttacaacattatttgaacattttggctattgtctcatgacccatgttagaatgggttggagtgtttcaaatctaatacacagtgagctcttctttaaactctaatgaagctgggctggtcacctatttgggaagcagccattagacgatccctggggccatgttgagcaccatggggccccagccatgcaggcactggcttgcgggccagcccgataatttgggcacagagtgtgtcctgtggtgaccacatgaggctgcagtgtgtggctttccagagggaacaccctggcgccttcctgggaaggatcgatctctttcctggtgtttggggagggaacctctgactcacggctcgcatctgttctgcagcacaccagcgctggtgcagaaggctctggccaagccctggcgtctcccggctcctgcctggaggagtttagaagtgcgccattcatcgagtgtcacggccgtgggacctgcaattactacgcaaacgcttacagcttttggctcgccaccatagagaggagcgagatgttcaagtaagtgggagcactgcttttttgcaggctgctggcccctttgtgactttattttttaatcatccgcgatccgtaacaccttccaatgcaaagtctcaaagatggttagcaatgaatatttgatgctgttcgacatgggcagatgaccgagacgattttcaaaggcagaccttcagtcacaggtttaattttttcatttaccgaagaaccatgaaagaaaaaggtcattttccattttttctaggtgagtgtactaaaatgtaattaaagcaactgaaatctccaaacagagcatgtttgaaatacagtatatttaacaatcccggggagaagaagtgagcagcgttcattttcatgccattcataacactgatcgtaatgtacactttgtgtaagttctgagtgacttcacaaggtatttttttagacctgtgcaaataaaaattaatttcagcacaaattcagctgaaactgagagggaagacccttccttccttttccattaccaaaatctcacctttaaaatgactggcccaagtggctactaaccttgctggagttgactgggagccgggccggtccccgaaggccaggaacgcataatgaaccctctatcccgagccccagctgcagccccgctggagccaatgcaggaggctgacggagctggcacagctgcttactgttcatttccaaaacaagcgcttctcacccctggagatgagcctttccatcttcacctttttggagagaattatatggaaccctgctatgatcctgtctctttccagcttagatagtaagaggcagaacaacatacacgcttctctaattcgttactcatccaaaaagtgccgcgtgcctaactggtggtttattggagcctttcaaggaactggaaacttgacatccatgctgcagatagagtttaaccattcactaccaaaatgagcgcactttgttcatgcctcagcccttgcggtgtcctcttataaggttgataggtaatgatgggttttttttttttaaccagcagcctgatacaataaactaaaatgttttcccaaagcaaattaggtaagatcccattaatttaaataataaacttgagggtactagaatttgcaccaaaagttaataaaataagcagcctcaattttaggatgaggcactctcataaatggctattttaatttagtttaattaatttatttattttaatagaattttctcagtaacaattttagttcagattttaccttttcaacaatcaaaataatgtagagtttctaagcttgagaaacacttgggacattgaatgtctttccctctttttggtctcaaagcagaccatctgcatagaaatccttcaaaagttataaaagtatttcgaggtctagggaattactccagatttattactcatcacatcattccacaaatatttaatgaatacttactgtgtgtgtaaagtgttgcagagaagaataatatcttcttcttaccctggaggagtttatgatctagtggaggagaatggaaaaaaagtgaaattgtagtacgaggaggcagggtggcacagaggggaatggccaaggcttcggagccagactgatgtggcgggacttcagctgtgccctatggggctgtgggcactggggcaggtgccagggcctgggtgtgcagctggtaacctgcagtgttctgtgtgcgtgggaccgtgtgtgcactgcacccagcacctgcctgctcactgggtggtaccaggttgaggcctgatgccaggggctgggctgatcccttagagatttccgagcagggcaggagtgccatgtttctgacgtgctgtgagatgatggccaatggtctgtctctgtgtcgtgttttaggaagcctacgccgtccaccttgaaggcaggggagctgcgcacgcacgtcagccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagctttcaatagtggcataccaaatggcacttttgatgaaataaaatatcaatattttctgcaatccaatgcactgatgtgtgaagtgagaactccatcagaaaaccaaagggtgctaggaggtgtgggtgccttccatactgtttgcccattttcattcttgtattataattaattttctacccccagagataaatgtttgtttatatcactgtctagctgtttcaaaatttaggtcccttggtctgtacaaataatagcaatgtaaaaatggttttttgaacctccaaatggaattacagactcagtagccatatcttccaaccccccagtataaatttctgtctttctgctatgtgtggtactttgcagctgcttttgcagaaatcaaaattttcctgtggaataaagatggtccaaaaatagtcaaaaattaaatatatatatatattagtaatttatatagatgtcagcaattaggcagatcaaggtttagtttaacttccactgttaaaataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatttcactaaaagtctccaaaacatttctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcataccttagattatttttattttgcacttcttccaaatgagagtcacagactgggggtgatttatagtgactacaacaaggaaaaaaagattggtgttctccatctcttcctctttcgtcgcctcctcactccctcctttgcatccttccatctgtccccccagagagctgtcatctatctctccatccttccattcattcactctacaaatgccacttcccaggcattggttaagtagaagataaacagcgatgaatagcacacatatatagccattaagtgtgaatccactgggggttagagctgagattttagttatattaggagtggagtagagggctggattccaagtattacttgatataggaaaaaaaaatagatggctgatttcttttccctaatgacttaagcttcagtctgagctggatcagaatatagtccacggagaatgagtgagttactgaatactcagaaaaaagctctcaatacgatgatgctctcagttaactcacccaccagagccattgtgaagacgaaggacagaatgtgaacacgcagcacagtgctccaggcaggccatgcggcagggacccgattcgccaccttt

SEQ ID NO: 15864 - DNA, 17098 bp, Human
  misc_feature (1)...(17098): n = A,T,C or G
attctcctgactcagcctccctagtagctgggactacaggcacgcactaccatgcctggctaatttttgtatttttagtagagatgaagtttcaccatgttggctaggctggccccgaactcccaacctcaagtgatctgcctgcctcagcctcccaaagtgctgggattacaggtgtgagccactgctcccagcctcttctaggcacttcggaaaagtgcagcgattactgaccacacgaaggccagagatgcagcaggcatctatttacatgcattaaatacatatattatcttcatgcatttacacattcattcaacaaacattactgagcgcctgccgtgggctggcatggtcctgggcacagctccgcttgcaggaagcccactttctcctggggagtcaaagcacaaacaaagccaagtcagtacgtaaagaagcaggggtgatgagagatgcggacccaggaggggttcaaggggctgtcctggacgcatgacagggaagcatagcttcttaaaggactcggcagtgcaccatgagaagacacgcaccaggggagcagagagaaacgccagaaccctctcgaagaaggagggatgtgaggaggtcaggatagtcacctgtgctgagccatcatggagagtgagggcctgtaagggtggacacagtatgcaggagggacaaatcttcctcaccggacaggtggggatccctgcggtgcactaggggaatgcacacagggggcactatgacctggcggcccacggggcacggggacgcaccaggtagccttgggatctgcaagtccctcccggaccctggggagtgccatgacggcttccagcagcagtcactgtcctgggcgcgtcccgcgctctagcccaggtgggtcccacaacggtgtgaccaaggacgtcctatgaccaccccttgacaggtaaggaaactgaggcaggagaggcgaagcaactcgcccaaggaatgggctgtgccggtagcttctccaaggcctggtgcgccctggcctgtgcgcgtgatcccgggcggggtctcagtacgaacaggggcttcgcgatgtggccagcgcgggcttatctccgtgccgtgacgacaaggctagaagcctgggcggccgcggtggatcctcgtggcgaggcggggagggcgccgggcctcactggcccgctcgaaccagggctgcgcagggcagagcccaagggagagggccgcgcggccgccgtaacgtcggagacgacgcctggcaggcgccagcaaacgcagaagacccgcgagggcgaggcagggagggcgcgacgcgacaacgaccacgtgccccgcccgcccaggcgcgcggcctgccgggagacgcagtccaaacctttcgggagcaggactaggggtcccagagagcctcgcggcgcgcatgcgagccccggccccctctcgcgcagcctgccgggacttgtagtccaacgccagcaggcttccgggcccggagtgggcggtgggactcggggtcccagagagccgtgcgcgggccgcgacgccgagcaccgccctcgccgtcgcctccgggctttctccggtcgctgccgccaccaccgttgcttcgcgggctgggaggcccggggtccccgggcgaacagaggctgcgggtgggagccttcgcgggcgctgcagagcgggccgggggaggccgggatggagccccgcggaggtgggcgcgctgccgggcggggcgcttgcggcgattggggagggggcagagggaggggcccggggcggggctcggtggcggggacaccggggcgggggcaccgggaggaagctgccttggaagaggtgggggcggcgacgggaggggcggcgagcccccgggagcctgggcgttaggcccgggcgtggcggggccccggcggcctggggggtctcctgggccccccccccacccatggagcccgccgccccggaggtcggtctcagatgactgaactgggcaccgagcgcccctggtgtccctcgcagtggactgacgccgcaggggcgagctagccggctccgcgcctctccgcgggatccagacgcctcctggggctgctggcggagggtctgaggcggcgcggccatggctcacctccggggatttgccaaccaggtgagaagggtgcaggtcaggaagactagcggcctctcaccgaggggctccagagtctcctgggggttcagaggggagcgccacgccggagcgggcagtggggtgagggaaggagcgcgcgtcgtgcgaccagcggagccgtcctgaggtgggcgcagggcggccccggggctctgccgtgtgcctgtggcgttttgcgtggcagaagctcgcaggcctctagaaaccgagcccctggtggctccgcctgtgcgagggcggtggaggtgcgtgaagagacaccggcgcagggacggggcgctgcccccagcgcggggcgggaacctcatgtcagcatccgaaggcagtggaaggtcgggggccaccctgcggcctcggcctgggccgcgggtcattctggccgtgttgggctgggcaggggctgtaggggagaccctggcgggcgctgaggggctgagattgtggagaagcagatctgagtggccggtgtgcagggaaagcagagaacacgtgtgtgctttggcccaggggagggtgaaaaggctgctctgtcaggaccgtttaacccctgcgacgggcggttgcccgaacatgagactcatctttcttctttaaagaagtcgtttccactatggagccacctttaagcgtctggtgggacagcctcggagggagccactacggcgagcccttagcctggaatgaggaccagctgctggtgccaaagggcttgccggggaaggagggtggggtcagccaacctggggcctggggacttgcattctctacccctccccacttttttgactctggccgctgggttttcttacatcttagctgttcggttttattctccttgatgccttggctctacctaaggcgttggaatcgccgctaaaatgtgtggccctccttgttcactcctatgtgctgaatggagagttgggcctgcagtggaacaggaagggcgtctgttcgcgtaggggcaggaactggagtcagggctgctttggaggaaaccggaccagcctagagacccggaacaccatgtgcagctgttgggccaggcaacctggacctgcgtggtcacagatgagactggggcttgctgactgttgctgaattaagctaacagatttttggtttgcttttggcattctgtatctggtaacttacatgactaaggtgctgggagaaaaatctgccaccagtttattttactttatttttatttttttgagacggagtttcgcttttgttgcccaggttggagtgcaatggtgcaatctcagctcactgcaccctctgcctcccaagtacaagcgattctcctgtcttggcctcccaagtagcttggattacaggcatgcgccaccatgcccagctaattttgtatttttagtagagacggagtttcaccatgttggtcaggctggtctcaaactcctgacctcaggtgatctgcttgccctggcctcccaacgtgctgggattacaggcatgagccaccgcgctcggccaccagtttatttttaagaactgcagaaataactcctttgggtcacaggatgagaaattggagctccgaggtgccctgtaactgtgtgctattggttcttggtgcgatcgcacacagggaagggagtgcgggcacattggagaagggattccaaaggtaggaagctccttttgtccttttagggatccctttgtcccagcctggatgatgagagacttgacttcatatagtggcagaaaacctgaggggctgtggttttctcctgagatggttgccatggtgtcctgtggacctgtggggcagcccctttgtgggagagtggggcgcgttccccccatagcctgtgctcctgccttagacttctcccctctacctggccagttcctgcctggccctggagggcccgaatggctgtggggtgccagagcactgtatcaccactcagctatgtgtgctgggtcattccccttgttttgtggggcaacactgacagcagacacattggcaagtggaggccccagacctggcagccccagggctaatgtggagaacaggtgtccaccgctcgagtcagctgagtggcccgagtgatcatccaggccacagctgctgctacatccaaaagaggattcgcagcctccaggccaggggcccacttaccctttcttctccaggtgggggtggggatggcttgccttggcttggcctgcgatgtcattgtagggccaggatcacagccaagagggttcctgtcacacagtttctgcttgggctgatgagccctggctctggcttaggggtccgctgtgctcccctgctgtgaagcagtagaggtctgagtgcccacccaggggtttcccttccggggctgctgtgatggagcagattcagctccaggccctgtgtggagagcagcatggcctcagcagggagcagggagtagagcagggcgggaggacgcgtcatccagagaggcctgaagagtcggaggggtggtggtgctgggtaatgctgccaggtcatggccctgctttctccaggccctctctcaggccaccttagacaggagtagatgggaggacacaagctcagggcaccaacagacctctggaatccccaggaggactcccttggggtctttccgggtgcttgggcagggttgggttgaggctgaggccaggcctacaggctaacggctcggtggagcagcgtcccagggccccgagtaagcgttgatgggctgagcaaacagggaggatttgacaaggtggcgttgggcctgctggaggaggagcaggcagaagaggggctgcttctgcagatcacctgaggtcaggagttcgagactagcctggccaacatggtgaaacccctgtctctacaaaaattcaaaaaaaaaaaaattaacggggcatgatggcgggtgcctgtaagtccggctactcgggaggctgaggtggaagaatcgcttgaacctgggaggcggaggttgcagtgagccgagatcacgccactgcactccagcctgggcaacagagtgagactctatctcaaaaaaaaaaagaaaaagaagaggggctgcttcttaaccttgtcctgcacctggcatccaggactgggctaggaacgggtggtcctccaccagaaatggagcaaacagggaggaggaaacggagatgatgctctctatggcaggagggtgatattttaacactgactgcttacctatgacagccagtgggctgatgagcttatgctttgacatgcacttgtgggcccagctactcaggaggctgaggagaccagcctgggcacacagcgagaccccccatctcaaaaaaagattgcatgttctgggttgactttcctttcagataggggctggttctcacctcatctgtgccacccaccctcaacccggagacagctgagcacctgtgacttgtcagctttgaatttttcctggcttctctttagaacacatggtcagcagcagtgatggggctgggggcagacacagctcaccttgaccggaatgaccccaggcagtactcagctctctctatcctgccgagtttcttgaccttggctttggggactcctggtagcaggtgggctcaaggcaccccctgctgtttcctccatgggtactggctttaggactgggctgctgtactgatgagagaatgagaaaggtcacttttgactcgaccagctgtctcaactggccagacctttgggctaagcaagggtctgtgtgtacactgcagctggcctgctctagctgctgcatggaggccacctgcacacccccgggccttgacaagccagccttgcagggaaaggttaggtggcctctggccctcccctaactgcctttccttccccagagttccagtcacctcgaggtctggcactcaaaaagggatgtgcagcggcatgtttcaaggtgggggcctgtgtgccgccccttccaccctcctggttaggaaccctgggaggtcagctaattggcagtttcacacggaagtgtcgcctcaggctggtgcgatgtccagttggcttcagccagctcctccgctgggcttaggcctggggtggacccagcacacaggtgtccagggggtgagtgtgagggctgtgtgtggtgtaccccatccttcttggtgggcacggtctccgcaggcccaggaacgtgcagggcacccccacccaaggacctgtcctgtcttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaatcccagcactttgggaggctgaggtgggcagatcacctgaagtcaggagttcgagaccagcctggccaacatggtgaaaccttatctctactaaaaatacaaaaaattaactgggagtggtggtgcatgcctgtaattccagctacttgggaggctgaggcagaagaatcgcttgaacccaggaggcagaggttgcagtgagccaagattgcaccactacactccagcctgggtgacagagcgagaagccatctcaaaaacatttaaaaaagggtcgaggcttgaggacacacctctgctggcttcccctggactctgggcctgggccacagaccccaggcaccttccacaccactggctcagaaacttttaggcattgcttctttaaatctgaggactgtgtgaggcagctttctgcatcaagaaagcatcaagtttctaactccgcgctggtgtagctgtcaggaggacttatggaggggtgagggaagccctttctaaatacgtgactttcaggagtggaggagaacttggttaacacatactgaggttttttgtttttgatgaggtttttttttttaaattttttatttttttgagacctagtttcgctcttgttgcccaggctggagtgcgatggtgcgatctcggctcaccgcaacctccgcttccctgattcaagtgattcttctgtcttggactctcaagtagctcggatcacaggcatacgcaacctcgcccggctaattttttttgtattcagtagagatggggttttaccatgttagtcaggctggttgcgaactcctgacttcaggtgatcaacccgccttggcctcccagagtgctgggatttcaggtgtgcaccaccaagcctggcctgatgagtttattttttagtaatttcagatttataacaaattaagtaagagctcccaaatcccccctcacccccaggggccattcacctattaacatctgtcacggggctggcatgttgttcgggttagatgaggcaaccttcatgccgtgtcatcacctaaagctcctgtttccagcagggttcatcgagttggcctggcctctttatactttctggggactttttcccttgcatggaaagttcagtttaggtttttttgttgttgttatttgtttgtttgtttgtttttttaatggagtttgattcttgttgcccaggttggagtgcaatggtgcggtcttggctcactgcaacctccgcctcccgggttcaagcaattctcctgcctcagcctcctgagtagctgggattacaggcatgagccgccacgcccagataatttttttgtattagagatggggtttcaccatgctggccaggctggtctcgaactcctgacctcaagtgatccacctgcctcggcctcccaaagtgctagaattacaggcgtgagccaccacgcccggccaagtttagtttttgaacaaaaagggagaaaggaagaaaccagagaagaattgaggtgcgctcccttggactcccccttccctacaggtcccttcctccccagcagggcagcctctgcctgtcccccgcctcttgtgaccggcgctgtctgccctctgtccccgccctggccccacagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaaggtgcctgttgtggggaggcggggaccctgctggtgctgtgcccggctctcttccatgtcagagggactgagtgacatgccagagggtgcaaggcggtcttgacggttcagtgcatgccctccgggaaactgccctgggcaggcagggtgtgagccctcgtccacgagggtcagttggctctaaatggccattgggacccacttgcctgcctgtggtaatgcagtgagggcgctgctaggagcactctggggggcccctactggcagtggtgagtgggcctgtgaggagcaggtggctggtggtgccagtgtctggggtgtagggaacgctgtggccatcctgcccaggagggtgatgggtgtgtcgggtcacatgcttgccagccatgccctcttcccagccctgtaggactggatcagcagcctggtttttgatggggtcttggtgaagtggagtcagccactgctgtgtgtactcaacctgtcctctgagcatctgtagcagtagtgtggcaggaggggaagatgggcaaggccgagagagccctttcctgttcagggttcttggcagggatgggaccggtggggcctgggccctggctgactccggcctgtgactcccaccctggagcatgcccttcctcttgctgccaaatgctgatgggtttgtctccggtcccagagcaccaagctatggatcatcatggagtacctgggcggcggctcagcactggacttggtgaggcataggccatggcagtggggggtcatgcagtgtccgagtcccctgcccctcagactcatgggctccaggggccacctctcgtttggtgtcatggcacgttaggtgttaattaggaatcgtctaaagcaaaaatgaactgccatctgcacgtctgcccagttggtgctgaaaggggtcctggcctgtgggagtgggcgggggcaggcctgctgggagatggctgggagcctatttttctgttacatgacagtaaggtgaggctggtttatatgctttagaaagagcctccaccaccccactcccatctgaaacttagttctgtttgggaagtaaaggaacacgaagcccccagctatctgcagggacagcccttccctgtgagagaggcagagaactcaggcattgggcctgggacaggagctgaggccctgctgtcgcaccttcctctccagcttaaaccaggtcccctggaggagacatacattgccacgatcctgcgggagattctgaagggcctggattatctgcactccgaacgcaagatccaccgagacatcaaaggtcctgctgggggtggatgtggctcttgtaacgtcctgagccccactgaccttagagaggccggggcctgtgaggggcaagtggctagtggtgcccagggtctggagtatagagaaccttgtggccaccctgaaactgagcagtcctgtctcgctccctttccagaagatactacttgtaacggtttccttgtacgctgaggaaaccagctgtggactgagtgtaggaaagggccacacttggctggagttgttggttccctgtggtgcacggcacagcagcaggtgtagaattgagtagccccagcgtgtggtctggccctgctgagagcagacgggaggctgggccagcccatggggagggacttgccactggcaacgagccatctctgtcatgtaggggacgattctggtggagcagggggcttcctggcaggcccgtgttggctacacccttggtcagggtcacctctgcggtagcccccagtgggcgaagtcgcttgtcgttgggatttgtcgtaaaagccaaatgcaggaagagccctggagctcggagtggagccgttgggctcctgctggcagtgcccctgtggccctaggtggccctgggtttgagagtggcaaggagggctgaggtcctgaggacagccctgctgtgccctaggaggccaggtggatggtaccctggcccttctcagggggcccggggtggagccacgtggagcctgggatgacgcctgcctgtcctgtgtcaagcagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggtgggtgcagcgggcgggcaggtgcgggcaccatgcctggctcgggtgctcagggcagcaacagtccttgtgttctgtccaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattcgtaaggcccgcctctggcccggtcccttctagacaggacgtggagggagggcgttcgcttggggtgggcggcacagcccggaggcccaggcccaccagccttgtagctgtgagggcccgccccggtccaggctgcctcacgtttgcttcccttaggcagagcttggctgggcccagtgactagtgttcccctgaccccctgcagcggcccacggccaaggagctcctgaagcacaagttcatcacacgctacaccaagaagacctccttcctcacggagctcatcgaccgctataagcgctggaagtcagaggggcatggcgaggagtccagctctgaggactctgacatgtagggacctggtttatcctcatggtgaccctaggtgctgtgacgtgggtggtccccactccagaagcaggggcgtgggccctgggggtgagggtgaccagatatagtgttgggcagggaccccctcaaggctgcaggacagggcctgctgaggcatcagctggaccccgtggcctggcagagccccgtctggtacctcgggtttcccttggccgtgaggtgtgccctgaggccctcatgcctcctggccctctccccactggccctggcaactcctcatcctcttcagtgatggcgaggcggaggacggggagcagggccccatctggacgttcccccctaccatccggccgagtccacacagcaagcttcacaaggggacggccctgcacagttcacagaaggtctgttcctggcctggcctttgccctctgtgcacccctggggccgtgggatgggctggatgcgggacccagctttgtccacccagtgtctggagcttggacaaggagcttgggaaaggcaggggtggtctgaagcccactgtggcactaggcctggtgtggagaccccgagccccagcatgtgccgggaagatgagggcctgtttggagccaaatttgtgaggagagggtgggagtcacaggccctcagagtcaggagagggtgggagtcacaagccctcagagtcaggagagggtgggagtcacaggccctcagagtcaggagagggtgggagtcacaggccctcagagtcaggagagggtgggagtcgccctcagagtcaggccatccgggtggcttgatggttttggggccggccctggacatgtgccccgacaggctgctcccagcctctgtctcttcaaggctagagcctgggcagggatgggagtgccctgcctgtcacctgcactgccctgctcaccctgggcctccactcctttgcagcctgcggagcccgtcaagaggcagccgaggtcccagtgcctgtccacgctggtccggcccgtcttcggagaggtgaggatggggctgggactgggcctggagtcccgtcaaggacaaggctgtgacactgttgcacggagatgtctccctcacagcactgtggggtggtttcagcttctagctttcctgcagctgattgtgggctgggttttctgagtggaaggagcagaatctgctgcaatgactccttttgtactcccagacctgccaaggttctctgggttcctagggtgacttttttttcttcaggtgcaaacacagatgatccttctatagagaaagcagagaaggtttagtcggggtccatccccgggcaggtgccgccctggttagtcacgtgaccctgcatcaacgtcacctgctgatgggcagtcagcaccgtcctcagaaatgtgatacagccaggatctgtgtgcccagggcgtggccagcgggcttgggcccaggtgtgccctccaggagccccacctggagcctggggagggaggatggaggatgtgggtgagaggtggtgaaggcagggcctgcctgaggacggcaaagggaggagcacggtcgagggacgttggccccagcccatgtggaggccccagcgggaagcagccactcgggtccaggtcctgggcagcctgctgatccagccacagccccccgagggtgggtgacacccggtgacaggaggctcagatgctggtgtcctgatggaggtcagatctgggcctggcggtgccgtgtgctttgggggtttctgggcttcgtgtttttgggtctgattagacccattgagtggcttccatgaccctcggctgggaggaagccatctggtcccctcctgagaaccgaggtccgagattccccggagtgtagggggaaggtaggtgctgtggggaaggaccactagggtccccgttggcagggcaggggcagaggcttccttgggccacctcacttcccggcttgctgaagggctcccgggtgtggctcctaggcgagagccctgaaggcctccggcatcactgtggccgagcaaaggagcaggctccctgaaggcctgtcctggggtccagggtcaggcgtggtggtcttttcacagctcaaagagaagcacaagcagagcggcgggagcgtgggtgcgctggaggagctggagaacgccttcagcctggccgaggagtcctgccccggcatctcagacaagctgatggtgcacctggtggagcgagtgcagaggtgagggcggccgtgccatagggtcggggagagcacccccaccaagaagctggacgtggggtgaggtccagtgctcactcgtgggtgtggctgcatttggcactacatgggctcgcttcactctgggaaggcgcggcgtggcatcctcttccttgtttggacccagctcacagggccatggagactttggggctggagagagtgggcagggcctttccagtctaagggtctgaggcagtgtctcagggtcccggcctcagtggccacatggctgtcctcagctggcctctgcccctccacctggtggctcccgggagctactctgacacgctggtggcaaaacgtcagagctgcccctgtgctgactcgagtccttagcaaagagacagggcaggacagatgctgggccctccaccgcccaacggacttagggtccaaccgccatgccgccggcagatgcgccaagtcctggtccacacacagggaccccttcccggcgcccctgggcagcagctctgggggtggggtctgggccagtcattgctgctcctgagaccctgtgcattggggacaccttcagacccacgtggtgcggtggcttgtcagggctgccaccgcagactgcacacccaagaggccgtcaggagcctgggcacagaggtgcacgcacgcagcagtgggctcttctctctgcaggttttcacacaacagaaaccacctgacatccacccgctgaagcgcactgctgttcagataggggacggaaggtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccacccctgcagtgtgctgttgtgcacgtcagggacgctgttctctatgcccactgccctcctccctctcctggcccagcagtattgctcacgggggctccagccgccggcgtggccctcatgagctacgcctgggtcttctgcagactcatgcagccctatggccgctcagaccaaggcgcagagcaactatcagggcagctctgcctcctcctcccatgaggtggggagaggcaacagggcagcccccagaggagtgtcctggccgctgtcctcccggggcccatgatggccatagatttgccttgtggtgttggatcaggtactgtgtctgctcataagtacttgtgtcatccagaatgttttgttttttaagaaaattgaattacttgtttcctgaaatattctgaggttaatatgttagttttcatagaacattgagaggcccctgccactttcaataaagacctgacttggagacatgcaggtgtgtgtggtggggcccgggccatgcggggctgcagcgtccctggtcccgagtcctcatcacagcacgcagagacggcagcccagccccccttcgaaacttccctgtgacggattcctgggctctgcttggcccaccggaagaacagagcaggcagaggagaatgcaggtggggagatgctgtttgtttatttttaatcaaatgtgtgtgaacaaagcagtcgcccatctacttcccgttggaaggaatgctgggcagtaataaattagacggccccaccctcccagggcacagggggactttggtttctgcttctctagaggtacatggggaacaagcgtggcttctgccagacttgtttagctgtgacctgcagggcaggcccctggggctgccacttggttcaccagatggaaggtcagcatggctgtgccacgcttgtctgagagggtcctggcagtgggtacgcagggtgtatggcagggcctcttttccagtgcttgctctaggccagtcctcggcagggaccctgctctggggagagaggcagggtgtgcccaggctttggtccgatgccgagagcactgctcaggccttgtctgcgtctttgagccaggggcctgggagctgtggcttgagcggctccgcgctcaagactcgcacatttttcccagggccccagatagctgctggcatgcactaggtcctgggtggggggatgaagcccctcccagatgttacatgaggcccacccacactgctggtgccagtggggatccagtgagaccacagccacttcccatctgttgagaagcctcaggacagaggtcacctctgtgtcctgctgttctttgtagttgtgtccaaacctgggcaggttgagcgtcattcctccttccccctgaccatcccctccagccctgaggagggttgggggccatcctgcacgatgcttggggccctcccggctgagctgctggccccctggatcacctccatccacctggaggagagggcggccatcagaccagtgagccatcttgtgctcagacactgtcccaagaacaacccaggatatgggacaagcaggacaaaagaagggttaaaaacctggggccgggtgcggtggctcatgcctataatcccagcactttgggaggctgaggcagatggatcacttgaggtcaggagttcgagaccagcctggccaacatggtgaaaccctgtctctactaaaaatacaaaaattagccaggcggcgtggcgtgcatgcctgtaatctcagttactcaggaggctgaggcagaagaatcgcttgaaccctggaggtgcaggttatagtgagccaagattgtatcactgcactccagcctgagtgacagagggagacgccatctccaaaaaaaaaaaaaacaaagcattgctgttttttggaaatgctggaagcattgctcagcccttcctttccagggcccagaaaacttgcctccaccaccatgagtagaaatgggagctgagcggacatcgaaatgggcagctgaccagggctgcctcctgcaaaattacctttcaaatgtgtacttgctctcagcccggaagaagtagacgtgggatttgaactggagcttgaaaacatagtctttgtgtatgccatcggcctccctggggatgctcacgctgtagcccagcagcgggaggctggccagtgggtagtcatcctgcaagacagcatagggacacgggttccaggggctgggttgccacagggaatgcccattcctctgctacctgcacaacggtggcacgtacaaatgcccacgggccaagggagccagtttccctgttcacacagcacagggtgtgtgggcaaagcatgggagggcagaaccaaaatacaaaagggacacaggtgag

SEQ ID NO: 15865 - DNA, 37059 bp, Human
  misc_feature (1)...(37059): n = A,T,C or G
cagagtgaagaagtctttcagaggcaaagcctcccagagaggagttcagtacccagaagagtaggtggacgtgggcctggaagggccaagcatgagcccagagcctcctatgcctgcccaaagtcttaattttatccccaaaatgaacttttaaggattcaatgcttaggagtaacatggccagatatgcattttacaaagattactccagggaccatgtcggtgcaaggctggaaagcaggagaaaggctacagtaatccaggcaagaaattataaagtcttaaattaaggtagcagcagaaagatgaagagagggaacccctaagagaaaaatggacatcgaatggtactgagatgcggaaggtaaggacgagaaaggcctcaagacggcagcgcaggcccctgccgtactctgggaaagaaaaattagtgaaaaaattaaggctcaagtccaggtctttgctgtaaccacgagcgccggcggcgcgcgcccccgaccccgcggcgccggctgagcccgcagggacccacacgcccagtgcaggaggctggcgggatccgggctggttctcctggagctcgccccgcagggccggctgcggtgaagagagcgcagggtcccgaggcgacccgaggcgcggggcctcggcgcccaccgggcaggctacactgaagggcaccccgaagacgctgggggcgcggggcccagggccaacggccgcaaccccgccgcgatttgggcacggagaggacgcgggctcggcggtgcgcgaagggcgacgggcgcaggggcgggagacccggggtcgggctggtctaagagtcgggcggcggatcctcctgggccaggggcgcggagccgcgcaggccccacagccgccctggggagatggcggagcccggcccgctctcccgagcgcaggtatctcacctggatcaggcgagggtcacgccaagccggctacacaccacggaaaggagcccttccgcgcttttatcccaccgaccaatcgcacagcgactcgcaccgattgacaagctccacggaccagccacttgcgcgtatgggcgggactaagctagccagagtctagaagcccgcgctaagggttgctagggacgcaccaaacacccctacggcgcttcggaggagccaaaggaataatgggcgcctccgcccccgggccgggcagatgcggtttcctcccgactcgcgatcaaaatgggtgagtagcgcagagctcgcctcttggaggcctctttctgaaggcggaggacgcggggcggctcgttcatgggccgggtggctccgcagggtagacgaaggctgcagcgtccgcactgggctgggaacgacttgcaaggggagcccagctggcgccccggagccagccagctggctagcggccccaccagcgcaagtgccccgcacctgcccgcctgctccgagcgtcaagagaaggcggcatttcgcatgggtaaaatccgcgcggggacgccgggagaatgttgttgctcttgccgttcggcccattgtacagacgcagccagcgaggctcgcagaggtcagggatgcacgtaggactggcccgcaccttgcagccacggaaagatccgcctggcccgcggcccctccacgcctccgaggtcgagacagtgacataagtcaactctcaagcccagggcgtctctccactctgcctagacgtccactccgtctgcctgcagctacggctctgtgcgtcccgcttcgactccctctgctttccttcccagcttctcgcctccagactgttccggctccgccgcctgaaattacctgctctgggggaggcgcggcgcgcggcctcatgacggaactacaactcccatgaggcgctgggcccacgcaggcgcggcgcggctgaagtcgccgcgccggaatcccattggcagggccggctctgaggcgggagccctgattggctgaggggtctgaggcgacagattccggaaaggggaagagcagccaacatggcggcggaacgcggcgcggggcagcaacagtcgcaggagatgatggagggtgagcggcccctgcgggcggcggcccaagggcccagcgggcggggggagctgcgggctggaactgctccgtgcctgagagaaactccacgtcctgcctctggccgccgccgcgcggccccctgacagctgacagccggacccgggggagcgggggaggcgctggacctcgggggagccccggcccgggggcggcagcggccgggaaggacccagagctagggggagagcggcggcgcgaggccaggccgggggtggggctgaatgggacgcggtggctccattcagtccagttggagcctcgccccgagcctctgagattgacgggcgggggagcctcctcggtcagctgacgaggaaactgaggcgctgggatctaccagagtctgctccttggttcacgtggtgagggtggagaagggtcttctcttgaaatcgaatggactgttgggaaggggtaacaaggaaccggaagattgagttacacaaggtgatacctgttttcaaagctgtcatagttccaaaaagtctgaattcaactttcttcctcctcattcactttgttggaaaaaaaaaccacatgcatatatgtatatgttatacgtacacatgtgtttataattttctgcatatctgtaggtacagtcatatacgtgcacgtacagtatgtgtgtaaacatgcgtgcacacacccacttagcaactggggaatcagttgtgtcatcagcttaagtacttttgggtcccatggtttggtgaggggtacagacctcccagaagagcagtcactgccttatgtgaaaggggtagggaagaggaatgtggagctggggaaggagggcgggtgcagcaggaaggcctgacatgttagggagtggtgacagctgcagaagcagggcgagctctgagctggagcctgaagaataactcgaaggcaacgaggttggggatagggtgagggaaaagagcaagaatcactcaagacggagaaaactgctgtcaaaaggtgtggaggagagtttgaccaaatcgtatgtggtggggatgggggcggtagtgttaagggtcttggacttcataccctttgagtctttttaagaagcgcctcttcatatcctcccactccctcttcagctgtttccatgtcttggtaaatgacagatataaaagcccggcttttctcactgtcccactcccacccatgtcctgttagtcaaggagctctgacttttacttttgaaagtatctccaaatctccgatacgtcctccattcccattgccagtaccttaactcagaccttcatcatctctaggctagattgattgtccctgttcaccagcccatcatccccagtacaccaaagtcattttcttacatgcagagccactgtcccatgttccagaccctctctgctgccctcaggcttcactttggccaaccttcgttagctaagcctttgctaacctcacaccactcctcctcttactggggtttttgtgccagattgtcatgcagtagaactttctctccctgagcctggaccaccaagtgacctgtgcctggtggtgactaatttgttatatatctactgcatgtcatgcacgtgctaactgctcttttgccttttctaatttaaccgtgacagcaacttgctgaggcataggtgctatactagctcccttccacagactaggagattgaggctttcaaatggaaacgatttgccaaagctgcatctctagcagcaagatgcaaactcaggaagagcattccagaaatacttttggactcaaaagatcagatttggattttagaattagatcagactctctggcaggggagaataggttaagcagggcaagacaagtcacagagacgagttaggaggcagggcaggagcccaggctgcagctaataagtaagtgagccaccgtcattgcgggggtagggaagaagagatggatttggaggttttggaggtgggttttataaggacttgttttctacagcaatcctttcttgggttttactttgctaggctaagcgggaagtacaaagatgaaattgaactttttccctcaaagagcacatctctttgtagataaaccatagtcaggaaagagtattttcagtatggttgataattccaagtaatgtgttagtgcctcatgttttccagacagacttccaaaagaggtcatgagtaaagttataaaaaagaaaaatgatttgacaaccttaccaaagaatttttacctgacacattgaattgccttattctttaattcaaaaaatatttatgaacctttaaaagccttaagttgctaacactctgtccagtgtccagtgtgaaagctcatttcacaccaatgagctttctgtgggcggtcagcactattggctgtattctccttttccttagtgatcctccctgcccacagtctgatttgagttagtcttgatttctttcagaacgtgggcctgtgaacttggctggttttcttagccagataaatagtagagcatggatggaggtatgtggcagaagggtcacagtggtgatcccccagcccaaaagtgaaaggcactcaggaggtgcttcactaccgggttccattagtggatttaatcacaggtgatccaaggctttcagaacactgggcaattcttcacaagctccttgagggcagaagtagtgtgttcctcacctaagtatccatgtgggctccacactctgctccccattctccccgcggccatatgcctcaaatggtgctgggacatgggagacactcagatgttcgttgaactggattcaacaaacatgtttaaatgaaatccttttgacttacaaccgggtgtttattatatgttcctcaaagtcccataaagtggatgtgaattctcattgacatgtgtgggttcagttgacaggcgggtcgagtctgaagaatccggcgatgaagaagggaagaaacacagcagtggcatcgtggccgacctcagtgaacagagcctgaaggatggggaggagcggggggaggaggacccagaaggtaccaggcccagctcccttggggacatctgctggttgggggatgtgggctgtgctgcacgtggtctggccctgggtgtgggtgctgtgtcggtctggagaaggactgccgtgctccttaggggtcctcagtggcccagggcaggtggatatgctctttgaggtgctccttcagcaggctgactcattgatggcgtttgcaaaaaggatgtggttttttccaattccactgaaggcaaatcctagcacaaatatgggtactagtatgccgtctgagacagaaccatgacattgttggccagatgcagtggctcatgcctgtaatcccagcactttggaaggccaaggcgggtggatcacgaggtcaggagatcaagcccatcctggccaacatggtgaaaccctgtctctacaaaaaatacaaaaattagctgggcgtggcagcgtgtgcctgtaatcccagttactcaggaggctgaggcaggagaaccgcttgaacccaggaggtggaggttgcagtgagccgagaacacaccactgcactccagcctaggtgacagagggatactccttctcaaaaaaaaaaaaaaaaaaaaaaaaaggaaaaagaaaagaaccgcaatattgttatattaaccatatgtttaggaaatgagattcgaaataaatgttatggctgactgctgtgtttctatgtcctaccatagcaatagaaacctttaatctctgagagaaattatttctgagtcttgccttaccatttttataggcctgaggattgacttctaaagtgcctagatgtggccgggcgtaatggcttacgcctgtaatcctagcactttggaaggccaaggcgggtggatcacttgaggtcaggagttcgagaccagcctggccaacatggtgaaaccctgtctctactaaaaatacaaaaaaaagaaaaaaagaaaaattagccaggcatggtggtgtgcacctgtagtcccagctactcaggaggctgaggcaggagaatcgcttgaaccagggaggcagaggttgcagtaagctgagatcacaccactgcactccagccggggtcagaatgagactccatctcaaaacaaaaaagtttctgaacagtatgcatgcatgtatgtacttttacctgctaaagaaagaaaacacatcaaacgggctgagtctgtccaaacagcaggtttaagaaggatctatacattttgtgttttctagatttgtatacagtgtatgaataatcatgcatcccttatgaaaataaatttatgaagaaacaaacctaatttttaaaataacattgtgctctctgtgccagcaaagatgattggtaactatggcaacctacttttaagtcacaaggagattaccacaaaagtaccagtcacattcactttggaactttgaggctgatgttctggaagtgatgtgggtggaataaagtgcatgggagtgatagatggaagcttccgtcatcgcctgacttagtcaccaacagtggagcggtaggagcccccgctatcctcagatgggtgctgctgagacattgggtgtttatggaggacttgagagttggcagagcaagccttgtgtgctttctttccctggctcactagcacaggctaatcatgttgtcatcatgttctgtaagtacaccagtgtggtaatgtgttatagatgaggaaaatgagactctctgcagcttgtccaagggcacacggctacaaggcagaccagctggcctggcctggaaaaatccaagttttttcttcgagatgattagctgattatgaattttctgggaatatgcatttctagcccttagaggagccaagacttgctcctacctgtatttatttaagtcttaaattcaattaaaacaaatttaatcatgtcaactgttaccttctacctattttccttaaattatttttaaaatatgatgaatatataatacactcagaagggcattctaggctggaaaccttgtttcagaggttagctgacattttgagtggtgagcggccagccctgctggctgtattacaaacaagaccccttaaagccatgcgaccgtgtgtcctgaggagcctggcacagcccgtttctgcctgctggcccagcataactgtgcccttctgctctcaaagggtcctggtttggactacatgacctgggcgccctgccttaattgtagcacctcttccagtgcaacttcctgagtttatgaacggtgacttgacactgtcttttgaggtgatttgttatctatctcttggttttgcccagttccttttatttaattcttaggttggtatcctttacagttgtggataaactatagtaaacttttttttttaactaaccacagttgatggttatagaaaaggcatagtggaaaacaatgaagtgaatgcaaccatgtgggatcatgactttgttaagctggtctgatgtcaggtgctcctctcagaggcctccaggtgagaggaggagccaggctggaggagccagcccttggcatggggtccagggctgtgtgagctcactcccctgcagaagcaagtgcacgtttgctctaggaagagccacagtaacagcactgacagccctgtaaggtagtgacaatgacaatctgtttacaggagaaagaacatcctatgcatataattcacagactccagactgggagaagcactacaagacaaacagcttgttttcctacaacagaaaactgcaaggggaaaaaagaaatttaagaaaaatgctgggctgggtgcagtggctcgtgcctataatcctggcactttgggaggccaaggtgggaggatcacttgaggctaggagttccagaccagcctgggcaacatagcgagaccctgattgtacaaaacatggttttaaaaaattagccaggcatggtagcacacacccgtagtctcagcttcctgggagcctaagacaaggattgcttgagcccacaagttcaaggctgcagtgagctatgatcacaccactatactccagcctgaacagcagagtgagaccctgtctcttaaaaaaaaattaatttaaaaaagttttttaaaagagaaataccatctagtcacaatatacagccttatttggatcataatgcaagtaaactaaggaaagaaatgttaagacagttgaggaaatacgaacactgacaatctttggtgatattgaggaattactgttaatttttttaagtgttttgaggggtgagtgtgcgtgtttgtgtgtctgcatgagtctgtgtataccactgttgtgcatgcgtgtgtctgtgtagtgtgcatacgtgcctgtgtgtctttgtgcatgcgtgtgtgtgtgcatctgtgtgtgtcttagtccttttcagcacacatgctgaagtaggttccaatgaaatgaaatgaggaagtgcttaacagggaagctgtcgcctcagcagggagagcagctctctccctcctccgcacagaggatgccggctccggggtagagagtcctcgtgaaatccaatgggcttctctgctggagtgagttcaccagtctccccactgagaagtgtgtttaaattattcagtgagcttctttgatcctatctgttgaactatgttttgttttgttttgctctttgcagagggaagtgtttgtagatgctgggccaccttccaaagcaataaaaggcccatcctagagcatctgatgtgcccagcatggtctagattctaatggcctggtttattgccacaaacaaaaagagaaaagctacatgggaggcaggctgctgccagttctgcagctctgggagtcacggaaaggcagtagtgctaccctgctcacctgcactcagctacttcctcccctccttcccactaacaggttcaaaacacatttcctttctcaggaagttcaaaggcacagatggatgtttggtgacctttgccaatatctgaattcaggaaattcagaatgcttaaaacatcactattgttggagcagggtctaaccctgccacattctccaggtcctcagcaaaccttcccattggttcctcctcggggtttgagctggctactgggcaccaaacagccccagacctcagccagaagcagctcttcaccagtgcctcctgttaatggggttctgaacaaatctctttttcttattttttcagaagaacatgagctgcctgtggacatggaaaccatcaacctggacagagatgcagaggtaatgccgcctgctcagcccagccttgggcgtggtgatggaccaccctgtcaggttatcttgtatgagattagtaagttatttccctagagaggtggcctaagcctcccttggttgagtcagagtcccgtgttcatgtttttcttaccagtgattgttatccccatgtctattcgacccttgaggattgtgtggcagatgagatgcctttgactcatacattgtctgggtctgatgattacattatacatgagggtcccaatggccccaggctgtgtatgactggccactgggcctcctgagcccacagcgtgtctctgatggtgatgggatggggtgcatatcctcagaacctgagcttatgttttgtgcatacaggatctaaggaatgagaaaaagatgtcatgtaccaatcattttaagggccagttttacataaaacttagtcatcactaagccaaagagcccccgcagcacaccttgtcactgacatctgtctgctgcagacccacctggcactgcctcccccactgctgcccacttccaggccgcctcttctaggacgacacaggtctccagccactttgctatagctgagtatagatttctgctttgtttcaggatgttgatttgaatcactatcgcatagggaagattgaaggatttgaggtactgaagaaagtgaaggtgagagggactcttatgaggggactatgacgctcacccataggatgtggataagtccagaatcgagcagtcagtcctgagttgtggtccttgtcccagcctgtgggcggcgtggctgcctccaccttgtagcaggcctttctttactgggagcacagcaggtgtgagacagcagtcgagggacttgaggcacagccctggggctggctctcctgagcccaggcagccagtgacctgtgactctggcctgcctcggtttctgtgcctgtgttcaattaggcactcgctgacttttacagtcctccgtgcctctcattggaatttgtcaaaattgagcccaccaaaggttcttatgttctgccaggaagtggcagacacccacaccccaggccaacgcctccctccccaactggcctgcttggtggggagcctgcctcctgcctccctttgggttcccgcccttcctcaggtgtgttaaggaattatagcttagtgcccttgcccacctgcctctcaaaggtcagcacctttctaggaaacagcaggagaatgaagacatgtccttctaccagaaaggcctttcttgtgtcctccagtatcagctgaggccttctcgtggcctcccccttgcctgtgtcaattgtcccttttcccatcccccagactctctgcctccgccaaaatttaattaaatgcattgagaatctggaggagctacagagtcttcgagagctggatctttacgacaaccagatcaagaagattgagaatctggaggcgctaacagagctggagtgagtcatgagacccacaggagaacagcatggtgggaaggccactgggtggggggtgtccagtctccagagccaacctcctgctggctcttagcccttgagaggctgcctctgccacagggtcctgccctgcatctgaatcccaagtctctgcctcctgttttcagggctccaggaggcctcatcggcttcatgcatgtctttggcttcctgaacaatcctgacttccaaagtaaatctttgatgggaaggctgcagtggggacttctggaaagcctccattcagggatgatactgagatcggtagagaggaaagttaatccagaattgcctcttgccttttgaatactcttttttttaattacaaaaaaaagtgacatttctaatttaaggagtcaggtcctaggccaggtgcagtggtgcatacctgtaatctcagtgctttgggaggccaaattgggaggatcacttgagcctagaagttcgagatagcctgggcaacataacaagaccctgtctacaaaaattaaaattaaaattaaaaaagaaggagccaggtcctagttataactttacctggatttctgccctttgtcgctcattcatttttgcttgttttgtttctgtttctaattcaatacttctcaggccccttctgtgtgcagagcctggtgtgaggtcctgtcatgggcacaagtgtgaacaaaacatagtttctgcctcaaataccatactgggagccagggcatcaggagcctgtaggctgcctctggcttgctccgggctcctgggcagcctccaaatccctcatgacagcatcagtgtgagccaggcggcagcaggggcacagtcagaaccccccaccctctcccacccggtagtgactgccgtcccctgatggggacgccacctttagtggttaaattgtgagttctatgcaacctatgctcgtgaaatttttttaaaaaactgttttggttgttctcaggattctagatatttcttttaatctgctgagaaacatcgaaggggttgacaagttgacacgactgaaaaaactcttcttggtcaacaataaaatcagtaaaattgagaacttaagcaacttacatcaactacagatgctagagctgggatctaaccgcatccgggtaggtgcagacagccctgactagtatattcagggagaggcagctagcgggttgtgtgtggactcagtgggtgtatgtagaatgcatggtgagtctgcatttcttacaatgctgtgatttttttcatgaacaaggaaattactatttttttaagaaaaaatgctaactgaaagtcagtatcagtaagtcctgagtggtctagcctttcttccgcacgtagatttcagttgctcttcatccagatcatgaccctgaatcacactgttcccagttacattctgcctgagatgaaccaaccaacctgaatgccttgctcttgaacttcctcatggtcatcttctctggcatgcttcttcgagaagaaagtttcccaagcccagcaaagtggtcacttggagtgaattgatgtacataccggggctttagaaagcctcttgatcatggtcatcttctctggcatgcttcttcgagatgaaagtttcccaagcccagcaaagtggtcacttggagtgaattgatgtacataccggggctttagaaagcctcttgatcatggtcatcttctctggcatacttcttcgagatgaaagtttcccaagcccagcaaagtggtcacttggagtgaactgatgtacataccggggctttagaaagcctcttgatcatggtcatcttctctggcatgcttcttcgagatgaaagtttcccaagcccagcaaagtggtcacttggagtgaactgatgtacataccggggctttagaaagcctcttgatcatggtcatcttctctggcatgcttcttcgagatgaaagtttcccaagcccagcaaagtggtcacttggagtgaactgatgtacataccgggggctttagaaaacctcttgatgctgacacactcccaaaggcagtgctgagttgggccttcctccctggacagctttatactcctggacaccgtccccagcaggattagatctgttctccaggatccatttgaccttgaaaacgtgggacagaatggaaataaaagaattttgaaaagtgatctggtgttccacagaagcaggatcaagtcttcaccagctgactcataaccaccgtcatgtgctggaggggaacttgggagggcgtcccaggaggactgacattggaggtggatctgccaggcagggaggagggagggttcccgtgggcaggaaggaggacttctctcagccagaagaacacttgagccccatgcctggctcctaatcagggtcatggcacggagcctttgctcccccggcctggcttagtggctttggcagctgtgtctaagcacatccgcccctgcccatgttcagaatgcccctctacttggcttctggaagtattacagcattctctgtctgtcctgggcccttgagagcttggacaggatacaaaccaagggagggtggttttggcaacagtctcttgacagttattgttagagatgtcatggccacaaatagcaaagcagcacatttaaaactagagagcagcccagatgtccgcattttaccaagtgtctcactatggaactttctagggcaacagtggctcatcacaaattaatgcaggctacagcatgtgaggatgcccctgcccccgccaagtcctgcagtggtgtgtggattagcacaccatctcccctcctagagtccccacctggttagcatgcaccttatctggttattttgtgtctgctgaaatatttaaagaatgacttgttctgagagagagtgaactgacagaggagggaaactgaagtcaaatcaataaacagtcattaaacatcctgctgtaggcaagtcaccatggggagaccagacagggcagcgtggtcactgcctctggaggtttatggttgaatagaggagcacacgatcacagcaagagtgatgtaggagggtgtggaaactgggcaagaggggcagagtgctgtggtgtgagggccccccaggaatcctaagtgagggtcccaggatttcaaagacttgaggtcagagtgccccgtacctctcttctgtagagactgaggctcttgggaggactttttttttttttttttgagacggagtctcgtgctgttgcccaggctagagtgcagtggcacaatctcggctcactgcaagctctgcctcctgggttcacgccattctcctgcctcagcctccggagtagctggaactacaggcacccgccgccacgcccagctaatttttttgtatttttaataaagacagggtttcaccgtgttagccaggatggtctctatctgaccttgtgatccacctgcctcagcttctcaaagtgctgggatttccacgcccgacagggggacattttaatgtgtcagctcacaaatttagaactggaagggacttgggaatctactggtccttgggttctgagactgttcctcagcaccccaggaaatctgagggttgggaatgagctcaagacagtcttggactcgccactattgtattctaccttcaagtaggatttccactggaagtcttagcagatacgtcactagccccacatcgcagagctgaagcccacatagctctgccccggtccaggcacctgctggctgcctggggcagcctgtcaactgcagtactcattgctgttctgtcctttccacaggcaatcgaaaatatcgacaccttaaccaacctggagagtttgtttttggggaaaaacaaaattactaaacttcagaacctggatgcgctcaccaacctgacagtcctcagtatgcaggtacggagcttcctgagccgcccttccctgcgagccctggcagggccagcgctgctggacacaatcttagtttttatccttcactgccttcacaattggcacttcgttgcactattagtaagcaattgaaacattagatgccatagactttatacacacatgtgccaagcaaaaacttgattctcttttttattttttatttatttttttcacttttttagaaacagggtctttatctgtcactcaggctgcagtgcagtggtgctgtcatagctcactgcagcctccaactcctgggctcaagccagcttcccacctcagcctaccaagtcggtaggactacaggcatgcaccacgaccttcagctaatattttgtcaagggggtgaggaatggaagagatgaggtctcactatgttgcctaggctggtcttgaactcttgacctcaagtgatcttcctgccttggccacccaaaatgctgggtttacaagcatgagtcaccactcgtggcctttcttttttttttaagagacaaggtctcactctgtcatccaggcaggagtgcagtgacaagtgcattcatagctcactatagcctcacactcctaggctcaagcaatcttccctcctcagcctcccaagtagctgggactgcaggtacacagcaccatgcctggctaatttttgtattttatgtagagaaggggtttccctatgttgcccagggtggtcttgaactcctggactcaagcaaacctcctgccttggcctcccaaaaaatttctttcttaagtgccatgtttttggctttttccacccacccacctcccccttctgccccagtagcagtcatagatggtttttagccaaaggggacttcttcagaaggtggagcttattctaaattctaaagtgtttggctcaatggtaaaagcaattccttccattgcacagagaatatcaaccctgttagacttctgcatttgggagttggtaagcacttgggtgtgcctaggctcctgtttaccttttgtgttggaagcaaattagcagaattggacccttgaagcgagatggaacagagtgctctggggacgaggcccggtatggttagttgatccctgatcccttcgactgatactgaggggcatgtggaaaccgctcttaacccttggtgaagcagaagtttgtcaggcttctttaagaaagttcttggcctggtacagtggctcatgcctgtaacctcagcacttcgggagatctaggcggtcagatcgcttgagcccaggagttcaagaccagcctgggcaacatagtgagagcccatctctaaaaaaattaaaaatataaaaaaaagctcttaggccaggcgtggtggctcacgcctgtaatcccagccctttgggaggccaaggcaggcggttcatttgaggtcaggagtttgagaccagcctggccaacatggtgaaatctcatctctactgaaaatacaaaaattagccaggcatggtggcgggcgcctgtaatcccagctactcaagaggatgaggcaggagaaatgcttgaatccaggaggaggacattgcagtgagccaaggttgtgccactgcactccagcctgggtgacagagcgagagtccatctcaaaaaaaagaaagaaagaaattataattaatttactttaaaatattcagtaatttttacactttaaaattattaaatcaggtaaaccttcaccaaatgtatcttttaacaatgagttcttttttttggtttttttttgagatggaatttcgctcttattgcccaggctggagcacaggggtgcaatctcggctcactgcaacctcagcttctgggttcaagcgattctcctgcctcagtctcccaaggagctgagattacaggtgtgcaccaccacgcccggctaattttttgtatttttagtggagacaggtttcaccatgttggccaggctggtctcaaactcctgacctcaggtgatcctcctgccttggcctcccaaagtgctgggattataggtgagagccactgcacctggcctaacaatgaattctttatataaaaaacatgtaattcccatgcatgaattttagctcagtacagcaggctcaaaattttgatcctctttttctctctacatgagtcccattctagcatgttttttgtttgtttgtttgttcgttttgagacggagtctcgctctgtcacccaggctggagtgcaatggtgcaatctcggctcactgcaagctccacctcccaggtttacgccattctcctgcctcagcctcccaagtagctgggactacaggcacccgccaccacgcccggctaattttttttgtatttttttcgtagagacggggtttcaccgtgttagccaggatggtctcgatctcataacctcatgatcctctcgcctcggcctcccaaagtgctgggattacaggcgtgagccaccgtgcccagccctttatatatatatatttttttttgagatggagtctcgctctgttgcccaggctggagtgcagtggcatgatcttggctcactgcaatctccgcctcccgggttcacgccgttctcctgcctcagcctcccgagtagctgggactacaggcgcccatcatcacacctggctaattttttgtatttttagtagagatggagtttcaccacgttagccaggatggtctcgatctcctgacctcgtgatctgccccactcggcctcccaaagtgctgggattacaggcatgagccaccgcgcccggccccattctagcatgttttaagtgaaattctctgttcttagaattcttcaagataacacaaaacctcgtttcctaaaaaccgtttcatttcataccttctgtactgttctgacagctgtgtgctctccctcttgcagagcaaccggctgaccaagatcgagggtctgcagaacctggtgaacctgcgggagctgtaccttagccacaatggcatcgaggtcatcgagggcctggagaacaatgtaagacacccactgtctgtctggggctgtgtgggcggtgggcaccaggcgggcaggcacctggccagccagcacacactggcctctcgggccggtgtcaggaagatgccctgcctctggaggtttatcagaaagaccttcccatcctaaaaactaagggaccctttcctcatactgaaaagtgcaggagctgtgtgtgcctgttggccctctgccctgagtgtgccttgaagggctgacgctttatgtgggatttcagcacaggcttccctaggcttcctcaatggggcagcatccattgcacacccactgtgcactgcaggcattttgcaagatttgaaaaaaacaaacccaacctgctcgtaaagggccctgtatgagggtgactggcatccctttaggccactgacctgtccatgggtccactggcctcagcccctacttcccagcccacagagagcacaggaccagctctcagtcccagccccttcctcttcttacagtatgagcagcttcctcctcccccattcctccctgcctgctttccacacctgtcctcacctgttcatgctcctccctccctccccggcccttctcactcaggtgcaggacagcctcacgtactgaggggaagtgtgctcacagagcccccaccctcctcagctgcctccagctcaccctgctctgccccagtgcggtgttcaagacaaataaaagactttttctcattcaattttacttgtttttttctgttttgttaaattgccagcaaatacaaccagattggtctataaacatagtgtttcaatctcattaaaggcctttgtgcctcaaccccagggcctagttggcagcagtaaatttcaccaacacctgcataaaattttggaaaaattcaaatttgcctgtggaaagtttggtcaccttcctttgactttgcattgaaattaaaagtttataaaactagcatgcaaaccaagtgttcacctgtgtagtttagagtggtaagtcgagacgtgcctgcagtggaatggcgctgaggactgtgtggcaggggctggggttggggccgggtggggtgcgcagcagggagccctggtgccctcctgcaccctggcctccctgagccaaggccctgcagtcaccaccaagcatccaccgggagacagacaatctgcagcacagttcacataagcagccagtcccaggaaaactggaaagaagtgtggttcagaattttaccagtagaagtgctacactgtgatcttggttaaacaccagattattcttgggcctctgaaacaaaacagaaaaaaaaaaattgttgtattaaaggtaattacgttattgtaatcttcatcatgatcaaatgtgacagtctttcttctgccatttttttcaactaaagatcagacaaatattttctcctaagttttgtttcttaatttatctggaatttatttttatggtgggaaataagaaagtaaatgtagttttgtcccaggtgggaacttagacgacaccccccatcccagtgtctcacgactcctgtcttgttcttcgtgtcttctccagctctgggctctcccgttggtctagaatatgtttgcagtggtccctgacaggtgtagtttctgtggcgttgtgtcatgccctttggtgtgcctgctctcctcaccctgttccattctttttttctgtttcttaagcagttcttactagtttgcttttggatgagttttcacaacattgtccagctcctgtagaaaaacgtgaaatagtgttgagtgcctacatggatccctgagctcagaggtgatggaccggttctgacagccagagcccaccaccggctctgcccctcgtgctgagccttggtgcttggacctcacgaggctcaaatcctgcgtgtgttccaggccactttcattttgccagtttctgggcttgcataccagatgaccatgagcatctcagaatggtgcagagtgcgggggagagctgccgtccgtgctagagaggcctgttccagccccaccgccaggcggtgtgtcgttggattacccacagtcgcgtcttctgcaacattttcctgcagtcctttttgctctgaacccgccccactgagctccctcgcacactgttgagcctgatactctgtgagcagacctgaccagggcaccgagatggggtggtttgaaggcacctcctaggcagcatgccacgtatagcctgctggagagtggcgtcagacttgacacacgcagctggtgccagctggggtgctgggcgccaaggcagcaagggtggtacagccagaggagctcccaggccacagccatagcgctttcgaattgggaaagctactggctgggtacatttcaggggagatggggggaggagtatttgcttttgagaaattttttaactttcccttaaaacttagaaggctttggaattggaataccaaaaatgcagtagaaaaccaaggaagggactcaggagggagcagagcgtgagggcagagaagggaatgaactttgtcagaggttctcagacagcttgtaaatgttttccttttgatgagaaacaaaattattactcaggcttagctaacatgtattggaaagtgagtaactgatgtgcattttcagagtagaagatcctaaaaacacactcttgtctcccagtgggggcacacaccctgcagcaggtgctcagcaggcccagcacccagtcctcagcatgggtcccttctctgcacttatgctcccgggacccttttcccagacaagagtgtaggcctggggtctgagagtcctgcctctcccactgctactgtgcgcctgggcagattcttagccccactgagccccaagttcctcatccctaaatgaagagaggaactttgttttgaagattacttggtcgtacatttcctcgtgatgagcactaagtaaatgtttctacaattgtcagcctttcttcagagcgtcagggggttactcggttcttcctgggaccatcagtctcactaggtctgtctcaatggacagggatctgggaggactgggcttggagtctgacacagtctcaaattccagcgatcaggagagctcagggagatagctgggcaggctctgatggaaacactgtcccagggagggctgcaggaagcaagcaggtctcgtcaccctccatagcatgcccttaccctgtgagggcagagagggcagtgcacctgcagccctaaggtcagcacttgacactgcctgcgtggtcatgcaaatcactgttgatcagaggtaatccaggaaacattttatttccttcttttagaacaaactcacgatgttggacattgcatcaaatagaatcaaaaagattgaaaatatcagccatctaacagagctgcaagagttctgggtaagtttaatacacgctggggttgatgacactttgactaaactggtctcactgattaaaatgtcttatgaatgaatacaagaatctcctgtaagccttcatgctgagtgactccgcacatcatgagatttggggtgggcgctcttgtagacttgtattgggtgttgtctgtgctcctcagcgtgagccacagatcagcagcattgacatagcttgttagaaatgcaaaatcttgggccccaccatagcccagatgaaaactgagtcaaaatctttgctttacaagactccgggtgattgcagtacacacaaaggttggagaagccctgatctaggtatgggtagaacctacaattgtcatttgaccaaatggtttgcaaacctcagcagagaggcagacgcattccctacagatatattccagcacaacagaaggaaatgttggatgggtttctgcagttagtcatcttggaatttgccttgtatttgtcttgtcacaggtatggtttcaggagtagtgttgtggagtcagcaggaagagaaacagaatataagaagtttttgcagttcctctaaaggggttgggaaatgatccccgagtggaagtcttcagtgctaggattcccttagagaaatctcctaaggtttattgcctttccgctagcacgtggccctgcagagactgcggcacaggtgtcaccctgtgatgctgggaatgtagtagtgtcctcagatacattcagtctaatccaggattcatgctgagtgtaaggcatcattcttccttgtctctcctctagccgtgctgctgaccctgcttatgtcctgtgctttctcctttccccactttaaaaggtcatccaagtttccctagaacacaggtggcctgctgcaaatgttccttgccccttattagtggcactgggtcttgagtagtgtcatgatgggataccagagcatgtctgggaagatcagagccagaatttggcaggtgataaagatgtaccaggccagggggagcctcaatgagtccaggtgggtctatgtgcagcccacccttgaaggaaggtgtggctggtggtaggctggttgaattagtgcatagggagttggcaaagaagccagggaacaacacaaagaaaccaaacaacaggaataaggagtccagagacagaggaccaggtgatagggaaagggcacctggcaaaaaattagggagcaggtttgggaaacgagctgatactgaagcaatgttcctgaagcgtaacgattccttctgcatgccctgcctaggaacagagcatggggcacagagtgctgagaccacaggcaggggccaacctgggtaccacagctagcagggaggcaggcaggctggtgatcaatcactaggggccaggtagtgcctgaccctgtaacacagaagaatcctgttccttaggccaccaaagatagtaaaaaatagccagaatttgcacagcgctttatggtgtccatacctctctccattctgatccaattatcacagcaaccatgtggataaggtcatattaccccattttacaggtaaagaattgcattccaggaaggaaagctgcaaaccaggaattctcaaactcagttccatgctcatatcacatttgagaggcacatcattcatctctaaggcagaaatagaaaaccagtcttaacaagtttctgataacccacatactatgtttgttgatttttctgcctatttgttccaattactgagaggagaatgttgaaaccttccaactataattgtcaatggatccatttctcctttcagttccatcagtttttgtttcttgtattttgaaagtctgttatcaggtgcatacatatttagaattgaggaattcttgatgaattgatccatttatcatatgaaatgttcttctttcttgcttatcctctttatccttgtcctggaagggtatcttgtctgttattaacacagccccttcatctgtcttatgattagcgctctcatggaatctttctccatccatttcctcttaacccatgcctttataattaaaatgtgtttttcataaaaagtatgtaactagatcttgctttcttctccagtctgagaatctctgccttttaagtggtgtctttagactgcttacatttaatataattacatttaattacattttgtgtaatggttgagtttaagtctatcatcttagtatttgttttttatttgtctcatctattctttgtttactctttcctacctactttttggagtgacttttttttttttgcagtctattttaactctattattggcttatttgctatacctctgtattagtgttttcttgttgattgtttggagggagggttgttttagcgattagaatttaaaaatacatttttaattttcaccatctatatattttacatttaaatatcttacgatccccatgataccttatcttttaaagaaatttaaaaatggccaggcgcagtggctcatgcctgtaatcctagcactttgggaggccaaggcaggtggatcacctgagatcaggagtttgagaccagcctggccaacgtggtgaaaccctgtctctactaaaaatgcaaaacttagctgggcatggtggcacatgctgtagtccaagctactcaggaggctaaggcacgacaatcacttgaacctggcaagtggagattgcagtgggccaagatcgtgccactgcactccagcctgggcaaaaaagtgaaactccgtctcaaaaaaaaaaaaaaagaaatttaaaaacaagaaaactcacttattttaccttttctggcattgtttattctttcgtgtggatctgagtttccacttggtatttcccttccacctgaagaattctattgttttgtcgtgcattctgcagtaaaccaatccttcactttgatttgtttgaaaaatctatttaatttgcctgcatttttggaatttaatattatggatacacaattctagcttgagagatttttttttcctttttaagtacattaaatactttgttctttcatcctctggtttgcattatttctcctttataaaatttttattattttaaaaatattttttaaaaataaatagagatggggccagacacggtggctcacacctgtaatcccaaggtggatcacttcaggtcaggagtttgagaccaacctgaccaacatggcgaaaccccgtctcaactaaaaattcaaaaattagctgggcgtggtggcacgtgcctgtagtcccagctactggggaggctgagacaggagaatcgcttgaatccaggaggcagaggttgcagtgagccaagatcatgccactgtagtccaacttgggcaacagagcaagactttctcaaaaaaaaaaaaaaaaaaaaaaaaggacgggatcttgccatgttgcccagactggtctcgaactcctgagctcagacagtcctcctgcctcagcctcccaaagggctgggagtacaggtgtgagccaccacacacggccctggtttgcattatttctaataagaagccagcagtcatttttatcttttttcctctggctgctttttaatgttctttttaatcattgtttcttattttgttttgttttttgcaacttgaatataacgtgccatggtgtagtttattttctgtgatgtgtcagggttaactgggtctgtgaatctatggtcttcatcaaatgtggaaagcttctggagactattttctctagaactgcttctgcccttgctcctcaccccggtttctctctgaaaacccagttatgcatgttcccctggcactagcgaggcccctgaggccattgcctccaccctgctccaccccttgggctttcatcttgctgtgcttgtttgtataatttctgttgttaaatcttcaagatcatgatcttatcatctgtagtagcctatctgctgttaagcccatgtcatgaattttttatttcagatactgtatttttctcaactctaaaagaacatttggctttatttttttttttttggtagattatttttctctcttcattagattcatgttttcctttaagtccttccttcttcacgtcttgtaattttttattagatcctgggctttatggtgttcaattgttgaatgtctggaatttatgttgttttccttcaaaacatactgaactttatctgacaggcagttaagttacagcttgatccttttgaggcttgtttttaagctttattagagtacatctaaatagtctactccgtaagattaatctagcactgttttgaagctgtggccctcctaggatctctggtgaatatcctgtgtatttaagttctctccactgtggttgacgggaacacaaacatggacctgctatgggtgagctctgggcattctgcatcttggggctgcttagtagttcttcgaccagcctttagcttttcactctgcctagcacagcttcatcttcagtccaggattccacaggataccatgtggatttctggaggctttttccctacatagctcactcctatctatacattccagctccctttgcctccccaaactacaatcaccatctcaactctgtgtggccaccaggctctgcttgggttccgcctccttgtggtcctgaaagttcctccaggcagaaggccgggatgatcacaccacccacctcatttgtttcctgtctctcaagaatcactgtctgtgttgcctgttgtctgatgtataaaaacaattatttcatatattttatcctcttttttttttttttgagatagagtctcgctctgtcccccaggctggagtgcagtggcgcgatctcagctcactgcaagctccgcctcctgggttcacaccattctcctgcctcagtctcctgagtagctgggactaccggtgcccgccaccacgcctggctaattttttttgtattttagtagagacagggtttcactgtgttagccaggacagtctccatctcctgacctcatgatccgcccgccttggcctccccaggtgctgggattacaggtgtgagccaccgcgcccggcctattctatcctattttctagtagcttgtgacaaaggcaggagctcagcaccagctattctgtcatggcttgaaacagaagtcctacttatttatcttacttttgtgtctgtctcccccactgtataatacaaacctcataagggcagggaaattagtgtttggtttactttgttttccctcccaatttctttattgtggtaaaacatgcataaaataaaactcaccatcttaaccatgtggaagtgtacagtgagtggtattcagcacattcgtaatggtgcacagccatcaccaccgtccatctccaggactcttttcaacttataaaactggaactctgtacccattaaacaataactccctattttccccttcccagaccttgacaatgacccttctactttctgtctctatgaatttaactacagacctcatatcactggaatcatgcagtatttatttttgtgactggcttacttcactcagcatattgacctgaagattcacccattctgtaagcatgtgtcagaattgcctttctttttagggccaaataatattccgcagtatggatattgttttgttcactcttatctcaccagcatctggaatagtgcctgatacacttttttcttttgagacagagtcttgttctgtcacccaggctagagtgcagtagcatgatcatggctcactgaagccttggcctcctgagttcaagtgatcctcccacctcagcctcccaagtagctgggactgcaggtgtgcaccaatgacctggctacatttgtgggttttttgttttgtttcgttttttgtttttttgagatggagttttgctcttgtcacccaggctggagtgcaatggcacaatctcactgcagcctccgctttccaggttcaaacgattctcctgcctcagcctctcagtagctgggattacaggtgaatgccaccacgcctggctaatttttgcatttttagcagagacggggtttcaccatgttggccaggatggtctcaaactcctgacctcaggtaatccgcccacctcggcctcccaaagtgctgggattacaggagtgagccactatgtctggaccattttaaaatcttttgtagagacaaggtctcactgtggtgtccaggctggtctcaaactcctgaactcaagcaatcctcctgcctgggcctcccaaagtgctgggattacaggtgtgagccaccatgcccagtcagtgcctgaaacatatttgaatgagcagaaggaacatagaaaaggctggccaactgggtggaggccagctacagataacattggaaaatatgttatccacatgtgtcagatgcagggctaacatccttacattaaaaacagctcacacccaggtaccacttgaaaactagggtgttcacagagcaagaagtaacagttgcttgtaaatacataaagcatttcctatctcattaatttttttttctttcttttttttttttttgagatggagctttgctcctgtcgtccaggctagagtgtagtggcacgatctcggctcactgcaacctccacctcccgggttcaagtgattctcctgcctcagcctcccaagtagttgggattacaggtggctgccaccaccatgcctggctaatttttgtatttttagtagagacggggttttgccatgttggccaggctggtcttgaactcctggcctccagtgatctgcctgcctcggcttcccaaagtgttgggattacaggcgtgagccactgtgcctggccatatctcattaacttttaaaatctactaaaacagtgagatacagtgttatctgtcaggttggtgaagactcgtagaatgcagctgcaaccagcctgtgatggcagcaggcactctcgtgactacggagatagctgtgtttcatacaagttttctgtagggcatttagagccttaaaaataccacatgcagccgggcacggtggctcacacctgtcatcccagcactttgggaggctgagacgggtgggtcacctaaggtcaggagtttgagactagtctaaccaatatggtgaaaccccatctctactaaaaatacaaaaatgagccaggcgtggcggcatgcacctatagtctcagctactggagaggctgagacaggagaattgcttgaacccaggaggcggaggttgcagtgagccaagatcgtgccactgcacgatcaggtcaggagatcgagaccatcctagccaacatggtgaaaccctgtctctactaaaatacaaaaatttagctggatgtggtggcacgcgcctgtagtcaccactactcgggaggctgaggcaggagaatcgcttgaacctgggaggcagaggttgcagtgagccaagattgtgccactgcactctagcctggcgacaaagctagactccaccttaaaaaaaaaaaaaatcatagagagcttcctaaccaagatttaaaaatcagtgaaaaaagaaagaataggtatatctaattttataaagcgtatgtattttgcatgatgaaagagtccattggtcgcctgagaggttaaggttaaggttattttctatgacatacaaaaagttctttaaagtgaaagaaagcgattcaatagaaaaataggtggaggatagcaatacacagttcaccaatatgatgcatcccgcccctgccatacgcgacttgtttcaagctgacatccagggcctggagggtgggctgagaccagcactgccctgctcaggcccccaccctcttcccagtaatccaggggaaaggtagcatcacagtgaccaaaggcagtagccaggggaggagaaacatttggcaggaaagtttccaccctcatggtgtctgatgccggcatggagcccatctgcccactgccctgctggcacaggggcctccccaggaccctcccagatgctctgttggcagatgctgcccgctcgtttaagccaagtgatgccatttaaattacattgcaggcctgctccatgccacagctgtgcttcctcagccctcttgatggaatgctttcctgtaggcagcgccctgcacaagcagcctgtgccagcttggcacccctgacccagggctgtctgggtgtgagctgcaaggagcggggggcacaggtaggggctgctcgaggagaggctgtgtgcctccctcccagcatgtgtgcctggcctgggcccactttctgctccccttcagtctagtgatggccatttcattaggtttcagttgcattcctttaattacagatgagtctaaccctggcgcctctgttttcaaccactttgtccttttgttccctcttgatactttctgctagctttagtccagtgcattttcccttttattattaacttatagagattctatcaatgaatgatactaaaccttagtatgtcatctgtgttgcagatactttactttgtcactggtcttcagctttttttttttttttttgagacagagtctggctctgtcacccaggctggagtgcagtggcgtgatctcggctcactgcaagctccacctcctgggttcacaccattctcctgcctcaacctcccgagtagctaggactacaggtgcccgccaccacgctccgctaatttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagcccttgtgggtagttggtttcttttttcctttatactctatagttctcctgaattttctgtaatgagcatgtatttcttttttttttttttttttttttgagatggagtctcgctctgtcaccaggctggaatgtagtggcgcgatctcggctcactgtaacctccgcctcccgggttcaagggattctcttgcctcagcctcccgagtagctcaccatccccacggacagctctcgatgtggccgtgcctgtgtctggcagcctcaccatccccacggacggctcttgatgggccgtgcctgtgtcacgcatctcctttgttaaactgtcatggagattttcagaaaataagtgatttttacattctaccagttgtttatgaaatgtatcttaagaattctacccatcttttgcttaaaacattactgagtttggggtaattaatgtgaattttctataatatcagccaaaaaaattgtgaagggaaatacaggtatcctatgtatgtatatgcaaaatacacagatagaaaaccccataaatacaaaatgcaagtttgggttccaaaaaccaaaagagtctgccaggaaaacgtcagccaagaagatgttctctagcagaatcccagccgttggttcgggcaagggatcagctgctgagattactgggaaggatgttgaagaagggatgtttgcacacaggcccaaggatcatgccacagagaactcgctaattgcaaagggaaagcatgttcccagagtcatctggggtcaccagctgatctgcatgataaaacttagcatccctaattgtgggaccacctgaagtgctgtgtccccagtgtgagtcatctgtgcagtatacctaccaaaaatgtttagtctgatctaaccaagcattcatacctaactttgagtttatgggaagtgtaagagctagaagaacaagctaaatgacagtgagggatactttacaagacagttcttcaagaagccaattttagtttttaaaaaacagtgtgagaaggacatgggaggtgctcaagattagaagagactgaagtggtccctctgggggaaaggaatgtgcccgcgctccccagccaggctccctgacagccccagtgtgcagaacttgataagagaaacataaggtcatcttttttccatgatgagtgtaacatctttgccccatcctgggattcaggagcctctggaatgtctatggagacagagtctcatacaagtgaatgtttttagttccattttggaaaaatgcaaagataagaatctctgaaagttaccagtatcaaacacattatttacacattatttacaatgcaccattggtggtgagtagaattccccgtgttaggtttactaagtcctggagaaaactgctctgagattggcagtgctatggaaaattacaacatctgcaatttataaagatggtccgcccatctagactaataatgacattggaaaatgctgtgatgtgtgagacaagaagcatctggtgtgtgacaaacacaaatacatcacatatcgagaaagaaggaggtgacacagcttgaagacctcccacgccagagctgaaagcctgagtcaactgccagtggtgttttgaatcattttttaaatagactatgctacaagaaaatcttacttcttccaaacagtgtgatattgctactttcattaaatgaatgtcctttttgtgtgttttgtggtagaagtggttaaggcagtggtgttcagtctttgggcttccctgggccacactggaaaaaagaagaattgtcttgggctacacataaaatactctaacgatcgctggtgagctaaaaaaaaaaaaaaaaaaaaaaaagtgaaaaaatcgcaaaaaaatctcaaaatgtttttaagcttacagatttgcgttgggcctcattcaaagccatcctaggccatttacagcctgcaggccgtgggttggacaagcttggtttaaggcgtgtgtgtgcatcattttcgtgactctccactttaaggggctctttctgttaactgaccagtgaccggccaatcacaggcctggcaggtggatggcttcccctgtaattctagtgttgcaggctctgcactggccacacaaccagcggggcggtgcgagtgtagtaacagagtagcatttaagaaggtacgctcacgtcccgtccacatggaggcactagtcgggacagcagcagcagggcaccagccctggtggtgcagctcctcccagcaggtgtcagtccctcttcaagggctaagctctaggatttggaattcttggtttcccaaggctggtacgcactagtcccacaaaaggttctgtgaaaatagggtccctcaggccaggcgcagtggctcacgcctgtaatcccagcactttgggaggctgaggcgggtggatcacttgaggtcaggagttcaagaccaggctggccaacgtggtgaaaccccatctctacaaaaatacaaaaattagccgagcatgatggcgagtgcctgtaatcccagctacttgggaggctgaggtgggagaatcgcttgaacccaggaggcggaagttgcagtgagcagagattgccccattgcactccagcctgggcgacagagcgagactccatctcaaaaaaaagaaaatagggttcctcaaacaggcaaacctgtgagatgcacgttatattcctctctgggaagcccctgacacacggtaagttactaaagacagcctggctgtgacagtggacctggtgcaaaactagccctcctgccacagacagatagaaaaatatgaaacaactctattcaggcagtggacagcaggcagcacgcacctgcaggctctgaggagggagttccagcgcgagccccgtgatcaccccactccttacctgggatgtttcccaagcagaacacagtacttctgagtggaagaggcagagatcaacatctctggcagctagagtgtgccagacagggccccagagagaaggggagctgtgcagagcaggggtccagaagtccatgcagggaccccccagtcggaccacagctgtgggcagggcagtgggcagtgtgggccccagagtagaacgcccctgcttgccttccgttccacatggacagttcccttcctaacttccctgtaaaaggagtcgaagtctgtcaccctataacgagtgcccctgcctgtgcccattgtaggttcacagtcaagtccagctgcctcttcaggagcagtgcccgtgctcttgccaccgcggtttgcctggcaggccctgaggccgggcagctctgaacatgtgatttctacacacagggtgtttgaaagggagggtcagaccaacagggtttgaagctggactggctccccttgttctggagatggcaccactgcactccagcctgggcgacagagcgagactctgtctcaaaaaaaaaaaaaatgcaagagaactcttcctgccaaaggcaggtccctccaactgggcatggcagggccaagatggtaaaatgtagcctgcaactcagacctctgaatcccacctgctcacgatttgtgtccctgcacttggtattgggtgaaagcagcagctgggacttccttgtggagagagccatagaggtaatttacagaagagttgagagttttaagtagagcggcctctgtctgctgtgtcacagtgatggcgcagagtgcagccttgggaatgatggctgagaactggtttgtagaaagtgcagcccaccctgctttgacacttgcctatggacaagtgtagcaggcaggtggccagaactgctttgtccttcctctgctgacctgaatgtggacttggccccgtcatagtgactggcccagggttggctatggacaggtaacttgtacttgggatgcagctgaaggtggccaggatgcaccaagaggccatggaaggtcccatgaggtgccagggaagacccacacctgctcgccatcttctgagtgggaaggaggagggtggctagtggaccccaccagagtcgagggctgggctgtttggttctaaaggcttttctgctgtgtgtgtccccagatgaacgacaatctccttgagagctggagcgacctcgacgagctgaagggagccaggagcctggagacagtgtacctggagcggaaccccttgcagaaggacccccagtaccggcggaaggtcatgctcgccctcccctccgtgcggcagatcgatgccacgttcgtcaggttctgagtccttcttggctcctcatgtggtccctctcctcggaagaactgcccagccacgggtttttaacccacctgttgctcctgaggtcgtcactatatcaacagtcacaaacccaatggcaataaaggcactgacgatagctggcgcgcgcgacgccacacaccattttcagatgccgttgcaattaaatcttgccacactgtcctcctgggtgattgttgacagttattgtagccacagagagaacataagacacgttgcgttcattcgctagaaatccctgtttccttctctcagaaggcagtcacagtccctacctgagtcgtgtgaaacacagggcctgagagtgctttacaggcattcacgtgctgtccgagtggcattcgggggctggcctagctggccctagtcctggtgtgcagggttcaggcagtcttgacctgcaacaaccgaggttttttagtcttttaacccagccattttcaattttttaaaaattaggtaagttaaaaaagctgggtaaaagctgactcagccctgtgtgcttgtgttccttagagctctccttcaaagagcgccgggcagggctgactgttttcacgtgtgcccgtcagttctcgccacatcccttgcctgtgggtgaaagctcaggtgtggggagggtgtcctgtgtcccacacggtgctgtgctgctgccagaatacgagtcccattgagcctctccaaagacggcctccaaggatctgaactcttggccactggtatagtggcctcctgttctcaccccattgttattttggcttttttaatataaaatgtacattgacagacacccgaagtctggatttaatgctaccagggcatcgtcacctcccagggtctcagatttctcctcctgcagaatgagggccacatcatgtggtcaccaaggtcccttctgcctccgggactctagactctagaaccgtctacttgaggaaccaggactctagaaccgtactgtccaatgtgggcgaggctgcagtgagccatgattgtacccactccagcctgggtgacagagggagaccctgtctcaagttttaaaaggctccaaattaatacccagccatctgttctttaacagacatttttacaaacatacaaaaaatgtggaagtgatgaggaaaggtatgctaaatccagcacaatcctaatcaaaatgccatttgattttttttttttttaaggagtcattctctgtcacccaggctggagtgcaatggcgcaatctcagctcactgcagccaccacctcccaggttcaagcgattctcctgcctcaccctccctagtagctgggattacaggcacccgccaccacacccagctgatttttgtatttttagtagagatggggttttgccatgttgccgggctggtcccaaactcctgacctcaggtgattcgcccacctcagcctcccaaaatgctggaattacaggggtgagccaccgcacccagccaccatttgattttttgagacacattaaattctaaaatttaattttttttccttttttttctgagacagagtctcgctctgtcgctaggctggagtgcagtggcgcgatctgtgctcactgcaaactccgcgtcccgggctcaagcgattctcccgcctcagcctcctgagtaggtaggactacaggcacatgccaccacacccagctaatttttatatttttagaagagacggggtttcaccatgttggccaggatggtcttgatctcttgacctcatgatccacctgcctctgcctcccaaagtgctgggattacaggagtgagccaccgtgcccggctttttctttttccttttttggcgaacagggtcttgctatattgcccaggcaagtctcaaactcctaggctcaagctgtcctcccacctctgccttcctaaaagctgggattataggcatgagctaccgtgcccgacaaattctaaaatgtatatggaagaaaaaagtcaacattgtgattcaattcattttgaaaaagagctgggagagacgctttcctaccagatcctgagtgctgcaaacccacagtgagagtgtggggggaggcctgacctaacagcaccaagacagggacacctcagcaggaacccaggggactcggggactgggaaaagtgtccgggggtcggggaggggtggacag

SEQ ID NO: 15866 - DNA, 30002 bp, Human
aacccttgtacactgttggtgggaatgtaaattagtacagccactacggagaatagtttggatattcctcaaaaagctaaaaatagagctaccacatgatccagcaatgccactgataggtatataccccaaagaaaggaaatcagtatatcctaagatatacttgcactcccatgtttattgcagcactgttcacaacagccaagatttggaaacaacctaagtgtccatcaatagacaaataaagaaaatgtggtttatgtacacaacgtagtagcattcagccataaaaatgaatgagatcctgttattttcaacaaaatggatgcaactgatgtcactactttaagtgaaataggccaggtacagaatgacaaactctgcatgttctcacttatttgtgggagctaaaaattaaaacaacggaactaacagagaatagaatgatggttacaaggctgggcagggtagtggggaattaaggggcagagtggggatggttaataggtacaaaagtatagacagaattagatctagtatttgacagcacgagagtgactagtcaacgataattcattgaacattttaaaataactaagtataattagattgtttgtagcacaaagaaaggataaatatttgaggtgatggatactccatgtaccctgatgtgattattacttattgtatgcctgtatcaaaatctcatgtaccccataaatatatataccatgtactcacaaaaaataaaaattaaaaattaaaagaattatctggattggactggcatagctttcaggaatttatatgtttatttttaatttttttggttacatagtaggtgtatatatttaaaaatacggaacgcttcacgaatttgcgtgttatccttgggaaggggccatgctaatctttatattattctaattttagtatatgtgctgcagaattaagcactgcttttaggaatgtaggtactttatttatttatttttgagacggagtctcgctctgtcgcccaggctggagtgcagtggcgcgatcttagctcactgcaagctccgcctcccgggttcacgccattcaccatggtctcgatctcctgacctcgtgatctgcccgtctcggcctcccaaagtgctgggataacaagcgtgagccaccgcgcccggccaggtactttattattattttttgatacggagtctcactctttggcccaggctgagtgcagtggcgcgatctcagctcactgcaacctccgcctcccggtttcaagcgattctcctgcatcaggctcttgagtagctgggattacaggcgcgtgccaccacgcccggggctaggttttgtatttttagtagaaacgggtttcaccatgttggtcaggctggtctggaacttctgacctcaggtgatccgtccgcctcggccttccaaaaggaatttaggtactttaaaatgctgttatgtatgttaacggaaaagtaactacatgcttcattttcagaaccaacattcaaatgaaatgaacgtgtcaaatcgacaaaagctcaaaaaagagaaaaacatataatacttaaaagtggttaatatactcttagattgcataactctggggcagtctgagtcctatgattttcttttaagaccccaagactctaaaatacctgctcatcacaagtttgttcagtgacaacattcagtaaaacttaacatttgttttacaaaattatgttgaaagatataaacataaacgtatatttgaagcacaaaaataattacggctttttttggaagcggagttagacatttccgtagaaaagtagatgcaatcaatctctcctgatttttgtcctccccacctttaatttttgacaaaccgaataacgacactcactattgagtacttttctaactccctattgcatcacaaacgcccgcaggggcttaaaaagcagcaggggttcctgcccttccccacactggccggtgtggtctggggcgggcctgatgagcacctggattttcacccggcgtgctggtaattcctacacttgtgggtgtttgagagacatgaagaggggaggatgacctcttcccggaagcgggacttccataaaagaagcgtggtgggcgggtcccgggcacctgtggtttggtgagtcctccaggtaactgtgatgcgggggtcagcgggagaggcacccggaagctcccggcgtctgcaccccggcagcgcgaggaaatgcccaaaggtgggttctcaggcgtgggaagctcgacccttcccggggtcctcggcgaagtggccgaggccgcgccttacgcagggaactccgccgggccatctgggtggcccgagttcgcagcagcttctcttccgctcgtccctcggccctctcgacgcgcacccaccggcctcaccaagtcgcacgcagaggggcggcggggcgctgaccgaggtctaggtctcgattgccgccggtcgagccgcgcagtttgcctgcagacctcggtcccctgcccgcgcagcctcggctccatcaggcccggcccctcgcccgggccgtggctccaccaatcgcagacttcgcccgccgcagccgcacctgcgaggaggggcccgcgcgccgctgcagccgccgtcgcagcgtccccgccccgctccgcccctatcgcggcgccccgagatcacccgcctccggcgcctggctccctgcaggcgaggagcggaagccgctatctggaggcggactccggcgccacagagccggggcagccgcggcaacggcgaggcgcgaggcaggggcgcccggcagaccccgcgaccccgagccagcgggcgccccgagcgggcagcctcgccgggggaggcggaggcggccacggcggccgcgctcgggcgcccctcgcgcagcgctccatgcccgtgtggtgctgccgctgctccctggccggtcatttcaggtgacttcctcgccggggatgggaggggagcaggcggggatgccgcgctctcgagctttttggcctggcccgggccgggaccggggtggagggcgagcgcctggaccgcagcgtcctcccgcctcggccgtcctgcctggcgtgggggtggggtggggtgcggtgtggtggggtccttgctccggggagccctgcgctgttcccttttctcgctctggaccgcgcgggtcacgggactgcgggatcggctaggccggactgagtcggttacggcgagctgagacttcccagtagtgcaaagttttagtgaagggggttctacgaagtgcctgcctccctaaaaaaaaattatttcttaaaaagtcttctaaataatgtaatgagtggaaggaaggtagggaactacatttcagtgtcatctaatcacaaatagattctgccttgttaagatgttagccatggtaagacgtgtgtgttgtagaaatttaaagaatgaggcggttttacaatcaccttatggggaaaggttttaggggtgataaaatataatacatttctaaaataaaagtatgttttctagatctagcacatttggtcaacacctcagtcattggtggaaagaccagacactagaaactgattttaaccctggggtgaagaatggttaagcatagggaatactttagtaccttgctttacatatactgatgttccagaataattctatgtaagacttcttccctggtaaaatatgaaattttgatcaagccttcctaaatagtgggtttcatacaatttaggtaacccatgaacttggatggaaagaaaggtatatcatttcactaaattttaaaaactaatattcagttaaaatataagcaacaaatcacagtagtatctgtgactgtcatcagtagagatcataaaatatgtttatatcacattgcagttaatatagaaatactgtttatacttattcaaaattatagtaacacatcactgaatttattgaatgcaacagagaagcacatatatatatcgcgtttactttttatgactgttttaatagaattagttttcttgtaaatcctgtgtatatttaagaacagtattcagagaagaggttaagaagcgtcatcctatagtaaaagagatgtaaggcatagagaaagtttggaacttcttttgtaacagcgataatccaagcttgtctaacctctcagtgagtttagaatgagtctctaggttgtggatattaaggaaaaattgtttcatataataaactgcttgattttaacttttaggcaaatttgttgactactgagacagcggtttgaaggtatcagattcactatggaaacttttaggaaataggttcccctagtgaaacttgttaaactaaataaagcccatgagaatctaacatgcctttcagaaaatattgtgtgaaagctatttgacaccttttgatgcacagtgtaggattcatattcttttgactaatactgggtgttgaataccatttgcttcctgccgtgcacagaaatttggagtagggagtgaaaacaaagtatttgctatgttttggtctggagggacagaaagaaaaacaagctagctgccaaagataaacattatgattaataaaccacactttttattgcaaaaacagttctgttgtgtctaaagtatttttttttttagttgtttaccagctccttcaggaatatgtttctgatttaccagtgctatttctcgagcagtttcaggtcagttcaggtcatcctggccaacatggtgaaaccccgtctctactaaaaactcaaaaattagccgggcagggtggtgtgcacctgtaatcccagctactcgggaggttgaggcaggagaatagcttgaacccaggagacacgttgcagtgacctgagatcgcaccactgcattccagctgggcgacagagtgagactgtctcaaaaaaacaaaaaacacacaaaaaaacacagattataaaacaggttgtgacatctattgtctaacatctgaatggataagtagtgagagaactgtccactaactttccaaaggaaaaaacctcttccttcgtgttctggaagatgaagagtgtgactgacttcatttgtggctttagaaccttctttccatgtggtagtataaatttggtaaattttaggttcatggttccaaagactataaaaattcagttagtaaagcatttcattttagtttgaatgatcatttaaacaagtactgctatggtatggaaaaagtctttttgttatcctgatactatgtccacactatcctttgaaatgttctctgaaactttgtgctgtaatgtttcaaaaacaaaaaatggaaggcctctaaaagcatcttaaatgtcaaataggcttttaacttgcttcctaacaatagagtaactaattttgcatgtaaagtgctgttctttactagttgctaaatgtaattgtacatattttccaattttaatttgtgcctcgaagaaaaagtagatttttattactcaaaataagctcttgttttaaatagaacaaatatcaaattggaaatctagagattaacactgttcatagacctgtgatatactgtgcatgtaccataaaacatgtacagcaatactaaatttataacttaagctctgaattttttagaaagaataattactaaaagtcttgtttcattaatgttttatgtaaaaccagtgaatcacactttccgtttttgtttccttgtttttctttgtgttaaaccactatcaaataggaggcaggtttactacaaatagtttatcacagagtttataccagtggctcctgaaaaatcagagcagattacctatactatgtaaatttagataagctaatgtgtagagaatttggataaactaaactttggttcttcattgcttgagggctgcacatgcaaaaaactactagacctaatatataaattcaacggtgttgcaggatgcaaaatcaacatacaaaagtgaattgtatttctgtacattaacactgaataatttaaaatgaaattaacaaaggtatttcatttatataatagcatcaaaaaatgaaatacataagaataaatttaataaatgcaatacttatgcactgaaaactacaaaatgttgagagaaattaaaggtctaaataaatggaaaggaattctatattcatggattgaaaaacttaatattctgttttttcttttaagtacagggatgcaagttcaggtttcttacataggtaaacatgtgtcatgggagtttgtttcatcacgcaggtattaagcctagtacccattagttcaggggtgtccactctttttgcttccctggaccacattggaagaattgtcttgggccacacataaaatacactcacattgatgatagctgatgagcttaaaaaaatggcaagaaaatctcataatgttttaagaaagtctacgaatttgtgttgagccacattcaaagccatcctgggccgcatgtgggttgaacaaacttgcattagttgtttttcttgatcctctccctcctcccacccttcatcctcaggtgggccccagtgtgtgttgttcccctctgtgtgtccatgtgttctcctcatttagctcccccttataagtgacaacatgtggtctttggttttctgttcctgtgttagtttgctaaggataagggcctccagctccatctatgtccctgcaaaggacctgatctcattcttttttgtggctgtatagtattctatggtgcatatgtaccatgttttctttatccagtctatcattgatgggtgtttaggttgattccatgcctttgccattgtgaatagtgctgcagtgaatgtacacgtgcatttgtctgtataatagaattatttttattcctttgggtatatacccagtaatgggattgctgggtggaatggtatttctatctttaggtctttgaggaatcaccacactattccacaatggctgaactaatacactccccccaacatataagcattcccttttctccataaccttgtcagcatttgttattttttgactttttaatagccattttgactggtgttagatggtgcctcattgtggttttgatttgcgtttctctaatgagtgatgttgaactttttttcatatgattgttggctgcctgtatgtcttcttttgagaagtgtctgttcatgtcctttgcccacttttctgtggggttgttttttcttgtaaatttaagttcctcatagatgctggatattagacctttgttggatgcatagtttgcaaaaattttctcccattctgttggttgtctgtttactctgttgatagtttcttttgctgtgcagaagctcgttagtttaattagataccatttgtcaattttttttttgcttttgttgcaattgcctttggcgtcttcctcatcaaactctgcttgtgcctgtgtcctgaatggtattgcctaggttgtcttccagggtttatatagtttggggttttatatttgagtctttaatccatctagagttactttttgtatgtggtataaggaaggtatccagtttagatcttctgcatatggctaactagttatcccagcactatttattgaatagggaatcctttccccattgcttatttttgtcaggtttgtcaaagatcagatagttgcaggtgtgtggtcttatttgtgggttttctcttccattggtctatgtgtctgtttttgtaccagtaccatgctgttttggttactgtagccctgtagaatagtctgaagtcaggtgaggtgatgcttcccgctttgttcttttcacttaggattgccttggctatttaggctcttttttggtttcatatgaattttaaaatagttttttctagttctttgaagaatgtcatcgggagtttaatgggaatagcattgtatctataaattgctttgggcagtttgtatgaatttgcatagccattttaatgatactgattcttcctacacatgaatatggaatgttttcccattcccgtcgcctctgatttcattgagcagtggtttgtgtgtgtcatctctgatttctttgagcagtggtttggaggtttctgatcaaaatgactttgatcagaagcctccaaaggtacaggagaacctaacctttgcacatactttggagaaataccagggacagagcagaatataaaacatgttaaatgcagttgccaagaggtagaagcgggcatgggcaagacagctgaggcatctggatctgatcagaggcagtagttggaatgagtcagaaatagatggattgagcatataaaacttcctcccaagggtaggcttgcactgtgaggaggggtttcccttagtagccatgtctgattggtgtctgttttggtcaaaagaggctatgtaaggggaaaccaaatatttggggtacaggttactttctttgcttcaagaaagctctcagtatgtcctgaggaagtctcgcctatcctagggtagactgggaactctgaaggttatagggaagtagaaatgcctgtctctgcctgattcttttctgtttatcaacctcctctgggatcagtgagttcaatcttgtgaaataactgatctatcccatgcttatttatcatctgagagtagtaataaacacacttacccactagtagatacttaatttaatacttccagacattgtggctgttactgactgtatgaagataaaattaattaagggattctattctaaagtaatctgttgtataatgcagaacattacctgtgtgcaggagatactccatgtattgcatgaaaatgtgagaatgctaaaactaatttctagagagccaattgagaaagaaaaattggaaaataacattaagaaattattttaatatatttttgaagtctgggtaacatagcgagatcctatctctaccaaaaaatattttttaaattagccaagtgtggtggcacacctgtagccctggctactctggaggctgaagcaagaggatgacatgagcccgggaggtggaggctgcagtgagccatgcttgcgccattatactccagcctgggtgacagagcaagaccttgtttccaaaaaaaaaaaaaaaaaaaaaaaaaaatatatatatatacatatatatatatataatgtatatgtagtatattttttgaataaaaatgtataaacctaatttcttatacaaaaatgcacaatttataatatataaataccgtaactttttcttaaaatgtgtatgactatatattgtattttagtgcactcaccttttaaaaagaaaggtatggaggagacactagccatttctaggctagtttcagagaattatgaactcctcaacaccatgctgtctttgatcatgagagaactgcttattagagacttgcctagaagatacttgtgagagaaaagcaactattaatattggggatatttggccttcaagttggtataggttgacatgtagcgaagctactaatttgaaagcattaatcagaaggattttctttgcttcttttatggaatgattaaaatattttatgtctaaataaactcggagtagagattgatttttataaaggctatattgactatatctctttttattcccccttttttttttttaaagaaactatagtgacactgaaactgaaggagagatttttaattccttagtgcaatactttggtgacaacttggggcgaaaagttaaagcgatgccattagttgaagaaacttctttactggaagattcgtcagtgacttttcctgtggtaataataggtaagttattgtattttatcttttaaaattatagttaatgacccttaatacttttataaatctacagttagtacaagttcttaagattttattgaaaagtattcttaggtggtttgatatgctaaaaaactaataaccaaatctttggagagtaattggtttatctgattttagcatctgtgttaaaatgcagtatctttttagtgaagaactgatattactacattattttaaaatatctcctacatttgtgttaattatatgacagtgtcatggtaatgtgataatattattagagctctgaagagtattctatgtatattattggataataccttacaactctgcagacttctgatgttggtagggcggatacagacagagaaactgacacagatgttgagtaacgtgcaagttagtaaccggtgctgtattagcaatgacattatagtactctaaggtaatgtttacagttaccttaaccacaacactactattttatatcctttgtatcacctcagcagataggcatttaagatattaaaaattaaactattaataaaacattcagatttataagcttttataatttagttttattgcatgcatttaattacctgttatgtatatttttcatctaatatacaaagtcgaggaattcagacaaggaatatagtgtgaagctaactaagccagaggagagagttaaggaatataggtgccttggtagcatatgacttcctttgtttctttgacagcttgtttcaaagttagtaggaaggggagaaaattcatgtcctctggcttgtgggaggaaaagaggagagcaagattgttctatactaggttctatactagattctcctctacaggatatgatagaggtgacagtttttgtaatagttctcaaccaagagatatcagggaccatacgtcatgtttcattttcccccttacctctaaccttggttttctatcctgaatgaatggaggaatcctgtcttcttgtgtggctaggctgtgggaaggtcagaaaagaaaaacttaaccttcatttgcacctgcccactccacttcccacaaagcagcctatccctgttttgcctcagctagctgtgagtagcttagcctcatgtatatttatatagtgtcattactgttgacaatggcaccaccagcctgagcataaagagctaatttcttaaatatatgttttctgttgccgctgtaacaaattaccacaaaactagtggctttaaacaatgtgaatgtattattctactgttctgtgggtcagaaattcaacatgggtcttcctgggccaaaatcaaggtgttggcagggctgtgttgctttctggaggctctagggaagaatgtttccttttcctggctcccttctgtagcttcaaaatcagcaatgttgtttcttaaccttctttcattgtcatgtctccctttcaccacaactgggaaaagttctctatttttaaggactcttgtgattagattgggtctacctgggtaatctagactactctccatctcaggatccttaatcatatctacagagtccttttgctctgtagtaacatttacaggttctaggggataggactgggacatctctgggcacagtggatcacgcctgttatcccagaactttgggaggctgaggtgggctggatcatctgagcacaggagttcgagaccagcctggccaacatggtgaaaccccgtctctactaaaaatacaaaaattagccgggcatggtggcgggcaactgtaatcctagctacttgggaggctgaggcaggaggatcgcctgaacccaggaggtggaggttgcagtgagccgcgattgcgccattgtactccagcttgggcgacaagtgaaactctgtctaaaaaaaaaaaaaaaaagaaaagagggccaggcctggtagctcacacctgtaatcccagcactttgagaggctgaggcgggcatataacaaggtcaggagatcgagaccatcctggctaacagggtgaaaccttgtctctactaaaaatacaaaaaattagccaggcatggtggcgagtgcctgtagtcagtcccagcttctcgggaggctgaggcaggagaatggtgtgaacccgtgaggcagaggttgcaatgagccgagatcgcaccactgtactccagcttgggcgacagagcgagactccgtctcaaaaaaaaaaagatataaaattagttctaaatattttttatttttctttcagtctttaaggcttcctattctagaattataagttgaaatctttctctgctttctctgtttctagtattcttatggttttacttttcttatatctttgagtatattttatttggggtaacatattaggtaaggaacaggattttttctttgcagctagcaattctctaggttggattaaatttttgaaaggcagatataataagtggtaatccagaataaaggaattattaattcataaatggaagtagttcaggaaatccagtttggttttagttaaagcatataaacatataggaaagcaatatcaggatttaggactggaaagatggttgagatgtataatcacctggcagtttcttgcctgctgcacagacaaaaccatttcactgagaccatggcgttgcagtaaagaagttgacacaaggccagcccatgtgagagaactgcagttgttcaaattagtctcctgataaaactcctgattggttgggcgtgatggctcatacttgtaatcccagcacttggggaggctgtggtgggtggatcaagagatcaagactgtcctggccaacacgctgaaaccccgtctctactaaaaatacaaaaataagctgggtgtggtgtcgtgcacctctagtcctagctacttgggaggctgaggcaggagaatcgcttgaacccaggaggcagaggttgcagtgagccgagatcatgccactgcactccagcctggtgacacagcgagactctgtctgaaaaaaaaaaacacaacgaaaaaaacaaaactcctgatccctcctgatggcttggaggttagggtttttcaaggatagttgggtgaacaggggactagggaataggtgctgctgattggttggggatgccatgctgggggtatcaaaaatggttctctagcactgagtccaactctgggtggggggccgcaggactggttcagttgagtcttgggtctgagtcttgaatcttgggaccaatagagtcagacagtcatcagaaatgcaaaagtctgaaaagacatttcaaaaggccaacctcaggatccacagtagcgatgttatctgtaagagcaattagggaagtcacacatcatgtgacctctggctgcgtgactcttcagcagtaaaggattatagaaactctgcctacatcttagcagaattccggcacctctcataatccgaaccttgtggcctttcattagttttagaaaggcggtttaattttgggaaggactgttaccatccttgctttaaggttaaactataaattccttccatgattagctttgcctatacccaggagtgagggaagacagccggcctttgaagctagaagcaagatggagtcagccatgttagatttctctcactgtcataatctttgcaaaagttgtttcaaatggagaacactggatagtcagaaacaaacaatgaagacctttagaacagaaggctaacatgatgaggattatgttaccaaaacttatgtgaatgtagtatgtgaaatgattgggagtgggtgaatctcagggcagagaaacagtaggagacttgtcttttaggtgaagtacaggaatgagaatagcaaagacaactgacaagatatagggggcaaactaggtttagaaccagaaactgattaacttagaagtttgctagtaccatactttgagataggatagggtttgaaggagagggcacctcaatgaagggactcatgagcttgcttttgagcacattacattaaagttattagtgggccattctatcaggtagaatcaagaagtggaatggaaatgtgggatatatccttgggaaataggtcaatttagagaactaattttggatgtcagtagcctagagagttgaagccttgagtagatgagattcccaaaagaaaataggagagaaggcagaggttaaaatctcatgaaacatctggttttaagagattagaaaaggaagaactggtcagagaaaagagccatcttcaaagtaggacaaaagccaaggaacaagagtattaagatgcatgacctacccctttccaccttttatttttaataggaaatggaccctcaggaatatgcctttcttatatgttatcaggctacagaccgtatttatcatcagaagcaatacacccaaatacaatcttaaatagtaaattagaagaagcaagacatctttccattgttgatcaggtattatttcttacatgtcaatttaaaaaatttttttatgctgaaacaagattagtttttatttatatgaactttcttagttgaaaccccttattctaaataacaccttatatcatttttattttagattcgtaaatgtattctgagttacttctgtttattttcttgaatttattagagcagagttttctgaattattttctaatggagatttagtaggtgctctgtggtcaagttgggggtactgctttttatcattggagcatcatggtaagcattagaatatactatctgggaaatgctggcttttttcaaactctgtctcccttttgttcattcaggacttagaatacttgtctgagggccttgagggccgatcatccaatccagttgcagtacttttcgatacacttcttcatccagatgctgactttgggtatgattatccatccgttttgcattggaaattagagcaacatcattatatccctcacgtagttcttggtaaaggtccacctggtggggcttggcatgtgagtatatttttcttagcattttagtgtatgtgaattatttgtcttgataagaccaactttattcttaagcattatgataatgttatatgtgatgtttatcacatttttatttgagaagaactttaatgctgttcagttagttaaatatgggtttattacaagtagcagtaaatcaagccaaattttattactggtacagtcttagaataagcatgtctctatactatcttacaagaattatgtagaaaacatttcaagaatgttttgtataataaaaatttaaaactcaattcattttagactttacataatctcacatagtatttcaaagcagtatccattattttcttacattttcagaatcttaaatgaaaaatgtaaaagaggttgtgttagtctgcttgtctgcgataacaaaatgccatagaattgatggcttaaacaacatatttatttctcacagttctggaggctggaagtcccaagatgaaggttccagccagttcagttcctggtaaaggccctcttcctagctttcagatagctgccttctcaatgtgtcctcacatagcagagagagagaaatattctcttcttatgaagccagtaatcccattctgagggacctaccctcatgacctcatctagctctacttacctcccaaaggccccatctccaaaagcatcacattgggggtcaggacctcaacgtaagaattttgagggtagatacaattcggttcatagcagaggttaaaccagagaaccagtgaattaaggattcactcagtgcatttcattagggggccagtaagtaataattgttcatccttcctgtgttcttagcagttaacactgtgtctagtgtgtagtgagtgttcatttgttatacaaattgatgttaagtaatttagtttgctgtgttatgaattacagacttcatgggaactttaacatattacataccaaatttttagtacaaacttcggttggctgttcgtgtattagtgcagttttgcacatctgaaaagttgtttacgtttataaaatgactgtttcagggtatcgggacattcctagattaaatacgtcatgggtttcttttaaaatctttattctctttttaataatgagtagcaactaccaaattatttgttgcttttagcttaagttttatgatttttactttttcatatcaactttaagctttatttacaataagctgcatccatttagagtgtataatttgacaaatgcctgtaactgtgaaaccaccaatacaagataagaaagaattctatcatgcccaaaacttaagtgtttatattttctctgttaattagtagcattcttaattttaaaaaaagccataatgtatttggaagtggggagggcatttagactgccttctctgaattcctgaggttttattttacttacattttttccgcttagaagaatgatgagttgtgcaggcgataattgatctgtttcatttctttcacttatgtataaaaaagttgaaagtatggataaaccctgattactaaaaacacattttgagccagtgataaaggttaaaatatacctaaaagttgctgatttttttcaggcatgtattcactaaaatagggctgtaagtaatatttcagctgtgtaccagttgccagtcatcacctctgtgaaggttcctaatgttcccagacataattacttgatcctacctgcattccatatcttaatcttactgtgcttgcctgtggtactatttatctgtttatgcgaccatctcccctgctatggtttatgtacatcctaattaacctgagttgtgacttaagacgtaaactccttgagtcatcacccctctctcctacttagcttcatatagttctctgtttctcttgtgatctagtttctcatcactcttctctcttccaaactttctgtggccccttgaaccaattttgtgataaacaacttgtttgctttcccacatctttaaccattctgtcagatgctgcttctgctccctttcttgaaagcttactctttcctaaagataccattcccactgtagccctctgaagtggagcctattcattctcccatagccctatgtcccatcaggttggctagtaaggttggtcttctcttcacacccctatgcacttgtgtaaaaagccctgttccattgaacagatgatgccattttctagcttttctaccattccagactgtctccagactgtctccatttctggcttttttaccattccagactgtctccagttactgaatctgtggcacctaattcatgggtcttccattatatcccaagttttgttaccaccttgaataattttacctctacaaacatgacacagaaccaagatcttaacctttttgttccttggtctcctcattcttgatgatgatgtattcttcattagctactcactccagtggctccactgtagatcttatctgtcataactactcaacttgtaaaaacctaaattctcaaatgtcttcctttctgatcacagtttcctgttcttcaagcttatcacccagttaattcacactatagataatctttgaacacagagcgtgctccaggctgtgatcttcatatccttacttacccagcccagcttctgtagtccatggagttaactattctctttaattcccttaacccattgtccttctgtcacataggtttgtcatacaggcaattcatctaactatccactttatcttttcttacacttgagcagtcagacccccagaaaaaaaattatacaactgtgaaaatattctccactctcagttggggccaaaacactactataacctttgatatttccttattaacttcttttcaaacctttatctcttttttttctttcatgcttagaagtggtcttggttcttattttacagataaaatgtaatccattaggattgaacttccacaatttcacactcaaaccgaaaacttacacattgatgcaaattctttttttttaatcccctgttataatggaagagatattactactaaggctcaccttccagccacattctggatccctgtcttcccaagaacattatttatttgattttccccatttcttttatatcttcaatttctctgccagcttctattggtcggtatgtaaacatgctgaaattatttccatctttaaaaaaattttaggtgccagctgatctttatcctttggtttatagctaacttcctgaaagagttacctatacatacttctccctgcctttgctttctgctccttagcttactcactctaccttctgccaccggttttccattggaactgttttttctgaaagtcggtaactttcttttttgcttaatttgatgacgagtctcagaatttatcttttctgatctctgcagcttttgacagtgttcatatctttcttaggttctctgaatcttcagtctccttgtttttcttcctgtttggtcactccttttctgatacctttgtggattcttgtcttttttgttgttgttgtttttgagagagggtctcactctgtcatgcagggtggagtgcagtggtacagtcatagctcactgcagcctcggacccctgagctcaaatgatcctcctgccttagcctcccagtgctgggattgcaggtgtgtgccaccacacccagctgactcttgttctttaaaaattgcttctgtagaccttatcccaagcccaggtcttttcttcatactcttcattctccctgggttatcttacctacttcaatggcttgcatattgatattaattgattcccaaatcagaattcccaaaatcaaaaccagcccagattgctgtttctcatatacccaagtaaatacattcccttgattattctgcaggtgtcctcagactcaacgtacctaaaactaactatctttatcatcaagtcccttcaatttccttgtcattaaatggcattctcatgtagttactcaagccaggaacctgagagtcttccttgatttctctttcttcaactcccatttcaaattaatcaccaaatctttttcatttatgatattttgggtccatctactctattttgttgctaatattggtcaccgctgtctttcaccagaattactgcaaaccctttctaaatggttttcttactcattgtctcttctccaatccattatccataccaaagccagactcatctttctaaattacatgtctgagatgttacaccaatgcataaaactcttcagttgctctccatctaacatatagtatgtagacttcgtaatgtatctcaccatactccaatctagcccttattaggtttcttgtcatattcctctttttatctctgacattctgtgctctagcatgcttttgttggggagtccaagttcattctcagtctcgaagattcaataggattcacaggactcagtaaagatggtgtacttgtggttaaattttactatagtgaaaggatacagattagaatcagcaatgggaaaaggttcacagggcaaagtccaggagaaaccaagtgtaagcttctagatatccactcctagtaaagtcactggtgcgtggtgtcgagggatgttttctgtggggtcagtcatataggccagcagctcccatgtgactcacctctgcctcccagagcaaaaactggtattcacataaatcacattgttaggataaactctcatggttacactggtatagcattgccaaggccttaggcatgcaaaactcatgctcatcaggtagagtattcaggggctcagaagttatttctaagaaggtggcagccaagcctggttctgaagacaggcttttgttggtaatgtaaaaggttggaacaacgcaggcctgctgagttaatcctttcaggcacaaggctgaatttcttttgactccttgaaggacactcatatttgctctctttattaagctgccacatggatttttatttggcttggaatattttccctttctaatggtacactcctctgcccatttgtgtccttgaagaaccagatactttctatatgctcctgcatacttctatttagtttgcatcctttaatactacagtgtccatggcagcttgtattcatggcatataggttacatggggaaaaaagaaagataggagaaaaatgaagagatcaaggcattagggctctcaaccaactggaagaactggtgcagtgggaataatgttaaaaaattgttgtcagaaagtgaaatagtagtgtcttaaggttttagagttacaggtgaaactctcaggttccaaataatctctgatagataatacattcttaacagctccttttatgatgattccaggttctgaacctggtatcagggctagcctccctcaaagcaggtggcagcttgctacattctctttcttgggtgatttgtatatagtcacaaatgaggtttcacagggcctagtacatagtaagtactctgtgaaagtcagttataataataataataatatgccccattttcaaactgggtgttatagaagcagggcaagaaattatgagaaaaggagccactgcctaaaagagttgattgaaagagatcatagaggtcataggtataacaggtacttggcctttgggcttttcttgctttgtattgaacaaagcagaaataagtaggtcaagggagcttgatggcaagcagtagcctcagctcgtttgtttctcaggcatccactgcctatttctgtatccttaagaagagatgctgctgtatccacatcagcctagattttagaattataattgatggaggagggaaaagcttctttgttgctaattaaaagaaagttaataatattaaaatggaaagccatctaaaattttggaacttaatgaacatttttccttttgttcaaaaaatgaatatactgaatttttgtttccctgacataatattgtacatctgaattatgttgatcatagaccaaagttatcaacattgtgtaggcattggataatattgtaaatttgttttataaatttataactatatgaaagaaggttgtcgggataatatcaagtgatgaaggtatatgaaagtttattggagtaatgtttttgaggtaagttagccaaccatttaggactgcaggagcgcaccttgtccagagtcataattattgtaaatgagatggatatggttaaaaaacagaccaaaaaaaaccatgttacttcttgttttttgacggtacatttttttttttaaactctaatagaatatggaaggctccatgttgacaatcagctttggaagttggatggaactacctggacttaaatttaaggactgggtatcaagtaaacgaaggtaaagattgaactgtattaaaattctttggtgtacgttgaaaaagagaatgtggaaaaatttcaaaatatttgtgattttgtcatggctgaagaatataaatgtacgtctttcaaataaaaatgtgtccttgaagcagtgattataatatgctagttttcatttagagatgttataaaactaagcacagagctaagggattattgcagattggtttcctgtgacttttgttaatcatgggtttatctactgtcttgttacatcactctctgtttagttactttctcatccatccatatattatttttcatactttatttttatgcattgatatataactttatctatgcatatctcttatatgaatacctaaactctgcatacctaaagtgtttgactttcagtataaagattgtatattttatgattgataatttaaaatgatggataagctagaatctggcttatggttggctaattgggtatgaaggaacatatttaataaaaaaaaataagagtagaactgagggcctggcgcagtggctcacgcctgtaatcccagcattttgggaagctgaggtgggaggatcacctgaggtcaggcgtttgaggccagcttgaccaacatggtgaaaccctgtttactaaaaacacaaaattagccaggcatggtggcgcatgcctgtaatcccagctactcgggaggctaaggcaggagaattgcttgaacccgggaggcagaggttgcagtgagccgaaatcgcgccactggactccagcctgggcaacagagcaagactctgtctcaaaaaaaaaaaggacggaagaaatctcaccttggaaaactataaatttatttattttaaggggaaatcccaaaatttaaaaagagaaatatgaaaatcctgtcaatcattttcaaggatagtaaatattagataagaattactaatacagagaatctactctaatttgactactcacaaaataagaagttacgtaacctttgttagaacagggatgtaacatttgagtacttcacttcctgctacataacaaccatgttaattcatagaaattttccttaatatgaggaaattcagggagagcaaatttacatcatcatgggtaattgagattaaacctttccaaaaattcattttagatttttaaaaagaattatatatgggtttgaaacttgaagtaaaattaggcaagttgtacagttcttgatcttcgtaacttggcaagtgaaattgcttaacacattcttcactttgtaaaagggtaagaaagagaaagctttatgatttatgtaccagaagcatttacttttctaaattatgcatattgtgttgaagtaatatgtgcaaatgaattttgtgataaatttaggtttagttgctgcctttgtataaagagaagactcttaggtctctagagattggtggagtttgagttccgacttatgacttctagtgttgtgatcctgaacaaataaactagttgtcaattttccattctgtaaaatggagatgataatacagccgtgtattgcttaatgatggtgatatgttctgagaattgtgtcgttaggtgatttcgttgggcaaacatcataaagtgtacttaacacaaacctccgtggtatagcctactatacccttaggctatagggtatagcctgttgctcctaggctacaacccagtacagcatgttgctgtactgaatactataggcagttgtaacacaattgtaagtatttttgtatctaaatatacaaaaagtacagtaaaaatacgatataaaagatttaaaatggtatacctgtgggaggtaccataccaaaaatggtatacctgtataagggcgcttaccatgaatggagcttggagggctggaagctgctttggatgagtcagtgagtggtgagtgaatgtgaaggcctagcacattactgtacactaaggtacactttataaacactgcacacttagggtacactgaatttctttttaaaaaagtaattttaccacaactttaagatggctgtgatgtcactaagctgtaggaatttttcagctcctttataatcctttatgggaccattgttgtatatgctatcctttgttgattgaattatgtgacacatgactgaagaagtaaaaatctaaagttaattctaaatcttaataataattattaaacttcaaaagaaaaatttttgtgaacttcccattacaagttacaaacagtccctgattaatcatggtttcacttaaggtttttaggttttaaggtggtaccaaagtgatgtgcatttcatacaaactatactttgggtaccaatgcaactgttctgtttttcactttcagtatagaattcaataagtcacatgaggtattcaacactttattataaaataggcattttgttagatgattttgcccaactgtaggctagtgtaagtgctctgagcacatttaaggcaagctaggctaagctttgatgttcagtaagctagttgttattaaatgcatttttgacttaaaatattttcaacttacaattggtctatcaggacaaaccctactgtaaattgaagagcatccacatcatgaattatgtcaaataatttgcttcttatctctgattggggcaggggattttgcttgttgctttgaactttggaaaatgacatacagactaatgcaagtttttcataacagttatgttttagctctgcttgtgagtaggaaaacacatagagtgaaatgtcatctgttacttaacctagatgtaagatgactttgtttagcaaaagacagatctgaattattttcagctgttaggaaaatagcagtgtactaaaattcatgtcaagatggcatgtataattttaagaagcatagatattagttaggcctgtaatatctcaatgattgccatgaaaataattcagttgataattatagattataattgtgagataaagtagtccaattttcaaatatccacattttaataccttcatttaatgaaagtttatcaagcagtgtatttgagcagacactatgcatggcactggggaaacagaagtgcattaaatatagtctctgctctcatgggacttcttccaattttttgctaaaaagtaactcatgaagatttttaactaaaaatagttttttttttaagtgttaggataatgtatagctaagacagtccagcagaattaaaaagctataaaagcttactaggtagataagtaataatcatggaaactgaaagtagtatccttataggatatttttccttttccttttttaggagcctaaaaggggatcgagttatgccagaggaaatagctcgctactataaacattatgtaaaagtcatgggtcttcagaagaatttcagagagaatacttacataacttccgtatcaagactctacagagatcaagatgatgatgatattcaagacagagatatttcaacaaagcatttacagatagagaagtcaaactttatcaagagaaactgggaaattaggggttatcagcgaatagctgatggttctcatgttcccttctgcctctttgctgagaatgtagcgctggcaactggaacgctggattctcctgcccatctggaaattgaaggggaagattttccttttgtgtttcattcaatgcctgaatttggagctgctataaacaaaggaaagttgcgtggcaaagtggatccagtgttaattgtaggttctgggcttactgccgctgacgcagtactgtgtgcttacaacagtaatatccctgtgattcatgtgtttcgcagacgagtaactgatccaagcttaattttcaaacagcttcccaaaaagctgtatcctgaatatcataaagtctatcatatgatgtgtactcagtcatattctgtagactcaaatcttttatctgattataccagctttcccgagcaccgtgtgctttcctttaagtcggacatgaaatgtgttctccaaagcgtttctggattgaagaaaatatttaagctgtctgcagcagtagtattgataggttctcatcctaatctgtcttttctgaaggatcaagggtgttacctaggccataagtcaagccagccaatcacatgtaagggtaatcctgtggaaatagatacatatacctatgagtgtattaaagaagccaacctttttgcattgggtcctttggttggagacaattttgttcgatttttaaagggaggggcgctgggtgttacacgctgtttagctacaagacagaagaaaaagcatttgtttgttgaaagaggaggaggagatgggatagcttaaagcaagtttacaagtaattaaaatggacagtttgccattaaagatttttaatagtggttttgcagtgtactggcttgaattttctggacttgagttaactgaaggagagcctcaaactatagtaacttcatttttaaaagttactagaatttggtatcctgatttatattgcagtgtttcaaaggtgtcactgtcagacaaatagaaacactgccaacttggtgtaacttaagctttcatttaactaaaacattcttttcttgcaaaacttatttttcatgatcatttttggttatttattatacttgattccaaaatagtacagccttgaatctataaaactgtgcagtcattatgccagaaattatcttaaatatataatgggtcaccttgctgttcaaagggtggtgcaaggtcctgcagcatcttacatctgtagcttgttagaaatgtaaactctcaggccccacaacttacttcctgcattttaacaagatccccaagggatatgtatgctcataaaaatttgagacactggtttaaatgaaaatggatataaggtatgtataactgggggtggggtgagggtaggaggcatttacaactcagattttatttattttgaaattatcaattgtataaatctaatttattaccaaatagggtcttttaaaaaatatttttatcgttgaaaccttgacaggtacttcatattcttctaataatttaaacagtccaataatgtggtatacactttgacatccaagaactcaccaagatgtttttcagagatttattctcgatttaactatcatagcatttaatgaatctgatttgtagttcaataaattgtgggttgaactacttatccctgtgtgaacattgaattactttctgtcactgaaactgaggtatttgggtgtggtaagtacttcgaaaattgtaatactgtttgggcattgtctaaattattaaaggttaaaatagaaaataaagtcagaatttttcttttccattccaaaggtgtacttagagatctctattagtattcattcgagatgacatagcagctcatatcatggttgtttattggatttatctgttctaattatataagtgtgtttactgtctgtgttttcacacaaactgctagaatttttaatgttaagacgaaaacatctgaagttctccatggcaaattgaatttttcagtcattttcttttctttttttggtacaattacttcatctggaatgtcttcattgaactcgttattctatttttcttagaattaaaagtggattaatgtgggtttttctgttcattttattgcagtattaaatgcttaagcttattaggaccataattcactttaaatataattgtatagaatatatttgcgtcgatcaaataattgcttcagatgaattcttagactcttgataatatcacacctaatttaacttgattttacaagctgtacaatccagttttagttttctattgtgataataacttttttcaaaccagtttcacatcttaatgaaataacattctctgactgcacttgcttcagtactctcttgcctgcctgtttttgacctctgcatgagttggattagatgtttttcttactgtcacttctaaatagaaaatgacagtgttataaaaaagggaaggataaaacctttgacatccccttgtgtctcaaaagtccacagttattcaaacaatggctttttttgtgatgagagtatttgttaaaaaaaaaaaaagacttcaagaaaaataaaagttcagtggagctgcaaataaatctggtgaataatttcatctttggtaatctcccatttcctgagttcttcctcaatccaagctgtcctgtgtagtatataacatttgggcattttctctgatatactatactctcatgttctataaatttctgtcccgtaattctaacactttacattttttctttgctatcagctatagctattcatggaagggaagaatcactaaatacttgtctagttatagcatgatgtgagcatctcctccttatccctcgatgcctggcttggtgtctggcaaacagtccataattagcagatgttgaaagaccgtttacaaagcagaatttggggatttaaagtgcaatgatacaacaaaaagatttaattacagcttccagtgttttgactatgtgaaccatatccaactacttttttgaaaatctagttctatgtaatatatttctgtggcatcaaattttagttgattgtattagtcaataggaagtggtggaaaatttctaaataaattcaactattaaataaatgcaagttccactaaatcttagtgtttggaacactgaagaacccagaatgaaacaaaattagactgaatgtaaatgtcatttaaaaatctaactgggggctgggcacagtggctcacgtctgtaatcccaaaacttcaggaggccgaggcaggtggatcacctgaggtcaggagtttgggaccagccccgctaacatggtgaaaccccatctctactaaaaatacaaaagttagctgggcgtggtggtgtgtgcctgtagtcccagctacttgggaagtgaggcacaagaatcgcttgaacctgggaagcagaggttgcagtgagctgagactgcaccactgcactccagcctgggcttcagagcagaactatctgaaaaaaaaaaattaaaaatctaactcggttacagaggctgcttgttgcatagagccattttgatctgatcagatcatacagtttttaagttgtatactttccttgtggggggagggggataaagggcctgagtcccctaaggctagtctgaagagtatgtgaaataaggattaaagagataccctgattattttgaacaactacccactccccccccgccgccaaccacccatgcaggttattcaagagaaatggtgtctggggaaggaacagggtaaaaaaggtgaagatcatgactaataaagcataaaaagaatgaaaaccttcaaattaaaaataaaaggatggcgtcctggttttaatcatgatggagtaataagaatagggcttaccttttactgtaataatcaactataaaactcttgaaaatatataaagcagtgttttcatacagttgtagacagcagtccaggactgatttttaagagaagaaacaagcggtgagctccatagtcaccctgactttctgcttgaaggtactttgcaaactaacacaaagtggagtatgtctggttgggagaaaataacacagtatagggttcctgctggaatctgctgggcagagtactggggaggaggaagctgcagagatgcagctgcagaaatctgcataattttcttacatctggcacaatactaaacagtacagggagaaaccatggggctttagggatcagcagctataagttaggggccgagtggagactttgaaggtattcagctctggaagacattggaattctggccaaatagcagagccagaccttgctgaacacctcaagcattcagctgaaaccccaaaaaggccatgccttgcgaataggggtaccttaatttgccccaaactaagcctcaacaggatcaagcagaaatgtgagtaaattaactgcctgccagcacaagacttgacactcctcaaggaagacaaaatccagactgtcacaacagcatcagtaatgtccagcacacaataaaagattactgggtgtccagacaagaaaatgtgacacagccagacaaaacaagcaatcaaaacagatctaagaattgatacaaatgttggaagtcgcagacaagtactttaaaagttaatatgttcaaaatattaaaatgacactgaacaagtagggaatctcagaagaaaaactaaaaagtgaacattctatagctgaaaagtacattctgaaatgaaaaattcactggatgagcctaacataccggacgctggagaagaaaagataatgaacttgagaacaggttaatataaactatccaaaaaaagcatagagaaaactaaaaaaacaattgccagacttgatgtgataatatcaagtgtctaacatgtacagttggaattcaaaaggagaggaagactgggccagagaaacacatatttggagaattaaaagctgaaaaatttacaaatttcatttaaaaaatctacaacccatagatccaagaaactcaaactgcaaacaggataaatattaaggaaatcacgcctatgcacctaatagattgctgagaaaaacaggaaagtttaaaagctgtcggagaaaaa

SEQ ID NO: 15867 - DNA, 54649 bp, Human
ctccagctgagcctccagataaaaacagcctagttgacaccttgattgcagtcttctgagacccagagccaaggatccagctaagctgtgcctagactcctaactcctgggaactgtgagataataaatgattaattgttttaagttacttattgtgttactccattctcacaatgctataaagaaatacctcatactgagtaatttataaagaaacgaagtttaattgactcacagttctgcaggctatataggaagcatgacttgagaggcctcaggaaacttacaatcatggtggaagatgaaggggaagcaggctgtcttacacagctggagcaggaggaagagagagggtgggaggtgccacacacttttaaacaaccagatctcctgagaactctatcaggagaatagcaccaaaggaagaaatctgtccccgtgatccaatcacctcctaccaggccccaattccaacactggagattacaattcaacatgagatttgggtagggacacaaatccaaaccgtatcactaatgttgcaacttctttttagaaacaagatgaatcccacttacaatttggtttggaagtcaagaataacagtgccatacatatatcaagagcttaggaaaagttttattattgatatattctcaaggtttttttgggaggacagaaaatgcctcctaagctggtctaaaagttatttaagagggcaagtgttctgggctgaattgtgtacttccctcttctcccagccaaatatatacattgaactcttaacccccagtatgtcagaatgtggctatatttggagatagagtctttagggaggtaattccagttaaattaggtcattgagggtgggccttaatccaacacgactggtgtcctcataagaagaggcaatttagatatggaaaggtacacaggaggatcatgtaaagacacagggagaagatggtcccacagtggctccacaagaaaccaactctgctgacttgtggcctccagaattgtgagaaaacaaatttccatttaagccacccaatctgtggtagttttgttcctggaccaaactgagggtcaggctgctatttcttgctgccaataatgagatgtcgatgaactggggatgaagaaagtttttatttctgtaaccagttacaggcagaaggcctggaaattatcaccagaccaactcaaaattacaaagtttttcagagtttatataccttataagctatatgtctacatgtaagtgtacattcctctgaagatataaatgtttctttatcagcatttggaacatgccaggcaaatagtaaacactcaatatcatctaccatcagcctcagcctggggcctcacacccatcttcttttatctaaaattctgaattagctatgaatattctcattttacgaatgaggaaagaaatgtgatctgagctaatgccttgtgtcaacaggtatattacactaagatggagaatgatatactgaatctgtgtttgcctttaacgtgtgtttaacttcgagaaaaaagccaaggctgggcggtcgcagtcacgctgcatccggcgacagggggcggtgtgtcctgcgaaaagtcaaaacgccggaagctgcccttagtgtttttcagcctcttggtcttagggaaagtgaggccgtgttttacatccaacatattattattctgataatatgtgacttggcgccacgcgcactctgcacttaaacacgcacttaagggataaacacatacgactgaaaaagagtttcgcccttgataggcagtgtatggggtgcgcagctgcaatctgcaaacccttgcagggcgcggggtttcgtacacccgctcaaggacgcaaagaacctccattctctgccatacaaagcactcctggcccagagagcaggaaagagcatcagctaggcccagctaggcggcgccctcggccggactctgaaggtcagggccgctgggcgtccacgccgcctgggtcccagtccccgtcccatcccccggcggcctaggcagcgtttccagccccgagaactttgttctttttgtcccgccccctgcgcccaaccgcctgcgccgccttccggcccgagttctggagactcaacatgaagctaccggccagggttttctttactctggggtcccggctgccctgtggcctcgctcctcggagggtaaggcggccgggggcgcggggagcgaggacagggcgtctcgacgcgcaaagagagaggacagggcgtcacgggggctcggggagcgaggacaaggcatcctggggcgcaaagagagaggacagggcgtcccgggggttcggggagcgaggacagggcatcccgaggcgcagagagagagaggacagggcgtcccggggcctcggggagcgaggacagggtgtcccggggctcaaagagagaggacagggcgttctggagcgctaagagagcacagagcaacccggggagcgagagagaggacaggacgtctcggggcgcaagagaaagggcaggaagtcttggggcacaaagagaggacccggcgtccctggggctcagggagctaggacagggcgttttggggcgcagagagagaggaccaccaggtcccggagcgaagggcaacgccgggagtgagcaccggggcccgggtcgtattccactgtcagatgaagccctgatgtgtgtaggggaatagggaagagacgtgattttcgaagttttcacagttctgcaagtttccaacttgtgtgtaaataggtagaaagaggtagggaaggatacggcgcccgtccaccccttaaggagtgagaggggatcaggccgagcgagcactgacctttgacgtcctttgttgtgaggaaagtccatctatgtgttagttatggaattaaacactaatacaaacaaattatcataaaaatgaaacaaaaacaaaaccccagctgtttatagactccccttcccagatgtatagctgggagaggtccgtctcacactggcttccccctctctctggcccacactcctgtcaccatctccattgcacccatagtggaaatagctaggaagtgaaaacagctaggaagaagaaagagaaacaaaaacaaaaagaagcaataatatccaagacaagccctccccacatctaaattacaaaattgttataagtaaactaaaaagcacattttctttagccaggtagaaaaattaatatgtcaactgtgaaaaaacttcttttgatttgatagaatagacagccatggtgttgtttttcaaaaaatatgggcagcagtagttccaaataggaatacaaagaattagtatggtggttccctcaagtaaggtatctttcttttaaaaagtgagatttgttcagggttagggttttgctgattttttttctctccctgtgaaaactgggttatagatcattataaaggaagcccatattttctgatacttttcagagacatttctcatttgaaatctacaacagctctgtgatgtcttcagagatttcattttttaacacacatcattaggattgtagcaataaggtcatacagaccttatccaagctcttctgacaccattagacaatacagtttgagaaggagaaaatgaactcatttaaaaattaattgtaatctgacaattttgaaattcctttgctgaagaaaaatatggaagttttgaggttcagggttgggaggcaagagaggtacctgttagtgtggtttgtccccttcctagcacatgtagcctcaagtttgaattcctgggagaagaaaagtctttacatctgtgatgtgggaggttgttccagggaacatcatgtttttgtgggcaaatacaagttgttataattaaaacccctaatttgaatatttttgttaccaagaaccaaggcaaatgtttaatttgttataaaacctgtttgtgaagtgctgtgttaaattgtgctgctggctaataggcctcatttcaatttaataaatatttattgaggactggctttatgtctggccctgtgctatgccctgggactcaaaatttaaaaaatacgagccctgctctcaactgttctcaagttgctctcagttctattgaggaaaacattcagtcattcagttgtttatgaggaaacactaattaattaagtacctattaagtattgggcattctttggcaatttgtggttgaaagacattcctgccttcaatgtactatagtctcatatatgtattttaagccacaaataataaccaatgagtaggccttgaaatcaatttagtggagcaaaacagcactttgggaggctgaggcgggtggatcattagatcaagagatcaagactatcctggccaacatggtgaaaccctgtctctagtaaaaatacaaaaattactgggtgtggtttcacacgcctgtagtcccagctacttgggaggctgaggcaggagaatcgctttaacctgggaggcagaggttgcagtgagctgaggtcgcgccactgtagtccaacctggcgatagagtgagtgagactccatctcaaaaacaaaaaaatggaatagaataggatatatctaaattcatctcatgtagtaaggttgttcattttgtgaaactttaaaaaaaaaatttaccattcttccttttttgattcattctttgattactatcatgcacactgccatgtttcttttccttttgtttttatcaagagtaataactatccaacctgatcaacatggtgaaaccctgtctctactgaaaatataaaaattagccgggcgtggtggcgcgtgcctgtaatcccagctactcaggaggctgaggcaggagctactcaggaggctgaggcaggagaatcacttgaacctaggaggcagaggttgcagtgagccaagatcacgccattgcactccagcctgggcaacaaagtgagattctatctcaaaaagaaaaaaaaaaaaaagaatagtaactatcaagagtaaaatcactatttttagaaaaatgattcctggccaatattcagcaatacagttaacaaagtaagatatgacctcaaactggccacctagaattaacttgggttagcatttggtgtatatcattccaggcatctgttctggtaaaaggatggataggcataattttacttggatgtcacattttcccttagtcaacattgtttcattgttttctcacgatgaatattgtcttggagcagtataaaaccaactagatgtgttttctttattttttttaaatctggaagcctaagtatttctttattcagtgtaaaattctggaatataagctctatgcaggcaaagattttcaactgttttgtccactgtttatacctagaacagtgcttagcatagagtaaacatgtaacaaatatctgttacatgaatgaacgtgtgtactgtgttgctatgaacatgtgtatgttgctatataaatcacatttcttgctatggttcacagtcagaaaaatctgaaaaatgatagtctagtgagtcaccagcagacatcaatagactgtgaagatgcagatgtgtattataatgcatatatgacccaaactgtacatacctagaggaggcaaggaaagcttcatggaggaggtggccccaggagcctgctgttaaatcaggagttggaatttgtgtggtcccaatggcaatatagacctaaggaatagcatgtatcaagaagtgaaagagtggcttatttataaaaattcaagtggtttgtttggtattgtggagttggtgaagtatgggaacagagagaagcgtgtggagacgagatcagtcaggttgctgggggacagggtatggtgggcttttcttatttatgtagaaaattgagcatttactatttgctaggcaccttactagggatatgaaggtgagaagaagagctgattcctgctgtcaagaagcatagagtccaatggcattatggtatgatgtgccgcatgttaggttgggtgttcttgcttttggatgggatcccaaataaatagcatccgttttttccagtctgaaaaatgagtaaagatggaagccaaagtatcacttttattgtggtttgtgagaggaagctgggcctatcagctggatctcccgaagtaggcggacttacataactctggaggagggcagaacattgtcctctgaaggcagctggctcccaaaaggaagaagaccaaggagaactgttcatacccaacgatcctgtcaaaatttaccagtcatatcaactgtctctgcacagacagattgtacctcagtctgtgttgctataaaggaatacctgaggctgggtaatttataaagaaaagggtttgtttgactcatgattctgatgcctggacaagttcaagactgggcatctgcatctggtgacggcctaaggctgcttgcacttgtggcagaaggtgaaggggagctggagtttgcagagatggaagtgagggggtgttgggaggtgccggcaagagaggaagtgagagggtgttgggaggtgccggcaagagaggaagtgagagggtgttgggaggtgccaggttctttcacaacctgctttagtgggaactaatagagtgcaaactcacttgccactgccaggatgaagatggtactacgacattcatgatggatctgccaccataacccaggcacctcccattagaccccacctccaacattggggatcacatttcaacatgagttttcaagggacaaacatccaaacatccttagcaggttgactaaggggacagaaagaagcctggagttgtactacctgaacttctcacagtagggagatgtcaggactggggaagaagcatctcctgctcatgggggaggtatgtccagttttatgagagtgttgttgtttggtatatatcaaagctgagacctgaaagatgagtaggagttagccaaagggagagatgtaagaatgttttaaacaggagagtagtctatgtgaaggcccagcataaaggttatcaacagagagtggggaggcaggaggtgagagacagcttagtgagcagcctgttggctgcgttaaagagttagaactttgtcctgcagggtgggagtggagacaaatggctaaaccctgagtaatcctctcatctgttgagaggtgatggtggcctcaacgagggcatgcattgggtttggagacactcaaagttgagtgatatttaggaggtaaaatcagaggccttggtgattggttggtggtgaggatgagagatggggctatgctcagtggtgacatgttgccatcaaaattgtgagcagaaatacgatatcatcaggtaagactggaagtagggagaccaaacatccaaacaccagtgatgagggtctgaactgaggatagcattagagctactggggactaaaacgaactgggcttggtttgaatgtatggggtaagatgaagcccagatttctgtctttggcccctgagctaaggacagtgccactctcttgagtgaggacattaagtgggggctggagggagaagaggagtaagtgacatcagtcctgaaatgtcagtagggtctgggactcctcaagtggtatatagataaataagctacagaagtagaggagagaatgttaattctccctgggagtgttagggaaagcaccagagctctcacagctgggtttcaatgatgaatgttgggtgatgatagggagcaatttgtgtaaagacaggaaagtaggaaagagttcatgtttggggaatcctgagtactttgttttcctgagtgtaaatttcaggggagatgaggcagaagagagggacaggagctaggtcgtgaagacatatgctatggggagcgaaggaatctggatattctgcagctaccaggagcccttagaagatcttaagaagagaagtaacatgatcccattagcagtcctcggaagatcagttaaaagatgacacagaataggcccccaatgtttgtgaatgttgtgagataggggtttgaaatcaggtggtggatatagagggacactggggaggtaaaaggcatggggcttatagacggatgggatgtatcaggtgaagaggagagggagtcaccaaggtggggcagggcagggcaggtggtgggggtggggttaatggatgaatcttggccttgtagcttaaggatgcatttgaagaaatttcaaacaaacttcctgcccaaactacaaagcaaactttatattattacaaaaaataatctagatctcagatatctcccaaaggtcatgataatgacatcaaaagaggggggaattttaaagttatccagagtttcttacagcccatggtagaaagcatgcaatagatgtttagcaacttttagtttttgcagaaaattctaggtagaaaatgatcagcattctcagctgtcctgcgctcttctcttcctaagttgatgaatcattctgagattgaagtgccagggtaatgataagtaagtctagaatacaaggtcaactgcacttttatcccttccagtctgggaaaccctcacactgcattgtaacataaaagcagtgatagaactgtaggctttcataattgctggaatgatgaaatgatgttgccatttacctttagccctaatttattcttcatgcttcaaaaccatatttcctactgcagcttagatatctctacctgactattccagaagcatcccaagtgcagcatttctgatgcagaactcattatcctcaatgctccaacttggtcttctcatgtcaacccagtcatttcagtcagagcatcactctgcatgcagccacttaaaactagaactcagttaccttccacagctctcaccttacttgccaggtctggctggttgggttctgggttcaggctaatttacatgttaaatgtgtgtggaatatgttgtcttctcttaatttctactgccctcggtatctctcatgtacacttaatgacttctgtctgatgagtctccatttccttttttctggctcacatttaaatcttaatttttctagaacacaaaggcagtgcagatgtaacagggatattgaggtaaagatgagagaggtagaaaaatctctctcagttcttttcagtaaacaggagacctgtttatatgctgttaatgaaacaggcaaaaatgtgatgaaatagatcaagaacaaaagtccaagctcatgttgttgggcaagaggcaagaagaaatcatggatctagtggatatcttaaatatcctgacttgatcattacacattctatgcatggaataaaatatcacatgtaccccataaataggttaaaatgttatgtattaataaaacattaagaaaaagaagaaataattggaccaggcgatattaggtacagtggtgactcattacgtcctcattttttgggacctttgctcttgcaagtagttttatttgctaacttcccaccagttcacatgatagcatcctgggctaagcatcaccatctcttgcctggcttgttatacaagtgtcctaatagtttccctgcttccaaccttgccctctacactccatggcagccagaacaatccccttaaaacttaaggcagatcatgtccattctctccttaaaacttagaagatgtttcccacttgcctcagagtaaaagcctaagtctccgtagtggctgactcagcctgcatggtccagtcccctttacctcactgacctcttctcctgcccctgtctccctccttccttcttctccagccacactggcttcctgactgttaccccatccataagcatgccccctgcttagggcctttgctcccaatcccttttgcctaaaaccctgtgattcattcttctccttcacgtctttgctccaatgtcaccttctcaatgaggcctttgctgatgactctatttaaagtagcaatgctctatccctattctctgccttattttttccccacactacatatcaacttttaatatactacatatttaacttaatttctttatccctcattcccccaaggataatcttgctgagaatagaatattgtgtctgttttttttttttactgccgtactgccatgcctagaacagtgcctggggcttaatatatgctcaataaacacttgcttaaaatgaataaatgaataaactctatatccatcataatgtcatgtttatccctaatacttttttatgtaagcaaattcccaaaacaaactctttgcaagagcagagattctaatttttggtttaaaaaagattgtcattatagttttggttaacatgataggggatcaataagagatgactcaaatcagaggcaggcaggagtgaagaccctagctgaaaatttcaaattgcctcttaggtctgtgatttcatctctttttattttgttgtattggagaagcatctgttcagtctgcatctaactgcagacagataaccactgtaataaaatgagatgtacaccctatggcatagagcaccgacattttcaaggactcatgttcactgatacaaaatgtatcattcctcaaaaatgtaatttctgtcttgctcctggcaactgcataattcagcttagccattggagcttggagtccagctgggcagtttcttttatatttgtttagccttaccttcaggttgctgtggcaacaagatctgtgctctgcggaagctgagaatatcagtggcctctgttcagtgccctgctataagttaaggagcaggcagatgtgcttaagcaatctacacagtcatggagcatgagttaacgaggcctgtggcaagcttttggtgtggtactcagttattttaatgtctgcagggcaactgttggcatttggggtgagacagttcttcattctgcaaggctgtccttttctgcactggaacatccagtagaacatcccaccaaactatcccttgtattaccagatacctccagctaaggaccacatacactgtgctgaagtggcagtggtgtggccattggaaagaatgcacgcatggccttctagcaatcggacaaaataaattgggaagtagttatggaaggcttcctgtattcagggagtacataaggtgttttgggaatgcaaagatgtacacttttgaaactcatcctttgaaaaatatggttgtccagtgtttaccacgctgatagtttaatatggcagttagggcccagtctgcaaaactcttatgtgaattccagttggagtaaatttgatctaaaaaatattgattcaacctgaaccaacagatacgtagaagctccaagaaaatagatgtggaaatatttcattatctttataaatatagctcacactttagtgtttaatatagagtagttatgcttcaagtaaggtatatgtccttatcatgaaattgattctaggccattttttttcttgctctgttttcctctacgtacttcttgtattgtgtgcttgcctatatgattcagttttctgttagctattgttaaagaaaaaaaatttatgaacatgttgaacattcaagcaatataaaaggatatgcagtgacagtgtaataaggttattattactatggttattactatgaataggttcttgtggatacttctgacagtttttgtgcatatgtcaacatatgtatgaagatatcctcattttaaaaaaccacatgaaggggagcctgttacatgtatttctctaccttgagttttacacttaacacatagtgtctcacattgttggtatccaacaaatacttattgaataattaaaaaataatacatctatagcaatgtttacagtcagcatatacattccagctccttcttttggtagataatagatccatataactgtattttgtaatatagatgtgctctaattcattggctatgtcccctaaggaaacacacatagattgttttgtagtctttctattacaaacaattctttaatgaatctctttggctattttgagtctcttgcattttcaaaacaattttaggataagcttgtcgacgttcacaaaaagctgattaggattttgatagggattttgttgaatctgtatatcaatttaggaagtgttgtcctcttaacaaaattaagctttccagtccatgaacatataatgtctttttgtttacttaggtctttaatttcttaatgatgtttcatagttttcaatttataagtcttgtacttcttttattaaatgtattagtattcttttcaatatgattataaacagaattgttttcttaatttcattttcatcttaatgtatatctttgatcatagctccttctccccctgcttctttcccaaatgaatgagtatttcttttagataaattcctgcatgtggatttgctgggtcaaagagtatttgtatctaacatttaaaaaaatgttgccagattggcctcctaagaagttgccagaattcttatcaacagattgtaagggtggctttaatcaactgtttcttgtattatagatgataaaattttgaaccttgctggtctggtaagagaaaaattatgtctccttttgtttaaatatgcttatttagttataaatatggtcgtatatttgttttttgtttgtgtggagtacctttctaagccctttgcttagtttttctatttgcaagtaactcagtacttgtatagattgatttagattttcttttcttttcttttttttttttttaagagggagtcttgttccgttgcccaggctggagtgtggtggcacgatcttggctcactgcaacctccgccatctgggttcaagaaattctcctgcctcagcctctcgaatagctgggactacaggcgcatgccaccacgcccggctaatttttgtatttttagtagagatggggtttcaccatgttggccaggttggtctcgaactcctgatctcaggtggtccacctgcctcggcctcccaaagtgctgggattacaggtgttagctaccgtgcccggcctgatgatttagattttctattcttgggcttattctaatgtttaagatgtcataatttagggtcattggaaatgactaattttttaaaacaagtggcaaaagctggatttcaatcatatattcacataagactacatgtctgtatccatgtgctttctaatgcaattggagtctggccaaccaagtgttacattaagtaagacaagcatttaccgaatgcctaactggtgccagaaactgtactatagtgatgaatataaggtcgtgtccctggcttcctaagcatcctgatatgttgaaatgaattgtggcaactccttagcaggccaatttggaagccttccatttgcctgtttttaatagggtacaatttaaagtgttgacagagatattgacaatgttgtctggttttgaaggccaattctgctgggttgagaaagacagtgggtggttcaggccaatgagaaagcaggagcaaaggccagaaggtgaaagtagttggcaagtttttggaattgtgagggcttggtaagtgtagagtttacttctacatggcagatcagtcacgaggtggggctaggaaagtattaatacgttggcaccatattgtccagtggcttgaatgccatgctcaagagtttgatttttgtctttttgactttggaaggcatccatgtttttgaggaatggaattttaatgtggaggacccatccatagtgatgatgatgacgacgatgataaatagctaaactaagtgctcaaaagataactcatttagccttacaacttccatatgagagactattattgtatgagttttatatatttgaaactggatcttcttaataatgtacctagcacacacattaaacaatgatttttgtagaaatttgttttaaatgaaatttagttgtggttccaaaataaaagccttgcctcttctttcgtttttttttttttttttttttttgtattggtttcttgtgtgttacttacaataggcatctaggagtcacatactcagaggcctaaagtccttgaaggccttgtttatgaaaggccacccagtgaaaagggctcacttttcctgtgtgagtcggggctggacagagctcaggccttgtctcaagggggcagtcgtagttgtacttaatcatgtggtaaggtgtacccaagtgttggtagagcttctgacttttatgtgaattcttccattatctaaatgttggctcaagttttaaaaactttgggctcaagttttaaaaacatatttggcctagaatcactaatctactgttatttgagatatttaccctagacattttagactagccaaaatatacttaagtaatttaggtatatatctcattgatatacagtccttatccttgaggggaaggtgcagtgtcaactctcagaactgccattttgaagattaaaagtatgatcatgtctcattagtttagatgctgtaattttggaatacatgaaggaggaagctattgtttatatgatgtaggagagggatgagtatggtgaggaaggtaggtgatagctaattttttgagggagagatttagagcttgtaactaaaaaataattctgtattgccaaagttggaagactctagaaagttttaagaattttaggtcactaaagatctcaagagaaatcaatcttgatacgaaaggtgttatttatatttttgaaaaaaacttatttctctaaaaaccataaagcaagacttgaaaatctttaaaagcctgttttgtatctactttttataattcaaaaaagcccaaccaaaatactgtttaaggttattaaggatgcttccttgtagaaacgggattgaatatgatgtgatcctgtgagatctgatcatctcaatgggtcttaaggttgaaatgaacatcttccttttaggcagagaagatggcttgaatttatattaacacatatgctgtgtattgtcagagggtaatgagaattaaaatagcttatcaatttcttcactttggtttggtgaggaagtggaatcataaggttagtattgatcagatcatataagataaaaatgtgctatgtaataacctgttacattatggacactaggaattatttttaccacatgtgacatttttacctttatatccttttctctaccagtgaggaggttgaggaaatgttttaaaataaatttaaaaagaaagtttgtatgcaaatatcttgtttaattattttcatgaagtcccacatcaaatcccctatacacattaacattaaaaagttaaaaattatgggaaagccttcagaaaattagaatacatttttttcattattattacttaatgacaaatttaccattctacttgagtgaacttcttgattcatcatcttaatgtaatagttctgaaggcaggtggcagctttaaggaaaactgccacttatgtagaaaaagattattgtagagttgcttggattactgtgctttggcaaaaggatatgaaaagaaaatgctttgtcaacatgaagctaaaataaatatgatgactggcatggagcataacaagatttacaaatgtatcttcaattattttatacatgatctcaaattttgtctttcagtaactttttttctgcttgtaaagatctaatcatacttattggatagatttggaaagtactaaaaaccaatcaaacaaacaaacaaaaaaaaacaaataattatctataatctcatcacttaaccataactgtaaagtaatgggtggactctgaagtcagacagatactggatttaagtctttattccctattattatttatctttaacagctagctacttgacctttctgtgcttcagtttttttcatctataaaatagaagtaacaattgaatttaccttatagagctgttttgaggactgtatggtaaatattgaatctactacttactgttgttatttccttctagtctttttttctaagcatatatttttatttgtagttaaaaacatactgtatatttgtttcttttttttcatttaacatcacattataaacattttcttgtgcaatttccaggtgatgaacagcctccttctaaatcattgaccacatttcttattctttcctgaggataaatttcaagatatcctgaaccaactgatgacagcctatttagctacaggaatactctggaaggaaatggtagcttctggagttttaactggagtgttaatcttgccaccatgacctaatggaatatcacataacctccctggtgtgaccattaagcttagcaggatctcagagaatagacagaggaatatgcaagctggttatcagagaaggctctggagcctgtcagtcagtttgaaccttggttctgcaactttggcaatatatatattttttatcactctgagccctttctgtacaataggataaaactaatacctatttcatgtggttgtttggaagattaaatagtttgatatgtaatcctggcaggtggtaactacttaatgaatgttagctcctattgttcattatattagatacctaaagtttgttttatgattaaatgcgagagaatggcagtgatgttcgcatgtaatgtgagtacaagctgttaacatataaaatagggcaatacaaatattttttactccgaaatggattgattttcctcccatttaaaataaataacagaaatattctgttttatgttttgtggccagaagctagcatgggaagaggcatttgatttaataatccttatagagaatttttaacaattttcttcagtaattcaaaggtggaaagtgatttttgtccagattattcttgttgaaagacaaaaatgctttatgttagttttttaaaaattaaatttggtcgggtgtggtggctcatgcctgtaatcccagctctttgggaggccgaggtgggcagatcatgaggtcaggagatcgagaccatcctagccaacatggtgaaaccctgtctgtactaaaaatacaaaaatttaacggcgtggtggtgtgtgcctgtaatcccagctactctactcgggaggctgaggcaggagaatcgcttgaacctgggaggcggaggttgcagtcagccaagatcatgccactgcactccagcctggctacagagcgagactccatctcaaaaaaacaaacaaacaaaacaaaacaaaacaaaaccaaaaaccaaaacaaaacacaacaatttaatttaagcaaaacacctgcagctaataatggtagcatttgtagtgcttactatgtgctacacactgctctaggtgctttacctgtaataactcatataatcctcacaatgccatatgaagaaatttattttattgtccccattttgtagatgaaggaactgaggcacagagaggtcaaataacctgctgaaagttacatagcttgggagaaaattctgtgctatgtagtccagctccagagcctgtgctttttaaatcagaaaacaaagaataataattaagtacaataccaatatgtttgcagtgagtttgtgttaatacaagaatttgattactattaaattcaagagcatgttttaaaaaattcatctgttttttggaaatatatgtatgcaaatttaaattcattttccccttttagtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggtaagtcccttacatcaagcctattggcgacgcttttgaagaaactgttctgtgccatagtattgaaaacactgttcgccagagttgtttgattagcatcttaatcttatatgaaatactagaaatattatttagattatttaaatacatctttttggaaaaagttaggtactatttgagatgaaagaaacaatgaaaattgtggaactgatgtttgggtaaacatccgcaattttcattattttaatttctccaattcagtggtagaatatttctttttctgtacacgaagatgaagttaaaaagtacgacatggagccaggtgggatggtgtgtgcctgtaatcccagctactgggaagctgaggcaggaagatcacttgaagcccagaatttgagaccagctgggcaacatagtgagaccttgtctcaaaagaaacattttttttttaagcactatatggaggttgctttgtcttcagtgggagtgattatggttactgctttaattaataattaaccttataccaggaaaattgatgcagtactttcattttattttttattttttgtgaggtggagttttgtccagctcttgtcgcccaggctggagtgcagtggcatgatctcagctcactgcaacctccgcctcccgggttcaagcagttctcctgcctcggccttccgagtagctgggattacaggcgcctgccaccacacctggctaattttttgtatttttagtagagactgggttttgccatattggccaggctggtcttgaactcctgacctcaggtgatccacccgccttggcctcccaaagtgctgggattacaggcgtgagccaccgcgcccagccagtactttcattttctataaaataaacaggtatttcaaaatatctgttattgtgatgaatataggaagggtaagaccatgtggaaggaatttcttcttattaggcatattctggtaccctgtaaactctgttccaaagtctgaggctttagagactggtttaaaaatccaccccttcaccattttgaatggtgtaaaattttaggtaagccaagtagtcatccaaacaacagttactgtgtcatttgcaattgcagattgtccggaatattttttgtttttacattgtaatgtttttaagagtttaaatatattattttcattttaataataatttctattcatagttttttttgtagaatgtgagactgcatgaataaatgtagtctctttgaacccataaatttagtacaaaacctactaacattataccatgaatatattttctttgtaaacctggcttatcaaggaaataatttaaatctgtgagtagataatgttaaagtaaactggtttaaaagtgactaattcaataagttagtatcaaatatataaaaatgatctaaatttgacttttagaaaaaattcacattgatttttgtatataaataacatctatactttctcagaaatgcttttctttaagctatggattctctgtattcttcaatttatgaaattgaaaaatataatatgaagtcatacaaggtgtttatttctaggaagatggatgttttgaaagctaccgcagaacaaatttcttctcaaactggaaataaggtacattaaaaatcagttatttaatttagatttaggaattataacatgttcaaataatttgttcatgcgtttggtttaagaaagctggaaaatgtcatattctttttgttattttgcaggttcatgcaattcagtgtgatgtgagggatcctgatatggttcaaaacactgtgtcagaactgatcaaagttgcaggacatcctaatgtaagtgtagcaatgatgaagccaaagtgcaagacacttgatgttgataacacccaccaacatgtacaaaggaaataaaatattgatactgatgtaggacaggcaagcccgaatctggggcttagcctgggaaggttcttggcttcacccaggaaagaattcaaggatgagccggtggtagaagagaacagctttattgaagcagcagcagtggaatggatctgtgactgttccttcagagcagggcaacaccatagtcaatgtgctgggcatagcagttgagaggcagttttatagtcgtatttatacccacttttaattgcctgcaaattaattaggtttatgcagaaatttctagaaaagggttggtaacttctgagttatcagttcgttgccatggaaagggcagtaacttgctgacattgccatggcaatggtaaacaaacatggtgcattggtgggtatgtctaaagagggggtgctttcatccaggacctggtttaactagtcctcattctggtcctgtgatggaactctgcctccagagttaggcctcctcctacctcaatatgagcaagtgctgtgttgagaagcacctattttccatccctaggaaaatgccagttctgctaaagcaaagaacagagtaggaagactgctacacaacttcctttcaggaatacttaaagaatccatttatgattgatcagaaaacaaacttgatttcactttatttaataagattatgaaataacaagagcagttatccaagagtacagcattgagtttaaatgattgatgctttttgcttctcctagtaacttttgattgtcttcctcagtggaggagaacgatataaacatgaaaaactataagaaattcaaaatttctccttttaagacctgaaatatgcatgaatattttgctgttgcttggtacatttatcggagagaagccgtttcttccagtagtctcaaagatagcacttttctatgttaaaggtattttcagaaccagtaacactgaatctcctgtagaactagccagaatctttactgatggtaaatagatcatcaaccacaagctgcattggttaagttaaactaaaatgacaccagaaacaaaaagccatttcttgagattctttgaaataaaatgcagtcacatggtaaatatgtttaatctgtattaattttcttttttttaacttttaaaattttattcatttattttgagacagagtcttgctctgtcactcaggttggagtgcaagtggcacaatcacggctcagtggagccttgacctcctgggttcaagcgatactcccacctcagcctcccaagtagctgggaatacaggcacgtgccaccacacccagctaatttttaaaacaaaatttttgtagagatgacgtctcgctttgttgcccagcctggtcttgaactcatcccaaagtgctgggattacaggcatgagccactgcactcagccttagttttcttaataagagaatctaccctaatttaaagacggcttaggattctgaaatttggtaactaacgtaggaggttttcacagactcagactaccaaatctcatggtattgtttcgtaggtagctgtggacttcaactttattgtattatttctattaatacatttcagaaaaaaaaccctgcagggaaaatgtttttcctcatctaaagtttctgtaacttgccttgttcatttattagattgtgataaacaatgcagcagggaattttatttctcctactgaaagactttctcctaatgcttggaaaaccataactgacatagttctaaatggcacagccttcgtgacactagaaattggaaaacaactaattaaagcacagaaaggtatgtttatttgcttttctcatatttatttggcttctgtgtgtgcaaggttctgtggtaagctctgtgatactttaaaagtcaatgagacagtctacacttgtacaactcacagtgtaatggagaaaaatgatatttaaataattatcatatgttacaatttgagcagtaataaatatatgtttcaagtgcattggcaatccagagacaggaatgactaactctccctagggtcagtgatcaggttgaggaacaagatgcaacttaagctgaaagttcaaagatctagatgtggagaaagaggagggaaaggacatgtgaatgtcaatggatagaggcctggtggagaggaggacataagtacatagggaatgatgaaaactttgatgtcattagagatggggaaaggaataggaaatgattttgggaaggtgggttggagtgtaattgggagagttctcaataccaaaataaggagtttaatgttaattctgaaagaaataggaagtatttttgtatagatttccattgaaggtggaacaaagaatgcgacttgattggaaaggttagtgacaacaagatggatgataaaaggagtgccattcaggaggatttgatttttcttttagcaggtggctagattgcatgggagataaagtagaagacatttagaagacaataagatcaacaggccttattgatttgatgagagtatttttagatgggatgaagagtctggatgataataccaatgagattaagaacactggagggaaaatagatttagaaagaacttactaggagaacatttttgttagtattatgaatgaattactttataaaagttcatatgtacatggatagcaaacatgtctaatgtatatatgtgtgtatattcatatatatctagaaccagcgtacatttattcacctgacagacacttactaatgacttttgggtagcaggccctatactcatgctcaaagcacagaggtggacaagaccctgtccctgaataatttggggaacttgaagggtgcgggtattttctcagagaaggtggagagtattttaaacaaggaaaatgaggaagcgttctcatgctcctcagaggatgtcctttgagggttgaggggaggaaagagggcatggagctggctaggttcctccctctgttcagaaacctttgccttataaggttcaatttcttcttttgtgcagcgcaggtgatcctagaaccagcttgagatacgctgtaggaacagagagatgctacagaggcactagctctgtgtgtgtgtgtgtctgctcacatacatacactaatagcttccatcctttctatgcactcattgaaattgaaattcctggttactcatttccatgatggcagaatggatgtgatttataattggattttggataagtgttttatttgatgttttttttttcagtgaggggcaggaagatggataagagtgggaaggggggacagggaagagtgtgactcctctctcttcccttctctgtccgaggaaccttgatctctgtatctctcctgtgtctctgcctctgtctgattttctctcgccctaccccttgctgatatctccatttcattctctactgctctgcctctgtcagctcctcatttttggttctctgtttctctcttcatctgtctctttcgtttctttgtccttctttgcctctttgtctcttatttcttccctcgctcatctctgtgaccctcaatttctgtctgactctcccttcttccctcattattgtctttcattttaacatagactctgatctatttttgttcatcacattggattaaaattctatgagcttcattaaaaatatattagataaaatatctttttaaaagatggaagccagtttttattcttccaagattcctgtcagttattgatgctataagctgacagagtttggagaacttggaccactcagctgaggggagtacgcggtaaaggatttgttctggtactggatcgacagtcaaggaactgaagcgtgacatttttaacaatatcatgtcttccagtctctcaatgtggtatctctcaccatttatttaggtcttctttaattcctatcagcagtgttttgcatgggcattgtacatgttttgttaactttctcccaaagtatttaaatttttggtgctattgcaaatggcactgttttctaaatgttattttctaggtgttttcttgtagtatttagaaatacaatggattagttttgtgtattgatgtattccctaggagcttgctaaactcacttaatggttattacagtttttttttgtttagattcctttggattttctgcattggtaatactgttggtgaaaaaaagacagtttttatattttccttcccaactgataagccttttattttctttcttgccttattttattggatgggaccttcactaaaatattgaataggtaaaaacttagattctgctggttcctagtattaagaacaaatcaaatacatttcctcctgatgccaggaggaaagcaattagattttcattattaattatgatttacctgtaaattttcataaatatccttcatcagctttgggaagttatcttctatatctagtttgctgatagcttttttttattattacactttaagttctagggtacatgtgcacaacgtgcaggttcgttacatatgtatacatgtgccatgttggtgtgctgcactcattaactcatcatttacattaggtatatctcctaatgctatccctcctctctcccccaaccccatgacaggccccagtatgtggtgttccccaccctgtgtccaagtgttcttattgttcacttcccacctatgagtgagaacatgtggtgtttggttttctgtctttgcaatagtttgctcagaatgatggtttccagctccatccatatccctacaaaggacatgaactcgtccttttttatggctgcatagtattccatggtgtatatgtgccacattttcttaatccagtctatcattgatggacatttgggttggttccaagtctttgctattgtgaatagtgccacaataagcatacatgtgcatatgtctttatagcagcatgatttataatcctttgggtatatacccagtaatgggatggctgggtcaaatggtaattctagttctagatccttgaggaatagccacactgtcttccacaatggttgaactagtttacagtcccaccaacagtgtaaaagtgttcctatttttccacatcctctccagcacctgttgtttcctgactttttaatgatcgccattctaactggtgtgagatggtatctcatcgtggttttgatttgcatttctctgatggccagtgatgatgagcattttttcatgtgtctgttggctgcataaatgtcttcttttgagaagtgtctgttcaaatccttcgcctactttttgttggggttgtttgatttttttcttgtaaatttgtttaagttctttgtagattctggatattagtcctttgtcagatgggtagattgcataaattttctcccattctgtaggttgcctgttcactctgatggtagtttcttttgctgtgcagaagctctttagtttaattagatcccgtttgtctattttggcttttgtggccattgcttttggtgttttagacatgaagcccttgcccatgcctatgtcctgaatggtaatgcctaggttttcttctagggtttttatggttttaggtctgacatttaagtctttaatccatcatgaataaatttttgtataaggagtaaaaggaagggatccagtttcagctttctacatatggctagccagttttcccagcaccatttattaaataggaaatcctttccccattgcttgtttttgtcaggtttgtcaaagatcagatggttatagatgtgtggtattacttctgagggctctgttctgttccattgatctatatctctgttttggtaccagtaccatgctgttttggttcctgtagccttgtagtatagtttgaagtgaggtagtatgatgcctccagctttgttcttttggcttaggattgtcttggcaatgtgggctcttttttggttccatatgaactttaaagtagttttttccaattctgtgaagaaagtcattggtagcttgatggggatggcattgaatctataaattaccttgggcagtatggccattttcatgatattgattcttcctatccatgagcatggaatgttcttccatttgtttgtgtcctcttttatttcattgagcagtggtttgtagttctccttgaagaggtccttcacatcccttgtaagttggattcctacatattttattttctttgaagcaattgtgaatgggagttcactcatgatttggctttctgtttgtctgttattgctgtataggaatgatgtgatttttgcacattgattttgtatcctgagactttgctgaatttgcttatcagcttaaggagattttgggctaagatgatggggttttctaaatatacaatcatgtcatctgcaaacaggaacaatttgacttcttcttttcctaattgaatatcccttatttctttctcctgcctgattgccctggccagaacttccaacactatgttgaataggagtggtgagagagggcatccctgtcttgtgccagttttcacagagaatccttccagtttttgcctattcagtatgatattggctctgggtttgtcataaatagctcttattattttgagatacgtcccatcaatacctaatttattgagagtttttagcatgaagggcggttgaattttgtcgaaggccttttctgcatctattgagataataatgtagtttttgtcttttgttctgtttgtatgatggattacgtttattgatttgcataatgttgaaccagccttgcatcccagggatgaagcccacttgatcatggtggataagctttttgatgtgctgctggatttggtttgccagtattttactgaagatttttgcatggatgttcatcagggatattggtctaaaattatcttttgttgttgtgtctctgtcaggctttggtatcaggatgatactggcctcataaaatgagtcagggaggattccctctttttctattgattggaataatttcagaaggaatggtaccagctcctctttgtacctctggtggaatttggctgtgaatctgtctgttcctggactttttttggttggtaggcttttaattattgcctcaatttcagagtgtgttattggtatattcagggattcaacttcctcctggtttagtcttgggtgggtgtatgtgtccaggaatgtatccatttcttccagattttctagtttatttgtgtagaggtgtttatagtattctctgatgagagtttgtatttctgtgggatcggtggtgatatcccctttatcattttttattgcatctatttgattcttctctcttttcttctttattactcttgctggcagtctatcaattttgttgacctttccaaaaacgagctcctggatttgttgattttttgaagggttttttgtgtttctatctccttcagttctgctctgatcttagtaatttcttgccttctgctagcttttgaatgtgtttgctcttgcttctctagttcttttaattgtgatgttgggtgcccattttagatcttccctgctttctcttgtgggcatttagtgctataaatttccctctacacactgctttaaatgtgtcccagagattctggtatgttgtgtctttgttctcattggcttcaaagaacatctttatttctgctttcatttcgttatgtacccagtagtcattcaggaacagattgttcagtttccatgtagttgagcggttttgagtgagtttcttaaacctgagttgtcgtttgattgcactgtggtctgagagacagtttgttataatttctgttcttttacatttgctgaggagtgctttacttccaactatgtggtcaagtttggaataagtgagatgtggtactgagaagaatatatagtctgttgatttggggtggagagttctgttgatgtctgttaggtctgcttggtgcagagctgagttcaattcctggatatccttgttaactttccatctcgttgatctgtctaatgttgacagtgggttgttaaagtctcccattattattgtgtgggcgtctacatctctttgtaggtctctaaggacttgctttatgaatctgggtgctcctgtattgggtgcatatatgtttaggatagttagctcttcctgttgaattgatccctttatcattatataatggcctttctctcttctgatctttgttggtttaaagtctgttttatcagagactaggattacaacccctgctttttttgttttccatttgcttggtagatcttcctccatccctttattttgagcctatgtgtgtctctgcaggtgagatgggtctcctgaatacagcacactgatgggtcttgactctttatccaatttgccagtctgtgtcttttaattggagcatttagcccatttacatttaagatttatattgttatgtgtgagtttgatcctgtgattatagttttttttttaaaaaaaaatcgtgaataagtattgaatttgttaatataagccttctttctacatttattgagatgggtatatttttaagcctgttaatatggtgaattacattaattaatttttgaatattgaacaccattgcattcctaggctgaatcttccttcattttggtaaattatcctagttatatattgctagatttgttttgctgaaattttcttaatgcttactttgtcattttccaagtgttacttttcattgagcttcttagcttctgtgcttgcttagtttagtgattaggatttgaggggagtttatatgcagatgttacctcgtcctttgcacctgctctggcagctttgtccaacaggtgataggttggctacagccttgctttgcgaaattgttactttaacctgaatccaacaaaagcctcttgtgccgccatcagaggcatattatataagtgttcaacatagtgtgatactcttcatatttggatttttttttagcatcttaagttacttaacattcaagttaaaatgttggcctcatgtctattattgtcttaaaattacattttgattgtatctagataaaactatttttcttaaaaaattttttttgcttttcttgcatgtatttattgaaaaaatatatgacagcctactcagatattgtacttgattttggactagctttggtgttgagtcacatggattactttataccagaaagctagaattccttatacctaagaacatatgagaattctatagtgattcccacaagttgtatattaaataaaggtatatgatgtaacaggtgttggaatacagaacaagcaaaatgtgaaatattctttttaaagacattacctaattttaaccaaattttcacttatttttacttccttctttccttcctccctccttcccttccttcctcccttcctttctttttttcccttataaaaatctttccttccttctttttttctttctttctttcatatctaatgtttattgagtgcttattttgtatcaggctttgttctaagtgctaaatacttattaactcatttaacacttgcaatgaccttgcaagtaagtgctcttttattcccatttatagacatgggtggaaactgacgtacaatctttttttaatgtaggaagtgaatttttaacgctcacatttacagatgagaaactatggcttattaattacctaagtgttaactattactattaaaatcgacaattgacataatttaaaaaattagttgttgtaagtggtctagtagagaaaaagaaggaactgtgactttttattgtagtcatagtcacttagtttacacctgatacttggacagttagtgagtgacgatattttactgttattcagctttttcatctataaaatatacttgataataaattactactccaatatttagtaacagaacaaggcgttaggtgtagaagcctcatgaaaaatataaattgttttacagatgtacatgtgctttttcttacatgtgaatggacatccgatagcctagctaacataaagactttggtggaaataacttttaagaacctcagagaatttaaaactaagaagtagaagcaacccaaggaagcttgaaccatatggagcttgtgttggggaaagggaaagagtgaagtgaataatcttaccagcagccttgtgatagaggaagagaataaatgtaaatcaccaactgaagaaagaataaaaacaaaggactgttttagttaatagagaagaagaaacagttttcaaggccagaggccttggaagcattgaactaagtaaagtacattatactgtttttacagtttaattaaattatcagaaaacacaagattttttaaccatcttgctgttcttctggagtccctgatgtgtgaaccgtaaacacaagaataaatttcaaaacattcctttttccaacccatagacattgtacttggccagttactcttccttgtcctccataatggagcaccctcagcctgtccagtctctatactagcccgtttgactgatccagtacacatgccctgattagaatcattctttacctgagccatagagtctccattcccagctctagtccactcctcactgaaggattaccagttcaggggctagcatgcatactttagcacagtggtccccagcccttttggcaccagggaccattttcgtgaaagaaaattttttcacagaccaggggaaggtgcagggggtggttttgggatgaaactgtttcacctcagatcatcaggcattagagtatcataaggaatgtgcaagctagattccttgcatgtgtagtttgcaatagggtttgcgctcctatgataacctaatgtcaccgctgatctgacattaggtggagctcaggcagtaatgctggctcacctactgctcacttcttgctgtgtggcctggtttctaactggccatagactggtatggggctggggtgtgggggtcccctgctttagcacttaaaaacatgctacatctagttattgtttcatgttgtaagtctccttttccatcaactctccgtccattacaaattcttttatcagggtgcattacttctgccctacctgcaaagcctttccattccttccccaccatttcctaactcaacactgaacacaaatgtggtgctttgtttatgcagtgaaacattttggagacctgcaaaaggaaggtgagttgagtacatacttaacacttctttcaattatgtccttcaactttactattggagggaaaagatgaccagtcattgacatgatcagttggaatggaagcaaatgcaccttgtttcagaagtgggaagagtagagcatagcagaaggctttccttattcgtcagtagtgtgagtgcaaggtgtatgttgcttagagtatataagaaccacataagtacatttctttatattgtgtccagagattttgtttttttctagaacagtgggtgcatctaaagaatatttgaaaacacatttttagttatcagttgaaatttattaaggtggtattagtatccttttgaaatcacttttttctagagtcatctcgtttgatgggagagttcaacctcatctgttaaaatttcttagagcaactgtgtaccttattttgatgttttttgaagataaggtaaaggtaaagcgatttgagaattttgaaaataaattagtttttctttctaagtagtaattagaaatttcttggcaaggcagtagtagttacatagtagttaagagtgcaggctctagagcttaactgccaagttccaatcctggttaatacttattagtcctatcaacttggacagattagcttgctgtgcctgtcttttctgtaaaataatgttgataataaagccttcctcctaggattgctgtaatgattataagagctagtgtctataaagtgttaagaatagttcccggggcagactagtactcaataaatgttagttatgaaagaaaatgttaagtttcctccaagataaatgtatttttaccacgtcttttacaaggggactatcaactatctgaaacttaggttttgactcataattaaaattagttagaaaaaccagagccctgatatcccttcttactataattaaacttaaaaatagcagcctacatgagggacatatttatattaaatgtttaaatgagaaaagtgtttccttagtagataatattatttatgtagggttattctagtttttaaatgttatagtcctattttgagtagcttttagagaattaaggatttttagattttcatatgggctctcattgaaaaatggctcggagacaggtatcctctgtgccctcatcaaaaagacagagaagtttgtcttcttaccatgattgtcagtaagattaattgctagcaataatagtagaagagttagaactgcaaccaacagctcagttgtgtatttaggcatacaaggagttcagtgttgcttatatgtgacatataatgcctggaggggtaggagatgaggccaagcaatgtggtctttatccttcggtgataggtaaagttaaacaaggattaaaaaaaaattaagatactttatttctgtttgttggaaagttgacataatacactatactagtcccccattgtggggaccacaaatgaccacaaacttaacagcttaatatatcatatgcttataattttataattctgtttttttcaagtaaatgcacagagttgcttggctggtttctctgcttcagatcttataggctaatatcagggagtcacccagcagagctcatgtcttggaggctctagaaagagtctgtatccaggctcatttaggtcgttggaagaatcaagtttcttgtggttgtaggactgaagtgtatatgttcatggttactgtcagcttagggccaccctatctcctagggacctctctctgatccttacatagggactggtacatctcagagccagcaataccacaatatgtctttctcatgcttagggactgactttctcttctaccacatctctcttgcctgctccttaaaattcatctttctgactacagccagagaaagttgtctgtttttaagagttcacgtgattagactgtgttacttggataatcccagaaaggcccctctcttaaatcctgtaatctttcttaatgtcttcaaagttattttgccaagtaaaataagaaattcagttcttaggaattagggcatgggatctttaagtggggccattctgcccacatatatttcttatcttgttagaaaggaaaccctcagaacaacaagaatattttgaaataagtaaataatcatgtaatatctgtaatgtaaaacatgcttccttagatatggcacccttatgcactgctcaaccatgtgtagcagccctgacctaccggccgttcaacaaattcttggatgtgtctgtgaaactagggggctgggttgcctgttggagttaccttccattctggtgatgtttcctaacgcaacttgccaaattattaatacacagctagtaaatggcagtctttttgcatgagagcggaagagtaataggtggaatcaacaacagcagtaaattaacaagtaatccttagaatctaatgacatttgctggatacgccctatgttcctgttttacaggtgataaatctagggtccagagcagggatgcgacttccccagtctcatagctacacagctagtaaatagtggaatcagtttctgagcccaggtgtctatactattccccttctgttggtcattggaactaaatttgtttagtgattctttcaattcatagtttgtattgaaaccagattttagaacttttgaatcttcttttgaaattagatcataatcttgcacatatcatagcttttttgatagataatatgatttttgatgttcttttattactatttttttccatttcaaaataacaaaggatggactaacataatatttatttcatttattgcttcccttctctattttcttaacctcattaataatatagattcatttctgttgtctgctctgagctgttagaaacttgacttttataaagcttttccatgagcagttattctaactgaaataatgggcctctgtacaagaaggaaaatatatgtgactaaccctggggatctaggaattctttactttgcactttagcaccactgttcatttttttgaagccgataattgtttcaccttgcagcattaatgctattggaacagtgcagtttcaaacctttatctcccttttacactcatgagaattaaaagctgcagtatattattctaagaggtgggctacccaaattttctaggctgagaaaataaaaccttaaagggataaaaagaatagtaaaataactttcatttcagcatctaaattgtagtaggatggcttaactcctttcccacacttggagaaatgtatttgttcagtcttagttgaaagatagtgcactttccattggagcatttgctttgtatttgccacttttaaagcagttttttttcttttgtaattttgctataagaatgatacagttagcatctgttgtcaatgtactgtaatggagcccactaatgttctacatccctcctctttcatggagtacgattttggaagcaaagtaattttcagcaatctgaaaggctgtttgatatatagaaggagttaccagaatgattaacataaccattcttattttttcctatcctcaaaatggtactcctgccccctcttccacccccgtgtttcccaggatgtgctgagttttctttctactctggaacatgctgagagaaagagaaactaaatatatggagcagagaaaaaacttatctgaatattcttcaaaatactttccttgtagtccttcaaatttaaatttctaaaagtatttgctgttatgtaaaagatgtaaacttattttgatccttttgcaaatattaagtattgtcttatcccgtgttatgaataaataagaagtagagaaatcactgatttctcaggacctaaagattacccttttaagcctttatttgtttatttatttatttgtttgtttgtttatttatttattttttgagatggagtctcactcttgtcacccagactggagtgcactggcatcatctcggctcactgcatcctctgcctcctgggttcaagtgattctcctgcctcagcctcctgagtagctggaattacaggcatgccctaccacacctggctaatttttgtatttttagtacaggcaggatttcactatgttggccaggctggtctcgaactcctgacctcaggtgatttgctccccttggtctcccaaagtgctgggattacaggcatgagccactgtgcctggccttattcagttaatttattgagaacctgctgtgtcctagacactattgaccactgtatatgcagtatcactttgtaatatagcttttatacaatcattttaaaaagaaatttagaaaacaagaaaaaatattttatatttacctacatatttactatttctttccttttgacaatctcagtttctctataatatcattttcatatcaccttgatttttgaagggtatttttgatggatatggaattcagagttaagttttatctttcaacaccttaaaaatataactccattgtcttctagcttacattatttttagaaatgagaagacaatgaaaatttttgtctgtgtttgtgtatttttattgcttatttttacctttggctgcaattaggattctatatatcattggttttcagttattgattatgataatgtattgatttttttccctgtttatcctgcttgggattcatttagctttctgcattgtaagttatagtttttaccaaattcggaatttttttagtccttattcaagtgctttttcttcctctgtgactctaactatacgtttgttagaatgctagatactgttccataggtcagtgaggttctgggtttttcctcagttttttttttcccatttgtctttcattttggatagtttatattgctgtgtcttcagattcatggatcttttcttctacagctaagcttatttgttcaatttttcctttcagatgctgtatttttctgctgtagaagccatattggtttctattttgtattttccatttttctcatcatataaatattttcagtgaaatcttttaaaatatttgtaatagcatttaaaaggctgtttgtctgctacatctgtcttctctgtcatttctgggactctttgtctattaatcatttttctccttgttaggtttctgtgtctttttatgtgcagtaattttttattgcatgctgtgaatgttatgttgttgttctgtgtttgtgtctgtgtgtattttaattttcttttgaggtgtgtggttttttttattttggaaagcttctaaattacttatgcatcagcctaatcatttttaagggtcattttaaagctttatttcagcaagtatatagtagtccttactttggggctaatttaaccctcctactaaggcatttttttttctgagctctctactgaaagctctggatgttcagtgaagctgcttagaactcccatgtctcccagccctatgcaagctctgggaattgcatcacttacagcttcctagtagttgttctttgcctggcctcaatggaatctcacactaaacatgtacagcttatttgtctaaagactctttgagactccatgcagctttatggagttctattaatatctctgcctactttcctccttggaggaactcttagaaaccttagtttcctcaggctccccaaaccgatctctatcttcttaactcagtgtgaatgccattttctgcttagattcctcctcctcatccttccatctatatagtatctttaggcaaaaagctagggtatctcagggcttagtcattttccttctatcagagtcatagtccttccctgcctgctgtgcagtatctgtatataattgtagcatatgtcttactcagttttcttgatgtttacagcagaagggtaagttcattatggctggaggcagaagtccctgctagtttaagtttaattctgatttattcttattcaagtagtacttagttaatgggaatcctgaccagctgattatacaaggtgcaataggggcatgcctctgagatttgggctttcgtattgactcgccaggcatacattccaagtaagtgcagattgggccatcctaaatcataagattagtagcaagacatatcaattttcttaggttactctctcattaatttagagtgagtgaagttttaaaaaatactttagtttttcttataccctctttaatcagatcccatttttataaataatgttttccttatgtgtagtgatacatctatattgctaatcaactgtatccttttaaaatttcaggagcagcatttctttctattactactatctatgctgagactggttcaggttttgtagtaccaagtgcttctgccaaagcaggtgtggaagccatgagcaagtaagtacttccttgtcaatcctgttgctgaacataactaatacagttggtggctcagggaactgtattcctgctttctggtgtccatccagagaaaagtaaacaaagacttggattcaccatgagacatacattttatctcccagataagtcctatttgtctatagcagcgctgtcctgtggaactttctgcagtgatgtaaatgttctgtaaatatgcactatccagtatccacatgtagatattgaacccttggaatatcccactgtgactgagaaactaaattttaaaaattagtagctgtatatggctagtggctacatattagacaccacaggactatagcttttttgctctcccatagatctttatcagtgccatccctaacccctctcataagcacacgtttattcttttattgtagatactgtataagattaatgggactaacacagactatgagcacttcccaagtccagtggccttttctcagcagagtataactgcttttttttttttttttgagacaggacttcagtctgttgcccaagctggattgcagtggtgcaatcacagcttattgcagccttaatctcccagactcaagcgatcctcccaccttagcctcccaagtagctgggactacaagcaggtgccacagcgcctggctaatttttaaaatttttttgtagagatgaggtcttgctatgttgcccaggctggtctggaactcctgacctcaagaaatcctcctgcctcagcctcccaaagtgctgggattacaggcatgagccactacacccagccatgattgctttttgaatttgtcctccactggccttttccattgtctttattataatggggcttctcatcatttcattgcttgtctggcttgctataatcatggtatatttctttactaccagtctcttccccctgtattttgtattcacattttcaccagaattatctttctaagaacatatatgtctgctcacgacactccccagctaaaaatcttagatcatttcctgtcactctttggaataaaagccagaactcactatggcattctaaacagacttgtctctggccattgttaattaatttatttattcaataaatatttattgtgtaccttatatatgcttcgtcctagggatatgatagtgatggaaatagaacagtcctcgttgttagctgagcttaaatttttttactattccatttattatttccatgctttaatttccattgaactgttccatgtttccctaaacttaccatacagctttcatatgtctatggctgagttatattgttgttggaattttgctgtgatgttttgcttacttcctttgagatgttttctctgtaatcatttcctcctctctgtgccttaaaactttgtttaatccaatctagtgagaggacaaacactaataaatagattctaaaatgaaggtaatataccaatgtagcagagagagagagcagggcatcgcgggcctttttttttttttttttttttgagacggagttttgctcttgttgcccaggctggagtgcaatggtgccatcttggctcaccgcaacctgtgcctcctgggttcaagcgattctcctgcctcagccttccaaggagctgagattacaggcatatgccaccacacctggctaattttgtacttttagtagagatgggatttcctccattaacgtaacattaaacaatctgacttccccacttggaccagaagagtctggtccgtagctggtgcttcatgcttgttgagctgaattatggtactcttcttttagtagtcccagagcatttttaatatttaagtcagtaaatacacattagtttgagatagaaagaaatatttattcacaagctgaatcttagtctgaaaagagataattaccattttttaaggtcaggtagtgttggaaataaaggatgagaacttgactattttggcagcatttgttcaatgtcaatatttgttttgtgaggactcttcagtcttgttagagctttttatctcatgtcctttaagaactgatttggtgctgcttttattgtgttcctgcatataatagatgctcattaaacatgtgccttcctttacagcttgagttcccatcaaccttcttctcatactttatagtacacagtcttactaaataaggcattataggttcccaaattctacatgttgtttgggcccttgtcctttactcatactgacccatatgccttggctgtcttccttctccatctgtattagtccgttctcactctgctatgaagaaatacctgagactgggtaatttataaagaaaagaggtttaattgactcacagtttccacatggctagggaggcctcaggaaacttagaatcatggtggaaggcacctcttcacagggcagcaggaaagagaatgtgttccaagtgaaggggtaagccccttataaaactatcagatcttgtgagaactcactcactatcatgagaacagcatggggaaaactgtcttcaggattcagttatgtctacctggtcccacccttgacatgtggggattattacaattcagagtgagatttgggtggggacacagagccaaaccatgtcaccatcctaccttcttaatctctcagctcctcctttcccctgcctcttgcagcaaactcctaatccttcttcacccatcagctcagaatgttaccttttcagagaagccttccttgtcactcccacttaggttcttcttcttttaagcaggtatagcttacatcacacaattcccagcctagtaactgattcattatataaccaggctcacctctcttgagagggagggactctcatttgagagcagggactgactttatttgaggctaagcaatatttatagtattgacacatggtaagtatataataaacattggttgaatgagcaataataatggctaacatattgcatatattgttcttagcatcttaacatgcagagataactgtatgaggtggattcattatcagattacagtagttcttcagtatatcagctagcttaatgacagttgaaagatcatgctagcaattgaacaaatgtatctggcacacctctgagcacagagaggatggcttttcctctaggcagattttcttaacaggttgctcagtttttcataggataatatagactctgctcagtacagtaattctattaagacatgaagcaatttagagtagatacactataaataaatgcccagggtagctatggcaatgaactttgtcaaaaacatcactcagagaagcaatttttatgtatgttctgtctgaaagagatacagcccacccatttctctaaaatacattcatggattaagtcagattaacaggctatcttgagattacgtgtaccctattctgtagaactggttttactgaattggcctttgaaatgatgctataagactattaacggatgtctgatagtttcatagaacttagcgcatttttaaaattatactttaagttctgggatacatgtgcagaatgtgcaggtttgttacataggtatacatgtgccatggtggtttgcagcacccaccaacccgtcatttacattaggaatttttcctaatgctatccctcccctagctctccaccccttgacagacccagtgtgtgatgttccccttcctgtgtccatgtgttctcattgttcagctcccacttatgagtaagaacatgcagtatttgattttctgttcctgtgttagtttgctgagaatgacagtttccagcttcatccacatccctgcaaagtacatgaactcatcctttattatggctgcacagtattccatggtgtatatgtgccacattttctttatccagtctatcattgatgggcatttgggttggttctaagtctttgctattaagaacagtgctgcaataaacatatgtgtgcatgtgtctttatagtagaattatttataatcctttgagtatatacccagtaatgggatggctgggtcaaatggtatttctagttctagatccttgaggaatcaccacactctctcccacaatggctgaactaatttacagtcccaccaacagtgtaaaagtgttcctatttctccacatcctctccagcatctgttgtttcctgactttttaatgattgccattctaactggcatgagatggtatctcgtggttttgatttgcatttctctaatgatcagtgatgatgagctttttttttcatagtttgctggctgcgtaaatgtcttcttttgagaagcgtctgttcatatccttcccccactttttgatggggttgtttgtgtttaagtttaatttgtttaagttctttaagttctttgtagattctggatattagccatttatcagatggatagattgcaaagcttttctcccattctgtaggttgcctgtgcactctgatgatagtttcttttgctgtgcacaagttctttagtttaattagatcccatttgtcaagtttgaacttagcccattttatctattgcaaggatacagtgtcttaaggagattgttatactgtacaattttccttttgtaagtctagaaagacttaaagcatttttcgtattagagacaattgtgcttttcctgagcaattagcttgctttttctttatgggtactgtggattgtgtaactgattaggcttaccttttttgtatagagtcatgggaagaatagatacaaatttgtgatgtgactattgcagttatatggaacatcacacacttcagtacatttagatattagcctcattcttggctccgttatatttcgttatcctggcttttctctctctttatcttgctttttttctttccttcttcctttcaaattatcctgtcttcctcatttgcattatatgaattcttttaagctacctcgtcattatttgaaattacattaagtatatatacacacaaatatacatatgaatgtaaattcctaaaatgaatttagattttaaaagagctacctgtaaagtaagcttttaaaacaagttcctttgaagttctttgtttgctattagtgttatatttttcttcaggacattaagcaagattttgttagattcctatttcctttcaagtttggttcaacaattatattaaagcctagttagacatggatgtggtttatattttcaatcgatgtactcttttactcaaataaagcacttgtgatattacagacattgtaatccaatgtacagggctatgagtaaagttataatgaactttgtaactacaagactgaactccagaaaatgtgagggaagggcatgaagcactcacgtttttatgtgaataatgaatacctactctaaaaatgtgtattgacattggacaaaagtatatattctaaactacaaatggtaggtggtgtagcatagtggttaaggacactaaaatgtaaaggttaggttgtacagtagagtgactaagggtacagactgaagctagacctcttgagattgacaaattggccatatgacatagagaaaatgatttaacctctctgtgccttagttacattatctgtaatatagggaacaataatagtacctacctgttggggttgtaatctctggcatgtagtaagcatctagtgagtctcagttattactgtctttaacatatggtataatatttcagaatgtatgttgttgattttaatttttaggtctcttgcagctgaatggggtaaatatggaatgcgattcaatgtgattcaaccagggcctataaaaaccaaagtaagttgtattttgcttgttatcacattgtgaatgattaaataatgaaacactgataggtatattctggttgttgtgtaaaggactttccagagatgcctaggtttagagccctggttctagggaagaggcctttgcctttattcattatcgaatataagaaataaggaggcgggcaggaatatagcagctatgcaatttcttcataatgtcaatttcagtgtcttaatcgtttgggatcttttataccatcaatgttggcactttgtctgatttgtttcagtggtctgttattgtcctgtatttgttaactttcatgacattttaaaggctcctacattgtctgacatccttttttaaaaaaaatcaaggaaatgtaactatatttttagtttgagagatgctttggtaacttattatataggctttgtcttgttataggtaggtagcattttccttgactcatgcttgtgccctttcactctcagtcaattatgcatgtcatctaacgcccacatgtctctgattataagtccttctgacagcatagatttcacctataagtaataatccttgtggatactcattgcaacttgtaattatctctaatgttgttacagatgttgctcagaatatccacaccttctctgctctctcattatcccaaaataacttcactcacacttctcttggttttcacctaaagcaagtatttataatgccaaccagatgtaatgttgaaagaccaggaaaaatttggtaacttgtttcagttgtgtaaacatattggaaaataatactaaaggacttttgggttataggtagctctgggtattaaaaataacttggaaatggccatattagtttatttagcagtttaaaggatgggaaatagaaacaaaaacttcctgagtgattgaaacttgttgactatcttatttatctgacaattcaatactaaacagtctaataaaattagtggaaagaaacttaaaaacatacattaaaacacatgattcagggtggccctgtcctaagcatatctgaaaataggcttatagacacaaacgcttctctccaagaccccaatatctagggaaaaatcacctgcattttatttatttaacctatatttattgactgttcactgtatctacgggtactgagaaagatacagaagtatctctgagaaagtgcttgccactaaggagtttacagtctagccactgagataggagttgtacccaaataataactacttactgttaaagagattaaaagaaaactgaagtgtagaaactccctagcatgcactttttagaaccaggactgggaccagttgcaaccccttgtctctgggctttataacctcctgggaagaactggaggtctgtcatggagtcccctgagtgtttgttctgtcttatggctgcattattgaggaaaactgccacctaaacttcaaggcactagtacagaaaaatccagttgtttttattaatcagtgcacatccataattcatcttggtctgttccttcacatcattgacagaaagcaaattgtttggccaatttagttgtagtttttctctctctagaatctaattgaatttctacatacttgttttcttccttttccaatactttgggatgaaagaaaaggaatttcctcttaaatatttcctatgagccacttttctgtgtttattaaatgaaaagccagtaataccactgcctttaccacctaagcttgtacatatttcaggatacctttatatacattttttcatttgatgcttataacaattttgtgaggtaactaagatagatatcctcattttacatagaagaaactaagattaaaagggttatattttccagtgatctattttttttttaagaataatttggtgaaattcttttttacttacaaagcctaaggttttaagctgcatggcagcatgccattttatacacattttttcttgagtaggaaaggaattgattgaaaaacccgacacaacctaattgttttcttaatttctaagggtgcctttagccgtctggacccaactggaacatttgagaaagaaatgattggcagaattccctgtggtcgcctggggactgtagaagaactcgcaaatcttgctgctttcctttgtagtgattatgcttcttggattaatggagcagtaagcgttgtttatttctcttcacttttttttcaggagtgtgtttggggcagggaggtctgttgtggaaccaatcctgacaatgctgaatgtaaatatcatttaaaatatgtatttagttgtaaataatataaaatattatatatattgtttagcctatgacatttattcagtgatgtattagtctgttctcacactgctaaagacatacctgagactatgtaatttataaagaaaagaggtttaagggaagtgcagggggttggggaattccctttcctagccaagggaagccctgacagatggtacctggaaaatcaggacactcccaccctaatactgcacttttccaatggtcttagcaaacggcacaccaggagattatatcccgcgcatggctcagagggtcccatgcccacagagcctcgctaactgctagcacagcagtctgaaatagaactgcagggtggcagtgagactgggggaggggtgtccgccagtgctggggcttgagtaggtaaacaaagtagcctggaagctcaaactgggtggagcccaccacagctcaaggaggcctgccttcctgcctctatagactccacctctaggggcaggacatagctgaacaaaaggcagcagaaacttctgcagacttaaatgtccctgtctgacagctttgaagagagtagtggttctcccagcatggagttggagatctgagaacggacagactggcccctcaactgggcccttgacccccgagtagcctaactgggagacacctcccagtaggggccaactgacacctcatacagccaggtgcccctctgagacgaagcttccagaggaaggatcaggcagcaacatttgccattctacaatatttgctgttctgcagcctccactggtgatacccaggcaaacagtgtctgcagtggacgtccagcaaactccaacagacctgcagctcagggtcctgactgttagaaggaaaactaacaaacagaaaggacatccacaccaaaaccccgtttgtatgtcaccatcacgaaagaccaaaggcagataaaaccacaaagatggggagaaaccagagcagaaaagctgaaaattctgaaattcagagcgcctcttctcttccaaaggaatgcagctcctcgccagcaacggaacaaagctggacggagaatgactttgacgagttgagagaagaaggcttcagatgattggtaataacagacttctctgagctaaaggaaggtgttggaacccatcgccagaaagctaaaaaccttgataaaagattagatgatggctaactagaataaacagcatagagaagaccctaaatgacctgatggagctgaaaaccatgacatgagaaatacgtgatgcatgaacaagcttcagtagctgattcgatcaagtggaggaaagggtatcagtgattgaagatcaaatgaatgaaatgaagtgagaagagaagtttagagaaaaaagagtaaaaagaaatgaacaaagcctccaagaaatatgggactatgtgaaaagaccaaatctacgtctgattgtacctgaaagtgacagggagaatggaaccaagttggaaaacatgctgcaggatattatccaggagaatttccccaacctaccaacgcaggccaacattcaaattcaggaaatacagagaaggctacaaagatactccctgagaagagcaactccaagacacataattgtcagattgactaaagttgaaatgaggaaaaaatgctaagggcagacagagagaaaggtcaggttacccacaaagggaagcccatcagactaacagtggatctctcagcagaaactacaagtcagaagaaagtgggggccaatattcaacattcttaaagaaaataatttttaacctagaatttcatatccagccaaactaagcttcataagtgaaggagaaataaaatactttacagacaagcaaatgctgagattttgtcaccaccaggcctgccttacaagaactcctgaaggaagcactaaacatggaaaggaacaaccggtaccagccactgcaaaaacaggccaaattgtagagaccatcaatgctacaaaaaaactgcatcaactaacgagcaaaataaccagctgacatcataatgacaggatcaaattcacacataacaatattaaccttaaatgtaaatgggctaaatgctccaattaaaagacacagactggcaaattggataaagagtcaagacccatcagtgtgctgtatttaggagacccatctcacatgcagagacacacataggctcaaaataaaggcatggaggaaaccctaccaagcaaatggaaaacaaaaaaaaagcaggggttgcaatcctagtctctgataaaacagactttaaaccaacaaagatcagaagagagaaagaaggccattacatattggtaaagggatcaattcaacaagaagagctaactatcctaaatatatttgcacccaatacaggagcacccagattcataaagcaagtccttagagacctacaaagagacttagactcccacacaataataatgggagactttaacgccccactgtcaatattagacagaacaacaagacagaaagttaacaaggatatccaggaattgaactcagctctgcaccaagcagacctaatagacatctacagaactctccacctcaaatcaacagaatatatattctttttagcaccacatctcacttattccaaaattgaccacataggtggaagtaaagcactcctcagcaaatgtaaaagaacagaaattataacaaactgtctctcagaccacagtgcaatcaaacgacaactcaggtttaagaaactcactcaaaaccgctcaactacatggaaactgaacaacctgttcctgaatgactactgggtacataacgaaatgaaggcagaaataaagatgttctttgaagccaatgagaacaaagacacaacataccagaatctctgggacacatttaaagcagtgtgtagagggaaatttatagcactaaatgcccacaagagaaagcagggaagatctaaaatgggcaccctaacatcacaattaaaagaactagagaagcaagagcaaacacattcaaaagctagcagaaggcaagaaagtactaagatcagagcagaactgaaggagatagagacacaaaaaacccttcaaaaaatcaatgaatccaggagctgttttttttgaaaagaccaaaaaaattgatagaccgctagcaagactaataaagaagaaaagagtgaagaatcaaatagatgcaataaaaaatgataaaggggatatcaccacctatcccacagagatacaaactcccatcagagaatactataaacaccactatgcagataaactagaaaatctagaagaaatggatacattcctgtacacatacactctcccaagactaaacctggaagaagttgaatccctgaatacaccaataacacactctgaaattgaggcaataattaaaagcctactaaccaaaaaaagtccaggaccagacagattcacagccaaattccaccagaggtacaaagaggagctggtaccattccttctgaaactattccaatcaatagaaaaagaggtaatcctccctgactcattttatgaggccagcatcatcctgatacgaaagcctggcagagatacaacaacaaaaaaagagaattttagaccaatattcctgatgaacattgatgcaaaaaacttcagtaaaatactggcaaaccaaatccagcagcacatcaaaaaggttatccaccacgatcaagtgggcctcatccctgggatgcaaggctggttcaacatacccaaatcaataaacataatccatcatataaacagaaccaaagacaaaaaccacatgattatctcaatagatgcagaaaaggccttcgacaaaattcaactgcccttcatgctaaaaactctcagtaaactaggtattgatgggacatgcctcaaaataataagagctatttatgacaaacccacagccagggggcaaaatctggaagcattccctttgaaaactggcacaagacagggatgccctctctcaccactcctattcaacatagtgttggaagttctggtcagggcagtcaggcaggagaaataaataaagggtattcaattaggaaaagagaaagtcaaattgtacctgtttgcagatgacatgattgtatatttagaaaaccccatcatctcagcccaaaacctccttaagctgataagcaacttcagcaaagtctcaggatacaaaatcaatgtgcaaaaatcacaagcattttttacaccaataacagacaagcagagagccaaatcatgagtgaactcccattcacaattgcttcaaagagaataaaatacctaggaatccaacttacaagggatgtgaagtacctcttcaaggagaactacaaaccactgctcagtaaaattaaagaggacacaaacaaatggaagaacattccatgctcatggataggaagaatcaatgtgtgaaaatggccacactgcccaaggtaatttatagattcagtgccatccccatcaagctaccaatgactttcttcacagaattggaaaaaactacttttaaagttcatatggaaccaaaaaagagcccacattgccaagacaatcctaagccaaaagaacaaagctggcatcatcacactacctgacttcaaactatactacaaggctacagtaaccaaaacagcatggtacggtaccaaaacagagatatagaccaacggaacagaacagagccctcagaaataataccacacatctacaaccatctgatctttgagaagcctgacaaatacaagaaatggggaaaggattccctgtttaataaatggtgctgggaaaactggctagccatatgtagaaagctgaaactggatgccttccttactccttatacaaaaattaattcaagatggattaaagacttaaatgttagacctgaaactataaacaccctagaagaaaacctaggcaatgccattcaggacataggcatggacaaggacttcatgactaaaacaccaaaagcaatggccacaaaagccaaaatagacaaatgagatctaattaaactaaagagcctctgcacagcaaaagaaactaccatcagagtgaacaggcaacctacagaatgggagaaaatgtttacaatctacccatctgacaaagggctaatatccagaatctacaaagaacttaaatttacaagaaaaaatcaaacaaccccatcacaaagtgggcaaagtgtatgaacagacacctctcaaaagaagatatttatgcagccaacagacacatgaaaaaatgctcatcatcactggccatcagagaaatgcaaatcaaaaccacagtgagataccatctcacaccagttagaatggtgttcattaaagattcaggaaacaacaggtgctggagaggatgtggaaaaataggaacacttttacgctgttggtgggactgtaaactagttaaaccattgtggaagacagtgtggtgattcctcaagggtctagaactagaaataccatttgacccagccatcccattactgggtatataccgaaagaattataaatcatggtgctataaagacacatgcacacgtatgtttattgcactactattcacaatagcaaagacttggaaccaacccagatgtctatcaatgatagactggattaagaaaatgtggcacatatacatcatggaatactatgcagacataaaaaaggatgagttcatgtcctttgtagggacatggatgaagctggaaaccatgattctgagcaaactctcacaaagacagaaaaccaaacaccgcatgttctcactcataagtgggaattgaacaatgaaaacacttggacacagggtggtgaacatcacacatgggggcccgtcgtggggtgggaggagcggggagggatagtattagcagatatacctaatgtaaatgacgagttaatgcgtgcagcacaccaacatggcacatgtatacatatgtaacaaacctgcacattgtgcacattcaccctagaacttcaagtataattaaaaaaaaaaaaagaaaagaggtttaattgattcactcttctgcatgtctgaggagggctcaggaaacttacaattatggctgaaggggaagagtcataacttaacatggtggcaggcaatagagataaagagagggagagagagaaaaaagggagacgagagagagagagattgaggattacaattcaagataagatttttttggggacacagccaaaccatatcaagtgataaattaatagatgcaggttaccttggtagatatacctttaagatgatcttcaatattgggtagatatttgaaattgtggagatgttagaaatagaattataaactgagtaaatcaatttaggtttaatcatgagttttatctttaaaatttgggcttgatttaaagtgccaaagagatattccatccaattagtatgggaaaatggctagtggttcagaaactttttaaaaggagttagtttcagagtttaaaaatttgttttttccaggtcattaaatttgacggtggagaggaagtacttatttcaggggaattcaacgacctgagaaaggtaatgcttttgtgtgtataatgtaatatcagcagctaggatactaagctttaaaaacatgtaaaaaggacattaaattgacatcttttttgtgttaggtcaccaaggagcagtgggacaccatagaagaactcatcaggaagacaaaaggttcctaagaccactttggccttcatcttggttacagaaaagggaatagaaatgaaacaaattatctctcatcttttgactatttcaagtctaataaattcttaattaacaaacattcattgaatatgtattatgtgccaggccagtgatagccattgtatattcaaagataaataaaatgaaatatagtccttcaaaacattaaaaaaaaaaaaaggaggcatggggagagtaggtaaaggctcctctttacctattgatagaggtaaaaagtacttagaagtgcagagagaacagatctttgtgacttggaaaatcaggagaaactcaatggtggcggtagcatttgagttacataatatactatacctatattaatagggcctaaaagaaagaaattagaggatacacactaaatataatagactttgcctttccagtatactttcttttcactggacttgtgaattatcttctttgggtaactcagtattaactcaaacctttaatttttactaggacctatttgtagccaggcattttatttagtactgaataagctatagccgttgccctttttaaattcattatctagcaagatagtcaaacttataaataattatttatgatacattgtgataagtattattccagcagtatttaagtgtagaggaggaagtaattcattctgtctccagagtttggagaatgtgatgcctaagagatagcatgccatcccagctgtaaaagaagaatagatttctctgggtaaaagaggtaaagaaagcctataaaatatttttgtatatcatttgattaaatttcatctttggtttgactaatttgtcatcctgaaaatcaaataataatgaatccaaagtctcaagtctacagagctatacttttgagcctatatttttaaaatgtccattttgctttcccaggagtcagttacaacatgttcactagactgactatccccattgcccaagttgacacaagaggaaaccagcttccatcttacctcatctgaataaatctgccacaagcccatggaaaccccaattaacattgacagttaattgtgtacataaattacatttattacatttaattgtgtatatataggggatgttataggtttggaataagtggcccaacatttccaattatactgactttcactgggcttttttttaggctgttgcactttttctccacatgcttgcaatacaatactctcaaaataaaacgcagacaggtacctagtctccattttacctttagtactaatcctgtgtattagtctgttctcatgctgctaataaagacataacccaaactgggtaatttataaaagaaagaggtttcattgactcatagttcagcatggctagggaggcctcacaatcatggcagaaggtgagtgaggagcaaagtcatgtcttacgtggtggcacccaagagagcttgtgcaggggaactcccatttataaaaccatcagatctcgtgagacttattcactatcacactattgtgttgatattgtgttcacacaccaataatgatggtttatcactcactccatttccaaacccaccttcccacccacctctcaccaaacacacaaagacacactctttccctccactgattccaccagtatagccatatttctctttctggttaaatttatactaaatgtttacatttatataacttaataaatattatttttttccagtgttgtctcaaccttttttaaaaaaaaaattcagattacatgataaatcaggtccttttttagataaatattatttttagtgttctattgttttgatgtatcattatttaatttattgggaatagggttatttatatttattgtttttatctttttaaatttttatagagacaatgtcttgctatctttatcagtctggtcttgaacttcagatctcaagtgatcctcctgcgttggcctcccaaagtgctggggttacaggcatgagccactgagcctggctgttgaaaattttttgttttttaatgtttttcaagaatgctaatgcctcccttgccaatgcattttaaaattattattaatatt

SEQ ID NO: 15868 - DNA, 374159 bp, Human
agtctttgggcaagcagactaactgaaatgacctgttagcctttgttgtatccatctgacaagatcagcttgtagaatccagaatggaggtgggagatcagctggcagcctcatttccctcctcaaccacccctacgctgatgtgcccaactccactcacagctgggcagccaccgcttgcttgaaaataaatgaatctacaccactctcatacggatgctctcaagcatcccttgttgtgagaaaaacatttattgctgctactaaaatgcgtaaagttatctcacaaacacatacttacaagaatgaggaatgagaaacagaaccatccataaaactataagaaacggcctggccagggcagaccaggaattagtactctgtccttgccaggggtcaggcagggacctcagaagcagggtgttttgtcctagggggcaccagaccagaggtcaggagactgagggctactcctagctctaggacttttccttatctgaaggccgggtcggttagcagagaaaatctcacagtcccgtgccagacctccacgcagggactctgcagtgctgttagaaaaattagctcagcaccttcagcttgctttcagccatcacttagctttccacacagacattccaaatggggcctttcaaaactctgccctcaaatgaaggtagttcagagcaacactttagatgatatcacaagactcccaggacgcttcactgcttcctcagcatacgccagtgcccgttttacaggggggatttatgatccttctctcagtagagcgagccaaacttttataatattcattaaaaatcagcaccacgtgtaataatatggaatactgcctgtacacaagagggccaagttataggtgtttagggaaacgtggcagaattttctggccttggcaagaggtaaagttgcaggcaccagcacaacactaacacaaccttattttattgcaaatgtacattcagcctaaatcctaattaccttctgtaaaatcctaaccaccaccaagctttcttctgacagggcactcacacgacggcctttaagggcagcaacaacatcctaagagccgcagaaaggaaaggcaggggagagtggctggaaggcagtaggagctggggctgaagcccgggaggttggcttttaatgtcctcctgaaattgaccactctctttccaaaaacactggcttgggggcttaaaggttcgctcagtagggcaggcggagggcctcctgaaaaggattgagaagtcaacattcaaaaggctgcttttactcgcccggtccccacccaaaagggagtccggtcagctttgtgggggccagtggagcatcttttcttgcccttccgggaaaacgctagctaaccctgggatccccggtcccgacgtctgctctccttccccaggtgcagcacctagggctctggccccctccccacgtgccacaccagccctcaccactactctcaccctgctatgcccccaaccctcgtctttcgtggccgggaaggccaggccgagcggggcggtcagccgggccgggaggagggggctctccgggccgcgcggccgcacaaagcggggagatctgctgctgcggcggcatggaggcgcgccccctcccgcgagccagcggagcgcgcgcgcccgcccccgtcccccgccccccgccccagcccccggagcgccattcgcggagcggcttacgctagtcgccgggcgtaccgcgccccagcggccggggaggtgcgctgcccggctcccgtaaagttattgtgaatggggagcgggtgacgtcagcgccgaatgtcaacaatgtagcgattgagagtgtgggcgttccggggagagcgcaagccgcgcggcgcggagcaaacagcgccgagccgccgccgcctcagcagcagcagcagcagcagcagcggcagcagcggccgtgcacgcccgggctgcggtcgcacagcgctaacgtgagcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgaggtgagtcccgggccccgggccccgggccccgccgctgggcggggtggcggggcaagtttgcggggggagcgggcgcgcggggcgggcggggaggcgtggggaaacggcgcgggaagggagccccggccgccgggcgcgcagccgccctccccgcgccctgcccgcttttatggcattttctaggaacgggaagggggtgggagccgagccggcggccgcgccgcgccgaatgtgtgctctccctcccggctgtttacggcggccgaggcgcattgtattttgctggcgtcgaagggtgttttggaacagcagagggaggaggagcagagagtaataagtcaggcatggggagggcgggctgcaggaggcgcgcgtccgcgcgagccgcagcagctgtcagacccgcggccctgcccccggcccggcgaggcccgggtgtcccggcccccagcctgcgatcccagctccaggccgggcggcctcctccttaaccctcggcgtgcgcatcccgggctgctccgcgaggaccttggccgcggcgcctttgcgctcagctgtcagccgccgccgggtggcccggaccaccgcgaccggcggggaatcaaagcccaagtttagggtcgcaggaagaggcgagctgggggcctcgcggcgcagacctggatcgaatctctcctagcgaaagatcgggttgtcggaaagcgtcccgcgtagctaagacctaagggcgccaggcttctgagagggaaaccttgcacctcctctcccacagatcctccatgaagtcaaggtgcaacacacacacacacacacacacacacacaccctacactccagtctccaagccccagaagcttcacccaggagactggtttatgaaggggacactgccctccccgtccccgcgtcgaggcgctccgtggccccgctgtgcttcgctcacccggcgggtgttcgggagcccggcgccgctggagacggcggcgggcggcgctcacgggctaccctaggtgcccacgaggggagagactggagcgagcatctcggcgacctcggtctggccaagcatttgcaggaactcggaccgtgaggggaagcgtgcagggccgggagtgagtgtgtgaaggggtggcacactcctggcttctggggtcgcgggcgcatggggcatccccagcactctcccgcgcgtaggcgagtttggtaacttgagggaagttccggcgcggccgctgccggggtggtttgtctgtggcccgatgaggcgcgcctcgcagcctgctctcccggtcaccgccgtcgccgtgacctgtggcctccaggaaacgagagggaccggggcgccccacccgcgagacggacccgcagtctcccggcgggcccgcgggcggcgagacgcggcgttcctggttttcaccttcgctgtctagtgctgcagtctctcactctctgtaaatttcatctgttgagtgtatttaactaaaaagggtaattactttagataaaaatcctttcctgcctagtgggaaccttggcggagatgatgcctaatgagatattttgcttttgtctgtttagagtaaaattagagatgttaacgctgataacggttttctcagatcattaaaatgtaacatgtaggaaaggcacgtcttgctgcaaaggctcgggctgacatgaaagaagctgagcgtgaaaggctgcccctcctttggcggagagggctattttggtaaggcagcgggcgtcttgcttaaaatgtgagatcgccccaccctggttctcgggcacctcccgagtaaacggcgtttttcattcttgcaggtaataataaacgtgagtcaaaatgacatcttgttagaattagtctttagtctgtaagagagattgccaaattacagtgttgcgttcaaactgctccactgaaaggtctgtcagcatttccattataaattcagtttttctggagtttataatttcaccacaaaactttgagtggctgaaatgttttcccttctagtattctggtttttgaaagaaatttattgattgcccatttccaacgttttttttactctcgaaacctgaatatcattgaaatagagcgaagtcccagaaatggaacacacaaccatggaataaagtatttttgttagaacataactttattggtgcagagccgtattttcgttttgcattgcaggaggcttcaggtttgccatttggtaatcatgaatgtgttgagtaaattcttctgctgtctgtctattctgcaggtggactgaaatgtcagttggtagtgtgtttgccaggattacatggagacacacacttctcagttaagtgtgtgtctgaactcatagctaaattgtgaacactcctgttagttacttttttggttctttgtatgttgcatgtcaggatctgctatgaagaagaaggggtgaggtgaaagagagggaggggatcaggattcactttctgtattaccagtgcctgggagaaagccatttattattttcctattgaattatgccctttgacttagtatcttcaggcaattcttttccagtagctcacctctggctgctgtgtaaggggcttaattatttgcaaactgccttgaaatccctggatgaaaggcactgaataagtgcacagtattgttattcagatatggaatttaatgatccattatagttcatcaggaaaatgcactttgcagtgatggtaggaaatgtttccacctgatagagggtaataataactgcttaaaagtagattcagattacagatgagacaattaactctagccatgtgctcttcaatttgttgcaattcattttgtgatcaaagtgagtcacagagggccagatggtcaggttcatgttcagatctctcctaggccagcccttcacttctgggcccactgtctgcacagccgacaggacttagttattcattagcgcttgtgagctgtttctcagaattcctaatcgaggctcctgtgatgccaacaaaagggctcaagccaatctgtattgttgagagcagtttaattttacttggattaactttcagtgtctctggtgtggatccagtcttaacaaaaaggaaagagaccctagtggctctctatctctgctgtgcctggcccctctactctagtttttgaacctcagatttcaggggtgtgacatctagcttattgtaaatgcaggcttgattgttaatgaatgagagaatacttagataaataaatatcttcctgtgtgtccagggggtgagagccagtactagcttcatgggcataagacctgtgcagttacataggcccccttcctcttccctgctcagaaggacctcatatttggtataaggttctgctgttttcttcggaaattcttaataatttttgaacaaagggcccctcgttttcatttttcactgagccctgcaaattatgtacttacctggttctggtgaggagcagggcatagtgtggagtggcaggccgcccctactcaactcattgtagactcttgctagggaacagttggtaggactactggctttgtgttgccacatcatttgatttttccaggggaagctgaatattggatatttatgtggaatttcctgatttttaaatattggctcaaatctttaaaaaatttttggatgaaagcatatgtaagagctagtgtcggcctgggggctgcttgtctcccactactgaacagactgaaacatctttttttgtttaatatctttgtgtgtctctgttttctaaaggcctggcatatagtggatgatttgtgagtatgcacccaatgaatggttacaactacctggaaaatagaaagatgccaaaaaaacaaaacttcaaatcaacattgagtcccactcagggattgatcagcttcctttttaacagagaattcgacatgaaaggccgaataatttaataccatgagtacagtgtgattccttgcaggtgaataatccattacttttgaaccacctgccctctatttagttgttactgaccagatggggtaacttggctgggtaatgcctgaggacctccatgggagtttgacatttgagaacactcaccaaaataatagttttgatttactgaatccgcaccatgtgccagacccagtgctgactaccttgcctgaatgtacttcattgattcctcaaagcaaccctttgaagtaggtgtcgtgcctgcccattctgcagagttggaagaactaatctcatgttggaatgaacttaatctgaatatagtgcatgttttcttgaatgtctgaaggttatttccccattccattacacagtccagtcctgaatcaatgactgggcatggtgtaggactgtgacatacagagaacatggtccctgccctcacatagaacagagaacaatataaaatgtaacatatttgtcaaaatctgcaattcagatagcagacgctgtaaatctgcctccctgtttttctcctttccctgtctggatgttgaagaagtttcagcgacatatgaccctgtcagaggtactcacagttcagaagtcaatgctggttgcaaaaattggaatttctttggaaaagaagacaagcttttggcagagctggggccacatatgggaacgcagcaccaaggccttgggaatgacggaaaatcgcttctgtattgttaatagcaatatatgacctctgctgtcctcctatctttaaattttatgtaaatatttacaaactgttcatgtccaaactgaaacctgctatgaactaaacattttgtaaactcagtaagattgcccaaaatacaactcaactttcacctttttttttttgtttgtgatgacatttaatttaaaaaaaaaagacagtagttgcttttttttttctttttttttgtcagttcagggtcttttaattttttccctttacttttttttttgttaatttcaaatgtcagtctatctaaaactgaaacttaattttactatcagcatgctactcagcttccgtaaggctggaaatgtcctgcgaatcttaccactatgtcttttccaagggccatttcatttctaaagaatgtataaattgaacctcatcctgctagtgacactacttcaaaattcaggcaggaattttgccatttgtttttccttgagctattttttttccaaaataataaatcttcccaatccaaaagcatttcacatcatccttcattctagtcattggaactacagccaaaatgcctctcagtcttccccagtgacttcataatcaccgtttcttcagcatattccctggttgacttctcctttgttccttagcctcataatgaattgccctttggttctgagatgtgtcattttcctccctgacctttttgttcttttcctgaaggctgtaggacatgctgctgctgatgtgatgagagccggcgcttggttgctaggtccctcctgtccttgtgtcagctttcattggctcctttcctaagcatttaaatcctccactttccagtcctcccattcatctcattattctcttcatgtgtgcctgagcctgtagctggcatgtagacaaagtcccagttagttagaagaaagcttttcgagtttccaagtcttccatcactctagtcttgggccatcttctattctccctcccctgtcactttctgcagatacttcaggaatttcctcaagactttccaggagtctaacccaaagacagcttagaccttcacttcggattttaaagttgggagatcccaatgtgatgatttccattccacaagtaggaaacaaagtgaatgtacatgctcagcatctttccttagtatttcagtatccatagatttttggcaatttttctttttttcctatcctgtattcttctaagcaacagaagctcgtggatagtgcaaaatgggccaagtgtccagaaatactgttgcttagaggcagatgcctcattcattcattaaacaaatatatactgagtatctcttacatggcaggcatagtgttaagtgaccacagtgctaatggggagcaaacccagtcctggcccctggtctcatgaagcacgtcatctggtaggaagaatggcactgatcagttagtaacagataacccactgctcgtgaaggaaagtatttcatacaccagagtgtctaatgggcagatttaacctggtcgggaggttggggaagccctccctgaggaattgtggagtgaccttccatcagggacagtctgaaacttgagattcactttttctccagcttcctaatcctattaattcactactatctttggccctttggagtattgcctaagccatgctggaacctctggggccattttggcaaataatagttcctgtatacagagtccagaattgatttatttacctgggtctttagaacctgataaaaacagaagttaactgccaagagtactgttcatttccatacttggaaaaaatacaagttaacattcttattttgaacatatttaggttggttttgacaatatttgaatgatcagaagctacaaagatattctctcccagtcagctgatgtgtgtagggcctttggtgaaaaagtgagtctaaatagtctgtctgaagtccctggctactccagagcagagggtctccatcctctgtggcccgaagattattccaagcttgtccaacccatggccagcaggcctcttgcgtgttgaatgcggaccaacacaaaggttttttgtttttgtttttgtttgtttgttttttgttttttgctatttttcttgtttcagctcatcatgtatcattagtgttgagtgtattttatgtgtggcccaagacagttctccttcttccagtgtgtcccagggaagccaaaagattggacacgtcttatttagaccattcttagatgcaaaattaaggaattttgacagcatctatttaaaataaattgattatacttcatgctaacacccctctattttctttttctttgatgatagttaacttgtattgagagcttcctctgtgtgctgctcatattaactcacataatcctcagaacaacccagggctaggtgtgatcactagaagccgcagcataggtgtcgctcagctaatgaatggtagaactggagttggacactagctgtctgatgcttgggcctgttctcttaccatgttatggctctcccttttccttttcttcttcatttgaagttggaactctctttagcagttcccagaagtagaaataaaggtcatctcactctaaaatattggatgttttgttgacatctatcttaaagttaaaaaataatttctcagtaaatctgagtgagtatatctcctgtctttcacatggcctgctttctaataattgcattccttaggttttagtgtccatttagggatcggaaagtaaaagtgatgcatataaaggcaaaagaagtactaggcatataactgaaataccatggctctgtctccagggtttacttgtaactcacactcctaccctcttgttaggtggagggaatttgttttttgcgttttgttttttgttttttgtttttttggtgggtaggaaaaggtaaaaaactatacctgtaagaggtagagtattctaccaaggaggaagatgttcattcagaactaattccatcagaaatcctaattagaaatattagctaccagtaacagataaaaggaggtaacctttgttctcattctggtcaatttcaggaagagattatcttgccagattagcatgttgcaactctcagctggagatttgaatggttttaaaggactcaggcagttggtatggcagtaacccccaattacctcaggtttgcagggtcactgtttagaatgctgactcagctctgcctgggccagacaccgaagttgtcatctttagtcaagaagcatcattctcaggagccacttgaaacattaagcacacatttgaagctcaatttgggaaatgatcaagtgtatgaatgtatagtactgtgcttatttttcagcatttagttcaaattttggagaaagctaaatgggagatgcttagtgtgtcagtgttggaggttttaagtgatttaaaaaatcaagcagatgagtgcataaagatttctatgcaaacaatgttgagcttaaattaaagctgctgatttagtgtgagaattacttgcattgatttgtagaatatctatgtgggttcaagattccatattatgcaaatgaataagccctgaagagtcaaactgaaaaaaaaatgaaattaactgtgaaagatattattacccattcagcaagaggaaaatgtagacagagttaacccttccttttcatacattttcttgggaagataagtgccagggatgatggtccgtgtcccagatgtaaagaagctaggcacggtttgcagccagttcccccatcctccttctgtgctcacttttttgtttcatgctctcttaccttttggccacccagtcccctcaactagtccttgtccttcccttccaaaaccaatctcagagaaagattttatgaacacagttttactaatatataagtaactgagcatacttaatgtgttacttttctgaagcatcagcatgttaataggagacaaagccaaagaagtaaaaccctaaagataaaaacaatagaatttcgcacactggtaacctggtgataggagaccatttctgaatggagagagggctcgtgataaataaacacaaccctaggcagagaatataggcaaatggattacagtatttaaatcaaagtagtattaaaatacaaagagaagattatttttaataatacatttgtcagtgagcatttcccgccttttgccgtacattggagttgatcacataaacctctatagcaagatggtatgttatttaacatttaaacaaagcttccagggaaagccatttggtttgtggttagggatttttgttattcagtagcaatgaacctgaaattctatattatctttgcatgttgaattttagaagaaaaaaaaagcagcggatccaacttcacttacctccccaccccagttgcattgatacaaattgaattgataaatttatttcaaaattggtgtgtcccaatttgacataccacaagcatagtggtgtcagcatggtggtgacatctggacattaggagagttggttgattaattaaactatacttattttagatagagttgttggcaggtaaatacctggctgtagagtcaacgcccttcagtcccacctctcccccaccatacccttctccagcaaccatgctatgttgagttgatggctccatctagtgccagtctgtggaactgtcttgcaggacttcactgtcacctccagagctgggtatgatgaagagtcctctttctctgggaacacactgtctagcggggaactgccctctagttcctacctctcctttgtttttgcagtttagttatacctccgtgtctttctttgttccagacttaatttgtttccctctctctagtaccccctctttgtacttgtttctcctccttttttgttttccaagtctcaattttttttttggagaacaaaacagtacttaaaaccggtaagtataaagattttttttctaacaatactttatgccaaagtaagagaattctatgcattttaaatgaaactatcaattgaaaccatgttagagaaccagaatgaccctaaagttgaagtctgaaagtgtcacttggaagactgtgtcccttcatcctcctgtagttagacatttcctcaaacacagttaatcaagagtattttcttttaaatggttttggaactatcattgtagtatcattttctttttagattataaatttaacctctcatattttaagttcaagacattttcacggactatcaaggaatcctagctcattggcctggccctatttctgtgggaaaatgtattctcagttccagacaaccagtgttcctgcagatttttaggtcccgtataaaacgagagaacatagatgaatgagaggcattgtcagacaaagcctggcacatgagatctcaattagcatacaggttttaaatttcccacattaaacagtacattttaaatttccacttatgttaagcgtgttgatattgtgggtttgaaagtaagtcccctctgaaaaacaggaactgtgcttgtctgttaccagttcttgtggtcgatatggtaactattttgatttttcagaagggaggaaaagcagttaaatctagttaaaattaaaaccagttaaaattaactggctcgtgagatttcagtgcagctgttccacacatagcaacactaagagtgagttgtttattaccatgattaattattattagttgttacttctttttgagcagtggcatagattatttatatttttggtctaaccttggaaaatagaaactgcaagcgtagagaggttcccgtttgctaatttgcatgtaccctgtttttgtttttgccaggtaggtgtgtgcatctcaagtacacgagagtaatttagcatgtcagcactttcctaccagcagtgcttgctgactcatgcagctgttgtagcactcagctggccgcactgtaaactgcccatagtaccagcaccgcccttggagagctccgggctgctgggctggttagctactgggaggctattttcagatctgtggtcactgctgagctgggtcctcttctcctgccagcagccagacacagccttctggttgcaggggagaaaattggacaaatttctacctttgtagggactgcataaagattcatagcatttctggatatgcctcaggaaaactttttttttgcttcactttatttttctgggaatatttaaggggagaggcaaaaggggctgataataaatgaaaagggaatgtgctgttatttcctactaagatcagaaagagttttcataaacctttaacttagttaggctttcttggcgtaactgaaacctgacccacttctccctcagtgcaaagcagtgtgtcctgagtagggaagcaggggcgagggtgcaagtgactagcctgacattgttttatgtggctgaagtccctaagtgatgacagcttttgtttatatccgttccctgttattgaggttaaaaaacaaaacaaaaaacttgacctcaggtcattttaaagctagcatgtattttcagagatggtttcactgtttgttttcagagttcagttttgcttattttcatcggaaagtgtgaaatgttgcttttctgaggcttctaaataaacttccttttgtagatacaagttgatccaatcatcataaactgtcttgaaaaaggatgattaaagtaagatcagctggggaagggaaagctttgcacacccttgaggagtttgccttctttttcttaagtttcaataagcattctgaagcagctttgaccagtaataaagaaaagccacagtgactgtgtgtaacatgatgttgatggaagttcttggtttccgccgatacgaatgactcatcagtatcaatagaattgtgacttctaataataacacagtgcaagaccttcaaaacatgtggttttagcccttgctcttagtgaaaggttggaaaatgttagtttgagctttttttttttaatctcttgattttgcccaagtataaagttgttttttgtaggaatgatgatccccctgttgttttctcatcttactgtttttagtttcattatgattaaggagccaaactcagatcatttcatcgtttagaaatctctgcgctaagcatctcctgtcggggctgtgtttgagggaaatgtggctgaaaagcaaatcctccctgaatgcagaaaggaaaatactggtgcagactacaatccactgagctgcgtccctcctacacagcatctattgcggagggctgtggtattgctaagtagccccataaccctgtgagtcattgtcaaaggattccaagaggaaggttaacagaaaatgcgagtcagaggaaacagcagagtggagcagctagctcaggaagaactgtgctacctgctgaggggctgcccagatgtcaccaggaattcaggtgtacgttcatctttttgcagcccatttccgtatgtctacatatggggacatttttgttttttgtttagttttggttggttttgctgcagtttggccagactatcagagatcactatcttagcttcgtatcacagtggtcttatcccagagcctttgctttttgtattttatagtcaaagcaactgaatttctagactgtaagaccaacatgtatatttaacataattcttttcctttctaagtgctttatttatttatttatttatttatttattttgagatggagtcttgtcctgtcacccaagctggagtgcagtggtgcgatctcggcccactgcaccctccacctcccaggttcaagtgatcctcctggctcagcctcctgagtagctggactacaggcacatgccaccatgcccagctaatttttgtaatcttagtagagatggggtttcaccatgtttgccaggctggtctcgaactcctgacctcaagtgatctgcctgcctcagcctccctaagtgctgggattataggtgtaagccgccgtgcctggccagacctaaaaaattcttataaaatagttcaaaagttaaaaatgcatgaggaggccgggtgtggtggctcacgcctgtaatcccagcactttgggaggtcgaggcgggtggatcacgaggtcaggagatcgggaccatcctggctaaaacgatgaaaccctgtctctagtaaaaatacaaaaaattagccgggcatggtggcaggcacctgtagtcccagctgctcgggaggctgaggcaggagaatggtgtgaacccaggaaacagagcttgcagtgagccaagatcgcaccacagcactccagcctgggcaacagagcgaaactccatctcaaaaaagaaaaaaaaaaaagcatgaggggtctttcacttattgttggaaaaaaaagtgagtaggacttctgttcactgagtggtaactatggagaatgagaaaacaagcccaaagtggtaaagacgtttgtggcacataaataatactggttcagcacacatgtgaatcaataaaaaagccagataaccaaaaagaaaaatgatactgtacattcatattcttaaacatgcatttcacaaaggaagaaacccaattggctagtaaatatataaaaagatgctcagcttcattaataaacaaacacatgcagattaaaatcatagtaacatatgattacacactctctggattggcagaaattttaaaacctgacaataccatgtaaggatgtgaatgaatgggagtttttgtatttagttgacaggagtctaacttggtacaattatatcggaaaacaatttgctgttacctaaccaagttcaacctgcaaataacttacaacacagccatcttacccctaggtatacacctaagaaaaatgattacctatgtgctttaagaaacatgaacaaaacaaaaaataattgatgctggcaaggttatggagaaaaaggaacacttacacactctcggtgggagtgtaaatcagttcagccattgtggaagactgtgatgattgctcaaagtcctaaagatagaaataccattcaacccagcagtttcattactgtgcatatacccaaaggaatataaattattctaagacacatacacgtgtatgttcgttgcggcactattcacaataagcaaagacatgtaatcaacctaaatgcccatcagtgatagactggataaagaaaatgtggtacatacaccatggaatactatgcagccataaaaaagaatgagatcatgtcctttgcagggacatagatggagctgggggccattatccttaagcggactaacacaggaacagaaaaccaaactgcacattctcacttataagtgggagctaaatgatgaaaacgcatggacatatagaggggaacaacggacactgagacctattagagggtgggaagagggagagaatcagggaaaataactaatggataccaggcctaatacctgagtgatgaaataatctgtatagcatacctccatgacacaagtttacctgtgtaacaaaccagtacatgtgcatacccctgaacttaaaagaaaaaacatggacaaacatattcaaagaagcattgttcataagagcaaaaaactggaagcaacccaaataaatgcccatcaacattgaatcgaatcagcacattttgctgtgaggtatttatacactgtgatactatttggcaatgaaaaatcaactagtataaccacatatagaagggtgtggagaggcagcatttcttggtggtcaagaggaaggattgtgcctgggttcagattttggttctgccacttattgtgtgaccttggatgaatttctgaacttcagtgtaccttagttttctcatctgtacatcagggaaaatgatgtctacctgatagtgttgttaggaagtttaaatgagtcaatgtttgtgacatgcttaggagaatgactggcagacaatacattctatatgtgtttgttaaacaaataaaagtgcatcaaaatggatgaatcttacaaacaatatggaaagaaagaagcaagatagaagaatatatacagtgtgattctattcatgtaaagttcaaaagcatgcaaaactaaatatgttatttagggatacatacatagatggtaaaactataaagaaaattaatatgatttaatatgattgtcacaaaaagcagtataacagctacctccagaggtgaaggagtgggtatgatagagaaggggctcactgggggcttctgaggtcctggcagtgttttatctcccaacctggacagtggtcccaaggatattctttcttcttaattgtttttaaaaactgtctatgttttttatatatgtgtgacctattagtaaacattttaaaggatttatgtgagttgttatagtagcaagatgacattaaatagaaataactgtaaattgctacattttagttaaaaataattgttcaagtgcacatgggaacacttgcttggtattatttcctccacaacattgtgagccaccagtgcagtgtgattcttacagaaggcgacacctccttaaggccacattaagagagctgtcccctttagatcagggaatgtaatgttctcactcaactactctcaggtctggatgtcccatgtgtgggatgctatgtcttgtcccaagggatttattttaagaaagattttcaccacagagggagcattttctgtgataaagatgtttaggggtctggaaacctatcagttctaagagtggccaaaggaagtggggattttcaacatggagaagaggagatgttgggagagaaagagtgtcttccatcactagaagtggaagcagcctttccttgttgcttccctctctgtaatatacaagtccctccctgtaatgtctacccttggaggcaggtttcaagtcctggatactggagatgcccaagcagaggctgtgggacctcccttagacttgactggggccacaatacccactgcctggtccctggaccagcagcatcggcatcacctggagcttgttagaaatgaagtctcagggccacccacacctactgagtctgaatctgcactttctcaaggtgcccctggggtctcacataaacatcaaaatttgagaggcactgggctaaatgtctctaagatccctcatggttcttaagatttaatgattttatagaataaactgtatgttcaactgaaaattatcagttcatatggtgacattatcaatttaaaacaccttgggatgttacatgtccacagaaccatgtaagtatttgttgctaaattagttttaaatggatttgtccagtttcccccgatgtcaaagttaggttgcttatgtatttgggcacctataagaattaaaatattacataacgttgtattttcttctttctaacatacaggattagattcttgctttaaaattctccattaatgtcttcaaatttttcttttatattcattgaaaattcaaaagcagattagggttctgaatacctgttaagaatactcaaaagggatatttaaataaatatatctcattaatacattgattttatatttagcatattttttcttcttatacatagtccatattttgaccttatgggaacctttgaagtctgagtattttataatgattctccacaatacctctttatcttttagattctagatctgagatcaggcaagtaaaatagttttacctttttcccctcaaaaggccatgactaacaagctcatttactttttccttaaatattttgctaattatccttttaactgatgaagttcaagtggaatccatgattcatttaatcttttcccctttatgtaattagtcacttgttcttttgatgttcctagcaaaactaatatttaaagggctagtcataaaattccaaaataaaaagttcttaaatgacttaaaataagagataaaatatgctttactgtatagtaaaaatggagaaaacgtctcatgaatagatgttctttaaggctgtgagttatttgatttaagcgtgtgttaccaggtctgtgttcttttggtatataggaccaagaaactactttatggcttaatgtttgctgtacgtatgtcatctagatgagataatgtatgacagagggctttataaaatgataaagtagtgtagactttttttttttttttttgagacggagtctcgctctgtcgcccaggctggagtgcagtggcatgatctcggctcactgcaacctccacctcctgggttcaagcgactctcctgcctcagcctcttgagtggctgcgattacaggcatgtgctgccgtgcccagctaatttttgtatttttagtagagacggggtttccctatgttggccaggctggtctgaaactcctgatctcaggtgatccgcccacctcagcctcccaaagtgctgggattacaggcatgagccaccgtgcctggccgtattcttttttttttaagagcaagatttaggaagattactgcatattcctatagcgtttgttcgattttagattttttcagaatggtttgaaatcacatattctagcttgaactctaaacctggtctgtccagtatggtagccatcagccacatgtggcatttgagcatatgaaatgtggttgagatgtgctgtgcaatatacaccagctttcaaacaaaaaggatatatatctccttgataatttttattatgttgattacatgttgaaatgataatgttttacatatataggattaactagtaaatattaagatacatttggcctgttcctttttactttttaatgtggctactagaaatttaaaattatatgtggttcaccttatactttgatttcaaagtgctgatttagtctctaaagtctagagtgattgagagctctcagagaaaagaagatcagagcttaacagagagttttagagatgaggtgccaccgacagaatccacttacttgaagaaatcccagtctgcacctttgccctacttttacagattactgctttcttgaacccacaaagtagagcactgggtagcaagcatttaatatctacaatgtacagagcattgaagggggattaaaataagtatcacacaggtccctgcctttagggaaaacatatagtctactggggaagcaagatatgagcacatgagttgttaaatcatggcttgagagatacatagctgttcaatgctcaggtccaagactgttgcaaacagacggttgaggcactaaaaaaagtgcttcaaaggaaggaaaggtctccacggcctggaaaggtctccatggcctggaagggtgtcccaccagaggaatgccttggctgggcactgacgagtgggtagaatttcagtgggcagagagaaagggggcatggccaggtaggaggcagggtagagtgggaagaaggaggaaaacatggaaaagcacagaatggttgagaagtcagtgagaagaagagatggattgaactgtgagctgtgagtagaatcattctctagtccacttattattgaagctttaatatttgacatcgtctcctataatattatgtatcttgacactcttccgaaaattatttaccaagtgtctcaaagtagaggttagggcaggacactttaactttgggtagaataaatgttgcatatctttgattgttaggaagttctttaaatggcaaaactgataatattatcttgccagttatgtttatactaacattttgtgtagaaccatgtaactttaaaggcttctcggataagtacattattagtatttcaggcagtagtgctcagcatttgtatattcttcttgcttaaaatgccttcagtgttatgtcatttgatctttgctgttggctccattttatagaactggaagccagagaagctaagattgaataattaatggtagagtctggaatttgaacctagctcttaagcttcttccattttactgtgtgaaacacactagttttcattcctgtaagtctgtttcttaagagaagctgattaattttatttctttttaattgaatgataatataaatagggaaaagtatgcatataacatatattcatcttactgacgaatttccataaagtgaacacgctgttgtaaccagttcccagattaagacacagcattatcagcgccctagaaatccctcaggcttccttccagtaactacttcacccgtggtagccactactctgacttgggaaagcatagatttgctttgcctgtttttgaactttatatcaatggagatacagaatgtactattttgtgtctaacttctttcactcgataatatgcacagttaactcatattgtgcatgacaccatattgactatggtagttgatttttcattctccatgctatatagtattatattgtgtgactataccactatttattaatttgtatagtttccagtttggggccattatgagtagcaatgtgaagattctagaacatatcttcaggtgaacaacataattatttgtgttgggcatatttaggagttaaatcaggaaagcagtgtaatttttaaatgtcttgtagatgaggctgaaatttgactttgtgacactcttcaagaaaagaagtgaaaacctcaaactgttggtgtcttgaatagtatatcaaaataaatactaaggcagccattatgaaaaggtccaaggtagaggaattttaatgcccgaacacattttttcaagggaggatgaaaatagtcaattctcatatagagagaatttgaaagggttaggatgttaaaatactgacgttatatcactcaggtttctcttacagttatattttttttcttcaagagaacttttagcaggtgatagtggaaaactaaggtgtgattggtaccaaaatgaccattgtcccagggtataataagggatgaataactggggagtgtatttactaggaaataagaaaatggggttgggttaaatggcaggaaggtacattccaaaatctataatgcaagctatggttctcaaaattttactgaaatttcctctctctctcactcttttgcttagcgtaatctgtaggcaaaagaatttgcattcttttaaagaaggcaattataaataccataacttgtttttagaaaaaatcttagacgtttatccagaggcaacctgtctgaatgaaaatgtagttctaggatttgccaacacaaaagacttcagtgtctacctttaatgcttattaacattaatggtgatcatttaaaggtgtgtgttttatgtttagacttataggtgttgttgatcttaagcagactaggcagagaaatccttcacattttctgtgctctcattcaggatggccctaggcatgttacatgggaaatgagaatatgtgaataaatactctcatactttcttgggcctcaatgaaaagaacatttgttaccatttttagtcataaattaaaattatttcagagtaggaaatataacattaatttagaacatggctgtcatagatgaaacgttttacacatgtattgctgtggtagacattccttgcatttattgaaagcctctcctttataaagttagtgaagtgtgactactctgacctccaaatactgggtgtatttgaactatgaaagtaggtttaaaagttacacttttctttaatgcccattgatgatttctttctttttttttttttaagacgaaatctagccctgtcacccaggctggagtgcagtggtgtgatctcggctcactgcagcctctgcctcctgggttcaaactgttctcctgcctcagcctcccaagtagctgggactaaaggtgcacaccaccatgcctggctaatttttttgtagagactgggtttcaccatattggccaggctggtctcgaacttctgacctcagatgttcaggccgccttggcctcccaaagtgctgggattacaggcgtgagccgctacgcccatccagaacaacaggcactggggcctactggagagtggagagtgggaggagggggaagagcagaaaaaaaaaaacctatcaggtactaggcttagtacctggatgacaaaataatctgtacgacaaacccccatgacgcaagttacccatatcacaaatctgcacatgtaaccctgaaggtaaaagttaagtaaataataaaatattttacatttatttaaaaattctaaaatggttgtattttaaaagtaaaaacaaattttggttaggatttgagcttattccatttttcttctaattttccaaattaaatgtaaaatgagagcatcccaggtagggggaggtaggggagaaaccaaataattttcaagtcatatttgaagagcaggtatgttctctcacgatttacagtgcaggtgcattttaatttaactgctttaaatgatgataaaaattgttcaagtagaacaaagcaaagttttagaagtgacttgtaaacagccattcttaattttttcctgttttctctccacttatgtgacttgcatgaatttctgaagcagtcctttcaaatgacactgctccaaacatgtgaattgcattcatcaacaaaatccagccttttcctttgtaggacaatgtggggtcacggggcaaggggtcttttctttgtctagcctggtgccaaagcaaagactagtcctccctgcgtttggacccagtgacatgtttccatttgtcattgaacactagggggaggaactgtagcctctgaggtacccccatttggtcctcaccctctaccagaggatttgctgcttcagcctcttcagtgccccaggtatttgatgcaaagattatgcacttatgctgccagttatcagggttgtgtgggtgtctttagaggggtctccccttagcatcaggtctcaatgacagaatctaaataacacaggttactcatcacgagttaaagattttttcccttttcacattgatgcttctgatatacttttatacgttagctgattgtatgtgcgtactttgtggctgcaaagatgcagctggaaagtgtgtgggggttgtctgcttcctctgaggctgctacaggtggtcaggtgggggcggctgtgataaaggtacagcacccacttccgccagcttgtcttgtgcgccctgtaacccactgcatgaacccgagtggcacttcaaccggattttcttgttggcacttttatctttcactgcttctgacttgcctgttgaggtttatgactaaggttgtgattaaaaattccctttttaggtatgaaaagtcttttcaattactttgtgttcctttttttgttttgttttgtttttgttgtgtgtggactttctgggttttgtaaaaatgaatcttaaaaaaatcttaatattatgtaagagttagataaaggttaagtagctaatatattctctcatcagggcatagaatcaacgtatgttcttggaagattaagtgtgtcaaaatgcattttatgatggaagcactgtcagttgtttagaataggcatggaaaagcccttttcagaatattgtcataaaatcagacttggaaaggttttcgtttattcagtctgtattcccctatctgtctgtttaatctctgcatattactgtccttggagcacggagaaacgtgagctacccttggaggtttatagtcccactggaagggaactaatgtttacgcctgattatatgataggagctttacatgttcttattcagtctttgaggaaaccttataaataagataataactttttcagagaaagaagctggggttctgagacattacccacttaggggcacccagaggaaagagcaagacctccagctccatcaccagtaatttccagcctgtgagcttccctccacactcagtaatttaaaaaacaacttgatttagggacatctagtaaatattctagaagttcagaggcagaaaagctagtttgcagctgaagtactcagatttcccactggctgagtgggaaatcagacccgagccttgacagtgggcagaatttgtatagaggagccaagagaagaagagtttccacactgtataagccaaatgatggaaggtgtaataacaaaggaagggtgagcacacaggtttaggagatgctgtgtgggccagtccagctgggagccattaccatttaacacttaatggagtgcttactgtgctaggcactcttctaagttcttcacaccttttaactattcttatcttcacagcaagcctttgcaggagatattatcaagtccctcctgcccccactttttttagaaacagagtcttgctctgttgcccaggctggagtgcagtggtatgatcgtagctcatggtggcctcgaactcctgggctcgagtgatccttttgccttagcctcctgagtagccaggactacaggtgtgtgccaccatgcctggctaattttttttccccatagaaacaggaactcgttatgttatccaggctggttttgaacacctggcctcaagcgatcctccgccttagcctcccaaagtgctggggttacaggtgtgagccactgcacctggccttcattgagggatgaggagactgaggcacatagcagttaagttgtggaactgtgattcaaagcatggccaccaggatccagagcctgagttcttagctactctgctgtcttgttttctctctactgggcaatgcaggttgcttgttagaggggtgatgaggattctcaaattgctggggatagcgagaggaagatgaaaatggcaggggtagtgatagaaagatcaaaatggcagcagcacgctggccaattttacaagaggaaacattaggaaagaagagaagagggagtttttctcagctaagcaggatctggtcagtgtaagtgggtagcaaaagatagaggtgagatgtaacaaatcaagaggccttgatgaatgactggaattgaagaagagggaatgagcaaaaatgaatctaagatttggagcttggttggctgggaggataattctgctattgcagaaatcaatgaggtcaatagacaagctcatttttccacagcagtagtgttgcagcaagaaatgaaggcttttgaagagcatatgcagtagagataccatatgcaggaaaaatggctcactggagagttgagaataaaggagaggagttcaagggagggaatggggatgattggggggctatctgcaaggagagaattgatgtgctgggaacagacgatttctgagggagagagaaaaacccagggccttaaaaagtgtccttggtcaagaagcagaaggagaaagaggagcaggaaaccataaaagaaacaggcgaagcaggagagagaggagaataaaaagaggaaaaaaaaaactactgaacagtgtcagacactacaaagaagtcaaggagaacaagagtgaaagggggacataagatttgacacggaagaaggccatttgtaccctgcacagtaagtcttggtgacatgaggaggtgaaatccagttgcattaaagtctgtggtattgctgagttcttcctcatgggcaagtccctggaccttttctaagcactaaatttgcaggtagttcaatgtcaagcagagaaggaagttggttaacagcacttggttgcatgatactacgttttgttatagtgacctaactgatctaacgtgttttgtctttcagcgcgttcgttcacatagctcccagttttaacatttcgccacctactgaagacatcatttgggaccaagctgatgagcccttgaagcacagcaggtgaggcaaggacctcagcttggtctttgtttcataagtttacacagctagcttacattcccaccagcagtgtgaaagtgttccctttttaccagatccacgccagcatctattattttttgtttttcagttatgtccgttcttacaggagtaagatggtatctcgtgcacttttaatttgcatttccctaatagagatgttgagcattttttcttatgtttgttggctatttggatgtcttcttttgagaattgtctgttcatgtcctttgcccagtttttgataggttctttttaaattagtttattagcttttaatataaacatgagaaaaaccacataaattgtagcattcttttcaaaataaaactgcaatcaatacttgaatgaatctccaagctctgaacttcataaacaatgttttttcttttctttttttttcttttcctttcttttttcttttttcttttttttttttttttaaatggggttgtttttatcttgctgatttgagttccttgtagattctggatattagtcctttgtcaggtgcatagtttgcaaagattttctcccactctgtgggttgtctttttactctgttgattttttagtttaattaggtcccaactatttatttttgtttttgttgcatttgcttttgggttcttaggcatgaactttttgcctaagccaatgtctagaagagtttttccagtgttctagagtttttatggtttcaggtcttagatttaagtctttgattcatcttgagttgatttttgtataaagtgagagatgaggatccagttcattcttctacatgtggcttgccaattattccagcaccatttattgaatagggtattctttcctcactttatgtttttgtttgctttgtcaaagatcagttggctgtaagtatttggctttatttccggattctctgttctgttccattggtctatgtgcctgtttttataccagcaccatgctgttttggcaactatagccttgtagtatagttggaaattgggcaatgtgatgcctccagatttcttctttttgcttttgttctattggctatgtgtacctttttttggttccttgtgaattttaggattgttttttctagttctatgaagaatgatgatagtattttgatgggaattgcattgaatctgtagattgcttttgtcagtatggtcattttcataatattgattctactcatccatgagcatgaaatatgtttccatttgtttgtgccatcgattatttctttcagcagtgttttgtagttttccctgtagagattttcacctccttggttaggtgtattcctaagtattttatttgtttatttagcagctgttgtaaaagggatttaattcttgatttgattctcagcatggtcacggttggtgtatagcagtgctactgatttgtgttcattgattttgcctcctgagaccttactgatctaggagctttttggatgagtctttagagtttcttaggtagtacaaccactctggaaaacagtgtggagattccttaaagaactaaaagtagaactaccattccatctagcaatcccactattatctacccaaaggaaaagaagtcattatatgaaaaagacacttgcacatgcatgtttgtagcagcacaattcgcaatttcaaaaatatggaaccagcttaaatacccatcaaccaatgagtggataaagaaaatgtggtatatatacatcatgaaatactactcagccataaaaaggaacaaaataatggcattcacagcaatctggatggaattggagaccattatcctaagtgaagtaactcaggaatggaaaaccaaatatagtgtatcataagaatgatataatggactctggagactcagagtgaagttccactagggaacttatccatgtaaccagaaaccatatgttcccccaaaactattgaaataaaataaaaattaaattaaaattttaaaagttcacacagctgcccagcgtgtgtcccactcaccggggccatcagcttattctgtgtatttctaagcatcttatgaacacactgattgttataaggaatccaaacaatatagcactgccacacttggggctgctatttgttttagggctcttttattatggaaagtccaaccgatatgaaaataacctaaattttctctgacttctcagaaattctcaaaacatcaaaatgtgccctgtcttttgatgctggttaccccttggtgggaatccaggatttccttatttcagtgtcacagctgtgagttgtaaagcatttcattcaccacaatgctagttacagttgattttatttaagctgccagatttggaaatgcacctcactatagcattagtttaaaaaatttaggaaggggagaagaaatttgtatgtacaaatgatattttttacttttggactgtaagtatgttttttggttctttattcttcccaccagtttttctgggtaactgtaacttggtgtatcaacttttagaaaactcagaagacttaggagtatgtaagctctctcccttcccttcccacccctcacccccagcatagaatattggtaggtgaaactttattaaatagaatctgcacggagtagtcagaccttagccccacctaaccctgccacttgtctctgttactgttttctgttgctattagcatcttcattcagaaggacgagaggggagaaaaaaatgaaaatgaagttaattttgttcagcaaaagttaaagtgtctggctgaactctgggtagctggttttggagttgtatggggtttcatttattctccaggtctcttagtcttcacttgaaaatagaaactagagttcatttttcctgacaagaatgaacttaattatttacctagaatggttagtaatctgttcttattaccagaaagctttcttctgatctatttagtatcttttttcataagagtttgaatatattagcatgtattctcaatagaatctaatctttcattattaaagttcctaaatatcttatattactatgttttatcattatgaacattgactctcattgtttagagttttgcttctctaattatcttgggtgaaggaccagttttgtttttaatttccagtatgtcatggattgataattttataaaatacaataaaaatgatttactagaaaaatgaaatactagaaaaatgaaatttaaagaaactaaaaacataagcctgattaaacatttattattcttatagtcaacagacataaaattactctggcaagctgctgtaaaaaaattctaaaggtctactctcagtttctgtgcttattctgggactagggctggtctgcagagtccagttcgagttgcactgttggacagaatatatacaacttaggagactgaagttcagtagatactaatttcagaacatatcctcaaagtgggtttttggggactgtccccttcacatttcttgcatgtataaaaggcaagtgcagttcgggtacagtggttcatggctgtaatcccagcactttgggaggccaaggcaggcagatcacttgagatcaggggtttgaggcaaatttggccaacatggtgaaacctcgtctctaaaaatacaaaaattagctgggcatggtggtgtgcacctgtaatcccagctactcaggaggctgaggcatgagaattgcctgaacccaggaggcagaggttgcagtaagccaagatcatggcactgcactctagcctgggcgacagagcaagaccctgtcttgaaaaaaaaaaaaaaacaaaaaaggcaagtgcagaaaaaaatgctgtttacttaaactttttctattttaaaaaaaattgtaggacaatgcataaaataatatttaggtgaatatagaaaaagttgattgtctttctcccactcctctggttcttttcctttctctatacatcatatacatacatacaaacatatacctttacatggagaagggacattttttctgctatgaaaatggcatcataaacaatactctgcaactttctttaatattttgttacaacatttatccttatcaaatatgaatctagtggctctttttaacagttgcataatatcctatggtatcgttgtaccatagtttattcaattattccccagctgatataccttcaagagcattctaggtttttaccattcctaacaacactgcagttaaattcttgtacatatattcatgtgtatctactttgatatttgaaggatagattcctaaaaacggagtcagtgactcatgcatgatgtcagatgatactccaaaaaagttgcattgctgtagagtcacacctgcaaaatatgagagtacctgtttgcctcacccctgccaggtgttaggagtctttttaagtgttctctctctgcggtgtaaagtgatcactagctgttttaatttgagttcccctgattgccagcaagagtgtgcttcttttcatatgtttaagggcctgctggatctttctattcaatttgggggcaacaaaacttgacagattttattttattaggtcttttgtgtaccaagttttctgtctgtggtacactcagtggttggggtttatattatttgttcgttttagtagggtagaggacatgggaaaagaacaaagatacagtgttgagggttttttggtgggggggagatgtcttagttctgattttctttgtctaacatgttttttttcttcaagatcagcttacaggaaatccgtccctatttgtgtgtaatgtaaaaagggcacagggtggggcatctttatagcttggcatagtgtatatcgttattcaagattgctcaaagactatgcgttgccatgtgtacttttaaaaaattgaggtaagttcatatagaattaaccctcctcaagtgtacaattcagtggcatatagtacatttacagtgccgtgcgactgggacctctatccagttctgaaacattttcctcaccccaaaggaaactccgtccccattaagcagtcactcctcattccccttatccctcaacccctggaaaccacttctctgcttcctgcgtctatggtttcaccttttctggatatttcatataaattgagtcatgcagtatgtgattttttatgtctggcttttttcatttagcataacatttttgaggttcatttgtattgttgtgtgtatcagtacttcattccttattgtggctggataaaattttattgtatgctacaatatacaataatttgtttatccatttaccagttgatattagggttgtttccaccttttggctgctgtgaacaattgcccatgtgcacctagatgccaagttaagtcatagagaggcatgagggaagaagaaagacagctgaaaagaacctcccagggagcatcttctgtcttctagagccttcctctctctgtagttggtcatctacaggctctttaggaggctgggtcagtcgtggggccagatttgggatctgttttcactggcttcagtatcttcgttaaaccagagatagaccctccatatcacaccctctggatttaaaaaggaatttacatcccaccctcagggcactaggtctgctctagcctccatgggtgcagtggccgcaaggaacattcatggctattcctccatggttgttgcctctacctttagcatctgggttggagcttgtagaatgtggtgatcaggaggaattgtgcccacatagtacctgggcatatgacagtataggctcatttcccatctctgcagccttagtccagttatgtatctctcagttttctccctggtaaaatggcattactaatacttacatcatagggttgtagagatagttacatgggataatgtatagagagcactgttacagtaccatgtggtagtacttgataaatgttcatttcttctgttctcagtgcttctctgtcctcttctatctggtgcccaggacattacatacttcacaaggtagtattaagtttaaaatgagttgataatgcagaggaagtctcttagcaccatgcctgcaacgtaagtcaacactcactatagatagaaaggtaccttaccttgcagttaggatttctcattgggaaaatgccatccaattgattacaagccgtctaaagtgttttaagtggtaaagatttcacctgggtatattgagttgttctgcagcgtggtgtttattaccatagacacatcgggctaattaagacagccatgttcaggatagatgcactatcactaagatcctgatgtgtgagttgggcatttcccatcatgttagcacaaatatattaaagaaagttacttttatatcaaagtgtttgcatcccaaagaaaatacttgtacagcctaaagttctctttcttgtggaagctgacaagagacttctgtcttgccctccaaagtggtttagtatcctattttgagcactctttgggtgctgttatttagaaattctattttagagcaaatgggaaggattttataaaaaagggagaagcaactgtcctccaccatgctctctctcagctgtgtaacaagcctctctgagggtgaagtggatccccataatgtgggccccatgtgtgaaccttttacaaggttttcttgttgtaatggctgatataattaaaggagagagttcatgttttgtctgaaatggagcatgccttgagttacaatgttttgtttttctcaccaaatatatcctgactataatagcaaacagcttgtataagatttttacataaacatttgaaaaagcattcttgtcttcactgaaattttgaaagccttttaagaatatttgtagcacttatgtttttaaatgtacaggtctaacatgcagttgtttatttggtaaattcattccatgagggtgctttgaatctacctccaacctctcacgggtctcccagacttcccaggaaccactgcttgacagctggagagacagcaggtgaaccagggtctcactgggagggaaagacgaggaaaccccaaagggacagctttctggagaaaaatgcctggctgtgaatgcctcttcacctccatcccagatacacacttccaggatgtgcaaattgagtcaacatcatgtctgtagaggacaacaacatgtcttttgttagtcttgacatttctttagccctaggcctctcaagttttggatatgtgatgctcaagaaatgcatttacaatttgaaaacctggtgctcattaagtaattcttttaaaatttttttcttttccttttgaaaaattcaaacctagagaggagatgaaagaatcatatgaagaacatttatataccctttgtttatatttgccaattattaatatttgttattttgtctctgaatttatagttttgtatgtgtgttggcaagaggggttcattttttagaactatttaaaagtaagttgcagacttactttcatgacatttttccctgaagacctcagcatcatttctgaagaataagaacattttcctacgtaaccacaatcctgttataaagtaagtcttaattgaaaacttcagacagaggacaaaagagtaaaaaaggcagagattgaacaaagctgtaattgaacttggaaagtataaggagaagaaatatagggaggtaattagaactcctgtttggttccttaaaggataaattttgtatataccagcaaatcactcaatgaatgcagattttcttcaaatatttactttatctagtccaaggagtttctcctggtgctctgaagtcagtgttttggccagggttataagcttttcagcctgtaaatacatttcttcagcatcatcaatctaaaacctgagtgaccacatcctacttagacttgtggttaggagcaaattttcaagggattttgctggtgccattaccttgagaacatgggaccttcagttattacagtcagaaatgtttactaatgggcagttagtgtaaacatgggagtcctttcctgacatttaatttaggtttgagtaaaagctgatgtgttagcacactattttgagaaataattttacaggcttggcaaaatgttaagcttgatgtcatcacagacttttgcagatttaggcttcaggagtcagcgcaagaaaaaatgctactcttataaaggctgaacagcaggaacaaagttaagtggatggcatgtagatgcatcactaatttgtctattttaaaacaaagatatacattttcttgataccaatagcttatagaacattaaacaaattaaaaggtttatttggactgtttccctgaaagcctccttcttcggtaggatttaatattttgccagaagaattatgtttggggatttatttttcaaattttttaaaaaagctattttcactaagctttgggaggggaaccatattaagctgtctgtctaactaagcacatcaggcatcatcatgtcaagaatgagaaactatgtgtttcctttaacagcagtgtatgtcatagagatgtttgacccatgatttttcatgaaaaggtccattttcagtaaactcttgtgcttacctagtgtcttcaatgtgataactggcttcccactgatcaggggtgagatgcatcacagagagtttgaaactacacattttgtcttttatttcctttttctttttactctttcagccttcagtggccatggagattttttattttaaattccaattttacatatcaaatttacaaactgtgacttttaaaataattgttgtactcttttctgtgagtgaattttaaaaagcatttaatgtaaaatgcatgtgtagtttcttgtgtatcaaagccatgcttttccttagatcagcttaatcgtctcctgtttccaatttgtgttagaaagttctgtgtgaaatgtgaactctagtttatatacttactaacagttaatgcgtgtcccttgggataatagctcttgagctatctttgtggctgtcttacgtagaccatttgaatctttctcctttaatgccaagtatccacttttcacgtgtaaattggagatgtcactacctgcacttggacaccagtgtgtgcatgtaatgttgattggtgtcatcatggtttttggctactctgtgataattttgtttttcagaggcaaattttgtgaggccaaacttcggagattgggtctgtacatcattcattctttcagtcagtaaacatccatttagtgcctactctgtgtcagtgctagtcaaaaaggaacagggcaggattgctgtcctggaatcatgtgcacgcatggtacccatgaatgggtactaacaacacaacagccacttgaatggcctgggaatggggcgtggggatgggaaggggctccacagataggtgaattggtctgtaaaagtcatcgctgtacaaatgaatcccaaaccaaacattgaaagaatgcacagtagattcccccagttagggcagggtcatagagcattttgggcaaagagcccatacaaggccatagaagcatgaaacatatgccacattgtatgaatttcaaataacttcatataatgagagtttgggaacatggagaaggtagtggaggaagatcagactaaaactgattatgaaggaccttacgtaccatgccaaggaggctggccttcatcctgtagtcagtggggaacaacttcaggaatctcaatgcagaggtttcatgatgaaatttgtgctttagaaatattctcttgcagcactgtggaggtacagataagtaggaatggaatccaaggcgagagggtcactctgctcctacagaagttcatggggcagtggcagtggggagataaggagatgatggtgctgagagccagttaagaaatagaatcctcagaacttggtaactgattggttatgagtattgagactacatgggtgactacatgagtgatctcatcagtatataagtatataagtgctcaattagatcgtgagatcaaggggcgatattaatgtaggaaacagagaacagagagaaccaatgatataagccctaggaagtggacttttaaggaggaagcaaataaaaagaagctttagaaggaatgatctgagggtatgaggaaaacctgaggatagggtgctccacgaacccaaagcaggaatctgcagaaggagggagtagtcaagaatgttgaatacttcagaggggtcaagcaagggttccaggatgtgtcaactggtaggttcagtaatcctagcaagagcaattagtgggtggtgaaaaataagaaatgagatggttcatttatactactctttcaaggagcttagatactaagggaaggagagcaagagttgtcaaggaacatttttttaatattctttttcaaggttaaaatctcaagcaagtttacatcctggaggatagatataatccattagacaggaagaagaaggagataactgatggaataatgtctctaagcagatctgatggcacgtaagctagaacacatggcaagattagctttgggctagacaaaggacaactcagtttttaatagatgggaacaaaggaggaaagactgggtgtggatatggataagggattgtaggtcttgaaagttggaagtttgaggggtgtagtgtccatgaaaataagtgcttagatctacagctagaagcgtagttgactgatggcccaactgctgcccctctgcagccacccttgcattgtactaaactacaaattgccactagcgtctcccagtcatgaccaagcacaataggggctcctatttcaggctcattcctgtgggacacaggacttttccagtgggccaaattggctcaagaactcctattggcctgagcagacctttcttggaactgtgttggaatccaagacttcctagccattccttcttcctttcctctccatgtccataggtgtggtttgaaggacctcccacattctgtggcttcctttctcaatatatcttttgtatttctagttctatcttggtacttgcttctgggtagacccaaactaacataaagaatttggtcgaaatgtgtatattattaaggtaatgctagctgctgtaaaaataacttctcagttcaacaacatgtacatcattcagacagaaaattagtaagaaatgcaggacttgaattgcatttttggccaaatggacccaatagacatgtacagaattttccatccaacagcagcagaatgtaaagtttttctagagtatacatagaacattctccaggatagaccatatgttaggccacaaaatttaagattgaaattatgtctagtatcatttcagatataacttcaaaccacagtggtataaactagacatcagtgacaggaggaatcttgaaaaattcacaaatatctggaacataaacaacatgccccagaacaaccaatgggtcaaagaagaaattaaaagataaatttaaaaaatgccttgagacaaatgacaacggaaacacaatataccagaactgatgggatataggagaagcagttctgagaggaaagtttatagcaatatatgcctacattagaaaagaagaaagatctcaaatgaatagtgtgacattacacctcaaggaactagaaaaagaacaaactaaaaccagattagtagaaggaaagaaataaaaatcagaacaaacataaactaaatggataatagaaaagccacaggaagaatcaataaacttaagagttgggtttttttttaagtaaaattggcaaacccatagatagtctaacaaagaaaaaagaaaactcaagtaaaaccaaaaatgaaattgaagaaattacaacagacacctcgggaataaaaaggatgataagtccctattacgaacaattatatgccaacaaattgggtggcctagaggaaacagataaattcctaggaaaatacaacctaccaggattgactcaggaagaaatagaaagcctgtaacagaccaatcacaaatagattggagaagtaatgaaaaacctctcaacaaagacaagcccaggaacagatagcttcacagctgagttctaccagacattcaaagaattgataccagtacttcttaaactcttccaaaaaaatagaactagaaggaatactttcaaacacattttatgaggccaggatcaccctgatacccagccagccaaagacatcacaagaaaagaaaatttaaacccaatttctctgatgaatattggtgcaaaaagccccagtaaaatattaggaaaccaaatccaacaacacatcaaaaagattacatgtcatgactaagtgggatttatccctggcatacaaagctggtttaacatctgcagatcaatcagtagtgatacattgcattaacagaatgaaagataaaaatcacatgataatcttaattgacacagaaaaagcatttgacaaagtccaacatcctttattgagaaaaatgctcaatagtgtatgtatagaaggaaagcttctctatgtaataaaggccatttatgaaaaacccacagctaacattataatacatgggggaaaactgaaagtttttccatgaaggtctagtatcaggcaggcatggatgcccactttcaccacttctattcaacatagtactggaagtaccagcaatagtaattagataaggaaaagaaattaaaggcattgaggtcaggaagaagtaaagttatctctatttgcagatggtgtgatcctatattgtagggggggaaaaaagcccctgcagattccacacaaaaaaactgttagaacaacgaatgaattcagtaaagctgtggggtgcaaaatcaacatgcaaaatcagttgcgttttttttcataccaattacagtctgtttgaaaagaacatgaagaaaatggtcccacttaacaaagcatcaaaaagaacaaaatacctaggaataaattcaaccaatgtgaaagatgtgtacactgaaaactataaaacattaatgaaagaaattaagcacaaaaaaatggaaagatatcacatgctcatggatcagaagaattaatattgttgaaatgtccatagtacccaaagcaatatacagattcggtgcaatctctatcaaaattccagtgaccttcttcacagaaatagaaaaaatgcttcttaaatttgtacagaaccatgaaagaccctgaatagccaaaacaattatgaaaaagcaaaacaaagttggaggtattatacttcctgatttaaaaattatattacaaagttatagtaataaagacagtattatacaggcataaaaacagacacatagaccagtggaacagaatagagagtccagaaataaatccacgtatatatagtcaactaatttttgacaagggcaccaagaagacacaatgggaaaagaatagtctctttgataggatgttaagaaaactggatttccacatgcaaaagaatggaattggactgttatcgtataccacatacaaaaatcaactcaaaattgataaaagacctaaacataaaagcagaaactataaaactcctacacaggaacataggggaatagctcctggacattggcgttggtagtcagcttttggatatcacaacaagagctcaggccacaaaagcaaaattaaataaatgggggctgggcgcagtggctcacgcctgtaatcccggcacttttgggaggctgaggtagggggatcacaaggtcaggagatcgagaccatcctggccaacatggtgaaaccccatctctactaaaaatacaaaaattagctgggtgtggtggcgcacacctgtaattccagctacttgggaggctgaggcaggagaatcgcttgaacccaggaggccgagattgtagtgagccgagatggcgccactgcactctagcctggaggacagagtgagactccatctcaaaaataaaataaataaatgggactacaccaaactagaaagtttctgtacagtaaaggaaacaatcaacaaagtgaagtagcagcctacagattgggaaaaaattccaatcagtatatcccaatattccaatgtacatcagatatattgtaaatcatgtatttggtaaggagttagtagccaaaatttatcaggaactcatacaactcaatagcaaagaacaaacgaattacctgatttataaaatgggcaaaaggcctgagtagacatttttctaaagaagacacaaagatggccacaggcatatgaaagggtacacaacatcatatcagggaaatgcaaatcaaaaccactgtgatttacctcctcacaactgttaggatggctgttatcaaaaagtcaaaagataacaaatgttggtgaggatgtggaggactcttgtccactgttggtgggaatgtagattgggtatagccgttatggaaaacgttatagaggtttctaaagaaattaaaaacagaactaccatatatgacccagccattccttttctgggcatatacccaaaggaaatgaaatcaccacctcataaagatgtctgcactcccatgttcactgcagcatgattcacaataactaagatatggaaacaacctaagtgtctgatgatggacaaatagagaaagaagtggctgtaagtataccacatttggtttatacaaaatgaatattattcagccctagaaaataatgagagcttgtcatttgccacaacatgggaaagcccattgtgctaagcgaaatacgccaaagaaagacatattatatgatcttacttatatgtggaaccaaaaaaatttcaaatatgcagagagaatacaacagtggttaccagggatatgggttgtgggcaggaaatggagagatgtaggtcagaggatacaaagtagtatgaacaagtatagagatctaatgtgcagtatgaagactataggtatgggattcatgctaagtgagattttagctgctcttaacataaaaacaaaaatagggtaactgagatgatggatatgttaatttgcttcactacagtaacctttttactatctatattaagcctataacatcacgttgtataccataaatatacgtaataaaaattatttttcaaaataaaaaaatacaagataacttctcaacatttcactgttctaacacaagtttcttccttattcacatgaggtcttaaatgggtgttgatgaatggtaggtgacattttcctcctggaaatccttcaggaattcagattccttccatcttgtagtttctccatcttcaccatgtgactcccagagttactgtgcttgtttgcatcacatcaagagagggggaaaaacatggcaggttacacatggaaggtttttatggagtaggcctagaaattagcatagaaattaggcctagaaattagcataatcactttcacttatatttcgtggtagaactcaatcacatgtcaccaactagctgcaaaggaggctggaaaacgtggcccagctgtgcaccaggaagaagacactataagtttcatggaatagtccctgtgggaagtgggaggacacagctaatgctatgaggcctggatttatcacactgtacgttttatgtgagattttttttttccccaggagcttcaacattgagttcactggtgaagttgctgagaaagcaggtggttgagtttgaaattcagaatttggaggttcaaaactgaatagttttaaaaggaaaacttgggcaagtctccgttggaaaatgtcttttcagtgtttcggtacattttggggttgatatgagaagggcatagtcacaacatatgtcactctgtgtgttgctggttttgggtcctgcacctggacaaccaaacaggactggccccttcgttcctgcttcacgttggacccttcagtcggagatagtatgacttacagagggagagatgttttcaaaccctgtgaaaccacccattgttcagatgaaccatttatcttgcacttttctctaatacaaatgaatgaaccttgctgcttctagctagtacccttattcacctgctcttctggtggtatgcaatgctcattacattttttgcttttgcaaatttgtctcattgtgtttcctttgcttaaagttggctgttttcttcttccctcttctcttcccttaaatcattgtcaatccaaatcctggacaacctgtcctctcaggcccaactcaaatgccatctcctctgtcattctccccatttaccacagttgagtgcctcctgtcttcctgacactctttgggtctcagtttcaccactcaggtggcccatggctgccttgatacttctgtatgagtctttcacctactagatttaaaacttgatgatagaactgtgacttcctagtacttacttgctcttagcacaatgtcttacacacagtacatttttagtaaacaattgttgagtgaaaatgaataaatattgcttattgtggagcagatagaatgaagttcagtttggagaatcagtcttgtgtggccacagatcacatgaggaatgtaaaaattaaataaataaaacaagcctaagataatgtgttagaaggggagaaaggcctgtaccgattttttgcatctctaatgatcatagagatatgatttgtattatttatgtgggctagaaaaggggatctctattagggctctgaagtttgtgaaggctccagccacccatctgatgttgaaaaagtcaattgattgagaacccactgtatttacaatcttgacttattttggagcgttaatggaggcaaactgagatttgggttggttggttgtagggagtataagttatatcaatgctcaggggagtagttttgagtttgaaacattacaataacttcttcaggcttttaagatgtacataaaatacttgtaagtggatgataatgaattgacaagagacctctttatacagctagaatatatcaagttgttacttttctacaaatctccttatagattgggttttgctggtactgtttttatggttgtagttgtttattgtaggataaaagtccaagaggaaatgtctcttaaatataaaatgtatattctaaatataatatatagatactatgtataagctatttttctgctctaggtcctttttattttcttaaagccaaacatattgtgtgtgattcaaacaggtagagagcaattaatttaaaagtggcctaaaacccaccttcctctactacctttgaggggcattataccattatatgatccaggatttatatagcagattattttatcactactcccttagagcaaccaatcaatcagcttcattttattaggatgctttaatatacccattttaaaaatgtttatttaatatttttaagtaatttttgaaaagatctaggaagattcacatactcattttttcatgaacaaattatgctgtatacttaattgagtctgtctgtagggatcatttatttctattcatcaactctttaccaagcttcatactagatattgagatgatagtctattgattttgtttctctctctcatgtttttctagtatgtcttatcttttggggtttatttctggccctggagatcattcttttatgtcagttctcagctagttgtgatttgttgctaaattacctgcattcaagtttttataaatgaatgtagatattttgaaaactatttcttttaggatactaaacagtaagacaaagatacactgcacaattgtgtacaaaaggtcttttggaatatgacttctttgttaaaagcaatttgtgccatgatagtttaaaaaaaatagttcggcaatgatgttttcatttatgactatgtacatactgcatttgagcagagagaagttttttattatgactaaggcctctgtgtaaccaacttcaggtcaaatatgaaatatatggtgtaacaagtgctgtgttttctctttaaaatacacttggattcttccacgaggtatattaaaaatgctttgacatcattatttcatcttgagttaccctttcattcactagcttggttggagaaaattaactcttcaatacatgatacagaaaatctgttgatgcagcctccctccagttcttagtatttaatttcatgagggacatagcacttttccccatgtaattacagattggtagagttgagcaagaccttaaacatcctgaagtttaacacccatcaaatgcagatacctcttctaaggtatcctaatttctatatcgaaaataattctaattatcagtttacttggcaaatctgccataataaagtctttttcaaagttatctatgcccagttcccctcaatatttctcataatattagttccacagtcattctgatctcactcctttttgctttctccagtttatcagaaagttccttaaaaggtagtggacaaattatagaagtacctcccttttttttttgaggcaagatttcactcctgtcatccaggttggagtacaatggcgcaatcttggctcactgcacccttcacctcccaggctcaagcaattctcctgcctcagcctcccaagtagctgggtctacagttgcataccaccatgcctagctaatttgtgtatgtcttgtagagacgagttttgccatgttacccaagctggtcttgaactccttacctcaagtggtccgcctgctttggcctcccaaagtgctgggattataggcgtgagccactgcacctggccctaaagctactctttctgagcagtttgagagggactgtggcttatctggccttgagaacagtgtctttattaatgcagcctaagagtacatttttgcaaacccatcacactgcctgtattgaatcaagaggctgctggacctccatgtactgaccatacaggacctcacatttgagcctagtaaacttgactatattcattttggtctatttttaaccttgtgagaacttttgtaatcctgtttctggcatccctggtgttgtgtttttgtaccaatacagcttctggatcattgtctcaatcattgataaaaatgggcaaatacagactttctgtccagagtgataatcatatccattacttttgctttagataagagtgttgctgttgatcatctttgcctgggaagttgaatgataaagccagaagaaagcatgctttctgatcattgtaagttttacttttaaggaaagagactaaaaaaatttagcaggaaatttaaattttattaatatcatctcatatactttagaagatctaaaactgttaaaagaaacaaaatggtttacactggagcctggttataacctttctttggtagcccatagctgtggggcccatagctttggggcccaaagctctctttgatttgagtcagagaccttcccatgtgcccaggaattttgattatggcaggtgatattatcaagtcttcatcagatttggctggagggaaaagctgtctgtcaccaagttgtgtgaatctttgtattgctaaaaaggatacccgggcagtcttaaaactggtgccttatgttatttgaactttaaaatattgtgatgttcatgtttgctcaggctggctactccagttttgttacaacatagtgctgctcagaccatggttgaaagtttgatgctaaaaagcacagtgtatttgagcatagtcaattctaaaaaaaattttgttttctttcttccttccttctcctttcctttcttctttctgtcttgaaatctgtggattgaactttcccacccctggaaaaacaactcagaaagtatatcatgtgtcatcactatcatcttccttttatcagtgcaggtttatagaaagtgttctcatatcatcctgaatcatttctacaaactataaaacaaaattaactttccattacaatcctaacaattgtaataaatgctcctattagaagcttttacttccatcctgtgaagtatatcatgctgaggggaaagttgcatcttcattagtcacccatgacttactccaggtgttaccctctaagttagaaagagagagggcaaaataccctggtgacacatacgttttttaagggaaaaaattctgaaagcaaaagggttctctctttttttaatatgactagcaaaagagtgttgattaagatgtgtcaagcaggtgctgggtatgtgctaaactaatggttttcagagtactgagtggctatttttaaatgtttctatatcattctcagttaagctgctggatgaaaagtacaaaaggctaaaaatatttacagtttcagtaatgtctgttttaaaagaaaccatccgcgtctatggccacaccaccctgaacgtgcctgatcttgtctaaaagaaaccatcctgtgtgatttttctttatttccatttgaaggaaaagaatattatggcttacagagaagtggttgaaagcagtttgttcaacactgaggtttttaggaaaaaatggccatcaaaaggacagtaagttgggttacaaatcatcaggattaaaaaaaaaaagttgattattattccttgtactatattattattactatttttgtattattaactgtagttccaactgaaaatagtattatctttgaaactttttgtatggagttaggagacaagttgctggtatcagattacttgggcctatatctcagctctatcccttggatatgtgatcctggataaattgtttaacctctttgtgcctcagtgtacccatctgtaaaacagaataataatagtgccttcctgctaaggttgttgtgattaaatgagatgatgctctgcctaacatggtaagtactcagtaaatgtttgttatgcttatttttttcatttaaaaaaatttttggttaaatgaacacatttattctcttaaccatttttgagtatataactcagtaatattagctatatttacattgtagtgtaacaaatctttagaatttttcatctggcaaaactgaaatgtttattatgttttaaaagctcatttttcttcagagtcagttacacagctgtgtggacgtaacacaggaatgcaagcaccattggggcagggagtttagactcttctgttcactgctgtatcacaagtgccacaatcagcatctggcccataacagggctcaatcaatatctgtcgaatgaatgaatgaatgaatgaatgaacagtgaggcttcatttgacaaactacatgtgtgtttgaaaattatttcttaaatggtaaatccatttttatgagtgattttaagtatacatggaaagttgactcctttcggagggtgaagtgatttctaaaacaactgttttgtaattatttagcagttctggctttggtaggtcaacttttcttaaactggaaaaaaaaatagtattcttagtgtagattgcaaaaggaaagaggatatgttagatgatttgcccaaaatttaaacaggattcgctttttaaattcaagcctttttgctttcattcagatctggtcaccagacttactttttccttaaggcatatatgaatcatcttgttctttcattcagaaatcaaaagttcaggcctagatcagtatttaccaaaactggtggaacactacctttccactgagagtgcattacctttttttgagtctttgaaaagaatgtcagctgaacatggtctggaagtggccaaaactctgtgggtggggagaaaggaagaaataacctatctcccatttaaaaacctaccacctattaaataaacggcagtcttgttctgtggagtattcatttgggttatctattctgatgaacaaatacaaattcttggtagggttttcttgcttctggataaaatgcttagtgttgctttttgttgttcaatcttaggttttgtttcattttgtttttcagggtctcactctgtcaaccaggctagagtgcagtagcgcaatcatggttcgtggcagcctcagcagctccctgggctcaggtgattcccccacgtcagcctctcgagtagttgagactataggcacgcaccaccacaccctgctaatttttgtgtttgtagtagagatgggagtctcaccatgttgctcaggctggtctcgaactcctggactcgagtgatttgcccactttggcctcccaaagtgctggcattacaggcatgagccactgcgcctggcctgtttttatgatatgtattgaaatgctccaatagcattttatttttatttaaacattgctgttaggtagttggcacaaaatgtgtcttatgccaaagtttacttccttctaccaaggaaaggggactctgtctcctggactttgcagttatgggaggaagatgacaggaagctacatcatctgccaggatttttatggggccacatcacatacagtgcctgtctgtaactaagagcaagagcacatctctcctttcagctgatgtttagcaaaccctcactctgctcccatggcaaagacagtcactcatcttccaaattgtggtatcttgagtcatttccattatgacttgtcttctgaaaagtgataaaggaaaatcatcttacctagtcattttttcccattctacaagacaaagtttatctctgaatcaaagagcataaatctctgttgcctctctgagataataaaatatttttatatttaaattttctgttaacaggaaaatgtataaaaccttcccaaatttttaactccttcttttgattctatacctacataggtttttatttggatttgaaaccaaataaaagaccgtttcatggtctgggcccttgggacagggtagtagtgaagcagccagttcatttattcttcatctgccctgccatggcttcctgttgcactaagaatccagcctcctccccggagttggtgggagtctgctgacctggccccagccaggctctctggcctcatgcagccattttcccttcattgaccccataccaccactgtgaccaggtgcaccaggctcttcctgaggctgcttttctccctgaaatgcccaccccacctcccacttttcatttttctaactctcgttcatccttcacttgcattttaacatcacatcctctgagaagccttccctgatctccacccttaatgagcaccacccagttgtccatactttgctttctcctttctttcccagcccttattagaattttaatttcatatttggccatacatttgtttctttaatagttttctctcccattagtctatgagcccattagggatcacggctattttgtctgctgtatgtaatatccacttcctagcaagcaggacacactcaaggaagagttattgaataataatttaaaaatattttttattaaatgaaaaatataaatatccaattctaagaatgtgcaattctgtcaggagtgttaagtactgaaaaaacgacagcagattagttaattggttgatttcacaaacatctgtagattgttgacagtgcactatgatgtgctgttctaggtgctgagtacatgtggacgggttgttgcctggctttgcagaggtctcaccttggggagatagcaaagagacacaatgaggaataaaattagtgcctttctctcaaggagcatatgtattcattcatgtaacaaacatttgttgagcacctatgatatactctaagctagaagacacttgaatgtgatgagtataacatataagagagtaaaattaatctccaagaaagatacagaatgctgtagggatgaagattaagaaatgctgtctgattagggacatcagagagcatcctggataaagcagagaccgaagtgctacttgaagaatgggttcaactttgacagctgaagctatgagggaggaaattctaggcatgggaaccacttgggtaaaggcatggagatgggaagacattccagggatagctattaaccctttttaactgaagcatagggtggatgatggtgaataagaagaaattagactaaaaaagtaggtagaggctatactttaggggagtgaagaattcctctaagtttagaaaaagttgattttaattaccttaaataaggcagtaatggtactaatattgctgtttggtagcccttaggaaaatgatacttgtgacttggtacagtggctcacacctgcaattccagcactttgggagattgaggtgggaggattgcttgaggccaggagttcaagaccagcctgggcaacatagcaagaccccatctcaaaaaaaaaaataactgtacatggtggtgcatgcctgtagtcccagctactaaggaggttgaaacaggaggatcacttgagcccaggagttagagattgcaatgagctatgatgaccactgcactccagcctgggtaagacaccatctctacaaaaaaaaaaaaaagaagaagaagaaagaaattgatacttgtttaaatatattacatgtcaaatgtactacaacagtcctctccaaatgagaatataaagagcttcatccttgtaaactgcagtcatgttctcgttatagtggtagttagtatgcaggtcaataatttatatgtggtctttagctttgtctttttcattaaacagtaaaaacggtaacctgacatttgaaggtttttttttcacatttgtaatatcaaaaacttgattcgtaacaagtatcgtaaatttacaagtatgtttttcatgcatattttaagaaaattttcataggactttaacgtcaggtttcttttgaatacttccacatgctctacctaacaattttagtgtaaagtttcattttccttatcaaattctatgtaagtgagacattggtgttttagccaaggtaccctgctttatggagtatctgtgttcctagaaaatttgttttgaaatatgattttgtaaatcagattgtattgtaatatacttggtgaccttttgcttcaaatcaccttaaaataaattcatttatattatctaattcatattttataaatcctaatttttatatgtactcatttttcttgaattgggggtaattctacaaacaataaacaaggtaaatgatttttttttgccagtttgtactaagagaacatgttattttgtttcgggtgaatgtatgtatcttaatacactgtactacattagacatcaatagggaggaatgtaacgcatttttcttttgtatggaaatctgttgaaacctatcttaaagagttttgagcagaaattgaaggatgagcctgaggttttctgattagttggagaatattgttttcagtagacaacagtaagaataaaagtggaaaaattgtatttaaaattgatgttttataactttcagaagttgatgtctccattttacacattatacttataaaagtacagtaatcaactctgctttataactgttttgtgaagattatttaaaggtcaagggagtgtagtagaggcacagaaaaacagaataaaattggaatcctagagtttatgtgcatttaggttaattttgacttagtggctcctggctctcaccaatctgggttgagtgaaggacccactgttcattgtgttccagcagtagtcactcagacccagcttgccacgttatcagtccaacttaacttctgccacgtcccactcctcctcccttgatagcttctcttgctgacatcctttccacccctttgtgctgcattcctctggcactgccagcctcctgtcatggaatgagggtctgggccaggagacctttggagaaaattcctggagagcaagttttcatagatttttgtccaattttttctgtttccaccctgttacaaatattttaatccaaatatgaaaaatctttaaattcagacttctcttgtttcaaattcagacttctcttgtttcaaattcagattatttctgatcacctcatagctagttcttgaagttcatcttagcaggaacagagctaactaaactactgaatgatgtaaatgaacatataaaggctatgtttacctacttaagaaattgcttttagccagtttagaaatgtctgcttactcttttgtttttaaatttaaaaaattcttcagagatgggatctcgttctgtcaaccaggccggagtgcagtgccaccgtcacagttcactggctacctcagcctctggagtagctgggactacaggcacgcaccacaacacctggataatttttttaaattttcttgttagaaacagagtctctctatgttgccctgactggtcttgaactcctggcctcaagtgatcctcctgccttggcctccaaaagtactgtgattacaagtgtgagccactgagcctggttgaaatgtccacttacttttaaaaatgaattgtattttaaggaagagtttgcaatgcttaaataattttcatcagtttacttaaaaagtactaaagcctttttttttttttaagacagaatctcactctgtcacccaggcaggattgcagtggcatgatctcagctgactgtaacctctgcctcccaggttcaagcgatattctcccacttcagcctcccaagtagctgggattacaggcacctgccaccacacccggctaattttttgtgtgtttttagtagagacagggtttcaccatgttggccaagctggtctcgaactcctgacctcaggtgatctgcccaccttggcctcccaaagtgctgggattacaggcgtgagccaccacacctggctaaagcctatttttaaagcataatttatattaggtattgttaatccttcacggttcttgtttggttaatttcagcagcttaaggaagatcacttggagctagaaaggcccatgagggtgatgatggctcagagggggcaatagaagcagcttttagggaggagtcaagtgcagtaggtaaacatgggatgtgtcagatatgataccagccagtggtccccatagcacaggcagcaagtgtgaggcacagcacagagcacatgtacacgagtatttgtgtgcgtgtgtgcgcatgtgtgcgcgtgtgaaggggggagggggtggttgctgtcaggtgagcaatatacccaaatggagaccccagaagcagctgatactaatccatccaagtaggcagcagtgtctgtccatgagaatgttgggcccagccattatccaaggattctagaccagattctggagagatcacagcagagtttctgcttgacttcactgagcttcagtgtttgaatctgtaaaatggaagcagtaatagtaattacctcaaggggttattttgatggctaattgaaaacatgtatgcgaagcccttgaataccatctggtacatagtaagtatttagtaaatgttagctattactgtattacatgaaattgggaagacagtatttctttttaaatgtcctataaataaccgggtgcagtggctcatgcctgtaatcccagcactttgggaggcccaggcaggcggattgcttgaggtcaggagttcaagatcagcctggccaacatggtgaaaccctgtccctactaaaattgcaaaaattagccgggtgtggtggcacatgcctgttatcccagctactcaggaggctgaggcatgagaatcatttgaacccaggagatggaggttgcagtgagctgagatcatgccactgcactccagcctgggcaacagagcgagactctgtctcccaaaaataaaaaataaaaaatgaatgtcctatgactgaggtttattgctcctcaattgagctattccaatcaatgaaattttactacataaaggtagatgccttctaatggttttcttcccacagggatggtggggtgagatggggaactgttcaggtagtagacctgttcatgaggaaaaaaactatttaaatgctgagaaaaggatgctagcttttttggatccatcatcatttttgccaaattcatagaatttttggccagtggtgtcaaactttaaaattcataggaaaaagagattcagtaattactctgtaatattagggagggtgtggaaataaggaatgaacgttatgtaaagaccataatgctagtcagagaatgttccaatggaaaactgatgtttccttctgccaccaggacaaaacttttgtgatctaaaggcaaaacaataacaaaaacagcaacagcaacaaaaaccagcctaacagtcccaagtggtcttcactgtcatgattattaagcattttctccaaagtctgaactacagtttgttgaggtttcattgaaaatgatactaaaacaaatttgcttaaaagtaaaatggagttattggcatcacaaagatcatagtcaccttcttaagaattgcataacctttaatgactgtaaaggatttttaaagacgatccttgcgactagttattaatacatttttttgaggctgtggaaatcagataatttgggccgggcacattggctcacgcctgtaatcccagcattttgggaggctgaggcgggcggagcacctgaagttgggagttcaagaccagcctgaccaacatggagaaaccttgtctctactaaaaaaaaaaaaaaaaaaaaaaaaaaattagccgggcatggtggtgtatccctgtaatccaagcgactcgggaggctgagacaggagaatcgcttgaactcgggaggcggaggttgcagtgagccaagatcacgccattgcactccagtctgggcaacaagagctaaactccgcctcaaaaaaaaaaagaaatcagataatttgcccaaagtcaacagcccaaagtcaacaactcctgaattttttgatcacattatctttcaagtttagttagaacctgaaagttaactgtccttcacttaggtagatcataaataatgcactggtcacattgtgtagatattaagttacactttggtagatggatttttagatattgaaaatgatagattggtacaactgctttgaaagtttggcagcttcttataaagctcaagataggcttaacgtacaattcagcaactacgcatctagatgtttacccaaatgagttgaaaatttatgtctgcagaacaacctgcatgcgaatcttgatagcagctttatttataactgtcaaaaactggaagcaactaagggatccttcattagatgaattgataaactgtggtacatccagataatggaatattattcagcactaaaaagaaatgagcaatgaagccacagaaagacacaaaggaaccttaaatgcatattgctaagtgaaagaagccagtctggaaaggctacatactgtacgatttaaactatagaaaaggcaaaagtcaaaaccatagagacagtaaaaagatcagtggttgctagttcagggaagaggggacaggatgaacaggtggagcacagtggattttaagggctgtgacactattctgtatgatattgtaatggtggatagataggtgtgtcaaaacccatacaactgtgtaacataaagagtgaactcttatgtaaactatattgactgttatgactagttaatcctatatcatcattggctcattaattataacagatgtaccatacttgtgcaagatggttaataacaggggaaacggggaagagggaacttttggcttagtttttctataaacctaaaactgctctaaaaaatagtctactaataaaaaaaaaaaaagaaaatcaggatagattgtagcttagaaataaaaaaacaatactccaagacaaaacaaaacaaaagccttgtataatgtctttcatataatattccccaccttatttctctagttgttttttaatttttttttcatttatcttatgtgttatctcatcaacctttagtaacgggcagttaaaaaaataagcagtttggcaacttcctgtggcatacatttcagattgtgagcagagatgcccaccatgtgactggcaggtgtccctctccctagccacaccctgtccctcttttccacctaccctagcattagttgtctcctaccttgcttttgacaacagacagggtgaaaatgtgggcttgtggccattgtgctaaatgttttatttctatgtattttttaatccttacagcagttcccattttgtagatgaggaaatgagagcactggaagagaggaaattcctacccttgcagtctgactccattctgatcctctatcaggctaatgtgaacacacgtgactctctgtcccagcctgccccctgttgagtaggtgggagggggagccatttggaggatttggtcccagtccaggtgctatttaagtgagcggttgattttagctgtggtgaataccaccaccctacaggctagtgtctgccattgagaagtatcatctcatcattttcaatctattaagtgatacattatcacattattattatacatatatattattatatattatctggaaaccatataactataattttagtcaactcttttttttttttttttgagttggagtctcgctctgtcacccaggctggagtgcagtggggcgatctcggctcactgcaacctctgcctcccaagttcaagcgattctcctgcctcagcctcccaagtagctggagactacaggcgcacgccaccacgcctggctaattttttctatacttttagtcaactcttaatttctagcctcatattgacaagtgatagggttcaaaagtaatatctgttggctttggaaataatattatatttagtattatatttaatggaagttagcagatttagcttcttaataatgtttggctggaggcagtattaacctttggttgctgtcttgtggcctgcagatgtttgtaatgcaagagataggaatttggtccctaggagggtaaagctaaggttcactctaagaaagccacaaagcagacagtctacatgttgaggattaaatgttgattttacgtgggtcatcatttttaaagtccatttgccttcttattttgtgatgaatatttaagattttgaagtacatctcctcttatttgctttgtagttcttatgaggaagaattcccattatagtggggctgaggagataaccattatttttcgttatgcttgttttcttaatatcgtaaagcagacaatagcaggatatttaatgaaatacatcatgaatttaatcctagaccaaagcaaagtattttcaagtatttttcattttcacataaattatattaaaattcatatttaagttaaaatttttgagacagtttacttgaaacatagtagcattcttcactgatgttagaattactttataagttattttgcatttcttaggaggcaaaataggttttcaaaaggattaacatgtgttaaactttttgatatttcattaaaaaagatagtattggaaaaatgcagtattttttcatttacttccaaatgttttgtattaaactttttttgacctagtagatgactagtacaaatagaacttttaaagattaggatatacctgttacttgtaagatgaatttttttaatgcttaattcaaataataaaatatatctgtttttgtattttctgtaacaatatagaagtagttctcagatttctttttctataagatgaatttttagatctttattttacttggcaagtctaaaatagtggtggttctggggttgattcatgtgttcgtttttcctactgtttggctaattcttgtatgtggttttaatttttttaatagcaaatatatatttctgtatgtgaatagtcagcgtgtgtgtgtgtgtgtgtgtgtgtgtgtgtgtgtgtgtgtgtgtgtattcccccccccttactatggagatcatgcatgtcagtgctgagcttggggaaaacagaaaaacaaacgtgacctttgatcccttcagagataacataatctcttagtcatataaagataaggtccatctcttagtcatatagacgagatttatatcttagtcatgtatggctatatacataaatatgtgcatattgccagagattattaaagcatgtacatgcatacataaataatttttaaagtgaaaagagaatcctcctataacaccttacagggtggctatgttcttttaatgtttcatggggaccttgctgtaattttagagccagcacctggctcaggttcacccatgacattttcagctgatctttcgcttgttttctagttgaccttcaaacagaaagttcatagcctcttctcagctgttaatgtgatttacttcttatgtctgggaagtcaagattgttgctgaattcattgttttaaggggattgaggtccttggtttaatgccaggacattcccagctgacagaaaactaaatccgccaaccctaatttcaaagattaccaggtttgtggctcgtggacatcttagatcctaggtcgagcaactcttaggctgttcctggcacaccacatacatatggggttgtgtattgattttaattcaagtatcattttagcattgattggcaaacaccctagtggctttcagtcagtaaaattcagtgcagcagctaacctgctgctgctcctgccttaaaatcagtatttgagttagtggtcgtttaactttgcaattttgactctgtgttaaaatgtatactttttcttaattttcaaaataggaagtgaggtgtgctcttcaggttcttgggctcacagcagggaggttatgaaatataaatgaaaggagacactagatgagctccacacaaggcagtatcacaactcactcccccaagaaggaagcacatcatcatttcttacaccgtgagaaacagccatcttgtcacaggaaaatgagattgaagaattagtctgattaaaaacaaattaccagagttgctgttcagttaggtggcctgcagaatattagcagctgtggttggaaagccatcaggagtttctctcaagcaagaccaagctggtttccttagatccctgtcttgtgtcccagcctgttttatgccttcaccaccctcactttagctttttcccagtaggaaacaatggcaaggtagaggaagagtttttaaattcattcttattaggagtgagtttttttctttgtagatattagtaatctaaaagtagaagtagtgtaaatattttttacagcatataattcaattgcacatcagcagttgcgctatctgtatatgcaaatactctaagaaatttaatattttatcaaaagccacaactccaaaaatgaaatctaatgacttgtttctatggtaaccactatcgaaatatgtctagccagtgtgtgtcttcccataatttttctctaagagtttcagggagttcattaaatttgctttcccaacatagatagatgatcgatcgatcgataagagagaacagatacatttttccccctaatggggttatgagactattataaaattctctttagcttcgtatagagtatgacttcattcttagacatgaatgtatttggctaagggacaagcctattgttttataaatttagtttaaaccagtaataaagccaggttagtaataatttctaaaacgagattaatcttgcttcataaatattttctggtatttatatatggaactgttggattgcacacacattgatttctagaatgacccatgtccttttaaaattgaaattcatttgctgttcctttgagaccttgttagatttctttattgctcgtccaccgttgtctttgttatctaccagggcgttgagtgtctgtccaccttgatggagttctgacctggatttgatcaacatccccttgtggcctttcttccttgtcagaggttgtgtgctgcaaatacaatgaaagtcacaacttatttatttagagatcttgacatttcccagcaggttcattcagaaaagctgactacagtgtttccagaggtacagaagagattccattgcattttacatttaagagaaagtaaactattggtttggtaaatttttcaccagtctcaaggcctgtcatgtcacaaaacaaacagatgtggtcagatattctagtgatataagtgtgcattcaccgtgagtattaacattatggcagggttcatggaattctctggttacattcaaagggaaacattttgtaaagtaaagtggcaggaaatagatactgaggaaataaaactacactgggtctgacaacctggaactttcatttagcctacaaagttgacagacaggctaggatgtctctgaacctgttagatatggttggtcataataacatttaattgtttgttgaggagggatgactatttaacttaagggcccttcctctgtactttcaagctctcccagatttctaaaacaagagcactgggctgggcgcagtggctcacgcctgtaatcccagcactttgggaggccgaggtggatggatcgtgaggtcaggagatcgagaccatcctggctaacacagtgaaaccccatctctactaaaaatacgaaaaattagccgggcgtggtggcaggcgcctgtagtcccagctacttgggaggctgaggcaggagaatcgcttgaacctgggaggtggaggttgcagtgagctgagattgcgccactgcactccagcctgggcgacagagagagactctctcaaaaaaaaaataagaacattggccttcctgagtcctggagaatgggtttgtacaatttcacagtggaatcatggacatagtataagtgcatgtagttttcaattttaatttgtagtctcagttctttcaagaagtagctgaacagtgacaggcacagttttctatacagtgagctaaagtaagatagcttcatggaatcaggtggtttcatatcctgaaatcccagagactctcttttttgctccctcatctattgccctgtgttcaggctttaccatttctcttctggacaaacacaggaaactctttacctgcctcctgctttgcacatatggccagccccttggttcatcttccatactgccaaccaaatgttctttctaaaggcaaaactaaacatcatggcatgactttgcttaaaatcttccgaagacttctcttcctttgcaaggtgtctaaatcccagaatgtctcagacctatgtatctttccagtctactctttctgtgccctgggtaaactgttcgcttcccaagtgctttgtgctaattgtgtgaactctttctgggtcccaccatgcaggcctgaggtccctcatggctcaggtttgtctctggcctagcatactgtttctaatcgttagttgacgtgccttcctcactaaactctaaaaagcattttgagcactgtttattgcttgcttttgcttaacaaatactgagcccagcacctggcacctaggtggtgctcaataaatgtttcttatatgattgaataaatgaatgaaggaatgagttagtgatatcacacaggaagcagtggtgaaggagacactgcatttagttagtaaaacaggcttgagctgcaattaacagatttcagcaagagtgaggctggttggttgctgggtggcccccataagggcatagccctggtgaatagccacaggaccaaaatcagttttattagttctttttgagagatgtgacttgcaagaattgacttatagttaaatttatgagagattaattcataattgatatgctcatgtattcttgacaatgaaaagaggaaggccaggcagcacaactgacatgggtcatttgctcaggccacatcctgctggtcagtaagttcattcaggaggcccaatattagaacttactaaattctgagtaaatgcatcctttctaattgtctctaagggattgtccatcaagctggattacccagaagaaggattattttcttttcctatttaaaaatgtttttaaatttaaaaaaattttttagagacagggtctcactatatcgcccaggctcaaactccttggctgaaaggatcctctttgcctccacctcccaggtagctgggaactacaggcttgtgccacaatccctggcttttttagttgaagggcatttctctatagatcactgacttttacaacatccttaacagtaatcaaaacagttctacctttgtaataataatggctaattcttgaatgtttactgtgttgggcactgttctaaatgctttatctactttgacataatcttcacaaccctgtgatgtaattactattattagctctgtttttacagactgggaaaccgagagcaaagatgttaagtgatttatctctgttctaaggggtgctggaatttgaacccatgcagatggactcaatacctttgcttttaaccacacactaatcttcctttctatgaatgcaaccagcatttcttgtgtttgctttgtgtgacttcgtttaatgctcctagcaacttctgcaaattaggtgttaaatctcttttgcttgcagccgaaaaaaggtcttggttttttggttacaagcaacggactaaagcaaaaaagattttaccatgtcttatacctgagctatctttaggtcaggttgctgactatgatgatgggtgccccagttggtatggggaggggcaacttttcacaaaggaaggggagccaatgatggagaaacaaaatcacatgaagaaatggaagtttaaatgacttgcccaaggtcacccagctagtgagtgccaaaggtgggatttggccctaggctgcctctagcaccatctgggttcactctgatttgagtggaccctttgcaaactgtacatcctgctgctgctgttctttcatcagcaggttatgctatcataaccataacatgtatcattttctttattccattctggttctaagaatacactgtgaccaccttctttgaacctggctgtttcccaaatgtagtgcacattgttttatttaattctaaactatcttttaggatagttgtataaacagtttagttcatctaaaattttaactaaaatttgtactgctttccacttctgaaagtgacctttttttctgacctggctgcaaattctggagaaggcttgactgaagctctgtgagcagaccagagctttttcaggctaaggtttatacaaaacattgaccttcatggaaattctggttcttgatcacttgggtaagcaagtaagttcatgggaatgcccatctattcactgtcaactcacagccctactgtacaggtccttgctggggagcatgctctctggaaagtggcttatactttgcacttctgaatctgtttgtgaggaaatgacagtatttttccgcacttgcaccaccgactgaagcgctgatccttgatgtgtttagtttttacctgtgctcatctctacatcaaaaacagaggaagccacaggaaattgctgcctgtatttccaggaaacttaactacatcatcggctccccaatccgcacagcccagaagaccctgatgctggcctcagtgttgctgatgtgggtggtgataaggggccgagagtgttctcatcctgtggctctgccagtgaaagcctagaagagatgaagcactcttcagactaacaggaaaaccctgagtctggttctataagcacttagtctctgaacatgccgacagtgagggtgaagtgagggataattctatcccaaggctagtggtcctctttctttctgctcaggtgtgctatcttgtccctggtccatagggccgtggctggcattctctctgatcacagaaaattgaaatgatcctgggaaaattgtcacatgagcctgtggatggggtcaggagagataaagaccataggatttacactggccaccagcagttcctcaaagaattataataacataattgtaataccaatcgctgatatttattgagcattgactttggtgtgccaggcattttgtcgaggaccctatgagcattaatgtaatcctcacataaaccccaaaagggactctttattattcccaattgtcaggcgaggtacctgagactcatagagtttgataccttgtccagggtcatatagccattaaaggatgcaaaacttgaacctaaatctgtgtcattctaagccagcactatacatagtcaagtaggttttactggagggtggagtggggctggcagcctgtgtgcacaggcagacggaagcagacaagatccatccaaggcaggctgaagacttatacccagagaaggctttggtgtacatctgccaaagtgatattctcatgtagaagaaaggattgggtgatagtccaataaatactttaccacagggaacttatgtgtcttctggggtctggccaaagtcatgagtgcaagctcccaaataaaaaaaaggtggcttctcacctcctcatgatcccagcttcctagcatagcactcttctctattttagcttatcaattccaaatgtgattgaaacaagtatgagaaattgatgttgcttcagcttctctgtgaactgaaacaaattcttgttgaaacatgatatctcctgcctcatggatcaaagagggatggtctggaagagaagcccccataaatatttgaggcttaatgaaggctatctgttgaataatacacctgtattattgtaaaaagttttaatttggcctcagagatactccccactaaagcagacaacaaaaaagtgagaaaatgaggctaggaattaataaaagatgtcaagaaagaccatttaaggacttcttagagacaggccataaatgtggttttgaactttttggcagctattatgaagacggaaagagaagtgtcatgggaatcaattttcaaaacttaaaagttctcttaaaattctagcagaaaaatagtttgcagctctacacaggtattggctagcattagtttaaagtggttgacatgcagccctactgcacacctctttatattccctttgtgtttaggattagaaaaactcacatagtatgatctatcatatgtctacttctggattatttcaagattgataatctggtttgtgtattatcttggtcttcatttctctttccttctgggcctgttgttcatctactggacatttcttttcttattaacatttctgctaaattttaaacagagaaaagaaaaataaatacacaattccagctatttgcagaggtgatttcaatgctttgtcagctaaagggaatttcaagagagatctttctacatcagtctactcataatagaactcctggctatcttgggttgagcctgcctgcaggtgtgcttaacctgggccacagattaaggcaggtaagggagaaacacctgcagaggtaggttttgaccccattatacctaagatgaaggtcactccttgtgaattgatatagaatgtgaaaagggtagaaactgctgattaaaacaaagtgttttgattatctggatttcagtaataagtgttttcctctcttccagttataaagagttgaaaaccttgcaaggcactcttgtataattgtgtccttaaaaggtttagataacggttgggcttctctctctctctctctctctctctctctgtctctctctctcagaccaaatatatcatgtctattgaaagtctgaagatcagtacatttcctcctgtttggaaaataataatgcctaggtttcactagaattctttttatctccaaggctctcttaaatattgactaattaaataaaaactaaggaagtctagctaaatagcctcactttgaggaccagcccagtggacttagaatacacagtgatttgctgtatctctgaaacaagcaactagaaatcttttattattggctataatagcaagtggcatctcttattatgtttggcagctgacatttcaaattgcattttggttggttgttatacatgaaatagtaggatatgagtagactaaaaatgagaatttgcagcccagggatgacatgaaatatctaacatctaggggttgccatgacaactcatcagaaagttgctttgtaatcttttggattaggctctggcccagggtcactggattggagttggagaacgctttggtaacaggatgtgaatgttgtacctttactcaatggcatttgaatttgcagtttggtcatgttgctaaggtcaagtagaaatgacattgagggaatttttaaattcccgcagaacctagacaaggtcacatttgtcagcaaaaatactcagatggaatagtctgagacttagcaactgaaagacaggatttcctgtccttgatagataaaaagtatgcacatatccatttatatatgcctatctctaaacagttgtatgtaatgaaaatttgggaaattaaacccttttcataattgtcttctgttataaaattggaactgaacacccctaagaaaacagtttggccacaaacaaaccacagctgctttctagtgctctgtgtcctccctttcagctggaaatggcctgcagggtgtggaatttggaccagggaagggaattcggcagagagaggaaggaagcaattgggaaacagggtaccacattcctcatcccccacattggccttgaccacaaggacagcatcttccacatgataatgcacctctcaggcatgcttctcaccagggatgatcaatggaagcaacctggaaactaaagagctctgttcctaagtctgatcccagttctgccactcacactgtgatcttgagcaaaacacatttcaactctgggttcccctaggaaatgagggggctgagtttcctctggctgtcaagttctgctatttatcatcatgtgggggcagagccaggtctccacatcgcttttctttgccattaagcccacattcccatcataactttgcagtagaagtaccgttcattgttagtgggacctcttaataattaaaagaaagagaaaaaatgatttattcttatccccataccttttaaagttgtggttttctgaagcaaaggctgccatgcagtgaggaaaggatgaaattccagacagaagacagtcagttgcaataagttgtcctactaccagtactgtcagcatcagctcagcttatatttactgagtattttctatatggagacagtgctaagccctttatatgcatcaaactgtttaatccttaggacatattcacatgtacacatgtataggtatgatgcatgtgattaaaattgaacatttgctatgtaccaggtgttatgccaaatccgtacaataatccactgagatcaataaatggattcagtcagtcaagcctcacaacaaaggaggtgttatcagttatctccgtttttacaaataaggaaactgagccatagctagtaactagtggagcagggatttgaacccacgtagtatggcctcagcatcctttctcaaaacctctctgcctgtggttctcctcactcatatgacataaccacacctggggaactttagaaatataaggatcttggggccccattctggatcagtcagaatgtcggggattgcgtcccagacccaggtttgctaatatgcagccagggctgggaaccactgcctcagatggaataccagggttatgttgttggagagttgcctgtagctctacagccagcagatgactgacctaggacttgcatccaggctgtaggctctcaagccaaatatctcgacggcacaatgggcaacaattcagttgttatctgggctcatatctaccaccatgcctagtttctctctcctagtctaaatcgcaaagccgcaagttcatttagggctgtttaaagactgtatgctacaccaattatgagaatcagagcacaaacttcttgttgcagccaaagcagtgatttcctacttaaaagtttcagaggtaacctttgcttttacctgtcaccaacttaaatgtaagttatcgtgctttttcctcattgagcaaaatcttgtactgacagagtctaggacagtggttctaaaactctgatgcacattagaatctcctggggatctttaagagctacagatggcctggcttccaccccagacattttttttttctttttttttttgagacaaagtctcgctgtgtagcccaggttggagtgcagtggcatgatctctgctcgccgcaacctccgcctcccaagttcaagcaattctctggcctcagcctccagagtagctgggattacaggcgctggccactgcacccggctaattttttgtatttttagtatagacggggtttcaccatgttggccaggctggtcttgaactcccgacctcaggtcatccgcctgcctcggcctcccaaagtgctaggattacaggcgtgagccaccgcccagcctctgattttattagtatgggatgtgacctcggcaatgggagtttgtaaagctctccaggtgattctgatgtgtagcagagtttgaacagtggtttaagaacttggtctgtgagttcacagatgtgttgacttgagaagactgtggaatcacctcatggatagaactcactttttaactctctgacagtgtctcttgcgtttcagctggcaggattaatttgagtttaattccacccatttcactacctgacttggaattgtacctcactgtcaaatgatggtttctccccaaaggttgttcttatacttaggctcatgcagtgatattggcgacatgtctgtaagatccctttgtaaagttctcagcctcatttgactctcttatttccactatagaatatttctttttatgttgttttaccttttaaaactgttttttcttgagacagtgtcttgctgtcacccaggctggagtgcagtggtgccatctcggctcactgccccctccacctcctgggttcaagcaattctcctgcctcagcctccagaatagcttggtgtgccaccaagcctggctaatttttgtaattttagtagagacaaagtttcttttcactgtgctgcccaggctggtcttgaactcctggtctcaagcaatccgcctgccttgacctcccaaaaagtgctgggattacaggcgtgagccaccacgcccaacctaaaaacatttttatgattttaatacatgttgctttttttcttccaggagcaaaataaacacctcttccacataatgcattatagtaataatccacctatggttcttttcccaaaatggctgaccatcagcctcactattgggagacagcagctgatgtgcctgtagtgtttaacggctgatagcgtcttacagatagatagtgatatggtggaaagttggagattatgtaaagaagaattgactcagactttatcctcagagattttagtaaagtcagattaatgtaatcaactggaaaatatagatggattataaaagtatattaaagcagaagtgtaaatttgttggcaagtttgcaaatgtactggattaatctagaaatcatttttgcagtaagtcttaaatagatttttaaacagagatgttattttgtggataaaaagagacaggtaatttacaagtggaacaattcttgataaaggctggggatggcaaatggagtgttgcaggccactaggccagctagctaggctggtatgaaaagtataaactgggtgtagcagttaatgaggaaggattgctgaggtggatagagctagctattgcatgagatttaataccaagaatactttggaagagcttttttttttttaaagggatatatcaggagtttctgttttcctttatgtggttgttgaagtctagttgatttctagtctgtaattttgttgatatttcagatcaccaaacaaggctggtaagatgggttagttatgcttctcttgaggataaagcttttgaaattaactctgcttctttaggtttaagaatttctaattctgtctgtctacatcttgctgctgtaatctccaagaaaagaaaaaggggttaggatgcctctcttttgaaatggaggggtcagagcaggcagggggctgtcactgttgtttctctttgttcagaaattagaacatgtgagcaagtggttccacccctcattttgtgagctgttttcctctgatatttcctaatttttcccatgacgttttagcctgtttcttcacaagattgtaaggcctgaaagaccccattgtttgacaggagtgcaggcttgtgcacatttgctgatctggctgcccggggtctgagtgtgggtggtataccgcccgagggatcatgcagacgggagaatgcgtggagcagactcctggtagttgcaaacactttatgtgtattaagagttcatagaatgtctttttgtagacagaagatgctgcactttgaaaatgttattcacaaactgaaatctcattgacagaagtagggatattccattaggctaagaaaagtttcttaatggcaaatcaaatggatgaaggccttattcaaacttcatttcatcttcagatagattcaaacttttattcttgcagttcacgcacattccttgatggcctgtcttggatttatgtgagcctttggagcagcaatctcacatactatgcatggcaaatcctagtcaatgcatactttttgagagtgcaagatgttaattgtagtaagagaagagaaattcaataacaaatgtttttgaataaaggaagctgaaatttaatactaatggtgttttctctaaatgaagttaatatattattgttgtattaacttttcaggagtttgaggctgcaatgagctgtgattgcaccattgccctccagcctggatgacagagtgagaccctgcctcttaaaaaaaaaaaattctaaggacttgggctctgtgtttgattgacagtaatagaccaatagaagacattgcatttatatagacttataaaatagcattcacatttccaatcagatttacagaattctcccttatttttaaatgttctcagtggtaacagtgacgttgggactagagtcagtattgtgagtcgtttatgcacatctcttcacaactccatgttcagtgagtcatactggcagcttgaaatcagccatggtgggagagtttacaccatggaaatcaaacactacaaattggtgctcctcaccctcagagtctgtttttaaacatttagcagcataccactgcccaaaatggagttgagcagtcagggagtctcctcttgaggcaagtcatgcagtgcttccactcaaccaaacagccaacatgaacattttgaaatgtaggctgtgtggctcctgaagaaaagtccttcatagctccacatttttctgagccaaagccttgctgtgatcataaagctattcatgctgtggccaccaccgtccgtcctcctggctctcacctccagatgcctggtttcacccctttttctgtagaacatcctagacccactcctattttagggccttttctgtagggcagtggttctcaaactttacagcacatcagaatcacctggagagtctgcaaaaacagaccactgggtgcctctctagcatttctgagctagtgacaagtttcagggtaatgctggtggccttaggaccccgcttggagaaccactgcttgaactgatggcctcttggtttacctctcccctccagatctctgatcctctttttctttctctcagtaaggcacaccctgactatcctatgtaaaattgcagcctttctcctccaccacagttctaattcctgactccaatttttatttatttaagttccaggatacacgtgcaggatgtgcaggtttgttacataggtaaatgtgtggcatggtggtttgctgcacctatcaacctatcacctaggtattaagtcccaaatgcattagctatttatcctgatgctctccctccccacccccctctaacaggctccagtatgcgttgttcccttccctgtgtccatgcgttctcattgttcagctcccacgtataagtgtgaacatgtggtgtttgcctgactcccaatttttttcagtgcacctgtcacctgttaccttacaacaagtttcttatttgtgattatcgtctgtctctccccactaactctaaatttcacaaagatagggaattttgtctgtatttttttaaaaaacagggtatcactccaattatccagactggagtgcagtggcatgatcacagctcactgcagcctcgaactcccgggcctgggcttgggtgattctcccccatcagcctcccgagtagctgggactacaggcatgcaccaccatgcccagctaattttttgtattttagtagagagttttgccatgttgcccaagctggtcttgaactcctgggctcaagtgacccacccgcctcggcctcagaaagtgctgggattacaggtgtgagccagcatgcccaaccttgtttgttgttgttgttgttgttgttgttgttgttatgatgtatttcaagcctctagaacagtgcctcgtggcaggtgctcagtaaattgttgaatgaattaatggatgaacaacattgagatatgaataatgtatttcaaattttggtcccagccttttaaattctaactcaccagagaatctgaaaacactttctgcagttttgtttctcagcttcactgctcttaggataatgaggaatggtttctgccctgggctgaagtttgggaatgacttgatgagccttaaaatagcaggtgcaccaaattgttgttcttccatttacattttaacctcaaagtccctaagccagtgatcttcaaactctggtctgcagaagttccctggagatacttcagaggctctgcaaacatctaatttgcatttcattttaatatattttaaactatgttttataactataataaaagaaaatgcacacaaatgtgctacctaccaaattttaacacattaggaccaccagcacattgaattggactgccaagtcaaccttgaaatagtgttttccactattttggcttacatatttgaacttcttataaataaatgaatcattgattaggaacttccatcccagtatttttcatattccagcctgatcataaattgaacaggcaaattcctcttgtcacacatattcagcacacttgatgacatgccaggcagcgtttcagagcctctgtgggatggaggcttctgtgtggattaatggctagttgtacaataagtgaacaccacacacatcacttagtgatgtacattctgttagaggatcatgtctacccactctacattttggatactcttttaccttaaatagttgtcaaattatcattagtgattaaaatttgaaataaaatcttgactgctgcattttctccaagcttttagattagttttgaggcatattatgagattatcaaatgaaatgctaaagaactgttataatttccaatacaactgtgccttacaattcaaatctgctcatttccagaattcaggtgccaaaatttcccattgtaaattccagtgcaaaggaatttgaacttgttatgttcatgtcagcttcgtttctcagtttcagatagtaagtagtaagagtagcaaatagcgagagatttgtctgaaaatttgagttttgagagcagagattcagatagtgttatctgtatttaggagtatcaggattctcttaatacagtgagtgcaaccaaatacagacacagaagtaaatcatattctggatcacttttaaaaatcaattgaggctgagcctggtggctcatacctgtaatcccagcattttgggagctcagggcaggtggattgcttgagtccatgttttcaagaccatcctgggcaacatggcaaaaccctatctctacttaaaaaaacaaaaaaaaaattagctgggtgtagtggtgtgcacctgtagtcccagctacttgggaggctgaggtgagagaatcacctgagcccaggaggtcgaggctgcagtgagctgagatcacgccactgcactccagcctgggcaactgcagtgaggccctgtctcaaaaaagtcagctgatagaagccttactatctgaaagccccactccatctcacaagtgccattgaatacattatatgaaacagttctaagttatacattatggaacattttgtaggcctctttgcatatctgtttattaatttacttaatgctctgttgtaatttgttttgtctcctacactgtatttgagctctttgaaagtaagaattatgtcgtagctttgcttccccagtgcccagcgttgcctaacatgtggtgggtactcagcacatgtttattaagtgttggaagtaaatgctcggtgccaccaagtgaaaatagcacccaggcaaaagttttctcagcaaggcaatttgcttctatagaagggtgcgtctcatggatggagcaatggcgagagcacactggacaaggaaggggaagtgggtcttatccttaacgcagctagtccctactgctgtgtctttcccctattggctagggttggaccacacagtctaagctaattccgattggctgttttaaagagagcaggggtgcgcgccagagtggcgggttgagtagtttcggcaggaaggactgtttgagagcaggtgacagaggatgactaaggacagtgcaggtgactaaggatgactaaggacagagcagttgactaaggacagagcaggtgactaaggatgactaagagcagatgatagaggctaagagggggttgtttactgaaactaggggcaaggagacataaagaacgaggaagttttaaactttaaaatggagaacaaagaacaggagagctgaacatgctgaacgtaccatattggttctttgaagaggaatttactatatcctacataagtgacactgcattctactgcagaaggaagcaagctcaaaaggaacaatgaaacttcatattaaatacacaatcagtgagctttcattctaagcacaaatttcagcatgaaaaaaatgtaatggttctgtgagtccttcacttgatccctcacatacagtcttctaaagttttctgaattccttttacaagtatcttctgactctgactcttccatgccatcctacttgctctgagccttgttcttctctgtgtcccttgcatggactgtggaagccacctcagaagccttctcccagacccaatgtttctgcttcttcacattgttgccattgtctcatgaaataaaaccaagcatatcctttggtctgcactgcctgcaaaataagggctaaacctgtgctttccaaatataatagtcactagccacaggtggctgttgagctcttaaaatgtggcttgtccaaattgagatgtgccgtaagtgtagaatccacaccctgtttcaaagactcagtatgaacaaaatttgtaaaatagcacattaatactttttatattgatagcatgttaaaataatacttttttctataatattaagtaaatttctctctttttatttgtttaatgtggttattaaaaagttttaaattacaggtttagttcaccttgtgtttctgttggccagcactggtctaagctatatcatgacatttagagtttcttataacctggactcagttacctctttggcctcatctcccagcccttcctgtcccttgcagaatttctcataacccccagactcaccaaccctgtttatacttacgggttttaatttttttcacattcagtttcttctttctgaaatgtccctccttttttaggtgtcaaaaatcctgctcacacttttaggacctgacttaattgtcccttgctggtgatgtcacgccctatttcctcaagcagaattagccactccttcccatatagtgtctctcagcacctccattattgcatttgtcttgctgttctgccattaggtgtcgtcttaagtagactcctcaagggaaaggctgcaacttatttctctgatgaccacagggcagtacctcgtgtgtagtaagcacttaatggatgtttattacattaacttatgaactaattttcatcctgctatacacactgctatttttatatacatcagaccttgatcatcttaaccattggccatggaaaaaattagatgctgaggtgtataggactggacctttcagccttaacctcaatttcaggttttgtgttcaataaaatggcctcctttttctcactgggtggcttatgattaaaaaattataactttgaacttaaaaaatccatgaatattgtacagactaaaagtataaaaggacagtataaattactgctttttacctatcttgcttatagggatttcatataagattttgtttgattgaagatttcacttcagaacaagtttggaaagctactgttctattcctaaatttcatttacatttctataccaaaggtttcatttttattttgatgagatggtttctactatcatgttagttcacataaggcaacacttctcaactttagttgcacaaaattgggaagcttttcaaaaatacctccccactcagggatccttgtataattgagctggaggaaaggggcccaggcaccagtatttatgaaaagcacaaatacctgtaataaaatgattctgcagtgcttagaaaaccaggtagttaactatgaaaatactgaagttttaaattgctaatttttctttctttttattaactatgctgttattgtttttcttggcagtcaagctaatgcaatttaaagtttgtattatggttttgagacctcaaacagcatttaatagacgccatcatctgtggacaattttcctaaggcttctgaaattaaaaatttccttttctgtcactctctaaaaacctacatgcagcagaattttaatgtcccttattgatagaaatagctaacacaacacctatttcagatcatggaaatgaggactgacaagggctgtgggtttaagaagtttacataggtagtggccttcctggcacccttgttagcctgaataaacagtcctcccctgacaaatcctctgtagctctgccacattgataaaatctgacattctggttagtcactttttaatgatattctttcttttgttcttgatatgttagaaaccagcccttatttttttcagtgtgtgggaaagaattaactttaatttcctaattcggtaaaatgggctgctaatgcagaccttattcttagggggacaggaagaaaagtgacctaatttctatatatcaaatacatcttccttcatacatttaaaaatgtatagagttataaaggaccttaaatcctgtagcggagaaactctggggtaaatactttggaaacattgtgaaaaaattctataaattctgatagtaggttccatttcattgctgtgtactattaaaaagtgcagatgtaaataagcataagttttgcaggttgtcaatttgttacaagcggctgcatgttcttattcttctgaagtgtcatctctttcaatgtgggctgtttaggcggaaaaaaaaaaactcagaaaaatacacacttgggatcaaacccttagtgcagaaaaaagaatcaaaacctgtagttaagttggttatttgcagtggtggtatgtcatcctgtgtgagactgacgtcaggcagattgaatgcagaggcaaacttcgggagcgtgtgtgtgtgtgtgtgtgtgtgtgtgtatgtgttttaaagccccactcccagaatatgaagtgagtatgaagggcaccacagcaacccctggatctctcaagaatgtacctgtttttaacatgctggatcaagtgtcagcactcagtagatgaggaaggggtagagcccgacttgtacagattccgcggatggtaaatggccctctggcgtgtttacaatacagctgtgcattcttaatggctctgccgctgccatgtcaggtaaagttttctttgtacgtgatgaatggcagagaattctttagcagaaggaaccaaaggagctgggaggaggaaaggggaagagaagagcggaaaagagagagaaaaagaaacacacagctccagagggacatagcctgtgctttgcagttgcttgtgtggatagaaaccagatggtaagctggaacacccgcttggctatctgaggagccaaacatatggttaatggtcgggagaaatagctttcagagccagggctttgctgactgcctcatattacagattgttacagtgtgtcattacattgccaacctaagtgcttaatacccactgcaggcgctgggcatacacttacaagaaagacttttagctctttgctggctctaaacagagaagtgacatcatagggaggctgaaaatgtctggtgttggaggtggggagaaggataattttgtagtggaaacaacaattttttttcttttttttacaagccttcactccactgaagtctactgttttctgagaaccttttaatactagactggttctctcactctctcaatctctcttgcgtgcactctcactctctgtgtcacacacacacacacacacacacacacacacacacacggaaaggaaaccgaaattcacagcccaggccatgtcccccaactccagtggatttgacaggcctcgttcacctggaagccacatcactgactcagaggccctgcatttgaagtttctgtttggggagctttgggcaacagcaggcctgtgttatctaaggaactgctgagcccattcatctgcttttcacggcccgtttccttttatttttagccaaatccgtcaggcctgacaggcgggtaattcgagccagagaaagggcagagctccaggtcctttccacaaagcaattcttctcctccctcctgggagggctccagacttggcctgcttcaggcagatggatttgttgagtcatgtgagatcatttacacaaaaacacagtgaggcagtggaaattaaaaaaaaaaaaagaaagaaaagaaaaagaggagggtgggggaagaggaaagaggggaagccaggggaatgtgcgctgccctgctgctgaggagcataggaattttgcagtgaggcagctagactgaggaatgcctagagtcatttgtgtataaggtaatgtctagtttacagagtggggcgggccaggcgaggacggcgcctccagcagcttgcctctgtttaaaagaagaaggtgttgggaaactttaaaaaaatttttagagcaacacccaccaaacaaagaccacactgttgacagcgttgggttccagtagcggtaaactaccaaggggctggtttacagaaaatgagtttgctctgtgatgtcatacaagtttgctttgtcctgacgccaacatgacactgaggcagcagaggagggagaacaggaaaattggaaccgtactcttagttaatggtttccagagattatttagcaggacttgaacagagggaggaaaatattgtgaaggattgctgcgaggtgtaccataattgcggtaggtaaaacaaagtcattactatggttttcttgctcaagaaggattgagcaatgacttcaaaatgccaagtaaggtattatttttccctaccacagtatttattttcctttagcttctggggcattaaaaaaaaagaccaactctcacatcatggcaaacagtattaatgttagtgaatcaattttgtttactgtttataccacaagcctttaaaacattccattaaaaaattgtctcccgctcattcatgaaattctttttttccttcaaatttgcttacatgcattagctttgtttggatagggactttttccctttttggctggagtaaaagaatgcataaaagaatagtgagtagattatctaaatgtacattcttacaacaaatgtaatgaaaatatgccgcgtggatgagagggaatatttgaaaacagaaagaaaaacagaaatggggagcatttcaaaatagtcaccctgattatctttgttatgatgcatttcttcaattctgcatttatttagaaccctattgtgcagctatttcttttagccaccctagatagaatgtaggtcaacatcaacattgttcctcatattttgttggtattttaaaagttgaaacattttgcagttttttccagagctagatattcttaggttatttagacggttttagtgaccatagaacttcacgtataaactccttctgttaatagctaccactgaattttgatagtagacactcagatcacaccttgacctggagtaaacaaggcactgatgatattgatgataacatagtccaacactgaagctgttccacttcttccaggcaactctgatggtcttactctgtgtaagttacagcttttacttcgctcaaggagagaactggtaaatttttatggttgttaattgtttacattttggggaccccaagttgcatggtgccacattattataatgtgattatgagttggcatgattttaagtctacccatatccttgaatgttccctccccgtcaggatttcccaatctcagcactattgacattttggaccagtaatactttattatggggtgtgtcctgtacgtggtaggatcttcagtagcatcattggtctcacccactagatgccagtagcaccctcccccgggtcatgacaaccaaaaatgtctacagcattgccagatgtcccctgggagacaaaaccactctggttcagaacttctgctccacatttcttactctggtttagaagctcacgctttacgtcatgagctggctgctcagttacttctaagattgaattaaaggatatgaaataatgttttaagttggaattccaagttaagtaaagtttttgaaggtgcaggcaagagtacttttgagtatggttatgcagaacaacctctctcttggaattgcgaccttagcaggtggatcccctcaggactcccttacagtgagtttcccagtgctgtttaagaggaaatgaccccaccgtctgagccgagggaagtcgacattagcagaaagggaacttcccctcagtcacctgagcagacagcctaggccccaggctcgctgcctgtatatccagccccagaaagagggcaaggcagcagccacagttctttcttgggagcacagctgacctcctccccattccagcggctgtggtctcagaagctgaaactctcgttaataaggaatgtggagctttccacagctaaggcaagcataaatttcctctgtttgttttgtgaggactagtgtcaactgctgtaatgagatcagagaggaccccagggtcagctgctggaactgctttctgtggctgttctcttggctgcttgctgtcggagaacgcagtgactccctgcagacctccctgatgtgttaaggtggttgtgcccttgttgcatttcttgctgtctttgcttctctcattctactaaaacatcagtgtgcagtcatccagttctaaattatggaaaagttaatggaaggcagattcctttccacagaactgagggcagacttgggtgtggaaaatgcagccttgggaaggaaggtgacctgtttccttggggtaactgcctggacctgctgcttctggctaagggtaggtttctcaaggcctgggctacccgtaagcactttctacccccaatggcactctgtaatgaggatgagttagtgaaagagtcacagcaattagcttaggctacaaagaacataattctagttgtagcctaaatgacagctagaattggctacatatggaacctaaatatggcagaattgcatttagggaacccaattctggcagaatggtatactgagctcatgcagcctggcctacttctgaccacccaccccaaaaagtcctaagcctggcctacttctgaccacccaccccaaaaagtcctaaggtattatattggttaaatattttcaagtacatacgagctttaaagcaggacagggaaattcttaggtgccagaagacattgatgccactggccttagagtgtttcagacccagctgtaggctctaggctctaggggctatggtgtctatactcacacaggaattgcttgtgaaaggggggcaagaagattttccccagtctgtttggggctttaagtctgtgtgttggggcacagaccagggggatggaaacccagggttacactgtttgaatagctctggggttcatagttacactactacctgcatggtataacttcaactgttttggcagaaactggtttgagagcattgaacgccctcaggccatagtggaggcaaacactagatccctgtggagaggcttaacaacctgggacatggtactccctcaaaaagaataagctgcactaaggagatgctgataataagtacagaatatggccagatacagtggctcatgcctgtaatcccagcaatttgggaggccaacacaggaggatcacttgagcccaggagtttgaaaccagcctatgcaacatagcaaaaccctgtctctacaaaaaattatctgggcatgggtggtgcacacctgtagtcccagctacttgggaagctgaggtgggagaatcacttgagcctgggaggttgaggcttcagtgagccaagatggcaccactccactccagcctgggcgacagagtgagaccctgtctcagaaaaaaaaaaaaaaaaaaaaaaaaaaggaacagaatctaagccccagaaaagcagaggttaacagtgaaccttcaggccaactagagttttcttctgcagattaatgaaagtttcttctcaagaggaacaaggcatataacccattctggcttgctaagcagtttcagttgtaagcactagccccaattaaggtaacatcctacttatagcttgtccccaagatcttcttgagaatattttagttccttaattagaaactttttattggagagatagctggcccccttaacgcttctttaacagtgctcccattgcagtggatcactctgaagtaacccatcaggctgtctgttatttcagtttctcaccaaatcataggaaatatgtttgcctgaattgtacagcaaccccctccccccgccccgccaagggagagggaagttgaaattatttggaggggtctgggattctttcagcataaaatcaaagaaacccaggtaaataagacatggttagtaaacatttgttctagatgaatataattcagccttctcaatccaaagtgaacaaatggatcaagagttgcctggaatagccactgtgtactccctttgcagtgacgtgcactattggcaaacatgagttgagaatgctaaacttaatgcatgattccttaatttattaataggacaatgaaatctcttttgtttagttttttttcttctaaagtgcgcaaaaagctgtcaccagtagtacccaaatagtgccttgctgacctaaaagtgtgccatgcttcttaagaaaaaacttcagtatttattcttaatttggacttctataaagtttaatttcaaaatattctgaccaagcgagaagtagatatgaatattgacattaaagcatcagaagaggagagaatgaaaggaaataggttcaactggtgccagacttacaggagatcttcccaaacattataattaaatttggcatatattgagtgcctactgtatgtatgtaaggcagcgggataggtgctgggtatttgggtactagtacaaaatagacaagatctcttcttgtgaaatgctcaaaacaatcctcaaaagaatctccagagatataaagaatttcccccagctttagggataaaggaacagagactgagagagagccagtaacttgccaaaaatcacattccgagaggtggagttgatattcagactgacttggcccctatctctctttgcctactcttctccctggctttctgtgggcagtgaagccctagcagtacaacccagaggggccaagaggcaggtagagagttttctctcccggaggtttacaggaacaaagaatcccctgactgacatggaaggtgtgcagtagaagaggcaaactagccaaccagacccaactcctacaaaatttccaaagtattagcatgagtttccaacattaaaacagcaaattattttacacagtctctcaactccgtttcttgagtatcagaagctcttggcacatggggcttgttcctgctttgctggggctagagctgagtagcagactccccggatgccccattcctcactgtcttcccagacctgacctttcactcatctcattctttcttgacccttgcagtcatctgaatttgtgacccctggtttaaatagtcacttaggcaagggaagtgggccaggccaagtaacctcttgggggctcctctgtgttgtgcctttaaattgagatagtcctaaatcactggagactgcgatttacattttacagtgatagccctgaatctaaagattagatatcctgacttatcatttgaccaagtgcaagaaccccctagcctgtgtgccagaagtgggtgtatgaaagtgatggaccctctaccacttgtcactcttggcccttcctggcctctgtttctccccatctggctctcagactatttgtgtgcgtgtgttaccaacaatgtgtctctcttttataatttataatcctcttgtttcctcctctttattaccatttcctattgaaccataactcatatattagttaaaatttcagaacattcattttcaaattacctaacctatccttggggaggaaggctgttgttgatgcttgatgggaagatgctcttgttgttctggcttagaatgtctgttttccatggtatgctgtgaaggcagcgcacaggggagcaaagcagaatggcaaacgtctggtctcttggggcagaaccatgttatagtgtgtttgctgcctccatgtggggtggcgaggacactgaagtcatggagaaccacagccacacatctgctgtaactttgaggatggagagggacctgcaggaatctccttggcaagctccactctgttcctcttgcctcttctttaggaagcagggaatgagccagccacttggaaagaaggtgtgtatgcattgggggaagggggcaggagtctagtttctttgcctttggatccttcaatcccagcaccatgccccctatggtagaagggagggattagctttctgtaataaaatgaccttatattttttcagttgaaagtctccagttgaagattgtccagacttaacttcaaagccatgtgaattactccaccccttaaaatagagtagaggaaatttgggatattgctctcacctgtccatctgatttcccaagtttctaagtcctagatgcaagagcatttttttctagacttcagagccggttcaccttgtattacttcacttactccttctccaaaagctcttgggcctggcataggccctcatgccccagccctctgcctaagctgctgggcgtggtggtgggaagggtaggaacaagagtccatcccacagactggcctcatggtacgttatgtctaaaagctagtgagacctttaacactgcgaagagtgacctgcttgctcttgttggcctatctatctcccacaggagtgcctgagctacccagctttgacatatattactgaaggcttctagaatggacatcatagaagggggtgggagttggagtggggagaaaagcccaactcaccatattccattcagtatttggcagtattagttgcattttcaagggtcaggagagcacacacacacacacacacacacacacacacacacacacacacagcccttgacacttttaagcttctctttaaagagcataggattaaaggtggcttatgttattctcagcatacctctataccacattaacagtgatccaggtaaaataggcttctctccatggtagatggaggttgatggtaaataaatagtggtgaatcaggtacgcctggtgttttctccaactcccatttgctgacacccaagacatcagagtataaccctcagagaagccataggatgtggaattgtcaccaggagcccaaatctctgggtctcttccatagcgaggacctggctggtgaggggcacttggccatgttaccaaacctatctctgagtgtctttgtttgcttgccgccctttgtttttctccattctttatatctttcatcttttcttgtcatttctctcttcttcttagacttactttgtctctgcctttttttttttttttttttttttgagatggagtctccctctgtcacccaggctacagtgcctctgcctcctggttcaggctattctcctgcctcagcctcctgagtagctgggattacaggcctgccccaccatgcccagctaatttttgtatttttagtagagatgaggtttttccatgttggccaggctggtactcctgacttcaagtggtccacccgtctcagcctcacaaagtgctgggattctgtaattctggaccacctttcttcttacccatgcttctatccacctggaaagacaaattatgtttcattaaccttttagaagtctaagattgaccattgaaccaactgttaggatcagctgagtggaagtcacacgggcttatgggattaactttctcaaggcaccctttaaagacgtctgtagttttccttttgttcagtactagaggaatccaacttcttaaaacaataaaaagaaacattgaataataaactaaaaaagaaaacattcttgattccaccatggtaactcaggtatctttttccctaatgctttatatttaagatgcagtctccttttttaagctgtagattttgctaagcttcttcataaactgaattggctgcaaaacaaccaggttccctcgatttcaaaggagatggaaagtacttgatagaacaaggccagtctttttggttgctgtccagaagtgaactgacccagtttctaaaattgtcatctgttctctgaggcgttttctgttaaatggtggtcttggtgtgtgcatgtgcgtgtgtgtgtgtgtgtgtgtgtgtgtgtgtgtgtgtgttgttttggggtgtgtgttgtgtttattttttatttctggtctttcacatgctttatttccatagcgtcttgaaatgaagtcacttctagtccagggtctattgcttattatagcaagaaccaggaaaaattcttttacctctctgtgtctggtttccaaattaggaaaactaccacccagattggtattagtattaaatgagagtattaatatataaaagtgcattgtacagtttggggtactatacagttgtatgacattcttaatattttttaaaagatttacaaccctggcattaagaggttttcctttttaaaagaactccaaaggcagctgcaacaattattaacattgtttttaagaccccacacttaagagtctgtatcatcctaggccctgtgagtgacagcaaagaaaaaactatcgtaatatttattttaaaacgttctgtgtgtctgatgtttccctcaaagggtttttagcctgtttcggttgtaaaacaacatacatgaaaatgacataagaacagttggggcgggggcaggaagggatccgtaatcagtttagtgcaagctatttatccaagttctgagagtacggggattgtggcatgattggagctgggtggggttcctcagggaaatgatgttcaagaatccttgtctgttattatcttcttgtgcccacatttcctgtgttgataccaatgtgtacatagaaattgaattgtgacatgaggcatctctgctaggcatttgggcaagctttccagttaagtgctaggctgtagtttttacatggatggatacatacattgaaaaggaaacagcatgtataaagttctactttaaaactaagaaatttattagcacatgcttctggaaattgaaagagtaaaagttacatgcattatttttttcagtcactttaagatcaattacaattagatattgaattttcttgactttgaagccatgattacccaggcatcatgtacatgtggagatgtttggatgtattcgtactacaaagttggaattccaagatctgtgttgtacattattgttaaaatatgctattgctatgactgaatgtggtattttcttttttattatactttaagttctgggatacatgtgcacaacattcaggtttattacataggtatacatgtgccacgttggtttgctgcacccatcaactcatcatttacgtaaggtatttctcctaatgctatccctcccccagccccccaccccccgacaggccctggtgtatgatgttcccctccctgtgtccatatgttctcattgttcaactcccacttatgagtaagaacatgcggtgtttagttttcccttcttgtgttactttgctgagaatgatggtttccagtttcctccatatccctgcaaaggacatgaactcatccttttttatggctgcatagcattccatggtatatatgtgccacattttatttatccagtctatcattgatgggcatttgggttggttctaagactttgctattgtgaacagtgctgcaataaacatatatctgcatgtgtttttatggtagaatgatttataatcctttgggtatatacccagtaatgggattgctgagtcaaatggtatttctagttctagatccttgaggaatcaccacgctgtcttccacaatggttgaactaatttacactcccaccaacagtgtagaagtgttcctgtttctccacatcctctccagcatctgttgtttcctgactttttaatgatcaccattctaactggtgtgaggtggtatctcattgtggttttgatttgcatttctctaatgaccagtgatgatgagcattttttcataagtttgttggctgcattaatgtcttcttttgagaagtgtctgtctatatcctttgcccactttttgatggggttgttttttttcttgtaaatttgtttaagttctttgtagattctgggtattagccctttgtcagatgggtagattgcaaaaactttctcccatctgtaggttgcctgttcactctgctgatagtttcttttgctgtgcagaagctctttagtttaattagatcccatttgtcaattttggcttttgttgccattgcttttggtattttagtcctgaagtccttgcccatgcctatgtcctgaatggtattgcctaggttttcttctagggtttttatggttttagatcttacatttaagtctttaatccgcatgtggtattttttttggaatctgtatttcaaatagccaaggagtgatttgcaatttcctctctctatcatctgatttataaaaggaacgtagtaatattatgttcatagaatagtaatgtgcatggagtaggagtttatctttgaaaatgtaaattgcaaaatcattttcttagcagtgaaagatgttaatatggggaatacagctttggaattctccatgtcctggacttagttagcagacatgttattctccagtgtagacaaaggctgattactaagaactaaagatggttatggtgggcttgtggggttataagtacctttttcttttcctgttgaacattttctatagtcttaatatattataattaaaaatagtatatttttcatttttaaaagcactgcagttccagttaaacctccgattccatgtattatgggaaggtgcagatatataaatccctcctagatgcaacttaaaaaaataacacacaaattgagtatcaggaaccttacaatattttgctctcctctcagttccacctgtaaacacctttcagaggaaaaggctacaagtccatttaagtaattgaagtcatttttaaaatattttcccctaatatttgacaaattaaccttgaaactggccaggtatggtggctcataatcccagcatgttggaaggctaaggcaggaggatcacttgagcttaggagtttgagaccagcttgggcaacatggcaaaaccctatctcttcaaaaaatacaaaaattagctggacatagtggtgcacgcctgtagccccagctgcttgggaggctgaggtgggaggatcactgtagccgagaaggttgaggctgcagtgagccgtggtcatgccactgcactcaaacctgggcaacagaatgagactctatgccaaaaaaacaaaaacaaaaacaaaaaagacaaagaagaaccctgaaactgtacaatgacccttttactctaaaatgtaattcatatgaatcaaaaaacgccatgtaaagaataaatagcatgaatgaaaacatggtggggggaattggactgtttggggggaattggactgtttagttcatttggcccatggaagactgacctcctgaattcccttatggtacactgcctttctaggaaatctgtgaaagttctagctgttgagtcctggcagcccccgtttgcactagctgcttttcaagtgctcaataatagccacatctgactagtggctaccatgttggacagtgcagacttggatcattgccatcatgacagcaagtgccactggacatggcagtgctctatgccttcctgggcaccagctgatggatttcttctttgtttatattcacagtgcagctgtctgcttcagaaagtgagggctccaggaatgaggagaatcttcaagaacttcctcgcactgtgacatgtctgatcccttgctcccatccctgcagcatgaacaaggtaagaggtactttgaggaatcagcacttgtatttcctttacggtaccatgattttctggagtacatatgtctttccatgatgtgaagaggttgcttctcctgccagaagcatttcagagttggagagtcgtgtgatcccccacaagcagggtcacaggtgctggtggctactctggctgcgtagtcctctggaggtgtcatttatacttgccaggggcctctgagtggctgaaatactgggttttagtgtaactgccttggcatgaatattggaatattgagactctggggctagatttcctgggactaaatatcacttttttgggatgctagtgtcagtgaccctagacaagtggcctgacttcttggttccccaatttccccatctgtaaaatgctgataataatgatacctacctgataggattattgcaaggatgaaatgagttactgcgtataccagtgcttaatatggtacctgtccacattacaagcacttgatacatatttactgctgttgtttttaatgttggggacactgttatcccttagacatagttccaagagagtgtaaggtgcatcttttccattttgatttattccctgattaaattggtgagtggtgatttattaccagatgggccctatgggaataaacgaagaatacaacttgagatgcctttagcgtgtgcagactatcttgggtcaacatagtgagtatgttctagcaaggtgtgtaccagaagctttggaggcacagaaaaaggaacatccaactctggggaatctgggaaagacagtgtagaggaggtgacatttgagtaggatcctagatgggaaatggtaatttcctggacagggaaggtggggcaaggcattccaggtaaaggaatgtgtttaggcacaaaagcatatgagaaagcctggtgtgctcagagaacagcaaagagtttggtatggctggagcagggattctcagccttgacacttggtatttggaccaggtaattctttgcagtgagagactgtcttctgaattttaggattttttgtagcatccccttcccttcactctaattgtgacaaccaaaaatgtccccagattattgcccaatgtcccatacggggacagaattaccccttggttggaaactgctgcacaagtggaaggtggtcaaatataagcccagagaaggaggcaagggccagatcctatgagccactgaaggatttaaaacaggggagagttgtttccggagcctacaaaaacaggtgtgttattgtgggcctgttgtatggattgtggtagagttggacagccctgttcgatggtttggttgtgaaaagagcatatggaatctctagactttagaaagcccatttccctgttgaaattcttctactaaaggaccctcttccagtggtgacttttctcatggtcatttactcagccttctcatgggcacgaagggccctgggcagcttcaggggtgggagaaagctggaaaagccctctgtgcacttaccctctttccctagatgcaagttttatgggagactctggccgctttatcctatctgaagagaccagcaaaaaaacaagcaattgtttttgaggagtttttgtttggctgagctgagccaaagagaaagaaaccagtgctgagttttcccgcttcaaccccaccccagcttaaacacttggcgttaagcctcctttgagaagttagctgctagaatactggaaagtaggcaggtgttctgccccagggtcatgactggaggtggggatgaggggagatccatggctgcaaaccttttttggctcctagtatttggagtttggtgtattgaaaagctaaggcaactcgggaaatctgttatcagcaaatgcagtttgctgtgacagctccgccctaagtttctccagggcaacccaacatctaatgtcatggattcactctccacacacagctgggaaccagactcctcggaaatgtcaagtctcagtaggtgtgtctgttgcttgggatattatgttctgcctgagtggctcagtacgttctttattttatattgttttaattgaaagtagtgattaagcatgatgtgtcaccttcataggtcagcatttttcttatggctttcttggcataagacaaagaataggtcactctctggggaggaaacagctcttctcagcatgaataaaaccagagaatctcctcctcaattatggtgttagttggagtgctagaaatattgttgtgggtgtgactgacgttctaagtggatttgttcctagaaagttggagacattcgaattgtgcactctcctcttcctcagacacacactgtaatgctctcctttcttcctaaatcccagctcactgacggggcacttcagttagggaggtgttcggatggagggtggccctggcgttctagggtccttgttattcctttgaagtgccagggcgatgctgattgcagttagacattgacagctctcttttgaatccattagagaccatccctctagaaaacacagaatcccccaaatcccgtgccacaaaaggattagcagttggccgcactaatttaacaggactaccctgatacctcatgagttgctgtccatcaggtagggccttcattcctcacattcttgaactcctatctgtgccagggtctgaggaaacaccagaaaggggtgtactttgggactttggatagctcgcatgttggtgtatcagtgccagctaaaaagagaagcagagggcattcctgcgcataaggcccatcaagaatctgctgtcatccctgaggccagtctacagggaatatgttagtgtacgtggaatatgataacaaactcatgggtttacacagagtagacagcctcatatttatttattcaccttttaaatattgtaaacaggcattaatggttgtaaattctgacaaccattgtaaattcttacatgttaaagaaattgtggggcacatattttcccagggtgtgcattctcccaaaccctcatgcagacttgaccatctttccagtgttcatacattcttcgcagctttttgcaagagctgactttccaatctttatgttgatcaaaaacttcataattagaatttaactctttttttttttttttttttttttttggagagagagagagagggtcttgctctgtcacccaggctggagtgctcaacctcctggactcaagcaatcctcccacctcagcctcctgagtagctgggactacaggtgtgtgccaccatacctggctaatttttgtattttttgtagagatggggtttcgccatgttacccaggctggtctggaacccctggactcaagcaatcctcccatctcaacctcccaaaatgctgggattacaggtgtgaaccacctcacctggccaaaatttaacttttaaattctgtcaaaagtatttctactactttcttggttattttcttgctaatatgtgtaaatatatattacatatagtatatttgccagtaagaaaaaccaacatttctggtttatctgtgttactgctgcattatcatgctatagagaaaggatttcagtgtgtcacttaaaagccatagccaaatgggaagccaattgaacaggattctgtagaggcaaattgtgcaggatggtgtacgttcagtgcatactgaccactgtgtacattcacagaaaacacactagcaagaaaagtgttgttcttctcttgaaagatctttccttcttagtagcaactttgggattatgatcctttactcttctccctcatggtcattgttttttatgaaggcatgtcacatgctgttctgtgctttaaatttatgaggacactccatctgattgaaaaataattgatttttccattattatacaaaatgaccctctctcttcccccatcatgaaaaaggatcttcttgagaactgtttcttccttgttatgttcagatcaagctggatctgatttttattgctttggacaaatgccaaagcatccaaatgaagtagagtagtgccccttgtctcttttagtgggtggatgccactgttttgcttaatgatctgcccagcagaatttttttttctctgaatattttccagtattcagcaccacatcctactgtcccaggtctgaggcagtttcacgtttacacgcagatcagtatctctacagtcaactaaaaagtaaaactgaaatttagtttctaccttcatttggagtttttctttcattgcacctccttcatatgaagctgtgaagtccagactttattatccctgcctctctcaccccaaacctggcatatacagagctctagttggtaaaacatcagctccaacacatatttgtcaagtgcatactatatgccatgcactgtgcttgcaagaaatacattatgaacgtagcaaaggtattttctatctaagacagctgctgttctggcaaaggtaagaagagtcatcacgcccactggtttaatattttaacataaacctaatatgaacacttttttcattttaaacttcttaaagagcaagttaacagagctactggaggttgtgtaaggaattggtgaataataaacataaaagatctctctcctttccaggacaccctcaatggtttgtttcaccaaatgtccaatctatatttaataagcctcaacagtcatttttctgaaggcattggccaggtcctccttgtggcagactttgaagagctattgcaaggtctaaacttgtgacatggaagaaaatacaactaaaaattaaatgatcttagaataaagaaggccttattaatttctagtgtcagaaattatcaaggaagagaatgtacttagctatgtaacacctcagaacttctttcaatcaaaagacattctgaactattctgaaagataaaagacaagctggggcagtatttacccatgtatgagaaagagttattaagagttcttacaaattaatatagatttataacataaagataattacactaatagaaaatgggccaagaacagaaaggtaagaccaacaaagaaagaaatatgatcaacaaaatagaagaaaaatgttcaacctcaacagcaatcaaagaaatgcaaattaaaatgatgagatagtatttttcacctatacaattgatgaagatttgtaacatttacccagtgaagttgggagtagggaacatcaggctctgtcatacacagttaatgaaagaacacctttcttaaggggacttaaataaggtgtatcaacgcctaaaaaattgacataccttttgtcccagaatttccatttctagaacattaactcaaagagaaccgccatggatgtgttcagaagtttagctaaaatgttcatcacaatattcttaaaatagtaatttttgaataaccatagtacagccatataataaaaatgccaaggagggattgaggaatactgagtgacataaaaagatgttctaaataaattgcgaagaagacaagttatataacagcatgtgcagtctaatcatttcattttttaaaaaaaggtacagtatgcacacagaataaagattgcttatacacatcaacatattatgagcattatctttattttgcttgtatgttctagattttcttaagcaatgtgcatttctttcatactaaaaatatttttaaataaaatatactaattatctttaaaatatgaacttcattgcatttttaaaatatacatgataaaaagaccggaaggctattgcccagaatgttgaccatggccttcccagagggtggaaacataggacacctttctttcttttttaaaaaatactttttggtattttcagcttttctacaatatttgtgtatttcattaacaaccagattagtaaccaaacatttaaaaaataagtactattttagctgttttgcatttgaggtgcaaatggatgaagatatttagtgagcagatagaaaacagagagtggtcaaaacagagatttggacctagggtcattctgcttggcatattaccaggaaggatcattttaatttactaatggtttgggggcagtagtgagtagagaaatgctctagaaaaagatgccatcatttgattcagtgcctcaatttttaaaaattaacagtacatcctcttactcggtactgtgccatttcttcatttacgtgttcaaagacactgccgatgtgtacaagtttgaactagaccagtggttcccaaactatggtttagggacccttgggaggggcacccttagaccctttcaggctgtctgcctgcaagataaaagccatttttataataatactaagatacaatttacctgtttcaccctttctctcttgactatacacaacggtgtttaaagagactgtgacatgcaatgacatcacttctgggatgtgtgcctgtgtcttcatgttgcaaaactttcttgggtttaacctccagtatggtaaacactgatagaaacaactcacataaacaaaagctctttagggtctgcgatcatttgtgagcctgtaaaagggccgtgagatgagtttgaaaacgactgagttagactgtgcctatgtcttatatgtggcaggctttcctctaacaagaatctggaccctcagtcctggtcagtgagtgcccttggacattgtagcacttctattctcactttctacatttttaaggaataatttcccttagctcttcaaaaaacttcatttttatagagtttgtgaagccaaaaagaaacattgctggcaccaggccactgtagcccctctgttacgtgtacattgagtcctgtcgaatgtgaggtgcatggaaatgttaaagggcaagttagacctccagactctgtctccacctgccttgtactgggaaattctgtgaagtttccggaagaaaatagcactataactcccttctgagaggtatggaagtgcaaatttaaaatacaacttaccatgtaattgagtagagggtcgatttggcatgaaagagagataagataaatttaaaataattaactgaatatgttaacgctcatttgtctttaaaatgcgtgcatgcatataatgtgtgcgtgtgtgtgtaaatatgtatgaaacatatacattccagaggattgcttcctaagttacgtagacttctctttgtacacagtcatcttgactatggaactatggtaatgcttctacgtcagtcccatctcttctcctcctttctgtctaaccagaaacacatttccgttgttctctctttgtgtgcatggctcaccaccaaatctcagagcagtgtgtggtgaagcactggctggtgtctacttctccaagaagcagtctgcattagcttgttctcacactgctaataaaagacatacctgagactgggtaatttataaagaaaaagaggtttaatggactcacagttacatcggaggcctcacaatcatgatggaaggtgaggaggagtgaagtcaaagtcacatcttgcatggcagcaggcaagagagagcatgtgcaggggaactcccctttataaaaccatcagatctcatgagacttattcaccgtcacaagaacagcatgggaaagacccacccccatgattcagttaacaattacctcctaccaggtccctcctatgatatgtgggaattatgggagctacagtttgaaatttgggtggggacacagccaaaccatatcacagtcttcatgttccagggcttatgctgaaaatctgaacctttttgtacagagagtttgagcatctgatgaatgattgtgttggagcacctcaaagtgagctctagccctgagactctgtgcacccactaccgtgtcatatggatatggcaatgccttgtcttgagtgaaagggtcatgtggcctgacttaacatctgataatgtcagaaaagatgaaggagagtctgaagaggtaggaggtaaattaagtcttcggaatagaaaagctggactttgtgttaagaccctataggccccagagaagaaaggatctgttttgacatgactgtaatataatttcaagtctgagaggcctagctgtgaatcatgataacttctttgaaatatggctgcagctactgaccatctgtcgggttctaactgaggtcggaggagagtcggtggatgagtggcaggcagctgaaagaccagtcaaggaatcatgggggcatttcaacatggctttattctctggacacacgggagctgtgggtgcaagcaagccatgggcacaagcaagccatgggtacaagcctgaggatgagccacaggtgcaagccgttacatacagcattagcagggtaattataccttttacagacaatagtggctccgagtcaagcatgagcacacatgagtggttacttaatgcacctcacatggcatggttacataacaggcagagctgtgtgcctgcactccaaactcgctgagtcatgctggactagatgtctgcctcggcctattcttgaccacagctcatccattttccttacaccatcaaacaggtttcatttgtaggaaagcacatattcagtcccacttcattcttgttgctggtactttcacacacattgtgattgttggttttggaatcttgttcatcctcattttttgaggatttaaagaggagtgcctagtattttcttaattaaaacaggctttgcttctctgcgtcccctgccccaaaccaatggactgccctgggccgtccttcatcaggagttttaattgcatgttgattgaactggtaggttcttgtcctacatcatcatgttggactaagcccacaacagccatgcagcctcagtaaagaggccctttggatactcaaagtgtgctgctgcctttttctttgtgactggtgatggctgggttcctacaacaacggccaggggattctgacctttatgaatcaggcagaggaatgcttctgtcttctttctccaagtcctcaactctgccctttttctgtcaattagtaggccttaatagatacaattaagagaattctacttagttaattggtgattggaaacatgattatttaggtacttaatctgtggtttgtccatctctagaatattaacaattgatttttgcctgattttacaaaggtatcatctcagtgggattgctatgtatgaaaggaaatttataatggaatgattgcttccaatccagtttattaatttaagtacgtaatactttagattggctttattttcccttcatttttgtgatacagaggccttataacgtatagctgtttgctggtattcttcccagcttcctattgtcctttgtcttcgtaaaataagcctagcagtattttctatattttcagagaatcttgtgcttttgaatatatgtacatcattggctttgtttttaaaaaaacttcatactgtgtgataaaattaatgtaataaaaaggtagagatgcctatttacaatttgcagaataatttgcagaaactcctcagttactgttcagaagacacatatttctagtccagtagacatctagtaaatgatgtttacttttaaatgcagagatttgatttgactaatcatagtttatatgttcttctggtttatttggttttcttttctattttttttaatggaatagttttgtaatttcttaccactctcaaactttaataaagtggcatcttgaggctagtttcagttaaatataaatataagcaattaattaagataaccaaccctaaccagagagataaagtatcatcgcgtgtcatagtgatcaaggagcacctgttaatgagaactgtaggaaaactgcaaccaatcatgaaaaaaaaagtgttgggtgaaattaacaatgtctgtgtttcttgttatttcttaaatccaacccataaacaatttgctgtgacagctctaggctgggattacggcatttgggatgaggtctgattatagctaaaaatagacacgtgtattgaagataagaaaaggaatattaaacaattgaaattttgtgaaagactgatgctgtttcattgtaataatttccccaaaggcacattagtaatgctgctaaatacagactttaatagactttaataatgtgtactttagaggcctgatacacaaaggaataatgtataaaacattcattatgaaaaattgctaccttttttatttaataagaaatctgttgaaacaaaacctatggcattgtgttcttggctattagcaggctgaagaataattgctaccttcttttacattttttcacctattctaatcaagttgcaatcatattttcttatttgttccatgaatgaaatggagattaaaaaaaaaaaaagtacttgcattgaatggacccttgttcaaattgtggctcattctctcgctaccttcatgatcttgggcaagttacctaaagtcaaaactccgtttctttatttgcaaactgaggattgttctacctatctaacaaggtaggaataagttaaatgttgacacagtggagtccctatgtaacagacactcagcaaatgctttctattatgattactttctacatctctttctctttatgttgcttgtttctttgaaggactgtagtggaggagctggaagggggttgagagtaggaaaaagcaattaaaaagataccttagctgctctgtagccaagccttgcattggatttcaatttgattttaatgtgctgctgctgagagccatgctgttgaaaaagagagaagagtaagaagcagatgctcttagaagaacagtggggcatttatctcttttaatgagataacatcattagagtgacaaagtgcagcgaatcaatactcgaaatggactggcgctatcttcccaaagtgcgctgattgttacacttcacaaccttagaatccgctgaatcacgaattctgtcttatctgttattagagccgctggctttgatctcacagactagatccacaccttagggatctccagaggaacaggaaaacagactaataggataaatgagaaaaatccaaggtgatttataaactgccctgtaatcaaggaacctcagagaaaggtggttgtgcttgttttttccttggacttctttaaatggctactcataactgccttcccctctgctcgctctccttgctctctgtctgcttcttggtgtaatgtcagaaacgctaatcatgtcagactgtgacactgacagccctgacattcacaacaaagagacaaggaggagagagaggaaaagagatgggggaggggggaggtgaggaaaagcagcaggagaagcatttttttattgcacataaaatccatagctgcagaatcacccacatctggacatgtcatatccaaggaaaatcaaggaaggcacaaggtgaattccaatagagattgaaactgagctggggattttcccctcttcttttagatttcattgtgtagtttatattagaattactgtgactatgatttcttctcatcaagaaaaagggcatttacatttatttttcctttttctttactacagtttttctcttcgaaacaaagcaaagttaaacacagatcttagcaggaagtgtgtgctgtcagaggttttccaatttattaccagattcccatagtttaatctgaacaatagccagttcaggaaagaagtcatgggtgagggatgttttctgaccatggcaaggctgaatgtcatgacaaagctgttcagtgtcatcctcaggcccttggcttctgcggcacctgcttaaagctgctggatgcagaaaatgctgatgttacctgttccctaacagtttggagtgggcttccaaatacctttgagacttctgtttctctcaggcactttctccatttggaataatgctggtgagtggtctgcaatctctgtcttggatcagtcatgacctgaaaatcggctgccacatctcacatgtgttttgaatccagatgctatgatctaaattgagctctgagctcaggctgaatcatcctagcttttctataaacatgagaagccagctgccagctcggcttttgaggtattttgaactataactctaagtcttaccgaagatagttatcatttcattttttcttcatgtcagaaaaaaaaaatcaaaaatggaaaatggtatccagtatttattctgtatcagttaccctgtcataaaagagggtacattttttgtccatattcaaacagaaggtattctgtacctagtgacttcttttcagattgattataaaaatattgagaactttggaaaaggctgataactcatttcacagtgttctcatctttagtacccaagtaaaattttacatacttgggctacttgatagaaatgctccacttaatttcaaaaaaaaaaaattaagtggattatgtggcgtagttgaagttccagcaactttgacattgtgacttgtttaatattcttgaggaaattctacttctattggcagaagagagtaaatttataccctatggaggatttgagagaatttaccccaaaatatcttcctgtaaattcaaattttctttgaagtgtttttaatcctaaaattttacatggattgttccctgtgatatgtgataggtccatgtttgttttcatgtaaaataatttaaaattacttgccacttaaattaattaggtcctatagtaggtaatgacagctggtataacagataagccctcaaaattgaatggtttgacacaactagtttcctttcttgctcagctctcagcccagtggaagtatttctgatcagtgaagtgcttttattgagaggtgattcaggaatcctgaactcaggtgccttccgtcttctggcctcaccatctattttgtctgctcaggctgctgtaacagagtaccacagactgggtggcttaaacaacagaaatgtgtggtcacacagttctgcagactaggagtcgaagatcaaggtgtcagcagggttggtttcttctgcggactgtgaggcaaggatctcttccaggccttgctccttggcttgtagaaggtcaccttttcccgagtctcttcacatcatcttccctcttttcctgtgtgtatccaaattttccctttttataaggacaccagtcatattggattaggggcacactctcttccagtatgacctcattttaactaattacatctgtaatggtcctattttcaaataaggtcactttctgaggtactgggggttaggacttcaccatgtgaattttgaggggacataattcatcctgtaacaccatcttgcaattgtctgcacctcacttcttaatcacagtcgccttgaagtaaagcaccatcttttctcatattcctttgttgagcactagtcacgtggctgcacctggaggtgaagtggcctgggaaatgtagtcccgtgctgaatagtgattgtgctagatggccacatgcacacacaggagccaccccatctttctcagaatgtgtatcaaactctcctgtatcttccagtgcttctgagcacacctgtccagagagctctcaaaaaggtaatcagtgttcaagtttgagaatcctattctagcatggctaggaatgcttttcagttaacaccctaaggatttatatgtaagtgagtgcctaaggttgcttactgttttgttttcttaagaatctaatatattctcaagggaattttacttacactagggttaatcactttttcttcttgtgaaactagtgaaatccaaatgaatgaagtttaactcttagccaaaaacttagcttgtggttagagtgattttctacagtacagtaactttttttgttacatgttctactattgctgaaaaatgatatatttccaagagggagaaaaggatattgtgagtgcagaagacggttgtataacctgctttgcttatctcaaatggctagactttagtatttaattaaagaagtcttgcctctcctatcaagttagtcattattttgaaggttgaacgtgggttttgtaagtgactaattgctttgtatgttccttttcaattacaataagaagttatgaattctctacatttagaactgctaaaaattatttagatttacctgttgaataggtttattctttaaaaaaaaaaaaaggaatcgagaaaaaatttccactgtaaatttttggattctccaaggaatttgtaagaaatctcccatgaaaaagagagtgatagcaatttgaaaaggataagtagttgcagtctgaaaactcagtaggtagtgtgaaagcacattaatactgaaccataatatgtaatgtaagattttagtcattaagaaaccactatattgctgtcttattgttctgttactttaaaacacagtttttacctaaagacttaaaacccaccaatggtattataaatttccttttggtcaaaaaactgacagttgtactgtagcaaagctagtcatttgaacagtggccttttcatttataatggttatagtttttaatatgtcaaaatcttagcaagtattcgagtcattttaagaatgaattaaatcctcattcattttgatattatgaattcagattttagagaagggtctaggatgaagtttgtcctttgtagatatttgataaataatcattattttaagtattaccattttatggaatccctgtttgccagatactgcattagcctctttacaatagactatattattgctaattttcaaacccaatttgcacagtagttggtattattcccactttacagatggggaaacgcagagacccttaagtaatgagcccaataatcacgtgtctagataaagcagatccaatatttgaatttggatcttagtgactccaaaatccatgcacgtttccattccgtcacattggaatgtcctaagcgtatttgttgaattgaattcgaaatatattgagtaaatttgcaatgaactaaacacaaatacaaaatcccagaatgaatgttttagttcttaaaagaatgagccatttgcaaatgtgcggatgaatgcagtagttgaaaatttgttccatctaatcattaaagcaagtctctaggacttttactcggtgacagtttagtagactgccacttccttaaatatgtgagcagtgtttgattcagaatacttcttaaatatccattatgtgaccaaattagagttctttagaactcttacagttccttaaaactggtttctacttcacactctcacacttgccctcctttctgaatgtggccaggttatgcaggtcttactgatttacagaagcaaacacaagaaaaggtagccttaagtcacggatgggcctggcccgaaggcaagatgaagaaaaccagtgagaagctcaaccagaaacctaaaatgaaagaaagctctcctcttgaaacacttcaccttttctcctttcctagcaaaatgataggcctgatttgtgatggttcagagttgctatctgcatcattttcagtttcatccagtttactttctcatagtttctgccgagcaattatggccaagccacatcccctgtttggaacttggtgtctccatatgtgaaacaaagcagtggaattagatcagagtcgttggtctggggtcttagcctaggttggcttcaggggttgtctctaaaatgctgggaagtgaatacaatatttggtatgcatatacatttttctggagggagaatggttcatagctcccatcagattcgccaaggggcttcagcttacaaagaaatcagtgggccagattatctttgaagtctgtagggactctagcattttagttttctataaattttatcgtacacagactatcacaggcaagatagttgagaaaataaatgggttttgtttcctttctacagtgtgacatgtaagggaaacttggagtgtttttactatagacaactgcttttctgttctgtaagataagtgttctggaatgtttgtggatagtgacaaaattctgttattagcagaagagcagaaatagtaaatcaattagaagtgattcacattttggtgatgaatgaacattttttcaggcctgaatatttcttacagttatctgtaatggtagcttaaagagtcatttaaaatagcactttcctatttggaatctcagacgcttggaatgttagtgcctaaaaatgctcagagttggctgcttgcggtggctcacgcctataatcccaccactttgggaggcccaggagggcggatcacaaggtcaggagttcaagaccagtttggccaacatagtgaaaccctgtctgtactaaaaatacaaaaagttagacgagtgtggtggtgtgcacctgtaatcccagctactcgggaggctgaggcaagagaaccacatgaacccctgtgacagaggttgcagtgagccgagatcatgccgttgcactccagcccaggtgacagtgcaagactccatctttaaaaaaaaaatgctcagagttaatagaccaattcctaccccaaagaagcagaggcttcagaggggagatgatatatctttggttctttcactgccatagtctctgtttggagagcatactgtcctgccagagaaccttctcatatgtgtcatggctcagcagattaaccaacctgaagcaagatccctattgctcagcagataaacagatgaaagaataaagaaaaatacttgagcacctcctccttctggtagggaagaaaaagaattaagtagcatcccctgtccagctgtttagtttgaagccaaaggaagcccactctttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacgggcgcccgccaccgcgcccggctaattttttgtatttttagtagatacggggtttcaccttgttagccaggatggtctcgatctcctgacctcatgatccacccgcctcggcctcccaaagtgctgggattacaggcgtgagccaccgcgcccggccggaagcccactcttgaagtgttaacttgcacattcactatactgaaacaacattttactactctccaggaaatcctagttcaatttaaacaaagactgtctcttagatgtttagatatgccttttaaacaatctgtgatctttacctacattgttgcttctctccaaaaaatgtatttgtttttttctgttggtgaattttaagaagttgcttttagaccaaatgtaaatatacaatataaatttctatatgtgtatgtttcacagccatttactctctctgtttctgtttaaattttaagcattttggctctgttttcttaggaaactttgtaaaaagagagtaattacgggtaggctgcactaatattatttgtcttcaaagttgctatgtataattcactattaagatttattctccagggtgagcccacaatttaaggtcaagaggaggcaaaatgttcagagctagcctttggaaactgatgttgttttttatttttttttaatccaatgctaaaaaacgtaaatactcagtcccctttcgctttttttttttttttttttcattttggggccaccagaccttattactagattggtagtatgaagtaactattaagatgtccagtttttcagtaggagcagaaaaagtaagtataaaatattagctatattattttattcagtttactagaataagcttacaaatgatcagtgtcttttggtcatgaatgagtacacagtatggcacacaattttgtaccgtgtatacttgtatatgtattttttttctttttttcttcgtgttttatttttgtttttatatatgtattttaatagatatgaataaatcagtgcccgggtaccaaataatgagcaccctcaaaatttgaatttcaaggaacagtggcagaaaatatcatttgaaactgaaactatcacagatcaacagaaaaatgactgaagttagctatgtataaaattcccataagttaacccacacttaaacaaattcatggtgtgtctactgacattctatacaaattcatggtgtgtctactgacattctatcaggaaaaataaaataaaataaatgtagataattaaactttacattttagaaattagaacacatttatatcaaaagcaaacagctggctgctggtctgtatgacagtcaccaaaaggagttggggagcctgaaagttttagggatgttcctgattatgacagcccaactggcagccatatgtcaccagtgcattttaagtctttaggcttgatgacagcaacctatgaccactgggctcccttgccagcaccttctgaactttgtgattttccgcatagtgagacccgtagcctcagcactggggcacttgtgctcttctgggagctttgctgctcctctaactgcatgacctcagcagagttcctctgcctctccaggccacagcctctatctaaaatgtacttaaaaagtactcacaccaaagatcggttgtgagagttaaatgaaaccactaatgtaaaagtgcctacgacagatcctgacccatagtaggtgctcaggaaatgttttaattttttaaaaaacagaataatctgatcctaatcctctgctcttctgggaaattctggttctcagattggttgataagcatttcagttaatctgtcagcctggcttttatgagtttgagtggaatgacccgtctctgtgaacagatccagatgatttcttcatcatgcaaagcagagtcctcagtgagcctgcgctcctggtgacccatcacatagtagaagcagattgcagagaagaccctaccaaaagcctcagctggctcgccctgcttcatgactgcacggtgatgttagtccttgtcagagttttatagattgggctgaaaagttgtttgtttcttttttaaacaagacaattaaactaagtatattcgtgtaccatagtaaatgagagaagtatgcatctcactcacaatatattttttagatgctgttaccctgatttatttttactttgacagatacttccgtttagggggtgctttccacagatagattctgttgtgcaatagaatattcggtacattttgcctctaggtttcctccagatctgtcaggtggccacacccaagcctctcagtattgccgtgttctcaataagacacttgatttatttatttagtagatgttcttagtttccctcaggaggtttttgttggcagaatttctaattttttatagggcatccttcttaatatagaggaagaccaattatgtatatgcaacagactcaaattaaaagtggcataattgcgattattcattgcttttgatttcacacttaattagccctctgaagtgaacaagtccttagtggttaagagtttgcactctgagagttatcagacctgggttcaaattccagctctgacacagaggcgttgtgagaccttggtcaaggtccctaaccttttcctaaacctatcatctgtaaaatactgatagaaatgcttaccttccagagctcttttgagtattatgttacatcatgcaagtgaagcacttaacactcagcacctgctgagagcacttggtaaatgctaccattgtcacgggggcaggggaggggcatgaggaccgagctctcaaaaagtgacttctccagtttaatttaataagcacttgggatttcacatttcctgcatattttacgataaccttgaaaggaacagacttaggccaaatttgataacaccgtgttttaaatttctaataagaataccacctgaaaccacactgacagtcatttgtaacttcttacagccaccgtactaaaaaaacaaaaagctactgtttattgataggtacatcttgagagtgacttcaaaagttacagtaaccttggttatattttagggaatataagaactctgaaaagaactttgtggggtctggaaaacactgtaaatggaagccgcttcattggatattactctagtgttgtaagagtggtttgacttagggctgttttggtttcttaagtggaacattttttgtgtgtgtctccctgtattttatattaattccaggtctgagtcagtggcgagtccagtaattgaattaatatggaaatcaaactgtaagctcatccttggaattacattcattatataacatggaaatgggctaaaacagagaaaattacagtactgttttactttctactttaaatatggtagaggatcggtctcttctatgagtgtatatgctgcaaaaaaattttttaaaagtagcctattaatacactatgattttaaagggggaaaacaatgtatgttcttattctgtgtcactgtccaagcatcagtaacactaaactggctgccagagtgaaaaagaaccaactacatttgcgtaatcatcataaaaattatattctgtctacatttttaattgagccagacattgcacagaattagacacagcctttgctctctgggagtttacagtgtaagacagaagatactaatgtgtgtagacgtgaagaccagttgaatttaacattttataaacgtggttggttctattttatgcctttctggccttccccaaccctcataacccatcatcagatgtcgtttcatccacaggtaattttcttcttaatttaagtaaccttatttcttaactatgaaaataatatatgttaattttagaaaaattggaaagtaaagtagaaagaaaaaacaaaaatcatgtataatcccacaaccacaaaaagatcgtgttatattttagtgacatttttaatgtatcatcttaaatgtatctatatattttacataattgggttctataaatgcagttttgccctgtgcttttttcacctaatgtatctttgcatgttttacatattaagaatttttttaaaacaccattttagtgattttataatattaggataattggaaaattgagaatccagctttcggtcccctgaaacagacatttaatgtgtaaaaagtcaaaggatcattccaactgttcaccagcccatccagacctgtttccgagacagagctattgttcacctaaagtggaagctcacccggctctgcatatttcctcaggctggttggctgttccgtgtctgtctccccccattgacttatcaggctctatgcatacatgcacatttgtttatagcagtcttcctgatacgcagccacgcatgggttttggaaaattgcccagctacataccattcataccggctgacattcagcttctggtagctaaacaggtactcttaactccttcagtctctaaagaactcactctacagtgccacaggccatggagctaacatactatcctctgagagtttctattcatggacacaaatgaaaagagaagtaatggcgcaagtattgtgagaggttacttgtaaaaatcaccagccctctgtttgccacccccttagccataccataggcaactgcttgagtttgtcctccttcaaccttaaggtgatgtttcctgaagcacttggaaagcaggtagagtctgcagggacttcccaggagtgacagagaccatccctggcctcctagaggatgggtgtgcccctgggctagggcttaccccttgtattaggaagagttgcctcatcatccctgaagccatttctttcatgaaacttcatatggtcctccacttcccccgggagcctgcttgtcttcttaccacttctgtttcttgtggagcatcagagtagaaagtccagtctgggtgagtggcaggaaagcagcagtgaaggggtggagggaggaaggttagccagagaggtgagtgagattgcaacaactgttgatgaggttcagaatctttcttttacctctgccagctcttacctttttttctccaaaagtgatttttactctctttcatcagtcttccttgtatgcaggaatctgaagaggaaatattcacaataatagcatgaggaaggaggaccctagataaagaggagatgttaaaatggcgtttattctagctacaaatatctccactgagcatgtttcagtagttaatcagagctttcttgcctggcacttttttaaatgatatcattatctggcttgctatttcagcagttccaggaataccttgcctgtgggtcagggtacttggtttcacataaacaactcataagaaccctttataatttcagaacgacagacaagagaagaaatagctatagaggttatatggacaaaaaataaattggcaacattcctcacctgtctaacatagacactgagaaaagacgtcctttgctacctctcatggttaaatgttgtttattgtttcctttcagaccacactgaatttagttccttggtagactaaggcacctttgaaattccagtgggagatcatgaagtacatgcctaattgcttcatggctgatatgaagtcctggaatgaaatccagccatcactcattaactaactcagcttagtaaaccttgacagctaacagaacccagtcaaacatccttgattaccagcagctcacagagcctggggagtagatcaggaagaatggtagagtagaatgagttattccagtaacatcagcttcatctgtttgaacttctcttcctgaaatctgagggtgacagaaatagatttgccaaatgcttttcctgctttcactggtggcagtaggaacaaataaatgaccattgtcttaattgggatactattcacggttattgacaagcataatcagtttttgttaaaactttttgcctggcttaaatctatgctagatcataagggaataaatgttattaggcatgttagaatttcacagatcacacttctcacagcaggaacctacagccagtcaacagttttactgactgtatgttatatatggacatttggtcaaggcataaactcggttactatctactgcaaaatcagtgtaaacataatgataaatctggttgattgatttgctttctgcttcatacaacaaaccaggtaatgtctctgaaagcaaatacattctaagttgtatataaatatcagtcattattatttcagtagataatctcacactgaggaggtaaaggttggtctgaattagtaaagaggccttccgtgcacacacacaatacacatctgtcacattccagctatgatttcacactgaatgccagcatttgagagggagtgagaggattttccctttgttttataaaaatgaaaacattatgtggtgtgttctcaaaatattagtgcagttttaagttcaaaatatcaaaggtataattgctatacccaggtaacaaacctgcacatgcgccccctgaatctaaaataaaaattgaaattattaaaagaattattattcccataaacttacaaaagaacttttcatagcttgtcctgctgttgctgagttggggaaaggcgagagtgaagatccgctgtgtgaggtgtagcctctttcctggtagtgatttggttcatattatttaaaagcaagggattcttggccttgtgcatggaagattgcatgttcatttgcctcagtattggacctatgacttatttaccttgtgaattaatacgttctcaatctcacagtttcatggaaccaatatttaattgaaggctataatgtgccaagcaccatgctggccactggaacaaggtgagagtgagaccatactcatgaggtctccagtggaagatcagtccctaagcccataatcaaagcctcagtgagcactgctaagagaagcctgtcctgattcttgagggcatgcaaagggtgaagcagttctgcctggatgaggtaggaaatccttgacggagaacgtgatatttgagctgcaacttcaagaatatggaagggttttcccagcagaggaaaaagatgaaggacattccagatagaaggaacagtatgtgatgggcctgaaggaaaaaagcacaccacgtgttcagggattgacaatatgtttccatttttaatttacttgagagagagagagagaaaagtgtctttgattctgagaagaacaaatcaataagagttacttagcagtggtgattaaaattatgtatctgtgcaacagagggttgctatcagcatcaaccaaaagcctcatgtctgcagcatctaccatgctatcatgctccaccccagaagtgagaggttcaaaggacgattggttgttttgaaagcagctcctgagattgacgaataatggtcaggaactccatgctggagaggccaattgcagggctagtgagtcctgcctgtgaatccataaccatcctaaatcacagtgtaatccttcagggctcagactgcagagtcagagagacctaggtacaagttctggttcttctgccattagcttagtatgggacttggggcaagtttctttcctttcttaaaaaacaaaataataataataagcctgagcaacaaagtgagactgtgtctacaatcaatgaatccatcaatcagtagccaggcatggtggtgccgtagctggtcccagctactcaagaggctgaggttagaggattgcttgagcccaggtgatcgaggctgcagtgagctgtgattgtgccagtgcaattgtagttcactgcactgtagttcaggtaacagagtaaaactctgtctctaaaataataaaatttaaacatgtaatattatatagctgtacaatacaaatgattttatataggtacataaatgtgataatagcatatacactttttggttccccatttttaaaaaaaaaacaacaacttttcctcttttgtctggatcactctcctcctcttttcccttctcccattttaactgcacatatagccttccatttttcccctgtttatgtaaatgtacaattacacacacacacacacacacacaccacacagtgggagtgaggggactgttattttgtttttaaaaaacaaaaacatgttatagagtgttctcaaagtgttaatgcattaaaaccacaacaacataccaccttaccccagccagaatggctataatgaaaaagtaaaaaaacaatagatattgatgtacatatagtgaaaagggaacacttacacactactggtgggaatgtaaattggtacaccctctgtggaaaacaatatggagatttctcaaagaactaaaagtagatctactattcaacccagcaatcccactactgggtatctacccaaagaagaagtcactatataaaaaggacacctgcaggtgtatgtttattgcagcacaattcacaattgcaaagatacgggttcaacctaagtgcccatcagatgatgagtggataaaacatgtgaggaatgtgtgtgtgtgtgtgtgtgtgtgtgtgtgtaatacacataattccatttcattctgttttatggctgagtagtattccatggtgtgtaaatagaatgcattccattccattggactggtgtgtattccacaccacacattccattcacacagtatggaatactactcagccatgaaaaagaatgaaataatgtctttgcagcaacttggatggaactggaggccattattctaagtgcagtaattcaggaattgaaagctaaataccatgttctcacttataagcaggtgctaagctatgggtacacaaaggcatacagagtggtgtaatggacattggagactcaagaggaggaggttgagaggtggttgaggcatgaaaagctacctgttgggtacagtgtacactacttgggtgacaggtacactaaaatcccaggatttaccactatacagtttattcatgtaaccaaaaacactagtatgcctaaagctattgaaataacatttttaagtattagtgcaattttaagttcataattttagaggtataattgctataaacttagaaacatttaaacatttagctatttatatttcttttatacttatttaactttggaattttgaataataaattttactcttagtttttttgtgcataatagtttttatattgattttaataagtaacatcaatattttaaaaagttaaatttttatttttcatatattgtttcttgaaagtgtatagcatttatacttctgaaattattaaagtttaaaatgcactaagacttttagaattccctgttaaacattctttttttatgttttgctcttctcagaaaactgtgttgaaatctcttcattcaattgataaagctctagaacattctttttaatgggtgcataatattccagtggggtaactattagaattttttattctacaattgccctactcatggatatttactttggtctcagtttttttggccattgtccacactgaaatcataaacatctttgtatttgttcttagatacagtgctattagttctatggcattggttcccaggagtgggattgcaggattaaagagtaaatgtaattttaaatttaatagatgatactataaatggctttaattaatcataataccttagattttagattcattgaaaataacattcacatgcattatttctttgatgcccacaataacctttgaggtagatagagtggatattattcccatttttctgatgagaagatggaggcacaagatgcttcatagtttcttatagttactcagttagaaagaccttcactccagtccagaactaagccttatcctcaataagctccatacagtctttctttacctacattttttgttttggtagatcagttagaagaaaaccttccaaatccatcaagttaagaaaaagaaaggtacctttggttatgccaccaggagggggcagtagttgaaacacatttatttttctaaatattagcaccccagccccttttaggggttgtatctttgtttctttgatatttgtaatgtcttaattttagttttaggttacttgtttcgtcattaaaatcttcattatgacagatggatacatttcattagtgatcaatttcttcccattttttttttaatttatagaaatacacactagagtgtctcccaagggttgtaatgcacattgtttccttggttcccttaaagaactccttcacatattcggagtctgactgactgttcaaatgccacttttgcaaacttactggcaatgtgattcggggcagttcatgtagtgctcagtttcctcatctgtaaaaaggggagaacataccttcctcctaagtatattttaacgagtcataaaaaatgtaaaccatttagcacagcatgtatcccagagcacaggctcagtacctacatgtgcatatgtggtcccctgcggaaccaggctaacactgctgatagtaacatgttgagtccagccatgtctcccaggaacacactgggtggtatgtattttttaaatactttgcatctgtgccattctcaaaatgccatcaagctcctctgcattttgtgcccaaagcaagtattgatgcagcacagctccttaaataaaagtgaaattataggaagtctcatggcatttctgggtactttttttttgagtgacaagtgtttaaaccacagtgaatactttggttcctgcaagggtttgattgagaggaacagcaaaaagaaatttagtttctcttcctccaagtgaacattgttttcttagctgtcttttttgggagttgggaaggagtggttactgaaaactaatagtgtgtgtaaataggagcgaggagtacagttagcgtttacgcactattactagtagacacgccccagaaatgggctcaggagacatctgggaacaaacagattttttcccttcaaatatgttaagaatctttttgtttctagtgggaacagctgtaggattcagctgtttgtttgtaatctgatgtctgagtgagggatgatgtttaagatgtagtatactaatatacagaatgtcatcttaggtaatagtgaggtggtgagggaagtggaatgaagctgggaaattcagtgttagagctgacatttcattctctccgaggtttgtgaaaaggccacagcaaactttgcatttccccaggaaggagggcggaggttcggttggtatcacaccctgcacattatttaaacactagcttgttgattttctcttctgtgaagagcagttatagaaagcgtgtttctggctgacttcatcctggttccctgctattttggtctacagcacttgggaacagggaaagtccgggtacctgctctgtgctgagaacaaaagtggacattttcttgaccaaaagtggcttctggcatcctttttcagaagcagtttttcagtgaaggaagagatgtttcaaggccaatatctagaaagagtacctaggtttatgattcacagtaccttcttatcagctttagaggtccttaagagtgaggatatgacatgggatctgttaaggatggcatttcccccatgaggaaagtgaagcccagagaaagcctgcgacagcccagagttgaggttaatcagtggcagaaccagaaaccccatgtcctaatgcctcctctagcattctgcataagcttcacagccttcaacccagggtgtaagttgggggagatttcatacgatccgatccacatttcgtgcattacgtttcaccagaggcccaaggagctaacgtaggcaatggtgtcagagacccaagtcctaatcagaattctaccacttactaactggaaggtcctggggatgttaacctcctaaatctcagtttcctcgtttgtaaaagaggtaattataaatagttcattgagttgttgtgggaactcacgtcataacatttgaaaagcttagtatgggatctgctgtacggtaggtgctcaatagatgatagtttttttatgggtcaggtgctgtgctacccactggaaatacaaagaaaaaataagataccatccctgccctcaagtagtctgcagtgtagttgggaagacagacatacatgtgaataaaatagtgtgcattgaatgtaatgagagcagcaaggtggtccataaagcgagcagactgcagttgtttgaggaggcttcagaatgaagtgttgcacagatttttgaagatgaataatagtgttaaggcaggcaaagattcttcctttcagaaggagaaaagagtacataatgtgctaatacctggacccatgaaataatattttaatattaacatattaaattaacatattaacatggagttggaatcagtttacagtgctgtggtctaaagtctccagccagagaagccagaaggacggcagaaaggaggacaatctaagtggcttggaggctactctgggtggatatgggtcaatcctgaaaggtttttaagctgggaagtaatatggtgatatttgtgttctataaagattactctgtggctacgtgaagcatgaactggaggaggcaggagcaggagggctggtaagacataatgagggcattgcatctggtttgggcaattggactctgtcaccaaaactgatttggaagtgatgatgttgagcagttctgacgcttgtagaaaaagtggaaggaggtaagggtaggtggggatacacacacattttttggatgggcccctcttttctgcccctacatccctctcctccggtgtgtcgtttccctgatctacttcaacctgcagatctatctagcaggcacctcacttggggatttgttcccataccagcaagaagcttataaattcctctgttaggcaccttaagctggttgaggttgtccaggtgccgtgaggtgcctcagagctgccccttcccagtgtgcactttccacagctatctcctgtttttcgaccactgaactctcaaactctcagtatttgcatattcttgtttcctgtaaatttgctccctccttcactaatctctgctcgccctgagctccagaattgtcattcctggagaccttggttaacatctgaaactcctgctttgctatgtgttttaagaatgtacatgttggatatgtgataaaatcagtacagccactgaaggggaaatgagaacagggcttggaaggaagaaatttgttacattcacaggtcccatagaggcgtgtcaccacatgctacgcagggccacaagggaaaacacccgtgttagtcaggaggcagaaggcaggagccaggggagagcttgggccagccacagcctttattggagtttccaagggaaaggcaaggcagggcagggttaacagtttagaattgctagttgaagtagtttggttaggctccaagctttctgggtggtccctgcttgcttggtacctggctgtggtatagtaaaggcagaggaatattgcctctgagggccagatagaggaggggtgtctctagattggtgaattttcttgtcaaaggcatgctaccagccgggctctttgttatctctgagaatcggctagccttgaaagagacagtctctctctagccagaaaggtagttttaagatgtcaaaacatctaatatgcagaaaatacaaaatatgtaaaatacataatgataccttctattcttagtcaacctgtttgcctgtttattgatctgagatctgatttcccaacccccagccactcaccccccaccgccccaacactgagaattttgaaaaattctctttcaaaagaagggattaggttttttccaccaaaaagttgtttttaatatgagaagtcaagcctttttgacatttcttattagttaatattctttccttaccagttaattgttcatttgttgtttttcttctgtcttatacaggcagttgtgaaaacaaaatggttgtataatttacctttaaaacctaccaagagagtttcttatgatttcagtgtaataggaaaaccattgtataaatgagaactctcaactttcctagaataaggaataagaaaaaataataaatattaatttcaaaacttagatatagaaaaagaacttcctaaatgcctgtgttttccaacttgaagtaacattgactttaaaatgcatttctaacaaagttcactcaggttcatttacttctttagattatgaagtatatcatacatgtggaagggaatatataacatgtagatacactttaaaggattaaataaagaaaacatccacatttctgctactcatctgaagaacattatcattgctactgaaacccttatgtacctctctcctattgttttctcctctccccaactactttcctggattttgagttacttactgtcttgtttgtttgcttttttttttttagttttactacatatgtaccacatataattttaccatatatatatcccaaagcaatatactatctcattttagcttttatgtaatagaatcatactgattattttgtgacttgctccccacaaaacacaatgttctgagttttatccaggttgacctgtgtaactttagttcattcattttcattgctatagaatattttattgtgtttattttactgtagtttatttagccatgccactgtcaaagggtcctacattttatcatgtatatggaaaccttattggcttccttattaataaaagtaatttgtagattctttatatcatttacaagtaatgatagttttttttccctttccaacccataaaatgttaattcttttttcttgtcttactgaactggcaagaatctccaatgttaaattaaaatagtgatagataaaactttaacttttcatttatattataaagtatggtatttgttatagggttgctttgtgatatcctttatccagttcaggaagtttctttctattctttgttttaatcatgaatgatgaatgttgtattttattgaatgctttttctatattctttgagataatcatatattttcttctttcatctagtgaataacactgattgatattgaagcaaccttgaattatggaataacccaaatttagacacattatttttctttggaaattattagatttgaattactaatattttgttcaggatttttgcatttatgttcataaatgagactgtcttatggttagtttctccttgaggttcttttatttttgggtttatatatttttgaagatacattattaggaacatattatatcttcccagggaattaaatatttctattaatatgtgatggccctttttatctctttgcctaaaattaactgtgtatgggtttaatttagctacaccagatttctgggttattatttgcctacgcagttcttcccccagcctcctttattcaaagacacaaaaggctttagatttgtgctttgtaaatcacataattggaatttgtctttttactagctttattaaggtataattttcatatgatcaaactcacatattttaagtgtacagtttgatgaattttggcaggtgtgtatagtcatgtaaccactaccacaataaagctatagatatttccgtcacaccagaaagttcctcatgcttttttgctatcagtttccttccctcacgtctggcattaggaaactactgatctattttttatcactatgttattttgtcttttccagaaagtcatacaaatgaaatcatacagtaagtagacttttgtgtttggcttctttcacttagtataatgcctttgagattcatttatgctgttacacatatcagagtttcattcctttatattttttcagtataatttcactgtatggatataccacaggtttttcgtttgtttgttttttagctattcacaagttgatggatatttgggtcatttccagttttttcaactattgtggataaagttgctatgaacattcacatgcaagtctgtgtggacatatgttgtctattttttaattcaatcagtcattgtcttttaagtaaaatattcagttgatgtatgttgtttagcagattacactaattattgattgcactaatgcatttatattcattttgaccatattattttttgctatttgtcctgcttttcctgagccttattttttctttattgccttcatttggattttgcttttgtttttttttttaaatatagttccatggtttttcttctactaatttaacagttgtacacaccattctcttttttccacgcttaccctagagatgttggcatcctatgtaacttaataaagtgttacactaaacagtattcattcttttctcaaacagttcagtaaccttagagttctttaatttggatcattctttttcagcctaacatgccatggttatttggtttatagttttatattattttttatattacacattattacaatttgtatacagtagcagctgttttttatactctatttaaacatagtcatgtatttactattttcttttctcaccatttcttcttctcagatcatcgctgttttctgaagcatgtcctttagaagtacctttaatgaatgtttttggaagtaaactttcttattttttgtttgattgaaaataccttctattcatgctttatttatgaaaggtagttttgctaggtatacacttacatattcagtattattttctttcagtgttttaaagacattttccccagatttcccccagagctttttttatgatggtcttctacagttttaccaggctttgtctgggtgggcatttcttttatttaacatccttgggatgcatttggctttctgaatttgatgattactagttctgaaaaatctcagaaaaaaaaattattttgaatgctgcctttcccacattgtctgttttttccttcacattctgccctttacatctctaaatatttcttttatattttccttctgtatgttatgtataatgtcttttttttttttttttttgagatggagtcttgctctgtcacccgggctgtagtgcaatggcatgatctcggctcactgcaacctttgcttcccaggttcaagcaattctcctgccccagccttccgagtagctgggattacaggcgcatgccaccacgcccagctaatttttgtatttttagtagaggtggggtttgcccattttggtcaggctggtctcgaactactgacctcgtgatccacctgccttggcctcccaaagtgctggaattacaggcgtgagccactgtgcccggccatataatttcttaaacgtaagattatatttttcatttttgtataagtttatgtacaatttctttatatctgtttaccaaatcactcattcctacttcagctgcatctattttggtattggacttactcatgtgagtctctaaatataattattatattttcatttctagaagttatttttggctgtttcttaaatctgcctagtcatttttgaaatcttccttgttcatattttaagatcctgtttacttttttaaaaatgttaaacacatctattttatatctgtgttcaatacattcaatagctaaagcctttgatgatttcattctgcagttttgttttttctcattcatgttcatgacagcttgattctttgttttgtgatttttgattgtgaacttaattacttggaattcttatgaaaatctcttgaaacttagatttaatattcattattctagagaggctttgtatttgcttctgctatgtgtttgtagtcatttccaactcaggactttttaccctatttggatttggaaagggcacatggatatgtaatttctgggctttgtttttgtttttttgtggggttttgtttttttttttcttcttgagacaagagtctcactttgtcacccaggctggagtgcagtggtgagatttcagctcgctgcaacctccacctcctgggttcaagcgattctcctagcttggcctcccaactagctgagactacgggtgcacactaccacacctggctaatttttttgtatttttagtagagacggggtttcatcatgttggccaggctggtctcaaacttctgacctcaagtgatcctcctgtctcggcctcccaaagtgctgggattacaggcgtgagccactgcacccagcctgggctttgtattttttgaggaaattttcttcttttttctcctctcccatcaccaagacttattctgtcttctatttctgggaagattttttttttttttaatttacccactgaggatttcatctttcaagggtattggctttgaccttcctgtgtggacattaggctgtccctttgtctcttaatatccccatcagggattgacttatgcaggacttacctacttacttctctaggttctaatttccttgtcattttcaacttttaacaattgctgttactttcttgctgcttagccatatctttaaaaatatttttagtactcagcatttttaggcattccacatgaatttgccatgcttgacaatcagaagtcctctttatttgaaagttgaaacatttcctggaagaggagcaatagtaaattagttagatccttgccattcatggatttcactacagtcaaaaaggtaactttacatcacaatagaatcatattttacctacaaaaagtagtatttggtttgtataaatattaatgttcaagattttgtctttttttctttggtcttctaaaatggagttacaaaaaggtctttaagaatcagtcactcatttactgacttttcaacaaatacttgttgagcccctacattttaggtgctggagacaagatgtatcagtgattaaagcagacaaaaattcttgctcctactgagcttacattctggttggaggagatggacagttaacaagataaataggtaaagtgtatagtatgttgaaaaggtgataagtgctgagggaaccctggggcaggtaaaggagaattgggagctgttctcattattctttttaaaataattttatcccaatagtaagcaatattatttattttttaaagaagatattttaaaagtaagacctatattaactgaagtttatgcagaaagttcctttaaatattctactacagcattattcctaaacttgtaaaggttaagttgcaattgatgtatacatttgtagaagtttctaaattagaaaaaaaaagtgttttataattccttggacacttgtttagtaagaaagtaaatgaatagaaatattgatcacaatagaacttcaactatacgatgccaaaacttgtaaaaaatcctcaggttttaaaaatagcatgaaactggaaaatgtttttttctgcccaccaattcccacaaaggcaaaaacaaacaaaatatccagcaacaactgactatcaaagggggctaaatatctgttagacttaactcactaggctggttctgaaagtcccaattggtgaaggtataaaagcccattcatttctttagtgcaaaaactgacaaacagggcaaaagtaaccagaagggaacaaagagagcagtggagacctttaaagacggcagcagtgtacaccagggtgcaaagcagcaggcactgttttaaaaggagcaccgttaatccagagactaaagctctgcagaccaagagcaaagcaccatttatagctcagttcccacaagggcatgaccatgctctattacaagcacatcagctgagggacagagagtctattattaaacaattgtagtggctacccgcaggaagtggggtgaatgtctgggttagtgtcctgacaccagtgacttcattgatccaacctgtgcaagtatcagggagggggtcagaataggaggagttattgcagaacgttattcatgagggagtttttcatcattaaggcatcatccaagactccatttttactgttgtttatgcttagacttttcttcacagtaaaaaattggggagactctccatcttcttgtaaagataaagaactctgaaaaatacataaatcactttagtggtttttctaattgtaaaaaataacagatgtttattgggaaaaagttcagaaaatcttttttttttttttaatcaccagtaacctgagagaaagcaactgttaacatcttgttatatacctgcagctccaaactgtgtgccaagatgctctggggcaccacagcaaattctgggtgcagctctagggttggcacagatactttccatcattaagggaaacatcgtacaacactctgccaactattagctggagatagttcacagtttcagcattagatcacactacattccttttgatgacatcatatctttacaaaaccgagttttcagtgattgctgagtgtttagtgataaaaagtgtatcacatgaaaaccagcgtggaacaggaaataaggtagtggtgtccagcgattccaagatttaaagttatgcagtgcccaacaggtgtatacattctataaacaagttataacaaagttacttgagaaggaaatagtagttttcatttatgtgtgtttttttttcagctgctaaatcattctgacataaatagttattatgttgtttggatctaactacttaacagacagctctattaggtatttgtttgggcctggaggcattgtgaaaaattactgagactctaagggctaccagaatcatttgggaacctctaatacagatcctttcggaccttcccctatatacaaccacacatatttttgaaacctattgttttctttgggttaacaatatattgtggaaatctttgcatgtcaataatatgtggatcattattttaaaattttaatggcagaatagttttccattgtttgaatttccatgttttttaaccaatcctttaatgttagaggtttagttaaacttcacttttatgccctgttgcacaggctggagtacagtggcatgatcatgactccctgcatcctctgcctcctgggctcaagcagtcctctggcctcaggcttccatgtagctgggactataggcaccaccacacctgactaatttttctatttttgtagagatggggtctcactatgttgcccaggctggtctcaaactcctgggctcaagtgattctcccaccttggcctcccaaagtactgagattacaggcgtgcagcactgcaccaggcctactttacttttataatcagcggtgtggtcagcctctttgcacatcctctttgtttatatagccagtgattccttaggctagattcctagaaagtgattttctaggtcaaagaatatgtactttttaatgacttttacatccatgtgtaaaatacagggagagagagcccaattgtcttttcaaagaggttacaccagtttcttttaaccaagtttacaagcctacctcagcaaaaagaagtgaaacattggagaactcccaaacatctaaattcagatttgtgaactggccaagcatgtttctctttctcaatcattgaataaagtgaatgaaagctggggaaatgtgtactttccaggagcgcctgggagcccttacagatgaagctccagctgaagtcagaggtagctgatagcaggccaggcgcagtggctcatgcctataaccccagcattttgggaagccaaggcattttggatcacttgaggtcaggtgtttgagaccagcctggacaacatggtaaaaccctgtctctactaaaaatataaaaaattacctgggcatggtggcaggtgcctgtaatccccagctatttgagaggctgaagcaggagaattgcttgaacccaggaggcaaaggttgcagtgagctgagatcatgccattgcactccagcctgggcaacaagagcgagactccatctcaaaaaaaaagaaaaagaaaaaaggaggtagctgatagcaacatccaaaatgacacccacctagggaataggaaaaccatttgcaaggaaacttctccagccttggttcactaactagttttttaaaacattttactccttgcaaagccatgctctaccacatagcttcactctacctctgtgaggaagaggcaaatgatacaaataggagttgacatcaggaattttttgagaggacaaatttcagaatactgtgagggtcaaacagactccttcctgttccatggtccacagcacataaatttattattattattattatactttaagttttagggtacatgtgcacaacgtgcaggttagttacatatgtatacatgtgccatgttggtgcgctgcacccagtaactcgtcatttagcattaggtatatttcctaatactattcctcccccctccccccaccccacgacaggccctggtgtgtgatgttccccttcctgtgtccatgtgttctcattgttcagttcccacctatgagtgagaacatgtggtgtttggttttttgtccttgcaatagtttgctgagaatgatggtttccagcttccatccatgtccctacaaaggacatgaactcatcattttttatggctgcatagtattccatggtgtatatgtgccacattttcttaatccagtctatcgttgttggacatttgggttggttccaaatctttgctattgtgaatagtgccgcaataaacatacgtgtgcatgtgtctttatagcagcatgatttataatcctttgggtatatacccagtaatgggattgctgggtcaaatggtatttctagttctggatccctgaggaatcgccacactgacttctgcaatggttgaactagtttatagtcccacgaacagtgtaaaagtgtttctatttctccacagcctctctagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccacttgttgatggggttgtttttttcttgtaaattttttggagttctttgtagattctggatattagccctttgtcagacgagtagatttcaaaactttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacattttaagtctttaatccatcttgaattaatttttgtataaggtgtaaggaagggatccactttcagctttctacaaatggctagccagttttcccagcaccatttattaaatagggaatcctttccctatttcttgtttttctcaggcttgtcaaagatcagatggttgtagatacgcggcattatttctgagggctctgttctgttccattggtctatatgtctgtcttggtaccagtaccatgctgttttggttactgtagccttgtagtatagtttgaagtcaggtagtgtgatgcctccagctttgttcttttggcttaggattgacttggcgatgcgggctcttttttggttccatatgaacttgaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttatttcattgagcagtggtttgtagttcttgaagaggtccttcacatcccttgtatgttggattcctgagtattttattctctttgaagcaattgtaaatgggagttccctcatgatttggctgtttgtctgttattggtgtataagaatgcttgtgatttttgtacattgattttatatcctgagactttgctgaagttgcttatcagcttaaggagattttgtgctgagatgatggggttttctagatatacaatcatgtcatctgcaaagagggacaatttgacttcctcttttcctaattgaataccctttatttccttctcctgcctaattgccctggccagaacttccaacactatgttgaataagagtggtgagacagggcatccctgtcttgtgactgttctcaaagggaatgcttccagtttttgcccattcagtatgatgttggctgtgggtttgtcataaatagctcttattattttgagatacatcccatcaatacctaatttattgagagtttttagcatgaagcgttgttgaattttgtcaaaggccttttctgcatctattgagataatcatgtggtttttgtctttggctctgtttatatgctggattatgtttattgatttgcgtatgttgaaccagccttgcatcccagggatgaagcccacttgatcatggtggataagctttttgatgtgctgctggatttgttttgccagtattttattgaggatttttgcatcaatgttcatcaaggatattggtctaaaattctcttttttggttgtgactctgccaggctttggtatcaggatgatgctggcctcataaaatgagttagggaggattccctctttttctattgattggaatagtttcagaaggaatggtacccagctcctccttgtacctctggtagaattcggctgtgaatccatctggtcctggactttttttggttggtaagctattaattattgcctcaatttcagaacctgttattggtctattcagagattcaacttgttcctggtttagtcttgggagggtgtctgtgtcgaggaatttatccatttcttctagattttcaagttttttgcgtagagatgtttgtagtattttctgatggtagtttgtatttctgtgggatcagtggtgatatcccctttatcattttttattgcatctatttgattcttctctcttttcttctttattagtcttgctagcagtctatcaatgttgttgatcttttcaaaaaaccagctcctggattcattgattttttgaaggttttttgtgtctctgtttccttcagttctgctctgatcttagttatttcttgccttctgctagcttttgaatgtgattgctcttgcttctctagttcttttaattgtgatgttagggtgtcaattttagatctttcctgctttctcttgtgggcatcacagtacataaattcttatctgtgaccaaattacctagcacattttgatctacattcaatttgtacacatgagctggtgtcttcaattataagttattaaggaaaaagtatattatgtgtcttagactgtgatcgtggaagcacagatatatggtacattttagaaatatttctattttaagaaaattttggagcccttcagctctctgggaaactaagctgtatagaacgcctcattcccaaagtatcctgaatggataaaatttggctgtaatttcacaggatgggaatgtatagtatctttttctttttacaatgaagatatcatctacctttagtcttgatttaaaatatttttaaatcaattttataattttataaaatagtctagattaatgctttttgaaaaatcagggcttagctgcttctgaaaagatgaatgtactcttaggggtccacatttgacttttttccaaattcaaataaaaattagtggggcaggatgttaagcaggataactctacttaaagcagaaaatctttaaaattttggtgtagataaattaaatctgtgttgtaaatacttatcacttcattgtttttacctgccttccatacatagtaccaaggacttattttcacttatatcagaggagaagtaaaaaaacgccactgtggtctgtttatcaaacaattgctacagagagggcctttccccttttgtgtagaaggagaatgtctgagctgttggaagtcttcatgtgactctctactgccacgagatattttcttttaaatctccgctagagaattctgccaaagtctggtgtgtttgtatgcatcatctttagagaagttgactgtattgagagaggggtgatttctgcctttatctgagatgggtacacttaggaaaaataagcttttcgggaacttaggaaaatttgaaggccatatcagttatttttatttgagtagcaaagttctctttatcatctttaaaaaaccaactacaagtccgctttcagagcactagatgtgtttgcagatttcggagacacacgccagagtgtgtagcgtaattacttaatcctcatctgtcatgcccagagcagtgttccttcaagataaaagaatgggcagcatcagagatgtctgggtagttccttcacccctggattttaaattcagaaaatcatgatcattctttgcttgcttgtccttagaaaattaaaatgcatattagtagacaaatctctggtgtctgaattttttgtttttattttattttttattttttgaaacagggttcttgctctcgtgaccagactggaatgtagtggcatgatcacagctcacggcagccccaacctcctgagctcaagtgatcctcccacctcagactcccaagtagctgggaccacaggtgtgtgccaccacgcccagctaatttttaaaaaattttttgtagcagcaaggtctcactatgttgcccagactggtcttgaactcctgagctcaagcagtcctcctgccttggcctcccaaagcgctaggattacaggcataagccaccacacctggccctggtctctgaattttttgtgataatcaggaactttcttttaacccacaccattttaattatatattcaccgaaagaacaaattttctgatagatgagagcactagtaatttaaataaatttagtcctatgctcattgacttattcaacatttataaagctccatcaatttataaacattgtccaggcacaagacagtatggctcctgcccttaagaagtttgatcctattgggaagctttcaagaaagccagtgtccaaaaatcgtgaagaagctctggggtggagtctgaagacattctctggagcagcattgttgggtccggctcagggctcagagaagcttctctgaggaactcctgctcagtctgaatctcaaaggttatgtggaagtcagagtactaatagccatgaaatccaaataaattcatcggccagaggttccgcttcttttagtacacattttcagacctataaccaccatcgagacgctggttggtaccattgtctatttgaatggtgccttctaatggttccagagccatccatcctgtctgtggttggcactggcattgtgggccactggccgttgtctgttacaggttgcagtggaaaggtaggatgttaagcattctgagttgctaagcattctgatattttttttccccagaataatgccaactgatggtactaggcctgtattacctagatttaacttgattggtttttaagtgagaccttgaatgactttctaatcagttgcttaactatgcctaatcatgatgctttgtatactcacacatgcaaataagcacatgtgtactttattgtttatatttatttaaaataaattctgatgttagtcatctgtgatttggggcaaatcatgaatagtgatatcagtattaccatttgtaagatgtggttaagagtagctgtaatttacctaacagggattaaatacttaatgtttgtaaagtgctgtgtttcattagaaaaaatatcattattatggtcattaatatgatttgcaaatcattagtaccaatcacagataatacacctgcaaaaataatcacatttctatacaaacctcagtttagatagctttaactttttttaatcccaaactttaattgctgagttttttggggcacagtgcctaaaagtatatcttttttttccttccagttagatctgtcccattgtaaaagggctgtgtaatgatttggcttctttaagggcaaaaatccttttttttttttttttttgagacggagtctcgctctgtcgccaggctggagtgcagtggcccgatctcggctcactgcaagctccgcctcccgggttcaagcaattcctctgcctcagcctccagagtagctggtactacaagcgcacgccaccacgcccagctaatttttgtattttagtaaagatggggtttcaccatgttggccaggatggtctttatctcctgacctcgtgatccaccggcctcggcctcccaaagtgctgggattacaggcatgagccaccgtgcctggcccaaaaatcctttcataaagaccataagtggtttaagtgaagactccaacttagatgtcgtctccatggggttcttttgtctcaagagaaaccaagtctgaagaaccatatagtctgactgaaaatagtgtggcctttttggaatgctttacagaaatttctaattaagaggtggtgtttgtcttaggtatacagacactgtttttgaaaagtctgcagtacaaaattcccatttagtttatttttagcttgagtctactctgctagtaaaaataaaactatttttgtacgtgctgcttctagtacttagatcctcattttaaaagaattcacagaaaacagtccatagtgataactgtgtgcactggccagattgttatagaattgtgttttaaataaatgttatgatggctgcattttagctgcatcacaggatccagctcacatgattcctgtcccctacagcccacacatgcacatacacaaagggcctcatccccgccttgcttacttagagtaaggacttggcttatctaatttctgtatttgtccagtgtgcaagtgctgactgtcctttgtgtattgtctaaggcctcacgtgcacagagagatactgaatacatgtctgtgatgacggttccccttaagagatgatggactgctcttttagggagttgtgtgtttctatggtaactcccttttgaaaacttcaattttatccacatatattttgcagatactgaaagcaagcttatgttgaatttagagaagctttaagtttttaggaggaaactgcagcttatcagcagatgtcaagagcatacatactttgaaagctcgttgaaaaaaattatgattccttttgtgcttgacacttaccaaaaaccaatgttccattcagataatcttttattgtcagttttttatgctccttagggtaaaagtcacaaatatatacacaatttgataaaattcaaaaggaacaaaataagcactattcctcctttggcctgtatccgcctctttcccatccccagttttgtacagtacaatgtcactagcttattgaattagatttactttaatcatccatttccttttctcctggttaccacaatagctatgggctctcagttagccagctacatctgatctagagaaaataggttatgtccctattttgaaaagagaattatctgcatggctcaatgctttgtgtatttaatagttagaattctggaagagatgtggacttccttcctgagcaataaaatatatgtatagtgaccatttcttaattctctagagaatgcagacaaagggatttgtgtagtctatgaggtctgcgtatataaaagttttcctttgcctttagttgccttattttacttttaggatgttttgtttcttttcttatacttccatatattttcactcttttccctttctttctgaaacacatattcagttgtcttaaaatcaaatcagctgtgcagtggatactgtatttggctttttccacatgtgttaattgttctgttggcttgttttgtttactgtttttgcagacctgatttgccatggtccgtgcctttcattctactagaccacgtagttgatttcccagtagggaaacgattctgctgtcttacccagtaattagttatctcatttcaaaagagacaagtttatctgagaggactttgtcacacgttaaatgtctgctttagaagatagagcccatttagttacttgcccatccatgtggtaaaagaaatgcataattagtcaccatggaaattaagtatttgaagggcagaagatggttaattcgaccatttatactcagctattgagagattatgatgtagtttattagtgctaagaaatcaaattaagagatgatatttttcagccccatgagggagtggcagtgttgtttatttctgaagcatattttcatttgctgagagaggactttgtggcactttcccttgaatagttttgtgtaacctcttgctatgtgagtaagtgccccccccccaccaaaagaagacacagagggagactgagttctgccatctccatatcgttacctccctagaataggagagggaagtaaattctggactctgccctgtgctcctgggtcttttcccatcccccagctcaaccacccgtctctcgttacttactacacatcatgaagcccctgcccaggcccctgatcctgttcaaccctgtctcaaagccacgctcttcctgatgtccctttcctagcttggcctctttaattattttcttcctgtcccaatcagttatgactgtgtggcttcatctttcaaccccgctcctgggtctacctgtgccttgcctcccacacctgcctttcttctcgatgagatagtgtaagtgaaatggctagaagtatgcattttgcaaggaaggggaatggccatttgatagtcacactacattgtgcaccaaggcattttagagcttttgtttgtgtaaaactttatgtgaacaaatggtctaatatttttaaaatttaaaaagatgtttgttaatcttatcttctgttgtatacaactcatatggactggctcctgcctacctctttagctccgtcttactccaagctcaccctcactgtcttccatctggggacagtttttgaatgtgccataccccatccttctacttggccactgcttgtgctccctttgtctgaaatgtttctccatgccccttccccagcagctccatatcccttcatcagagaggcatcacctccccctcagttaacgctctcatgacaccacatacctttccaacatcgcacttaatacagttgcaattttatctttatttgtataattatttcattaatgtctgccttcctcattattgtctatgtgcaggcagttcctggtctctgtgtttctagtgatcagtacaggagtggacatatagtaggtgctcaatgaatacctttcaaatgaccatcgtggatatctccaggggctcactcaatggccattagcccctttctagctggtgcaaccctgatttggttggagtatttcctctcctctaagcggccatctgctcgggcagctggtcccagccccagttcctgatccagtgggtgaatttgttgttagatatacaagatctggtcatcagcttggctcatgcacagcggtatgggtttccctggaacctacaaaataggaccgaaagatggaaagaacccaggccctcgaggatatcagtgagctgtgggctaaaccagtcctgggttggctttacttccaggcaactctgtcgtgtaaaataataaatttacttactgtttaggtcaattcaaagttttttgcttctgaaaataatctgatgcagaatatcatgagtgaatgaataaattaacaacccaatctcacttcttcacaaatttttgtgcccttagagttcctttgtaattgttttctcttttctcatttctgtgaagtgttggtctaccaagtgaatatgttgattggcattgagcccaatgctaaatcccaaataactcatatgtttcgaaaagtgtttccttccactaaatgccccacacctggaatgtgagctcgtattcttcttcacctcttgccctttggctctgcactttgttcatacctttttggggcaagctcttctctaaggaggttgagagtcaggttaagtcatacccagcaatttcctgtttgtgagccttgaagctcttgaagagtgcggcaggtttgacagaatctgtaggtgttgtcagacgtgagctgattcatcccctttggtagttaattctccaaaggtctcatctccccagctaccatcccttcttctctctggatgctgcacagttcttctttgtgtgaggatgagattttcagggccgcctgggtcatgtattccatgtcttttttgggttttggtgcatgtattttagaccctacttttctccatttttatgcaagagttactccgtgttgtttcatagcatttttgttgttgttgttcctgcagggctttgaatggtccctgtgaaatctgctgcctttctttttcatagtcctccacctcagctcaatataacacaacttagcctaagaaatgcaaggccctaagtaaagaccacctgaaatgcctacttgtttggtagtagaaactttggtgttctctcattattttctttatttcccagcatattggcaatgaaaactagacaatcacccatttttgtacaatgctcccctgaagtaaaccatgagagtggggcagctaagtaacccatctttgagaatgttatttttggccatgccatgtagaaaaaggactgaatttgtaacccaaaaacttgcattcttaaaccaaaataggaacagtcccactttggccaaccaccctgggcaagtagcacactctccaagattcagaatataattcttactgcctacaggggttgttatgaaagtagagtaagatgcagtggaagtgttgcttatgcctgggaagtgctatacaaaagtattaaaattgtaaggctataaagaaaaactcttgtgaagcgttttttttacaccactcgatacctacctcagtttccctccccaccttcagatatgcaaggctggtcaggaggttgggccccatgcacattgggattaggtcccctggaacttttcaggtgagtcactgcttcatcagatagcggaactccctcactaaccttggaattccaatcttttttaaaactttggtgatttccattggggaaaaaaaatctcttgtagttagtgatgaggccacctcaattgtcatctgagaataggactttatgcaatattgacaacccatccatgactttttttagtcggccagcatttttgcacacctgcttgtgccaggcattgttctcaatgcatgggatgtgtctgtgaacaaaacagacacaaattgctgccctcttagagcttctattctattggaggaaaacagaaaataagcaataaacaagcaaattatagtaagttagaaggtggtaattgctaggaaaaaaatttaaaaacagagcaggaaagaggagggccaatttggggataggaagaggctgcagttttaaattaggtgcttgttgtaggcctcctatatttctagtcttttgttattgttgttgtttttacagaatgttgtgatgatttactattgcaaatgaatcatctctgtataaattaaatattgcatgaaatgaaaggagttcagctaaaggcgaaacctgattgctaaatgcttgcaaaaggatgggaagttgctctagcccttgcatggcattctcaggttatctattcttagtttagtttccttttccaaaaatgatgtttattatatagtcttcgaatggaacatatcgctgacacctactgccatgtgtttatagttaaacataactagcctcccttcttacaagaccaagaggttcatccagaatgtttccctttagaagtcctaagaaggctctcctggttggctttccagcccataacagtgatagattttgcagccttcttagtctagccatgtggagaaacctgatgttttgggtaattcacccctttaaacatgtgctttgtgttttggtggtggttgtttggggctgcggtgtcttaggcatggagcttattatatccatataaattacagatcgcagacactccgcctcaaatagcattggatttatgatccctagctctccctttgcagtgccccttctcctcatgtctgctgtgcaacctgacttatggttgagcctgcttcaagttcttcctgccagtttgtccccttttccgcagtctgccttggtagctgactgggaggggccagcatgtgggttatcccattgtctgtggctgtacacaagaggctctcagtgggtctctttctacggacaggaccctgccaaagtaacacttgtgcttcctgtccagtactgactaacgcagtgctattcaaaaggcaggctagaactagggccatcagaatgaacacgttttgagcattggcagatatacttcctcccttcctggcctgttgttccccatcactcaccagattcagaaggtgcagtgctccttgggagcaaggctggggcgcttagagagagggtcccttaaagaggaagggggctaccctggctcattatgaactttttgggttctgaacctaccactcattattctgaattgtgcagcacatgtctgtcacctcctagtatagagtggccttgagaaagtcacctactccttctaggtctcagtttctcatctataaaaggagtagattactcttcaaatgaccttcaaaattgcttccacttctaattttgttttaagacactattgactacacttctcctaaaaattgatctttttgacgtgattgggctcttgagacttttttaccctttgtcctgatctgattctctccatgaatcaattttgttcatctcatctgtcactcttcctctgtatgctttgtaacctgcatttcctctacttctggcacttttttgccaatggaacctgcaattctactctgcaaatagctagggttgtttcctccctcactcccagccaaaatacagcttttatagtagtatctctgagtagggagttgggctattgagaaaaacatgctatagcccaaagtccctattttaaaagagatagagattggaatgatatgttctttttagggtgtggatgttttaggctccaatgaccataatcaaaatagatctataaccaagccgtaaaagggtaatatatgtgaattttctcataatatgaatcctaacacaaaagcagttacaatactttaagcgtaaattacatagtctgcaccatgattttttcaaaatttgtcttacgaacctcaaggaggaaaatgtaccccactggttaggaaagaattattttctctaggttccataacatagaaggagtgttttatttcctcactgccttgtgcctgggaatactgaaatgatagattcagccatgttttaataaaattcctctgtaagaatattagcatggagagagattggtataaatacatgaatgtgcctggattttgaaggtaaatcctatagctatcagattgctattcacttaattgccacaatctaaaatttatctgttagtgtttcttttctaattgttactagtgtgataaaaagaaaaactcttatttatatatagattatttgtttcaggacattaactgagaatatagtattgaaatgacttgaaattgaaggaatcagattttctactgcttatttattcagaatataacttacccaacaaggtctgatttaatttattttgaggagtagtatttagaagcaggattactcttatttaggaaaagaatctggatcttagatatacagtgacttgcccagagtcacctagtaaatgaaagaactataagtcaccacttgggcgtgtgattcatgatcttgactatgaattgataccagtactttacatgaaatggccatactctgaaaattatatttttagatataaccttaataaatatacttgcctttcacagaatattagaaccaattcctccttatcttcatggaggagcatacttaatgatatatgtactgatgagatttcgtcttatttttaaaaacttccaagaaagaatgtttcatagctcccttcattcatctactctggtgcttaattagatttgatacgagaacgctttctttcttatctaacttgaatccctcatgctgtagcttaagtctgttttctctcactctgcctaggatgccaaaagcagctaatcaccattatccatagtaatattcacaaagtcctccttatgtttgaaatgttagcgctataactgacagtaaacataacccccaagtatcagcaaattataaactagagaagagggactagcttgtagtaaatatagatgacatattagtatttagttgtgatgaatgaataacactaaataacgtgacttaagcattaagcagactaaatgaaaggcattcttctgttaactcattcacttaaatatttattaggcacctactttgtgatgctatgctacattcaagactttcaatgaaaatgatttttaaaaagtaaaacttattaagtatatttctcagaaatgtgaatgtacaatagcctaatattaacaagataaccctgtgccttatctaatcatcctgtggaatttacccatattttggaggtggggctgaaaaatagtctgattattagaacatttgtgtttatatttacagctgccctattactaaaatatgcagttggcatcaaaattttaccatacacagtcactgagcccttcacctggaagcctctttatttcagcattactgctgaagagttacctgtgtctttctgtgtgcatttgaacatgtgtgagcatgcagccagtgtagcactacaagatgcttatcgctagaaataaattatagagtcgtgcagcatgaaaattatatgcccgggaatgcagaacacagggttaccttctgcctcctttctttgtcatggacagcagaggcagaaaggagaaagagatttattctaaagccatttgaagctgaccaagcaatttataacagatgaaatgctgatttattgctgcagagaaaataatgggtgttcttgctaaaatgccattaatagctttattgtttaaagtgcaaattatattcagcaatttgttagtcctcttttgaggcaaagttgaagtaattcaatgtaggcttttagcagaaaaaaggacaaagtaattaacaaatcgtaaaagaattcattcaccaagattggctgatagttgaattctctgtctgaactataaagacatagggaaaatttgcacttaagaaatacaagatgactcaagtatttgtttaaaactgaaaagccataaggaagttggagttgggacactacagatttaggagtatgccttctgttggtgtccactgtgtctgcaagatgtggtagtcaaccagagaaaaactgaaaatcacatagttcctacccttacagatcttactgtcttatggcaggagcagataatataaaattaattaaaatatatagcagaggctagatgtggtggctcatatctgtaatcccagcactttgggagaccaaggtgggaacatcgtttgatcccaggagttcaagaccagcctgggcaatgtagtgagaccctgtgtctacaaaaaaaatttagtttttaattagccagccatagtggtatatgcctgcagtacaagctactcaggagactgaggcaggagggtcagttgagcctgggaggtcgaggctacagtaaggtgtgattgtaccactgtattccagcctgggcaacagagcaagactctgtctcaaaaaaataaaatatatagcaggaaagggtcagtatttcaggaaagggacacacgaaatgattccaaggaggaaaagacaacattcagaagatgacatttgtcagttttaaaacgcataggatttctgtagccatggtgtgggttataaaactgttccaaactgatagaatgccaaaaagtggaaagatctatgctagtcaacactgagtaggccctttgatgcatctgttgccatagagtgacaataaattctagtttgcctagatggaccctggttctacctgtctgcctcgtgtaattattgataggtccctcttctactcttaaaagtgtcccagtttaatggtgaattatacagtgactgtggtggccatgaaaatgcaccgctcagctctcttgctttaggcaacaccgctgactgactgactgactgacatcccaactgctgcccctctgaacccaccactgttttggcaccaaggctatgcttcccaagggctactcccagccattgaccatgcatggtgggggtgctaagtaaggcatgcccattccagcaacacaaggggtcctccactgagaagcttgggctcaagcactccccattgacatggctaaacccttctcggaactatgctgcactccaagacacttcacagcctatcctccttccttcctcctctccttcccaggggccagacctgcatctcgatctgaaggcttttcttgcctcctcctgcaccctaccccaagaaatctctagcacatcgaatcccatgttagtgtctgcttctcaggacatttgaagtaatgaagtggccgtagtaattgataagtgttagatagtagatgtgaataagactagaaagtaaaattgagactatattgcaagcaactttgaaaactgcatggaagaattaaaactacctttaactcagtagactctgaggctccattgaggagggtttatccattgtaaaataattattatttggtcttgctgatgatgtagaagggtaattgaaacaaggagaccagttgggagggtacagcaattgtccaataaaagtccaaactagagtagtgcatgtgattataaacactggcacgggcatgagagacgctgcaggggtgggcttggttgcttatcactgtagacagggataactacagagaaggctctggtgctaatcaaacccctcggagatgatcagaacaataagaaagggaagaggaggagacctaatgttttcattaaccctgcagtgagaaaagtactgggggcttgaaggagagtaatcatgtcttggtttctgcaagtagctaataggtgattaagacctcccatttaatggcatctggactgtctgctgcccatttcccagaccaaagagaggtgatattgcagtgcctgctcttatgctcctccctaaatgatagccaggatagcagcagctcactgttaatgctaaggacttctggcagttcaaggacagactaattggaacccagtgaaagatgcaggctgtgttttagaaggaaaggaccccacatttcttgatacctttagagcaggatgaaaagattttcatctgcctatatatccagcaattggatttttgtaataccactcttcccttctctccatcatgcacagggggagctggcctttccagttccatgaatatatccttttgaatgtttcgtttatgctggattttacaatgggcatcccccatgttattgactcaccaactgagatgtttgatgcaatagaaactccagatgcctcagctgataagtaacctgtatgaatcgagatatttctctcaggagatcaaacagaggagacaatgtgtagcacggtaggaagaagatggactttggaatttatcctgagagcaaatgatagctctgttacttgctagccctgagaccaatgctagttattttaacttcagtgtccttaacagtgagttgggagtactggtattttctgagttcttttgagcattacatgagtaaacatgagccttttacatagaagcgctggaaaaaaatgtaggttacttgccccttatcatatctctgttgtcctaattttcttacgttcttatttgttcttgttcccaagcccagcatcaccttggactcacacctctgttgaactcacactctcaaatcatacatccgcatcacttccactccacctacttactcagccctgctggggcaacccttagcagcctgtgtccctctcttgttctgcctgctgggatgccttgcctagcttttctgaggtcagaaccttcccactctggaagcatttggttcttcgtctctcaaatgagagaagcagctcagggagccacaaggcccttccagccctggtgtttcataggtccctgtacacgagaccaccacctgattgtgttcctttttcaaaacctattactgatttttctctttatcaaaaaacaacatgtttttataaaagatgttttcaaaaaaaggcaagtaaggaaagaatcaaaacacttataattttaccattcctgaatgtgtcttacagtcctgactgtaggtgtgcgtgtatgcgtgtgtgtgtgtgtgtaaaacagacacttaaccattacattcccactttttggtcacatccttttaaatgttgtaatctcttcaatttttaccatgtcacttgaatattcctctagagcatcatttcaagtatctgtctagaatccatgtatgaatgcttcatggcttattactggacatttttccaccgttgtctagtttttccactgttggaaacaaggcagagcattatgaaaagtgcagcaaatagcatcttctgtgtatctatcttttcagatatccttgaaatggaattaccagatcgaaaggcatgcatatttttaatgtgtttggtacaatattgtcatatttcccagctgaaaggatggacctgttcatttcctcccctctgggcatctgaggctttgaccacctggtttctgattagatcagtaagtcctacttgggtacgggagagaaaaaaataacatttttcctcacttgggtggatgtggctccaagtctcctatgtttttaaactccttgaatggaaaatcttcctggctagtgcacgatgcttcactatttgtcagccattagctcctctgcctcctgtaaattgccacctttaagtcaatgaggtgttcctttaaagttggactgtttgggaagagcctctctgtacctctgtctcatcaaactagaggatttcatctgtgtgtctttctgtaatctcatctcattttgcaacaagattttctatttcctctgttattggccttttgatttaatgttttaatttggcatgtaggttctttgtattactgttttgggtaattcatgccattctagatagagtattctgtaaaaattttttgaaacatcattttgtgaaagatgtcttacagacccaaattatttatttgcagaaacaaaaacaagatgaaaagctgtgcacttgtgataaccagataactttattttttcaattacggtgctcaggagaaaactgcctgttcttttatacaacaggaagaagacaagcacaatttttttttctaattgactatctggcacatgggttgttgcttaaacaggttgatcatagcacatttcctaatttttagggatgtgaacccatatgctccttagaagaagactaggtgggttggccttgctccttctagacaatgaaactactgttgtagggtaccctcgtgcacccgggatccaggataccagcgagtggctgccgcggaacggctctccaagtgtactgttacggcagcatgtgggaaggcttatggtatagtgatgtgacaagctgcgaacagcagatcagagaaaaacgtgagataatttaattgaggagtttggagagaggacagctgaagagcagagagcagggacgtggcagaaaaaggccatctgaggaagggataaattatgaaataacattctgaggacagggtgaaaagggtgcttcctcattctctggcagtttgggtcaatttcctaccctcagatactttgcaataaggaaaataatttatttttattactgccccttcttgcagtggcttttttttaaatattgcatatagcaagttacccatttctatgtaagaaaccaacttcctctttttgctgggtttggtacttactgtttctgccatattctaccctttcgggaaaaatttttttcttttttatttaagtagcagtagaaatgaaagagtaggatcgagctatgatatgttcactttgacttatcctacgtctcctggaggctactgcaagattttttatttcttcactgtcattggctctaatatctgaaatgaatagttttaatcgtcattcacaaaccacttgtaaagttagttttagaagttatttcttatagtttactcccagagtttccttacaggacaattgttaatttaacattatcctatcttttagtaaatcttaatcctaatatctgagtgcttaagaaacaacaaagagatcaaaaagagtttacctagaagtattaatgtatttgattattcacattgaaacaattcacctactaatttttcaattttctattttgtgtgtgtgttgagaccagtcatctatttaagtatgtgtgatcatctggtttagaacaaggtcttggaagagttgaccatcagttatgggtcatggagtagttacagccatttcagacacttctgattttatatttcattttagaaaactttcatatatgccagtgacagaatctgtgcctcagaatcgtatagaataatcaactttggtccttgaggacagacaccactggaaaacaaggatgaatacacagagcacacgcacgcaagagagagagtgctaaataaatatactttgctttgtgttgtgctcaattaacagatgtggtttgtccaaaaggcaagccataggaatcagagtcatgaccttggtcagtacattatgtcatagagttcaacagagtcaggtaacatcacttctgcgggtcatctttggtcacacgtggtgatgaaagactattgattctagcttagatttaaccccaaacctcactacccctaaatttaatcttaaaaataaattattcatctttcacatcttcagaattctctttctgtgcacatgcacataagtctatacatagaatttaatgtaaaaattttaaagcaaaaattctagcttcaaactcttattgaagtttaatgtgttattggttacacagttgaaaatataaagtgtggttggaagtcaaagagaaaaagtcacaaaatgacactgccagacacacaaggacattgtcttcctctaccggtttctccccagctgccttctacactgtcttctcttacttaaacccatgtgttttacctctctgtgcaaatccaatcatgtactttcggaagatgatatcctactctttgtagtggagtgggtcaagatgtccaaattcgtcagagggagacttaatgcgttcacatattataatatgaatgatttgatttaaagacctggcacaccagtcatatttgggagaatgtcacttcacacaattttaaaggatatatctgcagaaagagaccctcgagggagcttcaagaagccttgtcaagcatttttccatcattctgggagagctttgatcctattttaaactcttcactgaaaagtttatatgtgtgtgaactagtttctaaaaagctgactatgtactagttttgtaaacactttttctattcacttgcaacccccacatcttcctaagtttatctccaaatgctttatattacccaagcacttgaacaagattgcagacattttcatctaagctagtagcagttaattacctatctttgtctgtgtttcagcacttaatactattttgacaggggttgcatactttctgtctttctggatttttttaagtgctcttatgagtaatttgagaaattccaagtacagattagatgagctattctttcctttgttgcttttttctactttaaacatttaaagaggacccactatgtgtcaggcagtatgcgcttgtctctcccacatacagtgtctgatttagtctcttcttaccctgaaactgcatctgcaatcaccaccataatctcagtttatatgtggtttatttggggggtgggagggagtgtttgagagagtggtacagaaaggtcacgatctctgggaactatatccttttttattagtgatttcgtctacaaggatgttgctgctcccatctttatttgtctccttggtaaaatccagacaaataaatggaagagaagttggttaatggaagagaagtgttttacaatcacggatgatcgctctctgggatctttcaacataagcatgtttctgtttcttttgaaaaacttgtgtttactcacctgcattgtaggtgaataggaagcctaactccccaaatggagtgtgtcaggaaggattacgaatttatttatgtttgcttctagaatatttgtaagaaattggttttattactctcttcagtggggcttactcacccagtcattgtttaaatatctcaggactgtcattctgaaacagtggtgttcctgaaggtgctttcccgaacctgaggagtgaaacctgcctcagatgcgggcaggcccagccaggatctcccttttttggctcaacccctgctttcctcctctggggccagacccatggcagctctgccagtgccttactggcctcagggataatgctctgtctcttccagctcttctcttggctcccaaacttttctccttctctccttcctccctccctccctccttccctctgtttttccctccctccttccctctgtccttcccaatccttcaaaaaacatttattgagtgcctactgatgacacagcactgtataaagttctagggatccagagctaaataaatagacttttctttgtgttgtacacaattaacagatgtggttttcccaaaaggcaagccattggaatcagttttttaaataaaggaaaaaatatctctagatgaatcatctctatattcctatttagagttgccatcaaagtagttgtaggtgagcattttctagcatgaaaatttttcaggatgacattcatccaacgaatacttattaagtgcttggtgtgacaagttctgtgctggacactagaaacataaagacaggtaagatcaggcccctttctccaaagactttccttctaacaggggaaagagttctataacatatatagtaatgtcatagcagatctccacagggatgctgaagagttcatgattatgagtgttgagcagggtcggggcaggagtttcattcactgctgtatttaaagtgcctgagacagtgcctgacacatagtaggctcttaatattagtatttgttgaccaaccaatgggggcagccctcagtcagggcttattcaaggagctgacgtttcagctgtttcatgaaggatgaggaaaacattgccaaagaggagaagcacattctagatagatagaatgccagcaaaagtggaggatgtggaggtgcacaggggttcatggaatggcctcagggtacctcagaaggaagtgttgaagagatgctttcagaaaggcaaactggggtcagagtatgaaaggtttgaaggctttggcctttttcatactgctcctaccagggtggggaggtgtggttcaggtaaccttgtggagtggaaactgttttccttattccacagatgaggaaaccaaggcacagagaagggaagtaacttgcccagcgttgcacaaccgataatgggcagaggtgaatttgaaccaagcaggcaggcaggttctagagactgcattcttaactgcaagccacactaccttcatattgtcatcgatgttactattaatttttccttcattgtaccatctcagtcctattccccagctctctagctgccaagactttatggggagtagaaggaaaggggtgtctggtgcctgacctttctgatcatctctcttcacataaagcagacctatccctgtcactgtctcgttccctccagaccctgtctgaggctggaaacgaatttgataaaggaatctgcagtgaatggaggatagtggataaatgagttagccttctaagaaacacatctacattttaactaacttgcaactggctgtcacccagaagagtgacaaatttcatgccaatagggaattctttttagctggaataccttaaatcacacccaaggctagcttagcctgcctctaatcatgtccaatgtattatttgtataatgtctcttccttttttttattattcttaatactatttccctaattatcacagtcactcttactcattgaaactttagaaaatagaagcaaacagaagaaaatttaaatcttttataatgatcttcctacccagcagtaaccactgtagactttatagagattttatgtctataatctttttttcattgtgtatacatgaaatatgtctgaatataaggcaagaagggggttttgtttggccaaacattatccttaaagtgggcatcatcttataatcaactccctgtaagtctcagattatggacactcctctattattttattttgaataacaaagtactgtttgggcaaatagtcctgaaattatcctgaaatcacctcaatcagcttgagttttgggtgcttatagaggtcacttgatagaattgctgtaaaaataagtgttgaaattcaacagaaacttggccattatagctaaagatgtgaccccatagcctaggattggatgccatgctgagcaagtcttttttatatagagcacttttaagaacaacacaataagtgatgcaatggcagagatcacatacagcccaaatgataacaccagctttcttaatatgatggaaatggatgtttcccactcaggatcaaatatccagtgacagcatcacatactaagtcaaagattctatctcagacaatgagaggtgttagatgactcgaaagacgttctaacaatgatgaagacattgaagatgaatgtgaaacatttgaattaaaaaaaaattttttttgagacagagtctagttctgtcacccaggatgaagtgcagtggtgcaatctcagctcacttataacctcgacctcatgggttcaagtgattctcgtacctcagccaccaaatagctgggattataggcataagccaccacacccagctagtttttgtatttttaatagagacagggttttgccatgttggccaggttggtctcgaactcctggccttaagtggtctgccctccttggcctcccaaagtgctgggattacaggcgtgagccactgcacacagcctgaatagaatttttaataaaatatgatttcagaaaacacttacaaatcaacctattatcatgtgtaaaatctaatttgaagtatgtatatacaactaaataaattaggtatcataagaagatgattattttatcacattcctcagagtttatatactcaagttagcaaagctgtttgtctttgttattgttgttttgttttgttattttgtattctcattggtaaaatgggagatcatttattgaggctaccttatattcaggtatatatggtaatatagattcattggtttaaaaaaaaaaaaaaaaacgggatcggggcggggtatggtggcttacacctgtaatcccagcactttgggatgccgaggcaggcggatcacttgaggtcaggagttcgtgactagcccggtcaacatggtgaaaccccgtctctactgaaaatacaaaaattagctggatatggtggcatgcgcctgtaatcccagctactcaggaggctgaggcaggagaatcgcctgaacccaggaggtggaggttgcagtgagccgagatcacgcccctgcactccagcctggaggacagagcaagactccatccctgggtgggggagcagttggaaaaaaaaatgtatcacgcaatacattttattttataacctactttgtacattttataaaattatgactattttccatgccttaagtttcttaaccttatcatccttatcatttgtaatggctgcactagaatttgtggactagcatctatttagccagtcctttcttgttagatattgaaggttttttcatttccttactatgataagtaaccttgatgaatatctgcatagataagtctctaagtgtatctatggctatttttcttaagttaaatttctagaaatagaattgctgagtcaggaacttgcagaattttaaagtatttaatataagttgccaggtcgcaccaaccaggaatactttcattgtatcttagggaattattcaattatcattcccttgtgacagtgtcttaattaattcaaagtaactctttagcatgatcattttattgctgtagaatatgtttgttttatctcccttcttcctccacctcatatgtctgaattagtattaaatacaagttagaggatttcatgtctatttcactgtccaaacctattgattgaaaatatttgctaccacctgggctcagccaaagtgtttctgtagtaccatgtggtatattacccttttcctgtgaatgacattaaatcattagaaagtatccctgtgtcttttgaggtggaaaaatctatcattttccttcaattcaatggaatactattactatagtttactgtaattgtgttctttttattcccatttgttgcatatgttgctaatcttcccattatacagcctcagaagataaggaagcttgcaaagccttcattatgggagacactgctagtttgacaccaagtagctttcttctctttgtctaccaattagcagaatcccttgtatagttgagctgctaaccaaaattgtgtttcccagcctcactggccatgcgactaagttatggccaatgagatgtaagaagtgtgcgtcagagttctaggaagtcttaaagggatggactgcacccttcttcagcccttttccatggggttccttggaacatgagtgtgatggctggagcaccagcatcattttagacttggaagaggaggaggactgtatcctagaactggtaggaaggaaaactggcaggagcttgggtcctgatgaatgaggaagctccgtatcatcctggactgcttgcccctgacttattttacatgagaaaaataaacttccatgttatttaagccctgatttggggagggtgtctattagctggagtctggcttaaccgtctgaaacaatgatcttgtagattttatggccacttatcttcctgttccctttcctacattttacttctctagtctcattagctaaaagggatttcttagttgaattagaggacctccacccccacctgtgtggaagtacaactggtagtgttcaaatggaagataaggacacatccgaacactgttacacaatcacgcttaccgtgttcattcacaaatactgttgaaggactgttggtttgttgaatatccccaacccctacccctcctccccagaaaaaaaagggagggagattattgcataaagaactaacaaatgaactctgctctatcagaaagtaagtggggcgtggcaacctagaggtgatgaggcagcagctggtctataagcgaagacagctccacgtagtcagcttgagtgtcttcagggagccagtcactgtgcatgcacacagcctgcaggggacctttccccaccttctccctcacttttcttactaaattatgatcacgtgttaggtctgtctggctcttccagcaaacagctcaaggcacaccactttttacatggaacattaaatattataaaacataatcatgaggaacatggcagaggatgactagaagacgtagagaaagaagaaaagggtggagaaaggataaaaagagaaaaattccagattttagccatgggcatatagaatcactgtaaacagactttttaaaaatctggtgatggattcataaaggcctttgatgcctttttttttagtgaagtcaccctgagagcaaacaaggaagtcaagtaggcatatcctgtttattcttcttgctaaagtgcatgtgtacgggaagatgatgaggcggaaaggacaatccttcaaaaagatgaacctggctcccattctgatgtgtcctacttgaggcccgcaggtttaacttcaccccagtctccttcccattccgctttcttgttacaaaaccatgtggtacgtgaattaatacatacatacagacattaaagtggggtcttggtattgagtttactatgccccagctcattgtgtttgtttccattcctgatagagctgttgggagttattatttagtggcaagaaatcggtagagctggagaggtgggcctggaagatgtcttctcagtttaatatgttctatctcctaggatgtgtccttcggtggatttaatgaattcgcctcagtaattcatattggcttgtcatctccaagctattatagtgatttttttcaatgattttttttttaaggagaagacttacatggatcctttttctacccactattagatttgtctgtatccccctgctggtttattttattttttatttatttttttgagatggatctcactctgtcacccaggctggagtgcaatggcaccatctcagctgactacagcctctgcctcccacaggcgattcttctgcctcagcctaccaagtaggtgagactacaggcacacgccaccacgcatggctaatttttgtatttttagtagagacggggcttcaccatgttggccagactggtctcgaactcctgaccttgggtgatccacccgcctcgacctcccaaagtgctgggattacaggcgtgagccaccgtgcccagcctccctgctggtttaaatggactctcactgtccagttcgtgtccatgtttctcccatttgtatctttgattaaatctagaatgagcctttggttatgagaaaacatatcagagagggagagagagagagactgtgtgtgtgtgtgtgtgtgtgtgtgtgtgtgtgttttatgattagaatagtcatgatctcatagagtattagggctgggagaatctgcgaagtcatcgctgtcaccacttcttatgttttattgttgcaaacccagagtcccaaagaggtgaaatcacttgctctgatcacacagagtcaatctaagcctagtcccactcacttcatccagctgtcccacactgcctggctttgcaagacagcagccgaatcttattagaagtctgggcatcgagtcctccttcttggtttagaattgtcttggaataaatcatcctggttggggagagcaccagagaattatagaatcccacaggcttctcaaagataattcactttaaactgttctccgtaaaagccacataaaaatgtccaacaaatcatagaaaaatgagctcatggagttaaccacaaacttgaataagaatgtgtttgtccagagctagaagtatgtagaagatgttttcaaaagtgtggcaagtagtaaaaattgggagaagaaagagactggagcctggtttggttctcattgtttttctgggaaagaacggagaaactagttagatccaattctccttgccccaccctaatttttgatgttctcagaatttgtttctttgaagttcaagctaatagatttatggcctctttaagcagttgaaaaccatcacattacactcaaatgcacatgttttttctcactccagcagaaacatctgaaagttctgtttaggtatttgcaaagaactagtatgcctctcagatagcatatactttaggcagaactgctcttgtctaacttatttcatgtgacatgcagtggagggattgttgaatgaaatgttagtgtgagtattccttaggtgttattgtgtcttgggtttaaaaatggcagatggagtcaagacaagcctgtccctctttctgtctgtgtcaggctttgccgtctgttctcttcctggcttcactggaacagacatttttttttatgtatgtgcacagtgctagtgtcacaggatgacatgacatgctaccaggactgcctcactgtcaggatgggtccagtgactctacaagttcctttttgaaatgggaatctggtctagatttttgcacatctgttagcttcttcacataagtccaagtctttctcacatgctaatttccttgtatcctatttctttgtaggatttaaaaaaaaaaaaagaaagaaaagaaaaatagcatggtttagtgctcattattgtagggcctggctgttatgttcacatttggtgaccactgctttttgctgctcctgtggaattaatttttgcctttttttcatcttaatctgtgcaattttatgatacaccagccctggtaatattaagtagcatttgtagttaatctgttcattattattagctttgcttaattttgccggtgatatcccctctccttcctaacagttcactatagccattttctgcatcacatttataaggagaaggtaaatagtgggccaggggaggggtgtttctagggtgccttctatgtgtaaggcattttatatattgaatccttatcaaaataaacatatgaggtaataattatcagtcccattttgccagtgtggcagctgaggctgagaagaacttaaatgatttgtcagagattccgcagctactgctgcagttggcaaggatttgaaatcagatctctctgactccaaaaccaggctctttccataatgttacattcacaaagcagccaccagtgttaatagtcctatttatccataatagaactgaccctgaagtttataaaaagaagaagaaagtcaattatgtaggtatctctggagataaagaaactcagccgtagcagtgagcaacaacaaaacagcgcagagtcacagcacaggattgtgctcgtgggactgactgatcacaggaaggagaaccctggtggctaggtgatgtctgaggaagggtaactggccttggagaaattcaggaagcttgggtgaagtgacaaaagagaaagaaggaaagaggcagagcagtagaaaacaagaagcagccaagataagaagtagggatgatgagctggccgtggcagagttgagaaacagcagtggaggtggccacagacctggcggcagtggaaagggtcagagacgatgatagaggctcagtgtatcatccacattccgccagccatgagacctgagtcagcatatgatgtgtgcccagtgaatgtctggtgagtgaggaaataagtgggaggagggctaatgcaaagagaatacaaggctcctagtaatcttgatcatagtagggtctgctcttattagacggagtcttgctctgttgcccaggctggagtgcagtggcatgatcacagctcactgtagcctcaacctcctgggctccagcagtcctcctactcagctctcgagtatctgagaccacaggcgtgtaccaccatgcctggctaattttttgtgttttggggtagagacagggttttgccctgttgcctaggctggtctcaagcgatccatccacctcagcttcccaaagtgccgggattacaggtgcgagctactgtgcccagcctaatgctttactttaaaggttgtttgtgaacagaattctgatcaatgtcaagcattcagtaaaacttaggcgagaagtgtagccgagggttactggtgcagaagcatcataatctaaagtcttggtgcagattctcaaaatgtgagcgatagatggcaaggtgtaggtaacaaggagggaacatgttatgatgaagctagagataaggttttagttggctgtgtcaggagggaggacaatggtagcaacaagtacagaaaatgtttgtaggatgtgaaaactactttgaagaaggaggacaaggctgcctcagtttcattctccattcggaagaaaatggctttagcatgctgccagggaggtgatactgttgcacggtcatcactccattggggcaggagaaaaattactcaaggaggcaactgaaaattattccaggagtataaatctcagggccactgctaaggctggatctgttcatcccatgtttcctgccatctgctctgcctgtatctgccatgtagatctcaataactgttaaagactcaaggccccagagacagggaggcatgaccctcctaagttgatgggaaggaattgccccagccctgtcagaccctctcccacagaggctacctgccctgaccaaagcacatgccagttatttgcacaaggcttcaattcaaccagaccatacagctctccatttagacataaataccagctcctctagcaaataccctgacttttggtcaagaagactgggcactgtgaaaagcctcactctggaggctgccattctggagatggtcaccattcagattattctatgcactgcctgtttctgctgcataattattaccatcccagtgaaacttgcccataggcccctgaccacctgaactatacatcccatgattccagctctaccaggtgctccaggctactcctgcctcactaaccccatccgaccaggaaggactcttctcatccatcctcttgtaaaatgtcagccttcatcactcttcatgcctaggttgatactacaaacagggcactgatgtacatcatcaaaatatttctatactgtattacagaaatatttctaaattaaaatggattaaaagcgaagtcatgtgtttgaagtgtttgggcaaaaatgcatttctaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgatccagccatcccattactgggtatatacccaaaggattataaatcatgctgctataaagacacatgcacacatgtttattgcagcactattcacaatagcaaagactttgaaccaacccaaatgtccaacagtgatagactgaattaagaaaacgtggcacatatacaccatggaatactatgcagccataaaaaatgatgagttcatgtcctttgtagggacatgaatgaagctggaaaccatcattctcagcaaactatcgcaagggcaaaaaaccaaacaccgcatgttctcactcataggtgggaattgaacaatgagaacacttggacacaggaaggggaacatcacacactggggcctgttgtggggtgtggggagggtggagggatagcattaggagatatacctaatgttaaatgacgacttaatcagtgcagcacaccaacatggcacatgtatacatatgtaacaaacctgcacgttgtgcacatgtaccctaaaacttaaagtacaataaaaaataaataaataaataaataaaataaaataaaaagaaaatgcttttctaaagaggaattattttctttcttcttctcccttccttacatactgaattatatctcaaagcctgagtttaagattacctgatttaacgtaggtgagggcatttggcagcattgaagatgtgctggcagcagatgtactcaattctgggtttattcaattctgctgtgtcttccacccagaggggccagttacatctctgctgagtttactcttgcatttcacttcaatttccttcctggtttctccttaggacacagataaaaataagtccttatttaatattatgattgctacatgggttttgaaggaggaggagaaggacaaaggatgaggtgggcagagaaaatataaaaaagtagaaaatataatcttctgggagctatgataaatctagttgaagagacaagaaattaactaatttgcatttgaatagccatcaaagcagtaagtgctataaaagagatcaaaaggaagtactctacttatcaccaagtgagtgatccagatctgggctgcacgttctcaggaatgaccagagctgtcttcctggaggagatgtggtttaactgggtcttggagcgtaactggacagaagtgggcactttgggtgggaaaagatgatatgcaaatacagggagtgggtacagtgcagggctcaagaagtggttcagccaggcagaaaggggaaataggattggaaagacaggctggcaccaagttgttgggggccatgaatacaagctgagttgtggactgcccttttgtaagcccaggaaaaccattacagtggcttaatggtggtgtccctgacaggttgctggggcacaaaccagagatggaagaccagtgagaggttcttgtaatggtgtagccacggtaggggtgggaggaggaacctgcacaaaaatgatgactgtaagagtaaagagacagagatggactctgggcacatatcaaaggagtaatctgtgagatgttggtgaaaactgaatatgaatattggtggggccaggacaacagaggaaccagaaagataaaatcagagaagaccctgaggctccaagtctaggagcctggaagtatgattggtagacataggaaggtgggaggggtggctggtatgtaacccaggctggttctgatgcttggtatataacccagatttgatcaaagctgtttagggggtatgaccagccctgttgcatgctggaaggataatgttctgccttaggaaaaaatagacgaagaccaagtcaggttgacttacgtaatgctacattgcttgcaagtagaagtcgtagccacttggcagaagagcgtggtttacactctttggatgagtctctaggacttagatagcttcctctcttaacatctaccacattgttgtatccatttttactgctacctgattcacagtagtgtgtgttttcatttactttttattagccagcagtggcttctaaatgggataagcctggatgtggttatgtccatcatcagcaaaagtaacagcctcttgacctcctggcatgaacatgtaatactaaggaggagcagtctctgaagctctgtttccacttaatttaggaatgcaatcactttcattggctggcataacaatggtgagcttaattttttagttgtgagtgaaagcagcttgctcagcttggcattctctttgccgtggcagctggcccactgacctcatcatttgggttccctttcttatggtggaaccaataccacaaaattgaaatgctgtattttccacagagtcacgctacatgtgattgtttgtttacaatgacataatgctttaaactttagttcagcccgcccaaaaatggacataaatgtggtatttgaagggtgagctcatgtgtagaaaaagaattgagattcgccataataaagggttacgttaatgaccacagtctgtccttctggagcttgcctatctattcagaggctttcgctgagatttgggccattagaagcaggaagtttggtatcctgatggcctcccctggttctcagcaggttggtgtctttgaactactttgggagaagctactgcattttggaattattacaaaatgaggagtcaactacacaaaggtgaccctttcttttgaagccagccggcagtgtacaaaggcataagtgtaatcaccaacaagaaaatgatgcctcctactctgattcagcagctgacacaggacttgaagcaggctgtgagtgtggaatttctgaattcattgaaagttcatgtttctcatccacatgtcacagaattcatcttgtgttgttttttagggtcaaacttcactattactagtaaatgcctctgataactggtacatgcttctactcccttttccccagtggtcctccagagagcccactcctggatttgtcaggtggggtaggtgatactgatgtgaaagtcaatcttccgctctcaggagtgactcttcccactaaaagaccatattaacactaataacatctaagagtttatgcttcccaaaacattttgcatgtgtattaccttattcagttctcacaaacaactctgtaaagcaggtagtatcagatgaattttatagatggaaaaaactaaagttcacagattaaccgcaggtcttaaagcaaagcaacaaacagggccaggattttaaccagattgtttgccttcagatttcatgctcttctaacttcaccaccttcgcgtaagcaaagcctctgcatctgcagtatggcctctagctgtcttagtattgtcccatggtgaagcagggggtgctggcctgtaccagctgttcacaattgatggttcctattgggatgaaaccactggaggtagatagaagtccatgagctccagacagctggctttcaattccagttctgctattctgttagcatgataaccataagcaagttatctaacctcttcaagcctcaatttccaccttggtaaatgagaatgctaaaagtactcacgctcagggtcatactctactgaatgataaccacatttgtaaaagcatgtggtacatatgttacagtgccaggcaaaagagaaaatgctccttcggtgttagctcctgtgtcagcatcaccctaatcaggtaggaccagtgcatcctagctggtggctgcattaacacctgtatcctaggtcacctgtatcctgggcatgggcctatactgatcaaggagacctcctctatcttggaggatgtcttacgacttctcactgcatctcatcacaccagcaggaattccaccagtcaacggtgtactctaacaaatcccaaaagctggccaggcaccgtggcttactcctgtaatcccaacacttggagagggcaaagcaggcagatcacatgaggtcaggggtttgagaccagcctgaccaacatggtgaaaccccgtctctactaaaaaatataaaaattagccaggcacagtggtgagcacctgtaatcccagctactcgggaggctgaggcaggggaattgcttgaaccctggaggtggaggttgcagtgagctgagatcgcgccactgcattccagactgggtgacagaacgagactctgtctcaaaaaacaaacaacaacaacaaaaaaaaaacttcttgaactgataagcaacttcagcaaagtctcaggatacaaaatcaatgtgcaaaaatcacaagcattcctttacaccaacagtaggcaagcagagagccaaatcatgaatgaactcccattcacaattgctacaaagagaataaaatacctaggaatacagctaacaagggatgtgaaggacctcttcaaggataactacaaaccactgctccaggaagtaagagaggacacaaacaaatggaaaaacattccatcctcatggataggaagaatcagtattgtgaaaatggccacacattctgcacatgtaccctagaacttaaagtataataataaaaaaaaagaaagaaaccacatggatacagagaggggaacaacacacaccatggcctgttgggaggtgaggggagggaacttagaggacatgtcagtaggtgcagcaaaccgccatggcacgtgtacacctgtgtaacaaacctgcacattctgcacatgtaccccgtttttttagaagaaaaagaaatatgtgacagagaagtaggaaaccacttaatgaagtttttagggctccagtagtctgggacagtggttctaaaactatttgatatccagaaccctttatagattttttgttattatactttaagttttagggtacatgtgcgcaacgtgcaggtttgttacatatgtatacatgtgccatattggtgtgctgcacccattaactcgtcatttagcattaggtatatctcctaatgctatcccttcacccttcccccatccccaccccacaacaggccccagtgtgtgatgttccccttcctgtgtccaagtgttctcattgttcaattcccacctatgagtgagaacatgcggtgtttggttttttgcccttgcgatagtttgctgagaatgatggtttccagcttcattcatgtccccacaaaggacatgaactcatcattttttatggctgcatagtattccatggtgtatatgtgccacattttcttaatccagtctaccattgttggacatttgggttggttcaaagtctttgctattgtgagtagtactgcaataaacatatgtgtgcatgtgtctttatagcagcatggtttataatactttgggtatatacccagtaatgggattgctgggtcaaatggtatttctagttctagatccctgagcaatcaccacactgacttccacaatggttgaactagtttacagtcccaccaacagtgtaaaattttttgttgttgttgttgagacagagtctcgccctgccaccaggctggagtgcagtggcacgatcttggctcactgcaacctccgccccccaggttcaagcaattctcctgcctcagcctcctgagtagctgggactacaggcgcccgccatcacacccagctaatttttatatttttagtagaaacagggtttcaccatgttggccagaatggtctggatctctttacctcgtgatccacccgcctcggcctcccaaagtgctgggattacaggcatgagccacggcgcctggcctatagactcttaccaccaaacaaattaaaactgagggaaaaaaaatccccaaagcctagtaggatgaataccttaaattgtcagtcatttgcatcttgatatggattctttcctccacttccttcccaagaccaaaagaaaggagagtttggtgctgaggaggaataagagggaaggagaagcataggccaggatggggtaaggggcaaagccagaagagctctttgggcacctgtggaccatggctggggaaatggagatgggggggcataagggaaaagtgcatgggaaggctgtgaatcctggtccacagttttccttggggttagctccatgcaaaccttactttcaatagatacttacatatcaccatctaaagaaagtccttgcactgcgtagtttttacacatgtggctacttccaattgccagaagcacctttaaagtgtcaacggtcttcatttttcaagtcccgtgacttctcagagaggacgctgctcagcaggaactgttcaaacgcaagagcctcacaccacagcagatcgccgagctgagccaaagagtctgtacaacatcttccacatgaggccaaatactagctgtcccacctggcttcttttttaactctaaacatctcaggtaacttgagataattaaatcacactacattctttctgattttttaatgtaaatcatttctgagcaagaaagtcacatcttcccagcctcccaaagccattttaagtgcagggttattgttttttaaaggaagaggaagatgaattatttgtgtctcagaaagctgttatcctggcgtctccttttctgccaaggcggtataataaacagctctaccccacttcccaccctggtgcctgaggcttgccctagagggaaatgcctttgaaggaaaaaccaccagcaaggccagttgtaacagaggccgggggagaggctcgcagccttgcttcacctcaaaaagggggtccacgtcttctcatgcctgcagccatcaaccccggagcggagcgggaaatccttacctggagggtggcatttacaatctcagacgcatttcacagtctctctttggagcaacttcagtgtgtatgggctggaaaagagggtaagtgtgttacttttttttatgcaacaacgtataactgtgtcaacacataagacagtctgtcaaagctttctgctggtgttgctgctgtgaattaattttgagcgtcacttgtgagcagtaaacacttttgcagtgtgaacaactcttttgtacagtaggagttgtcaacagcttgccatcccccctttaaagggaggaaggaaacagaggctgcctcctccctgtcaagttaagttggctggagtaggaggagcagaaatttgtggcactcccattttgcagttttatcttttcttttgaccactcggctgttagattttcagtgagactggaggataaatgtagtgtgtagaattaagaatctgattaagccactgggcatctggccacttcttgctgttttagaattggttctagaatgtatggtctacatcacttttgcccttaaatttgttagagataccaccataaagagcaagatgcaaaaacacaacacatctgccaaacactgactagagagagatgcttctcagtgttttacattttattgctgttatgttgaatatttaattgaactttatttacacagttaaaacataatcacttcactagggttgacacttcatgtagctctatgttcatgttcactcttttgtttctttttatttaaaggtctttgttccttctcccctcttcatcccgtaactaaatattgaagtctacaactctttgtaactgtggcagacccaaagctttctcttctgcccgtgccgtatctgccagtagcactgagagcattgttgacactgtagcagcaagcttccttgactctgacccacatttttgagatgtgttcccgagtccctatccctttcaaacatgttaataatctattgttcccattctagcagctactgaaatacgttttagcatgcacaatccttaaggtatatgtgctttgtgtgtttacatagaacctgttctataaagtcatgcttctccttttgtcctcaaattccttccttcaggttttgtaatgggacctgcttgttctaacatcctaaaatatgtttattaaagaccttattccacctgttcatatcccacagatcgcaaagtggagcctagagactttctctctccacgctttcctctgtttccctgcagccggccctcctggccacctggcatagtgctcttgctgtactgtatgcagagaatggtcagcaaatgaggatgactgatttgtctcaattcacaaataaagcagcaactagagggtggcaggggtggatgaggtgggttttcacccatttggcgttgtcttatgggttgaaagagttccaggggccctgtgagaagacccctgccacttgttcagtagagaagttgcgtgtgctgggtatggagcccaaggtgggtgcctgtgtgacaaagcaggcctgaggtcaccctgggggtgtgagggatgcatgtgcccggtggaatgggcatggtctgcacatgccactgaagtcaaccagtacacagcatctgacccgtcccccatttttttccattggttctgagcagagaagcagttttacacccagtgaaaaggatgcaactgttctctttcctaagatgtgaacgtttggagaggattggtctttttcagaggcaaacgtgctgtttctcttgcctacctgggagggtggttagctcaccccattcctgacggcagaggataatccatatcatgagaaccttcaaagggttaaccaagaaggtttttaaaatggaaatcatcatgaaatatatgtaacatgaaaggcaaatgcaaaatacttaaatgacaggtggcatcatttgaaaaggatgtaggggctgatcccagagctgtgatcatacacagctgcattaatttgcctaatcactggattgctgtaactggtgtctataaataaacacacaaactaatcttttgattatctttttttatggcacattttcttctctcttccttttttttcttctccgtgtcttttcattgtgactaaaccatatttctaaactctgtaattccacagattcttttataactgttattttaaacaaccaaaataactttggacagttcacaaaatgagaaatacagatggccgataaatgtatgagaagcttttttattgcttttggaaaaatgcaaggaaaaaaatcaatgaagtgtcatttttaagtatcagatagacaaaggttaaaattattagaaaaattccagtgttggcaagagtgtgagggaacaagcattcgtgtgcaaggtcactgggcattcttgctggtgttctggcattaggtatcagaatgatcagtgtgcgtaaaattgcacactggttgacttctagggatttacccaaaaataataatgacaaaacagaaagatactttctcaaggatttttaggtgagcattgtttacaatggtgggaaaaatgggaaactagaaatgatcatcaaatgagagctcattaagtaaattctggtacataaaagaataccgtacatatattaagaaagatcataaggtttgtatttattaccaaggacagaggttacaatacattacagtgtggaaaaagcaagttacaaaacaagggatataacatatttgcagttttagtacatcctgctgtgtcagggcccgaaattctgaattgttaacaatttccttagtgttgtcaatgctgctggtctgtggaccacactctgagtagcaggttaaagtgtacacagacatctctgtgtgaataaacacttggaaatacacgtggaaagtttcctgagatggtgaatctggatatttacttttgtctttgtgcttttctgtattgtttaatacttcataatgcatctgtatcaagctttacataaacaataaagctgggttttaaataataaatagcctgttggacacgtttttttaaaagttggctgcagctgcagatctgcttctcaaacactgaaagcgggagggagcagaccacctgggcccatcatttttaaggatggaagatcattagaatcacatgggagactttgaaaaacatggattctccaacctgacctctagaaattctgactcagccacccttaagtggagatatcagtttttgacaaaagttcccctggcgactctgactcacactaggtctggccccatgcagccatcgggtttcttcatcagctttggggcccaggcctgcattcggaggagagtcgcaccctccctcctgctcccctcagaatcattgtgctttggggcatcaggaggcgattttggtgttctcacataagatttctatttctaatagaaatttctttatgttttcccaccggtcttcttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttatgtatttttagtagagacggggtttcaccgttttagctgggatggtctcgatctcctgacctcgtgatccgcccgcctcggcctcccaaagtgctgggattacaggcgtgagccaccgcgcccggcccccaccggtcttcttataagctgtcctagccttcagtgttagtgtcctaggtctgcttaacaaattatcacaaactggacaatttaaaacaatgtttattctctcacagttctggtggcctgaagtccaaaatcaaggtgtttcagggccacacttcctccaaaggcttcagggcagaatcatcccttgcctgtcccagcttctggggaggctccaggtgttcctcagctcatggctaaatgactccaatctctgcctccacttctgtcttcttctcttctcttggccttctcctctgtcttctcttctgtgtcttctaaggacacctccccttggatttagggcctactcaggtaatccaggatgatttcatctcgagattctcaacttaattacatctgcgaaggtccttttccaacataaagtttcatttccaggttctagaagttaggacacctgtattgttggggacctcaattcaaccccctactccttctaaactattcaacaacagttttgaagttaagcaaaacattctagatttaccattttacttttctctgccgttaagttctccggttttatgtctcttttttatgtgtaactataggaaggtctcccatgaaaaaaatagaaccattgccatgggcagtcagtagctacactagcaatgtgtctgccctgtgaagctcaggcttctgtcctggtgggtctccctcttgtcaagcagttttctcagccatcagaggggctgggagagccaggcctcgccaacactttctctgaacacattcacacttcttgcctgtgctcttctttgcccaggctctcctgggatgcagaaatcagggaggtgtttactgaggaataaaactaatgtctcagtagaaatttttttaaaatgtcatagtaagtctattattgattgtgttcagttggactttgagcagatttggggccactttccccatcccagccctcaaggagaaagagaaaagacaagactaaaatgagtgtggccatgtatcccatcttactgccttcaagaagtcctttcctgtaaaccttttttttgattgttcttgttgttctggtaagggagggcgaactgggtttgattctgagactgccacaagcctgtctctttttttgtgttgtactgactcgatccttgcttcacgctacagatttctcacagtgggtatttttagttgaggaggaggtttctcaaaaatactttgccgatgtctggtcatgcacaacccctgggcatccccagtgaagtgctttgagtcatggccccttaagggcagagaggatgtgcatttggcccatggtgtgctttgcctggacgtgtgtcatttcccaaaatatacaggaggagaaccagattagtaaaaggaaaccttgtcacacatggtagggttctgctgccccagaatcaacctttacagctggaaaggttcagcctttcttacttggaagggtcatattcattgaactgcagttaaaacagtcttaccaatagataggtagcctcacaccagaaatggggggcaaaaggcagaatcactaaacatttaagcaacacatgagtaaaaatatttggcctctttttttctttgtttaaaatatgcaaaggtggccgggcacggtggctcacacatgtaatcccagcactttgggaggccgaggtgggcgaattacctgaggtcaggagttcgagaccagcctgaccaacatggtgaaaccccatctctactaaaaatacaaaaaattagctgggtatggtggtggacgcctgtaagatcccagctactcgggaggctgaggcaggagaattgcttgagcccggaaggtggaggttgcagtgagccaagattgtgccactgcactccagcctgggcacaacagagtaagactcgtctcaaaataaattaattaattaattaataaaatgcaaaggctttttgctccaagatagctgaaatttagatatatatctttttattaaaatagtttttatttaaataagcaaataataaccgttaagaaaagttagaaaattttaaaaatcagaaaaaacaacaagaaggaaccctatctacctagagcttcccagggttccaggctggttacagagtcagagccctcttagctaacctgactgggtgttttctcattagttgaaaaatcaattaaacagtgaatcattttttaaaaagatactacatagcctaaatcatgtatttaacctaaagttgcaaatgaacagttatttgccaatcttttgatgtgggctcgaggccttttcttcgagtttgggtctgctgattggaacttcatgtaatctttcatgcacattattgcatgatttccattttcagtctctttaagtgaggaattttttaagacacttgcaacacagtctgactgcaaagtcattttaaatttttattatttccccaatctttcacagttgtctcaatcatatctaattcaatggcagatttcctctagtgacttactttcatttctttaattttactaaattttcatacaaataactattttcacactcatattttatgggccaacataatatttaatttctgtaattacaaagcaagtatagctgacattaacagtttatgcagagagagctgatgtgctccagagttcgagagagaacattcagtattcgtttgaccacagtattggtcagtatattttatacaggggatggagaatgctgattgatccatccagttgattagggcccattggttaaaagactttctattggataggttctgaactcctcccaaaaattcatcagtaaaaacccgttcaaaaagcaggtagctttcagatgatttgaacggttctgccaaacatagatagggacccactttggcaaattaagatcatgacaagtctcaagatatttgaaggaggcttatggttatgcaaatatttggcttcctctgaagggccattaaacatatccatgaagatgtttgtgaactaggcaagctttgctctgataaccttgtacttatttgattttcctaatggtttattttaataaagtagggttttttatttcaaatttgtttaacacattgttaaatgcccacagagtttggtacctgctgaaatagagaaagcaggtgttgtactcatgttctatgaataaagaaacgaagccaaagacatttcatcccatgagagtggtgaccatcatggacctcttcctatgatgtttgatttaaacttcttctcaactctacggtcctctccccatttttagggtgctggtgaggccttaatgaataagctttgtgatatgtgatatgtgatatgtctgtcttgttcattgatgtccccagcagctggcatgaatagatgaatgaatgaatgagaccagtcacactgctagcaagagctaaagttggggtgagagccaggtcttctgactcttgatcctgtgtctttctagtacatcaaaatctcctagtcctttgctggctttcctgggtccttaatggtcccctgacctgagcaagacccattgtctcgtcacagattgtgacaacacaaaccaagagcaactctctgattttgatagatttggcgtttttgagcttcaaaattatctagaaatgtcccagtcagcagattttttttcaaggtggatgaacgttatgtttaaagagattgtttttactagtaactaagaacttctaaatatttgttttatttaaaatatttttaccccctaagaatcttcagtaaatgttaattatatcctttcaacaacttttgcagttactgggtaatattaaattctgatttttttcaataaataattgcttttttatgtgctgggtaacagtatatatttttataagtttgtttctgcagctgttcagctattctgtatattcaaatttcaggcttttaagtttaaattaatagctcagtaaactgacaccacaaagcaagtggaagattgaagataagcatttctctataatgtacagggtattttaaataatgcatttctcaacattatattagtgtgtgtttaagttgatttttggtatatgtgaattactctcatttgtgttcctcattaagtcttcgtattatagttgtcgattgaaactaacataattaggtaaagacagagctgggcccacaggagaccctggaagaatcatgactgaatcattttaaaatgtagccacatgggcatgagaggtataaatatgaacagttcctacaacatgcagatagaagttcccaaatgtcataggcacatggaagcttgcaagtgccacctaaagacttgcatataaataaagtcttcattttatatgatatcatgtcacatgtttgtgcaaaggaaggtggatgataacatatatttaatttaggtaaaatattctgaacatttgatagatagttgagactgggctcaaattttactttatatgtattgtctcctttaatcatcataaaaatcttacttggtaagtactattatctccattttatggtattgggtttaaaggaggtcaggaacattttctagatataggtagtgaatggcagagcttagaaccaaacccaggtctggttagaccccagctcccacgccttaatgactgtactgtactgtactgtgctgccaccttcttggataactgcaaataacagatgttcctttgtttattccactttgacatcagatacttacaatgaccctgttggcttaatatggtcaacttttcttaagagcgcatcttggtctttccatgactaaggcattttcattcatcaaatgcatgtctcttgaattactgagacaatatgaacatgaacaagtcaattctagctcatgagtactgatcattgatatgcctgtattaacaagaggtacatatagatagaacaaaattatttatcaaaactcttaccagctgagaggctggatctttgaaaggaataaactctcccagtgagactagcaatgtacttagatgcaataaagtgggcttccagagagctgttttaatcactggagagcaactttttttcctaacttgcaagccatctgcttaaaaaggatatttacttgtggagtatcaagatcctttcatcctgtttgtattatccacagagcagaaaaagctagtcagtagcaaagagaagtcagctgtgtgaagccattgtccctgttcccttagtatgaataatagatggttccccttcagatttcttggttagtatgacattcctgaaggatgtccataggagacggctttgctttaaagcttattatcttaaattttaattgcttttggaacttcaactttaaggacccttacattctctattagacttaagtgtctttaacatagccacataaatgaaactataatgagtcataaatgaaaaatattatagtcaataaacactgcagaatactttataagttagatgcttgttaatatgggatgaagtagaaaatagtgaaagcagagaaggtgaaaaagactttagaggaaaagggcctaaacttaggtaaggtaaagtttattctcgcttggtacgaaaaacacaaaataatggagaaatgtatattgatccaaaacataagtaaaagctaaacaagaatgctgaaaatcaagcacaggaactaggaagaagcaaagacattaaagaaaaaggaaaagctaaccacatatacactctctagaattacctgttttgtctttgatgggattcatggattagttcctttgttcataattccataattatttttgagcacctgttgtgtcttaggtagcagtctaggtgctagggctcagtgatgcacaggggagcagagttcttgcccttaaggagcttacagttgagtggaggaggctataaatgagcattcatcataggaatgacaaatgctgtgattgcagaagtataggatgctatagaattacaaaaaaaaaaaaaagtcaagctaacagtaaagaagtaaatgagacaggaagagtcagaaaggttctgaggagaagtgctctctaatcttacacctaaaggttgcgttagccagagagagggaagagggaagaaggaatgagcctgtcaatcccagatgagaaaagaattgaaattcaagatggctggagcagagagcagggtaggaggagtggtgaaagatgaagctgtagagggagcagcgtcctactcataaacagccttggaagccatatttgagcttcatcccaagatcagtgggatgaagggaagtgacatgatcagatttccatgttgaaagattattgagagtgctgggcgcatgcaccttgagaagttggccagagagacgagaaacacccaacccttagtgctttcttctgaacaatggctgaattcatagacagtacttcaagttagtgtgggaaatattattcatctgtgccagagaaagaaggagcaacccatgtctatcattttcacagagggaagttgaagctgcacatgtacttggacatagggaatggtcagagaaaagacagaaaaaagacatcccttggtcctggaggcatctatcaaatatcaaagcgtgctccagaggcatcccagcctagtgagaacacctctacatagaagtgtatccagggacctattctgtcactgtaggcgcaaattacttaaccaagaagacttatgtggtagcagttgattgtagacaaagtgtggacctggtcttccccatatggtattgaccatcactgccatcacatcacctttttttaagtagcaagaataacaccactgtatgattctctttttttaatttttattttaggtttgggggtaaatgtgaaggtttgttatatagataaacatgtgtcacagggatttgttgtacatattattgcatcacccagttatgctactttctctcccaccctccttcctcaagtagaccccagtgttcattgtttccttctttgtgttcataagttcttatcacgtagctcccacttataagtgagaacatgccatatttggttttctgttcctgcataagtttgctaagggtgatagcctccagctccatccatgttcctgccaaagacatgatcttgttcttttttatggctgcataatattccatgatgtatatgtaccacattttctttatccagtctgtcattgacgggcatttaggttgattccatgtctttgctattgtgaacagtgctgcagtgaacatttgcatgcgtgtgtctttatgggagaatgctctataatcctattaatgggattgctggatcaaatggtaattctgctttttgctctttgaggaattgccatacagctttccacaatggttgaactcatttacaataccaccaacagtgtgtaagggttcccttttctctgcaactttgccagaatgttattgactttttaataacaaccattctgactggtgtgagatggtctcttgtggttttgatttgcatttctataatcagtgatattgacctttttttcacatgcttgttgactgcatgtatgtcttttgagaagtgtttgttcgtgtcctttgcccccttttgaacagggttgtttatttttctcttgtaaatttgtttaagttccttacagatactggatattagaccttggttggatgggtagtttgcaaatattgtcttccattctgtaagttatctgtttactctattgataatttattttgctgtgcagaagctcttaagtttaattagatccaatttgtcaatatttgcttttgttgcaattgctcttggtgtctttttcatgaaatctttgcccgttcctatgtccaggatggtattgcccaggttgtcttccagggtttttatagtttggagttttacatttaagtgtttaatccatcttgaattgatttttgtacgtggtgtaaaaaaggggtccagcttcaatcttctgcatatagctagccagttatcccagcaccatttattgaatagagtctttttcccgttgcttgtttttgtcagctttgtcaaagatcagatggtcatagatgtgtggccttatttctgagctctctattctgttccattggtttatgtgtttgtttttgtaccagtaccatgctgttttggtcactatagccttatattgtagtttgaagtcaggtaacgtgattcctcaggctttgttctttttgtttaggattgcattggctatttgggctcttttttcgttccacataaattttaaaataattttttctagttctgtgaagaatatcattggtagcttgataggaatagcactgaatctgtaaattgcttcgggcagtatagccattttaatgatattgattattcctatccacgcgcatgggatgtttttccatttgtttgtgtcttctctaatttctttgagtagtgttttgtaattcttattgtagagatctttcacctcactgattagctgtattcctgggtatttttggtgtgtgtgtgtgtagcaattatgaatgggattacctttctgatttggccctcagtttggttattgttggtgtataggaatgctagtgatttttgtaccttgattttgtatcctgcaacttcgttgaagttgtttatgagctgaaggagcttttgggccgagactatagggttttctaggtgtagaatcatgttgtttgcaaacagagatcgtttgacttcctctcttcctatttggatacgctttatttctttctcttgcctgattgagctggctaggaattccagtgctatgttgaataaagtggtgagagagggcacccttgtcttgtgccagttttcaagggaaatgcttccagcatttgcccattcagtaatatgttggctgtgggtttatcatagatggctcttattcttttgaggtatgttccttcactacctagtttattcagagtttttaacatgaagagatgttgaattttatcaaaagcctgttctgcatctactgagataatcatgtggtttttgtctttagttttgtttatgggatgaatcacatgtattgatttttgtatgttgaaccaaccctgcatccgagggatgaagcctacttggttatggtggattcattttttgatgtgctgctggatttggtttgcaagtattttgttgaggatttttgcatggatattcatcaaggatattggcctgacgttttcttttttagtgtatctctgccaggttttggtatcaagatgatgctggactcatagagtgagttggggagacatttcctctcctaattttttggaataatttctgtaggaatggtaccagctctactttgtacatctggtgggattcagctgtgaatccatcaggtcttgcgctttttcggttgctaagctatttattgctgattcaatttcagagctcactgttggtctgttcagggaatcaatttcttcctgactcagtcttaggagggtgtatgtgtccaggaatttatccatcttgtctaggttttctagtttgtgtgtgtagacgtgtttgtaatcgtttctgatggttgttttatttctgtgtggtcagtagtaacattctcttcatcatttctaattgcgtttatttggatcttctttcttttattcttagtctagctgatggcctatccatttgattaatttaaaaaaaaaatcctggattcattgatattttgaattttcatgtctcaatattcttcagttcagctctgatttttgttatttctcatctcctgctagctttggggttgttctttctaactttttgatgtgaacatttagtgctatgaatttccctcttaacactgccttagctgtgtcccagagattctggtatatctttgttctcattattttcaataaacttcttgatttctgccttcatttcattatttacccaaaagtcattcaggaacatgttgtttcatttccatgtgattgtatggttttgagcagttttcattgtgttgacttctatttttattgtgctgtggtctgagagtatgtggttatttaacatttgttgaggattgttttatgtccaattatgtggtctattttagagtatgtgccttgtggagatgagaagaatgtatattctgttgtttcggggtggagatgtttgtaaaggtttatcagatctgtttggtccagtgctaagtttaggtcctgaatatctttgttaatttttcacctcaatgatctgtctaatactgtcagtggagtgttgaagtctcccacaactattgtgtgggaatctgtatctctttgtaggtctctaagaacttgctttataaatctgagtgctcctgtgttgagtgcatttatatttaggatattaggatgttcttgttgaattgaacattttaccattatgtaatgcccttccttgtcttttttgatctttgttggtttgaaatcagctttgtctgaaattaggattgtaacccctgctttttttctgttttccatttgcttggtagatttttctccatccttttattttgagcctatgagtgtcattaagtgtgagatgggtctcttgaagaccacataccattgggtcttgcttttctatccagcttgccactctgtgccttttaagtggggcatttagctcgtttacattcaaggttagtattgtatgtatgaatttggttatgtcattgtgctgttagctgattattttgttgtcttgtttgtgtggttgctttgcaagtaacactggtctgtgtgtttaagtgtgtttttgtattagctgatagcagtctttcctttctatattttgtgcacctttcaagatctcttgtaaggcaggtctggtgataatgaagttcctcaacctttgtttatctgaaaaggatctaatttctccttcacttaggaagcttagtttggctagttatgaaattcttggttgaagacttttttctgtaagaatgttgaatataggccgtgaatctcttctggcttatagggtttcagccttagaggttcactgttagcctgatggggatccctttgtagttgacctgccctttctctctagttgcctttaacattctttctttcatttcaaccttggaaaatctgacaattatgtgtcttggggatgatctttttgtgtacaatcttgcaggagccactatatgattctctcaaaaaaataaataaataaatgacatacattgcagaagatggcctggagaagaaaaggattaacaacagggagaccagtttggggagagacaaagagatcttggactcttatcttgtttgatctgcagaaaaatagtcaagaaggtaacactaatagcctgataatgttatctatgacttaaatttgacatggcaaagtatgtactagtgacggagaattacaagttgtaacacatcatttcccttaccttacatgtgtatattttgcagtatgcagagagctttcctgcatggtatcctaccacccattgtcactcacagaagcatccattcagcaaatactaattaatcacctgatgtgttccaagtattgtcttagatggtaaggatatggcatagcacaagattcaagattcctacccttgtggaaactcactttctgttttagaaatacagacaacaaaccagctgtcaaattagtgaacaatatcatttcagagaacgatgagagcaatcagggtaataaatggagctatgtaatccagaggagggcagtgtataggaagatgtgtatgggcaggttgagtaatgcctaacacaggagatgagacctaaatgaggagaaccctacctgctaaaacctgggggaggagccttccaggctggagcacacaggataggtttaaagagatccacaggtcaagtgactggagaaggggaaagaaaaggagtacaggcatgaatgagaaaataggggcagccagggccttgcaggcttgggcctgcacctcagatgctattctatgagcaatgggacatctgaagtgggagttttaagcaggagagcgatgtgatctgacatacatttttaaaagattatctggctgctctgtggagaagggcttctacagaggcaaaagtaaaagcatagagaccatcaaggaggcttttttgcaagcccgggagagagatggtggtggcctggacagaagatggcaagctagtgccacagttctcaaagtgtggtctgtgggttcctgggggcccgcaagatcttatcagggaatgcaaggttaaaactattttcacagtaataccaagatgctgtctgtctttttcgcagtattgacgtgcactgctagtgaaatgtaatggtggggaaaactgctggcacctcagcacgaaacaagatagtggtaccaaactgctagttcttcaccagcacatgcttacaatagaacagaatgccaatttcacttcagaatatcctgtatgaagcagtaacaattactgtttttattaaatctcaactcttgagtgatgtctttttaatattctgtgtgacaaaatgggaaggacacataagcccttctaccgtataccagagtgtactggttatctccaggaaaaacccgtgtgcagttgtttgagtcgcaagctgaactggctgcttttttcatggaatgccaatatgacttaaaagaacaactaacagacaaactctagttactccaatttgggtatttgtttgacagatcttttatcaaaaatgaatgaagtgccctgatacttcaagaaaaacaactgacagtatttgttgccaatgacaaaatttgagcttgagacaaaaattaggattttggaaaacacatagctgctactgtagagcttgataacttcccaatacattaaggactttttctgacgagattgatggtgatattaatgaatgtggagaatttggtattggatcatgaaatgtgaaacattcaaaagatctcaaagatctccgaacttagtgaacaagtatttccaaatgaccaaatgggtaatgttataaaattatgcacaggtgaaaaatccattcaaagcgcaagatagaccaatagattttaatattaacaaagtaaaaaaagtttattgacagattttcaggtaccacatttcagactccacatttaaaagctaccacttgttgatttctggtgtagaatcagagaatatccacagttatcaaaagatgatgaaaatacttcacccatttccaactatgtatctgtgtgagctagattttcttcatgtccttccatcaaaacaccatagagcaacatattgaaggtagtaccagatatgagaatccagcagtcctctgttaagccagatactagagagatttgcaaaaatgtaaaagtgttaattctctcacttatgttttgtaaaatgtattaattttcataaaatatgtgatttgtgttaatatacaatgttttattgtatttcaaatacaatgaattctatttttttaaagttttgttttaatttctaatatggcacatatcaatagctataacccacataatcaagaactctttggagattttattaatttttaaggttgtaaaggagtcctcagaccaacatgtctaaacactgagctaatgaaagtggttcatttcaagatgtattatggaggcagggcagatggaagtctatatattctctttgattcatcttcagatatttgtcccaagcagctgtgatgaaaaagactggaaagaagcaggtttggagggaggatggaaacaataattgtttttttggccatgttatacttgagatgcatgttgaatatacaagttcaggtgctgagtaggaaattggatatggaaattcaggaagaggtcaggggcaacatataataaatttgagagacttcagcatataggtgacaaaaaccacaggcctgggagtgagtatagttagaggaaagagaaagtccgtggatggagctccaagataacgccagcatttagatggggagcagaggaggaggagcagaggaggactctgcagaggagggagccacaggtgaagctgatgagaagccaggacagtgtggtgcccctgaagccacaagaagaagtggtttcatggaggaagttgacgactgagtcaagtgatggtgagaagtcttgtaagatgagaatagagagttgagcatggacttggcaagacggagatcatcactaaccttcataaaagcagtttctctggagtgacaaaaaaaaatctacaacaggttaaggaaagaaagagaaatgaggaaataatggcagcaagtaaagacaactattttgagggtcttccttcagaacaggggcagagaaagggattggttctggaggaagcgatggcatcaagaagggatttaagatatgccagtggaaatggtccaggagagagaaattgatgtcccagggacagtgaaggtaaattcagaaacagattctctaagtgagagagaggggatgggatccagagctcaagaatagtgattgattcctgaggaggggaaagagcaaacagaaagcccaagaatggggcaggtcatccctctgtcctcaataaaaaggttaactggggaatagctaaaattgaagaaagttccagaggatgtaagacaagaagggcgtagattctgtatttgggttgttggttggttttcactatcttaagtctagagcaatgatagacattctccactgccccaaccatttggttctcttccgctgggctgcagtaagcaaagagcccacctgataaccagcttgtgaggtagcatcctctgtctgatctcaggctgatctcaggctgtttcccaagctgggaaggaagaagggaagaattagacagaaagtgctttgtgatttctttggtagttcactttcagtaggaagccatggaagtgtaatgcagcgtccactaatctctaactagattcttcttgacctctccttattatgtcaattggaagaggagatggctctggagttaaaatgtctcttttcgccttttgagacaatagggattgacagcttgagcaggtaagcttagtcagggctgtattccatcccaagcacatgctgtccaccttcccaggagggtatattaaatattattattactaatgataattaataccaatcattcccttgagatctcaggttagtgatacataactaagtctgtgtcatttcaagacatctcccaggtgagggggtggtttaagaaacaaaaggaagtgaactgtgtctggtttcattatgagactgggacttgtatcagtcctcacgccccatgggcaagactcagcggagagcaaaaatcctgaaatctgtttcatcatttaacatcctcttgtcttatatagttctcagtaggagaaataaatagatatggtaaatatttattcagagtttcctcttggaatttaccaagcaggatttgacacagcatacacactgagccaattcctaaagggtattgtttactgagttagttttcaccctgactgcccactgctttgtaagccttgtacagttccatgataaaaagaaattcccttgagcacagttctctttcatgtgctcctttgccaccgagtgaatagacagaagaaagaagaagaaaacaagggacgagacccaagtgagttgacatttagtaataggaataagtgccaagacctgcagttgtatcccacacccccactaaaaaaaaaaaaaaaaaaatcacaaatagagaatgtgggaaataaaacacaatagcaatatgtgaagactccttgggggtttcatttctgtaagctcaatcctagccagagatgtgatgtagctgcccaaagcattaatgaaatcatggtctgcattgtaggactaagaaggtgaaagatagttctatgtactcttcagtaataaaattgtgctttatttgagatcacatttgatagatatattggcaaatgtattgttggctataacatggggtgttttttttgttttgttttgtttttttgtttttttttgagacagagtcttgctctgtctccaggctggaatgtagtggcacgatctcagctcactgcaacctccgcttcctggattcaagcaattctcctgcctcagtcccccaagtagctgggactacaggcgcacgccaccacacccagctaatttttgtatttttagtagagacggggtttcatgatgttggccaggatggtcttgatctcttgacctcgtgatccacccgcctcggcctcccaaagtgctgggattatgggagtgagccaccacacccggcctataatgtgattttaaattgaaatgatgatttttaaatttagaacttaaatatttttaaaggacagtggcccaagacagtgatagagaacctgaaaccatgtcaaataacatttgaaggaactagaaacaactatccagcgagaagacttgaggaaagagaggaggcggagccaccacttactccctaccatgtatgtaggtgttatccttcctctggttgccctgtagggcaaaccagtgtttttaggctacaaggaggcagattggcctgagagagaactgtgtaatgatgtatgcagtgatgtggtacataataattttccaaaattgacttggcagtacctttcttctcattagaggtatttaatcagcgccacccacttggtggtcaagactttgatgacacattgaactagctgatccccaaaatgcctgtcacctcataatagcacagtcattcattgcttaacgataggatgcattctgagaagtacgtcattaggcagtctcatcattgtgcaaacatcatagagtgtacctaatgcaaacctagatggtatagcctactgcacagctaggctgtatggtatagtctactgctcctaggccacaaacctgtacagcatattactctacaaaatactataagcagttgtaatacagtgggaggtatttgtgtatctaaacatagaaaaggtacagtaaaaatatgatgttagaatctatgggaccaccattatatatgcagtctattatcaactgaaatgtcattattcagcacattactttatttacttcatggaaagtgtaagtttgcttttcattaaccatctacttgattaaaataatgagctatgaaggccaaataaaaagaggtggccacttttccagagctacttttggtacctgaggataattttatggaataaatatctttgaattgttctagcttttttgaaacttcagctttaaaatatgaaaaggccctttcttagcagtccttgtctcaaagagaaaaagaaaaatgtattgaatgcagactgaggtcagcaaacccctctgccctgtttccttcttccctcttctgaagctcagttgctttagaaaggagctttggagagaacaggaaacaaagttgatgcaagaggctcactaactctaagaaaactgttggtgcaatctgtagttgtaatgtgggataagtcttaaataattactttgaagcttagaaccccaaattttaaaatttaaggtctaaaaattcagtcttttaaagcagattttggtgactaaaaccaggaaaatggccccatccttcacttttcttcttgttcatttggttagcagtagaattgccacccccataaacagataaaagtactgaaaaacaggaagcaacatcaaatagttttaaattactttgggaaactcctgaaagtgggtgtaatatgtgtgggcctttaaaaaagaatcatatttatgcatttgatatacagctacttaattatgtcttacagttcagcctaatgttcattggtatttttattttcctgcctatgttttggtccttacttgccgtgtataactactgctggtttgtctcccactggtacaccaagttgttcaactagctgctgataaacacattacaaagtatgtatggaataaagaaaccacaagagatgaaagtgttaggtaattattttttgtaaaaattatggtttgcttagttggcctgtagcaagaccctgatgtatttggctgcagccaaacagagaaatatttggctaagctgtcttcagcacagtgttcccaaaacaagtgaaggaaacctttgttgtgtgagcaccttgatattctggaaatgccttgcagccacctccactttatcatccagagggtcagtgaatgcaacatggggcttgtgtaatgcataactgcacatctgcaatctgaagccttcccagccctgatccacatggctctggacaggtctggctgtaatatttgtagggctccagacaaaggcacaattgaagctcatatgctgtatgcttaaatattaaaatttatgaatcaggctaacaaactggttgtataaaatacattctgtccttctgccttgatgtaatgacctttcggaaggccagatttaaatttagaattatcggtctccttagagttccaaatgggaacatggtagtatgggggaaaccagcatacacctacctgcttccttctttcctgctccttctcctcccactcccccagtcccccatcctacaggggtcttgaaacatgcacatggacaccccagcccacatgtccaagatacatgcatatctctgtaaatagctgcccttggccattctctcacccttcaggtggtgtagcccaccaaagggaggaaggaccgagggaaagggcatacactgaccctgggagctcacttggaaccatttgggtgggaaattctggaagagtttaagggagagatcataaggcaagatggggaacaatgcctccctggcctaactgaaggagaacagagtccttccttgcctgggtctaggggctgtgctgtctgtgggcatttaaataaaatctgcagcatctcccattttttcatgacagcagttctttctcttcacacagaaaccgctcctgcctcaactccaagggccagagcgagttggcacaccctccaagaggagcacctcgcttctgggcacagcaggagcagcctcactgttgaggtttcagtaaagtattttgcctgaagtcctcttgttggttcagcctctccttcaagctttgttcctgttccctctgaacaccccacctctccacacacacctagatctctaacttgagacctggacaaagaaactgctcttttgggggatacatcactcagccctaatatttgccttctccagaatcagtgatctcaataaaattgtgaaggattgtaacatctttttggaaataatatcaggggacccttgatacctgcggattttatttggtgctgattaagggtcagtatgtccctgtgatgcatttggccccctctttgccactttgtcggtcactgaccaggccacttcacttctctacacttcattgtctgcatctacaaaaagtgaacaataattcatgcctgtttctatttcaaatggatgttttcaggacaaatttgtaaatacatatatgaagaacaatcaaaatatccagtcagtcctttttccagtagaacttcatttaactctccaagagcttttgtatattaccaagaaataggattcagacttccctaagttgacagaaaagcatgaaatctgtttctaacagatgttccccatgatcccccaaacgtaaacatgttttcaagatgatagtgagacaacctgtttacacaaggaagtactttaaaaagcaaacaaaaaagcatcacccagagcagtcatcgtgatcaaagtgccgtcaattattagggcgtaaagggaactgatgactcaacttagcaccaccgcggtctccagatttcagtttcgtaacagagtttcttttcaggaatattcttcatttacacacaaatccgattttctttctaaattgtttctcgatttttgtcaaaccgaaataccaggatctcttcaaaagatgactccgataaccagataatgctgagatgagcatcacacggacacacttcgccatggagagcagggttgctactccctgggatcttggtgcctgggaggagggacaaggtcttccacacagcagctcctggctctctctgctcccacacctccccaattagtcagatgcagcatagaaactctcagactgcatggtggtagaaaataactttctaaatcaatcaaagtgtgatattttgatcctttcacatgcctgggtattctgggcaaatgcatgctcaaatcagtgactcatggatcaagatgcaaagtaggtctctgaatgctggctagaaatcagtttttgaacctgaagcaaaatatagtctggtaaaaaaaaaaaaaaaaaaaaaatatatatatatatatatatatatgtattgtgtcaaatttagcagtttttgtgcaaggtaactaccactgcccctcaaagtattgtatattaggagtcagccctgagttggaaagaagaagtaggttagcagaggtgtctacataaaagcccataagaagtcctaactgaatggaaggtccttttatttttattattattattattattattattattattattattattattattatttgaaatggagtttcgctcttgttgcccaggccagagtgcaatggcgcaatctcggctcactgtaacctctgcctcctcggttcaagtgattctcctgcctcgtcctcccgagtagctgggattacaggcacccgccatcatgcccagctaattgtttgtatttttagtagagacagggtttcaccatgttggccaggctggtcttgaactcctgacctcaagtgatccaccagccttggcctcccaaagtgctgggattacaggcatgagtcaccacgcccagcccaggagggcactttttgaaaggttcattcaaaactcctttagaatgtggtttttcattgaaacaaaccctttagattccctttgagaatggcgaggccagaccctgtggcatcctcaatgaatgatacccctttaaacagactttagggataggctggaaacctgacctctttttataataccacttctatggaaaatagattcgtgtctcaccatgtatcctggagtcccaggaacttttcaaatcattatatgggctgtcagcagcagtaggaatgccaccaagaccataacccaaaagcaggatcattacccaatgccacaggaaggggacaaataatagtatgagctccttatatttatagtgaagttttaagtcatgggtttttgtgccaggatattcctgtgattcagaatacttaaaaatacttgactgcaattcattagaagaaaaaataaaccacacacgaaaaaacctattagaatgaataataagatcatcagttttgcaggatgaaagttcagtctacaaaaatcaatttctgtaccctagcaagaaaaatgaaattacaaaaacaattccatttacatagcatcaaaaataattaaatattcaggaataaatttaagaaaagaagtgcaagacttgaacactgaaaattacagaatactatagaaagaaattaaggaaacataaataaatggaaagacatccaatgttcatagatcagaagacttgttaagatggcaaaactatccaaacctatatagtcaacacaatccctatcaaaattgcagcatttttgcagaaattgacaggctgattttaaaattcatatggaaatgcaagggacccagaatagctaaaacaatcttgcaaaagaggaacaaaattggaggactcacacttccttttttcaaaacatcctataagatagtgtagtcttgaatacagtacacgtatgctcaaagttttcaacaagggttccagaacaatttgatgaggaaagaacagtcttttcaacatatagtgccaggacaacaggatattcacacacagaagaatgaacttggacttataccttacaccatatacaaaaattaactcaaaatggatcacaaaaataaatgcaagcaaaaattctaaaactcttagaagaaaatatagggatacatttttgtgaccttgcgttaggcagtggattcttagatataacaccacaagtacaaaagacaaaagaaaaattagataaatgggacttcataaaattaaaaacttcatgcttaaaggaaaccattaagaaagtgaaaagatggtccacagatgggagaaaatacttacaaatcatgtatctgacaaaggatgtgtatccagaatatataaagaattcttacagctcaatgctcaaaagacaacccagacaagtaatggacaactaaaatatgcatttctcagaaaaagatatacaaatggccagtaagtgaatgaaaagatgttcagcatcattggtcattagggaaatgcaaatcaaaattatagtgagttaccactttacccccactaggatggttaaagtctaaaagacagtaataagtgttggtgaggatgtggagaaattggaacccttatacattgctggtgggattgtcctgctacagccattttggaaaacagttcctcaaaatgttaaatacagagttaccatttgtcccagtatattagttagggttctgcagagaatagaaccaatagagggtgtgtgtgtgtgtgtgtgtgtctgtgtgtgtgtgtgtgtgtgtgtgtctgtgtgtgtgtgtgtagagagagagaggaaagggacagatttattttaaagaattggcttacatgattgaggagactagcaagttcaaaatttgcagggtaggccagcaggctgtagacccagagaagcatcgatgttgcagttagagtccaaagggagtctgctgtcagtattccttcttcctgggagaggtcagccttttttcttaaggccttcaactgattggatgaggcccacctcatgaagagtaatctgctttattcaaagactactgatgtaaatgttaatctcatctaaaaaacacctttgtaacgacacccaaacatgtttgaccacaagtcttggtatggtgacttagccaaattaacacataaaattaaccatcctacctagcgatttcacttccaggtatatatccaagtaaattgaaaacatgtccaaatatgtctaaccatacaaaaatgttcttggcagcattattcataatagctaaaatgtggaaacaatccaaatatccatcaactgatataaatggataaacaggatgtggtagatgaatataattgattattatgcagccataaaaagggatgaaatattgacatttgctacatcaagtgtgaaccctgaaaatatggtaaagtgaaagaagctagacacaaaaggcctcataatagatgattccatttatacaaaatgtgtagaataggaaaatccacagagacagaaagtagattggtggttgccaagggttgaaggggaaaggaaatgaagagtaactactatgggtgtaggttttcttttttggatgatggaaatgttctgatattagatagtggtgatggtcgcacaactctgtgaatatactaaaaaacattgaattgtatattttaaaggtgtgaattgtatgatatgctgattatatctcaataaacctgttaaaaaatgcctaagcctccaaacgtaagtggtcctggccacctaatagaaagcagcaggagttgcttctaaaatatagaatgtatgctgaatcccatatgtgaagagttagaagggaatgaaatgatcatcaccatttactagataccttctgtgtttcagaagctgtgaacatatcagctctcttagtcttccttaaaaaacaaaaacaaaaaacatagccagttttaagggcacacacctgtagtcccagctactcaggaggctgaggccggaggatcgcttgagcccaagagttcgaggatgcagtgagctatgatcacgccactgtactccagcctgggtgacagagcaagaccctgtctaaaaaaaataaaacaaaagcatatgttggctttaatcttccttgtttgttcacatcaggaaactgagcctttgttcaaattgcttggccaaagtcagctatgttgggactagacctgggtctctctgactttaggcttattcctaattcactgccccacacttctcctggaggagaaaccctgtcccgaactgaacagagagtggcacgacctgccacttagagaggtgggcaaagtcttcccaagaacaaaggtatgaaggctgaagtatgcttttggagaaaaaacaaaggaattaagtgcaaacgggaggccgttgcttttatgataaagaaaaaaaaaacaggtttaatttttaaaacaaaagttccacaaggaccacaaggaaagtgacaggaagacagaagggaccacaggatccaagattgccaattgaaaagcaaaacctaacactggggtagagccagcatgtcatggaccagtaagagaaatgaacgttcccagagtagccagctgaattggggagaggcctagccgtgttgacagtcagttggaccagaagccacgtaggggtgttccggaagctgaaacaagtcgtttctcatccagagacaaaagtggccccagaagaagttaccctggatgctccatggatcaggatccagtacaggggcttgtagacaaagagaagtactggagttcttttacaagagattttaacctgaggtttatggattcttagggggcctacatcgtcttcaaagggtccttgagctcttgctatcatgtggaaatgttttgtgtctatgcgtctggttctggggagagagtcttcaggtttttaaagaatctatgtcaggaagaagatatttaaaagttatttaaatgtttctcttaaagcgctaggctaattttctggctgtgtgatagattgtgttaaatggtctggcactcctaatttttggaataaaaatgaattcttagtgaatgatctcacagcctgcagtgctgtctgattctgtcctggcatttgatagaacttgttaggggattaggtaagacaggatgttggtacatttgaggtcattaaaccaagaagggaagggtgggggttgcggggggggcaaagaaatcttgctaaatatattgtggagctgaactaaatgctgaatagctaagggacattctttgtgttctgtgccaagactttaaaaccctgtttagaaacagactagaatgatggagacagctccatctagatgcagtgcattggtaaatgcctgtctttccaagaaatactattttacttgtccttttatggaggaggcgtggaaggctgtgatgtactgggttgtataacatttttgtaagcggatacagctagtatagaacctagagaaacaataaaagccgccttttcacatggtgtctcacagttcccgtttcattactaggaaaataatgaatatgtcacagagaagctaattcgtatgaaaggtttttgtcagctgaaatgcatgcccaaaagtttattttctacctgtcttttctttctacttcttttttgtttccttcactcttgttttggatgtatagttttagaaaatactcactttaaaaatgtattggatggatagtggtgaaggctgtacaacgaaacaaatgtacttggtgccactgaaccgtatacttaaaaatgattaaagtggtaaattgtacgttttggatattttaccataatttttaaaaagtatatcggctaatacagaaggaaaacccacttaccctttgaggcaagaattccaagtatctttatgtggtaaatgccacaccctttcccacacgtggtatgaatatgtaagtcgtagggcaaagtgtgtatggggtagaagtgctcatttaagcattgcatggtccccactctgccactcactggctatgggacctgggaccctatatcccaaagcagatgttaagccctccacaaatgctgccttcttcctcctcggtccattactcacatgttggtttttcaacagtacagtgagacagtgggactcagtgatctccaaggtccctttcagctctgctgatccatactttaaactcactatttttaaaaaaatctatagaacactatgaaaattctcgtggacagatgtagtccacgggcttcccatgtggacacacagcagcttttgctgcttctgactttctctctcctctgttccacattctttctcttccccagcctgccaagagtcatccatgagcttggacatgggaagagagggcagacaggagaaagaagtgaggtggctcaggacagaaggctgggaaagagcctggtgctggatgtcaggctggactagggatgcatgcaacaagccaggagtcagccctgacagtgccacatggttatgggtgtgatggaacccaaggccgtggccccagattatctgaagggtatgtgaccacaggagaagtaagcacgattgatttttatacgaggtggatggtggtgggaatgtagagattagatccagggagagaagctgagctcatcgtgtgaggaagagcctctgttggggaagaagaggctatgtcaggaggtgcagcaggagaagagggccaagggccaagtgcaggtgtatgctcagtctccaggcagggttcaagctgagagcagatgaactctggcctaggactcgagggctggcaaaggcagatccccagggcaatgtctctcctctggttcctctatgtgtacctgtcactgtactctgcaaacactgatcttcattcatgtattggtgtagccattcattcaagtttgtgccaggcactattccaagtgtcaggtatcaatggttagcaagagaagctaggtccctgctgctgtgggtcttacatggaccaagagagaagataggtaattatacagtaaataaacatgtggattttggttatcccttgatggaaacaagcagggcaatgcctagctgtttgggagaggacagagcacattaaggacagtgtctctgcaagtgacatatttgaactagacctagtgaaggagaagtaaccagcatggctaagggttgtgggagggaattctaggcagagagagaagcaggtggcaaggccaggcaagggctttgcatagtcaagggacagaaacgacactgaaatatataacaagtaagaaattatgcttcatgaactataaccattttagcactaaaactcttcatacaaatagttaaattgctgtgggacctgcagccttgtcagtttactttcatgttttactggtggcacatgggaaagtggtcatgtttccttcgcagaagaaggatgtagtctccccacattgtagaggaaggcagtgttgtacaggaaaggaggtagccttgacaggccagcttggattcagattgcatgttgtcctgtctccagcagtatgaccttaagcaaaacacgttgcctctctgagtcagggttctctcatgtaccagagaggctaataattcctgtaaaatttctagcacagttcctagcaaatagatattttcagtaaatggagatgatgaaggcggcagtggtggtggtggtggggagatgatgatgatgatgatggtgatggtgatgatgtatcaatacaggctagtattccaatttttatgtataaagtctgcagaaatccaagaattatttcaaattatgtactttcaacacatttctatcacactttttatttttctggcttgttagtggcaagtagttctgcctgcaccatccttttatgatagaagtgaaaatctgataacctctttgttgtatttgggaacttaaacaccttgaatgtcaaataagtgaattttctagctttggttcttcagctagagtcccagaacctgaaatgttgaagtggaaactttcagagctgtttaatctcaattaatgttcgccatcctgtctgaaataactgcatctccctccccacttctttctctgttgcagcaaaaaagcccactttctttcatcacctttccatgccagtagaataaaacacaaaagccacaagatctgtggttcaaaggggttctgccttatacaagtgtctgtttaaattctgtttgaaagataagagtttaaaaaaaaaaaaaacttcatctctgaatttccaaaaaattaacaattaacatcaattgacctctttccttttgaaccccttcagccataaaatggcgtgcgactactccacttagtgtttctgaatataaataaggatttcagggccactctcaagatgtttgttaccaaagctgtcatcagattttcagtaatatttttatatagcctggaaccagctgaacgtttgagatttgacctttttaaaaagaagataatggtatctaaatgcaatttgtatttttagaactaagttttgaagtcttattttgttttctaaccattgtattaaattgtctttctactcaatccagaggggaaaaaagtgtgtgtgtgtgtgtgtatagttgtggaagagtcacttattagccctaaaaatcaaaagtctgacttagggcaggggaaccagaagtggcatggtgaagctcgaaagattggctgactggtgtcattcccattgagatgctgaacatgatccccttgggatgctgagcaaaatcagattgttttatttggtaaattttttacctccagtgataatattaatacaatggagagaattagcttaaaaattctgtatcccaacatgcagtgtcccgtccttgaagtttaggcaaacctggattcagttcaaacctgaatatcatgttttgtgttttttctgtcactccagatcccaataaggtaggaagaggtgattaggataggagagaattgacaacaggaggacattgagagcaacactggaaatcagatcattaaaccacttttgtgtttcttagaaattatgttcttggtattagatttgtaatgtaaatagaaatattttcacctgtagtttcctggggacaggcaaatggggctttcctcatcaaatcccattaaagccactaagaaaatcctagctaagagttgagttgggataaagaattcaatcagccttacttatacaaaaagtaccttctagaaaacctgatcatttcacaactaattggtaagaacactcccttgcccaccatttgcagctggagacccacttgtactttttctacggctgttgctgtaattgaataccatttacttttcttagcttcagaatgcggttcctcggacttttctttttaagtaaggttaagattatgcaagaggtagttacctacagataatttcccatatctgggatatgttactttacttgtaagagaatgaatagtaaccattcagatacctctttttaaactttcccccaacttctctaacagtaaatacgaagaaatgaaaaagcagtgctttcatgcttagtgtagcattaccatatctcctcacccaccttttcctaagagcagtctggtgagctacttcaagattttgtgaggtcttcggaaatcaatctagccgcaaaatgccacaaggcaggaagtgtccatggtactcttattcaccattgttctgagacacctaaacatggcccagcacctaggagaagggcagtgaatacctattgaaggactatattgggtattgtcctgtgggcttctggagtctgaaataggtccaagaaaactaatatgtgaagccacctagggctgcactgtccaatcagctaaccactaacaatatgtggctatttaaatttcagttgatttaaattgactaaagttaaaaattcagttcctcactctcactaggtacttttcaagtgctcagtatcctcatgtggctgccatattggacagcagagatattgaatatttccatcattacagaaagttgtgttaaacagtgttagtagaatagcattagtagaggcctaagttagtgtctttttaaagtcaaattcccatgtgaccctgatgtgcactcataataccaaaaagagccctcttacacatctccccccatgctgtaggaacttagccaagcaaggtggttggccctcagtggtggccgtctctttgagactgatagacaaacaacagtaaaactgttagcaagactgacagctggtatatacttacttggctataccagttgttaaagttataaaatacctgtaccagttaataaagacctgctgtcctaagtttcttcggtatttctttccaatgcccaagacaccctggccattcctttaggattccaccaacctcccctcagtccagcaaaatgagttagttaatgtctgtctcatctctgggagttgggggctgctcaaggactctgcgccagcactgcaggcctcagattgatggatgctacctttggcctcatggttccttggcctccaggagggattacttcctaaggcactcccatcactaccatggccacgtcctacatcacagatccattggcttccaaaagaccttacagtcatttcatccaacccccttgttttactgaagaaatcaagtcccagagagtcaggcagctagttcgtagccaatttagaaataaaactcagatcttctaacttagtactttttttgttacatcttcttgtgttcttttccaaactatgaaatggcgattaatatctttatgcctcacaaagttgtttagtttaaaaaaaagatacctaatattttatgtatgtcttataatctgcaaaaaaaattctgtatacattctcatgtgatccccacaagaacctgtgagaggtagtaggctccgaggcagtgagtggggtgcccagcataacaaagctactgtgagtgggaaagtctgtatctctgtggcttggaaaactataaactcttttgtaaatgtaagataatataccatgtggcattacttgcttttagcttgcggtgttttgcagttcaggatttagtgacattgaaagtaataactttgttcaagtgcaagtgatgcaatgtgtgtgtgtgtatatatatatatatatatatattttttttttttttactttgacagtgtgccaattgcacagactttggttcagcattgaaacagaagtgggttgcttcgaagtatatttttaaaatgagagaatccaaatttgtaattagctttgcaatgatagttgtacagtttgagtatccaaggagtgtctggtaatcgtttgcgttattaatggtggtttgttttttgtatttcccctgaagcagttaggccctttggaaaaaacaaagtatactctttgagggtttatttcttctattaccattttatttttcactccctgtagctctggtctgcttagaaacttaggcatatacctgaatgtggcaaagaaaaatcatttataagctattctacctgcgttgacacctaattatcaggaaaatgatgcttaaattatgaagtaaagccacagtgaaggaaatggtccacttctctttggtcttttgatcattttgatagaaacaatccttatttttagataagattgttgggaaagatcaatttaaatcactcccaaaataggattgaaattttttgcaccccccactcctcaaaccataaccatcttatagtattagtgggtgcagaaatttgagtttatacataagtgaaagagtgaggttatttcatttaatataacaaacaaacgtcacttcagtttgcttttattagcatatgaaaattgtggcattctctataccagttatcctgtaaggttaaatatacataaaggggaaagagaaagagagattattagaaaaagctataaatctaaaagaacctggggctgtaagacctgctttagcattcctaattcgtagccacatttgggaagaatgtgtttgtatgtttcttttttcaagtgtgtattttatctgtgtcttcatgtctttctccatgtataacctgttttgtgttatataacactcttacctcacacttctctattgtgctcaaagagctatagccttccccgtgtcaatataggactttcaaagggtttactattgtctagaattttcttagactttctctgcttcgtttagatgctatagatggtactgaccaaagagtggaaagatcaagcttgtgatatatagctaggcaatgagtcaacatagtaatgagacactaggcttgaatacatctttggaattctgaagcccaaattcctacaaacttattggggaataaggaggaccaatgagtgggcacatactttcaaacttgccagccaccagttttgttaccaatgcacttggcgttaaatgagataatacatacaaggacctggcattggagtggacacactgtaatcatgcataagggttagccattattattagctattctgatttgattttgtctttgcatctttttctgctttttgatgccatcctgaggaagagcaaaatgtccaagaaataggaaaaccccagaaggaaggaaaatacaaggcctcactactctagaagatgaattatcaacccacaaataatcagtggtttttcttctcacgatattatgggaattatttctgaattctctcacatgcttttccatgtggagaccccatggacaagtcacagctcccccactgtccacatctaactcagtctggcctaatgagggtcatttgatggtaaactaaaattaactccatttctctcttgctatgtcaaaaacagcaagctgttcactatcttctgtgtaaggaaaacaaaaataaaatatcttacatttggtcatcattgattagaattttgttaagttgcgtgaggagcaagtgtatttttctctgtctgtgataaggttcataattaaccaggcattcatgctgctgaaaaaaaatataaattggtgcaatctttctagaaaatcaagactctcaaagtttatgccctttcatgcaataattccttttctgggaacctgcgtaagaaaatgttcagaaattcaagacaatctgatattcagaaatatcccctaaagtgttatttacaataacaaagaaaaaaacaatctgcaactccaaaaatgagggaaataaatacataagatgtatttctatggggtataatacacatgaacattcaaaagcatgttttgaataatttttaataacttggggaaatactcatattcatataactcacattttatttcagaattgaatgaaaaagtagaagcaatactttgagtatgtgcatgtatctgaaaagaatactggcccacaatcccttatctctaattctaaatctaaaagttttcagaaatcaaaaggggttttgttttgttctatttttagtaacttctttggtaggaaaacctggcctgaacaaatgtgaggctctattttacccccacttaataagaatatgcatctatttttgtgcacaaatatttaatgtttaatatttaatattatagggtgctgctccatactctcacaagatactaatgtaataaatggtagctgcatctctaaaatccaaaaattctgaattctgaaatatatctggccccaagagtttcggtgaaggagtttcagacccatacaacaaaacatcattagtgatttatcggtgtcaaggttaccattgatctttatttttttctttatttttctgtatgtttcaaatgttctacaataagcatgtattaagttatctgaaaaaataaatattaattttaaaacgaaacacatttgaggcatcagggaatcatctcatttcggtcagaattcttaaatcatttgcttcccaaatctcttctatttacaatggccacatgtgtcttttaaaccaaggtgttctgatttgctgacagaaaacgtgagatgaaatatagaaggtgataacttactggacatggacctatctcctaggctgcatttggattcaggagagcccctcgtgagggctgctcacctaaaggagatacctcaaggaatagggcttctagtaggcagagcccaggcgtttctaccacgggctatggtgtcttattctgttcatgaggattggtcaagaggccgacagccagagacacagacagttgtgtgagatcataacaagcagaacggagtatggcgagatagcaggagagagggggaaacattcacatgcatactttcatctgctaatggacaacttttccttcccaattaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatgtaagttttgaccagggtttattttccttaattaaacaatgataaatattttcttaggtgatagtaacaaatagcccaagcacacatgaattactttttttttttaacaaaggagctggagagttatcattgagcaaaggttggaatctgtatattggtggttccttaactcagtggctcttaaatttcagcttgaatcagaatcacctggagggcttgttgaagtacagcttgctgggcctcaagctcagatttctgattcagtagatttggtacaggctaggaatttgcttttctaagaagtttccaagtgaggctgatgcagctggtccagggaccccaatttgagaatcactgctttaactcatgtgcttgaaataatgaaaaaggtagaaaactgtatatacttgagtaataaatagcattaaattaagaaatttaatgctttgcttaatacactgacttatgtctcagaaaagagttttaaggttcacttagcaccttcacatttggaagtccagcccagttgatgccattattctgtgccagctttaccccagagctgctagtaccagccattctttgcccctggttttcaacaagtgtgactaatagtgctgttattaggctaaaacaacagctacagtccttttgcaggtgtgctcatcatgcttttagacacactcaaaagagaaaatcttttttcccctgagttgggaaatacattgttccctttcagagtgagtcatcatagcattatccctcccctcacacacttaaatgtgatttgatttacaaaacacatgtgggacagaaaggcaaacatcacatgttctcacttactcatgggatctaaaagtcaaaacacttgaactcctggacatagagagtaggagggatagctaccataggccaggaagggtagtgggggttgggggcagggcatggaggtgggatagttaataggtacaaaaaaaaaaaaatagaaagaatgaatatggcccactatttgatagtacagtagagtgactatagtcaataataacttacattttatagtaaaatgtgtaattggattgtttgtaactcaaaggataaatgcttgagggggtggataccccattctccatgacgtgctcatttcatattgcatgcctgtatcaaaacatctcatgtactccacaaatatacacacctactgtatacccacaaaagttaaaaataaaaaaaaaacacacacatgggaagggaagcacacctccaatgagtaactcaagccagcaagtccaggttttgtgagattctaagttctcaagactgaaaaactttgtgaatcatcatgttgtggtgttagctttcgaacaggcccgttgcctaactgctgaggacaagaacaatttattccacgttaatagaaaaaagtagaagagtttgactaaacaaatgtacatttggacacatgtaagcatacatacaaatgtacatgtgtacctgtgaatagatatatgcattgtatatttctgagctttgactgtaggaatttgaaacagcattttttcttttgtttcattgagtcgatgtgagtgtaaaaatagtatgagtgatactgtccaggaaacatttgagaaatttctgggcattttaaatctgtggataagcactgtgatttataacattttacttggatatggtagatgttatcattcagagtagcacttaggatttacagttctcttattataactctctggagttgagaataatcactgttaataaagcaattgccaagcaaagaaagaacatatgtattgcctcaacattaatagagtcaaaaatcctggagatagacttaaatgtacagtaggtatatgttaaaatgtttaaaataaaacccccaatatcagaaaaataagacaaaaaccagtaagtgttaaaagtgatctataatggaattaacccagaggtgccttctgggggctgcccaaagggtaacagggctgggattagggctgatagagttgtgagtgatgtaattattattactccaccctcaaaaatataccatctccaacaagcactagtttattctgcactgcattcctggaaggaaggttatcagtttatgagacatcttcaccataaagtgaaagaaggaggttggatcaaatgccccttagcgccctctcctgctctgccactccgcagatctccacgtttacacatccagtgttcctgtgggatgacctttgctgtcagtcagtttcctgtctacaggtcaggaaggaaagaagttgtcatgactccttaggtgaatcatggcttcaggctcctgctggatctggcaggacctgcctggatcactccccatgtctttggacgagcgttcagtcaccgagtgagtagggtgcctataaaactgaatcttgtggggcagagggcgacagggggcatgtgggaaacttctgtactttctggtcagttttactgtgaacctaaaactgctctttatgataaagtgcatatatttaaaaaattaaatactaaacagtacgacagttcctcaaaaaaaattaaacaggattaccaagtgatccagcaattccacttctgggtatataccaaaaaaagtgaaagtagggaattgagcagatagatgtgtgtacaaccatgttcatagcagcattattcacagtagccagaggtggatgcaacccaggtgtccatctacaggtgaatggataaacaaaatgtggtgtatattaatacatacaatggaatattattcagcctttaaaaagatgaaattctgacacatgctaacgacatggaggaaccctgaagatgctaagtgaaataatccagacacaaaaaggcaaatattaaatatctcatttatatgagatacctagaactgtcagatttacagagtcagaaagtagaatggtggttgccaggggatgggaggatggaaaaattgaaagttgttgttcaatggatattaagtatcagtttgggaagattggagagttccggagatgaatgatgatgacagttgcacaacaatgtgaatgtatttaatgccaccgaaatgcacacttaaaatgggtaaaatggtaaattttatgttgtatatattttacataattttttaaagctttcctcctaagagtgctgtgcagaatcactagctagtgcttgatagggatgctgcagtttgtgagggtgcaggaagaacagatcattatgtctctcacacctccctcattcctgttaccctttgggcagcctttagaagccaacaaaggtaagggatccactgaatggtatatacttcagtcccaggaatgagtttcctatcagagtaaagacacagttgtcagaagccatcaagggaatttgccttaaacaactgtggtctctactaaaatgccatttacacatctagaagacctgcttcactggggcgaaggaaagcgtgagccacccatgctccagcagtggggctgctccagttcctccagatgggtgtttgtaaaccagtccatgcacagagcacagagagagtcccagagctgtgtgcctcactgtggcttctgaaaggtcttaatcagcggaggtggacatggaggcaggaaccagggaatgcagacttcccgtagattccagcgcagtagaaaatgaaagctgtgagaggaaatccacagcagatagttctcccgctgtagggcctatgattattatgatgcctgttttacattctccaagtgaagcaagatttatcccccatcaccaaatctctgtacttatgggtattattgtacccgtaagtcacagacaggttagtgagtggccggtagtcctgtgaggaacacacaggatggaactcactaggttagtccattgtaccctactttttttggcttttgtgttttattctacatttctagaaatttggctttgaagaacaatcaacagttttatggggcccagtagccatactttattcaggtcgtcttcactacctttaccctctacccctagggctgaccaggggttagaattcctgaagagtcatctataaggatccatggtttcaaaaagttcacaaactgctatcctaaattatcctactatctccttaagataccagtatatatatagtctgttacagaggccctatagcagaaccattatatataattttgcttaaggaaaaggtgtaactgaaaagaggtaaaatgaatttgttaaagtacaatatatataaattagtccactcattctcacgccagactttccaaacctgcttagaaagaaactcttcatgattttcacttaggtattggaaaacagggcaaaggaaaagaggtttctgagtcagttgctatggggagccgctgagataccaaaaaaaaaaaaaaactggaattaaagatttttgtagaggagaaaattcaggtcagcaagtctaagggagaggaaagtaagggcttattcatctttgacatccaccctaagcttgagttgaaagggcatggatatggaatctaatcaaaataaattccccccccatgagttcatagaccagaatttttagatagacacactgacacattttccacagagaagagcatcaaaccagcagtcaccgagacaaaatgacataaagtagagaagaccaacaaagacagaccctagtgggatctccttgtgtccttgtctcatcattcgcaggaatcagatgtgcctggttccagacattgaatttgtgtttactgacggttttgctacctggaacccaactagccagaaccctgaattagctaaccttcatacttccccaccccctccccttccctcccacacaccccaccctaccgcacacaccacacttccctttttcagcgatgaagaaaacaagatagctttggttttgagtaaaggtggggtgtaaaccctggaggatacttgtagctgatgacattgacctgctgaatcattgagaatggttagatgttttataaagaggaaaagaaactgctttggaaaaacttcaacaaaaagcattttgtagttgtcaattaaccagaaaatcaaaataataaaaaatattcttgtcctcaaatagtctaattaactgaggttttagtatacctatttccatgctttaataataatctaaaaattttgactgaggacagaacaatataccattcatttttatccttctcgagaaactgcaagttttggcttttaccacctttccagtgccagaggttaaatgttgaatgttctgtttatgttaagcactctaaaagttgtgatattactggttttaaaactaatatatgaaatcattttatgaacctatgtatttagctcctatagtcattgggaaccaacggcatacttttgaagccaattctgtttctttttaaaaaataaaaagaacctatgatatgattatttgtaatattccatttcagattcagattatgttctgctcaagagatcatcaaaattaattttcattctctgctaatggtacagagaggagtgatgttaccagcatggttgtaaacattaatatataaatcaaaaatttcaaaagataattctctgagtcgtgagtctccaaataatctatgttttattataaagctgcctgcccagtgacatcagttgtagtacaaattgtttatcaatttattctaatagtttccaatctgttgatttttaagaaatggtttgtgtgctcttttttggatgcacctgtcactagtgaaatgatgcctctctgtgagcccagatttaacccagggcattgcagcatgtttttccaaggatgtcccattagctagatcttgtaagagtgtgtgcctgcagccttgtggcagctggaagttgcacagactgtgcgtcatgaggaggaaaagcacttctgctcttctgccccagaacagtatttacaaagctttgcaggatagcaagatttttagagtccttgcggtgcttaattagaagctataatctgttatttctagcatgtttttcctgtattctgtgccttacttgtcatcagttcagttcagattagtatgctgggtccttgatttcttgacagaaagtgtcagaaacttattgatgaagtgttcttgatttctagacagaaccacaatcagaaaataattgtttccttttatctgaacagaagtagctttgttttccttattatcaaagtgatacatgtattctacataatttataaaatagcagaaaattgaataaaggtagagataaattacctataatctggctgcccaaatataacctacctgttaactcatacttttatgtatttttccagacttttttcaagaaactaattaactaattccaaatttacaagcagtgctctagactgattacatcctacaagctggtggcacttaggaatgatgcctttaagtgtcatcttataggacagtgatctccttgttactttttttttcttccttctaattatattaatcagctcttataagaacagatagctgtgtggactcactagtatctttatcaggtggaaattcctgtcaaccagtattttcatttctaccttctgtcagtcaaaatgatagtgagtggccctgtaagatcctagtgggcctctggaatcataaaggaagattcagttatgtacaagatggctttggtgttaggtcaactgattgtgttctgattatttagaaattagtaatcactgtactataaggcaatttggcagaaatgggaaaggttgagttagccagatcttcccattccgcattcacaatccaaacaatatgaactccaatcaaattctgattttataattttggtaacaaaatttcattcaaatatatgccttcttgtgctgtgaacagagttttcctttaactttgcatcctttatccccctttaaagatgcatctcttccgattgctgtggtgtgattttatagctccttgagttgtgctggtatctctgtgcttccctttggagagtactaggccttcaggttaggatgaatcctaacacttggccaaggttaggaagggctttgagcactgaaagaaaaccaaggtaaaatttaaggaattgttagaagattcatctgagaaatgtagaattgtaatccacaaactttatgtccgtagaataggaagtatttagtaagcagctagctgctagaagggattttgtttgtttaaaaaaaaaagaaaaagtctgtctttgacattggttatatctaggttttatcatcccgtgtaaaggattcttaagttccttgaaagcagtgactttgagagcatcccttcatgtcctctgtgtccttgtatgtaataggaactcagtgtatattggattaatatttctgtggctcttcagtgacagatgaatgaatgtgctcaattcaggtaactacatttgacctttttcctacagcaattgaagggtgtttgggtagcatctgcgattgtgttgaatgccctggttggttacgggtgtggggaagtggtatacagtactttgatcctcctttggagaaggagatgctaatgtggataatgagaatttggttctttatctttagtttcgatttggccgccttccttcactgagtcacagtgctcacttgtttagtgatgggcatgtcatttaagcctgagactgtccctcagactgtttatgacattggatctgaatttcccattagatgaacagccagcatttgtcatataaattcaagaacacactaaaagtttgttggctttgtagttgacattgagattaactttctctaacctaaaccagtgaaaactaaaatgctcctcaccacataaaagttttgctttcgctgcgttcagacccctcctaccttgtcacagcacagtcatttggagtctgatttgggggcggtgtggttgtctcagtggcgtatgacccactttgtgtaatacttaattgcctgtgtttttacaacacaagtcagaagttctggcgatagtggactatcacccaaaaaagattttctgagacatctcatcagagctgctcgagtaccgcgcatgaagacggtgttagctctgcagggcatgtgctaactaccagacgatgaaagaacatttcctctagtttctggataatgagcaggcacacaggtaaagatgcctttctcagggttgacgccttttgtttcctaatgattctgatgattttgttgaactagacttttaaatattaattgttacctgcatatgtttgctgttgtggtttgcagagggctcagaggaacaagcattttaattggtatcctgggactgtaataactttttattaaaagtctggaaagatagtaatcaaaaatagactctcatctctatcttctctgtgcccctggcaaatatcctcttcatcaattttgtttttattatttgccgtcaagatggttatctctaaatatcagatgcttcaatccacagtgataaccatgtgtgaattaatgcttgataagcttcaggttatcaggtggagaagtgtggttaaggcatacagaaagaaaaaatgcacagaaggaaagggatagcaaggggatactgtgccttggtaagcgtggtgccaccgcagactaaaagcagatataagtcaagtgctactgacttaagtttggcaaaatcactcctcacagcccgctctgttttagaaatgtttatatttctgatatcacttttgttaatttgaagaacttttaaaataccatcattgtttcaaaacaaaatgtggaaggtgtggatcaccttcctgaatttacagaaaagtttttgggtacatttctttgcggaagattggctgagatgtggttcacggcagggtggtgcccgtgccttgcggatcacgttgtctgtacactgactgacataccaacttagagtctttgaaaatgcccattggtaagtcaacattgttttccctgaaagtcctgagacagaaaaaaaaaaaaaatgaaagtacaaacactaactggaaaaaatgtcacacattttagccactttgcatcccttgttaggacaaaccctggtctgggtttttttacattttgaagttgtgtggtaggtggggcagtgtgggtggcccagaaaaagtagcggttagaataagattttccatttattgccctttgtgcatggctaaaaataagagtcatacaaatcagaatatgtagtgcaagcaaaatcactctgttaattctgatgactggtttgcccacatctttgcatctgtctggtaagtggtatattgggaaataatttgtctctgtttaaatagcaaaaggcaaccaagtttttgcgttgtgtgtctacacatgatagtttatcagcacttttctcttccgaaggaagaaagatccaactcatacataaacaaattgtgttgatggaaggaagaaagaagcgtgaaacccttgaatcttttttaaaaaggaattgccttatttgaaatgcagttttacaacatccatcttcttggcttattgttagaaagttatttcttgtaaactcatagcacagcaaggaaaggatatcttaatggtgttgccctagagattggaaaactttttgtgtgtttggttggaggagggagaagggacaaggatgagcacacgcctgccctgtagtatcttctgtagacacagatgttggagggacagttaaccaagtaaaaactcccctgcatctggctgctgagtcgaatgcaaccacagtaagtgataacgtgtccgtttgtggctagaagaaacaccaaagagaggcggcgccagcattcacagggaaatttgtgccttcgcaatcccattgatggtgctgtcccattccactgactgagtggttgtggcatttccaaagaatgagaatgtctgcaagtgttctgagcctttcagtctgatgagctttgtaaaatggatgagtcaagagggcagttccagaagattctgaaaaatgaagactgcaaatcacatttttctttggcatccccaactgtggcagacagtgtggcacagtggttacaatgagttgagagctttaggaggaaaaaaagactccggatcaaatcttagcttagctacttgttgaccttgatctgttaacctctcctaggcctgggtgtctttatttgaaaatgggaacagaagtagtactgcctgcctgaatgagagggtggttgtggggattcagtgagatgacgtacataaagcacaaagccagcactccacaaaatgatgttggtgttatcgtcatttgtgcagttgcatcataaaatgtgttggagaatttgagagcatttgggagttctcctctattcttggagtacaaattttggaattaaatggacaaaagatcagcctctggttcagtgtttcagaagaatacaggcatttatagagtggtttgcttcttcttaggttactaatgccaactgggggattgttgttttttttattttgctgttaagttagcacaatgtaagcctctctttccttttaagattagtgctgtgttgagcatattcagtaatttttaccttctccctgttttttatttaaacatggatgttcagttctaacatctgtgcatgttaattgtagtacctgctggtgtacgttatgaaagagagtgctaatgttgtaatcaagtaaggctaaaaaaatatttcaggtggaaatgggcaaaacttcaggagcaatagcttccatggtggtgtaattccccacagaaaatattgcatctgttataattctggttactgaacaatctgacagattgaccagatgctgacaggtagaaaacaattgctgttgcttttatttttattttttatgctttgcaagttattttctgtttaatacaatgtatacctgtccttctagagtccttttccacccaccaaagttttgcattataaagtgtattgtgtatttcacagtacaaagtcataattgtggacataacttttttgttagccttcaggattagatgctgagacttcaaatcagtctccctttaacctcctccaggactttcctagaatgctgtttcttcatttatcaaagttaaagagaagttatgactgtatcttaactttgcctcacctgagacctgacaagaagtgatgaattaaacctataagctaaggaattaaaatacaggacagatataaaacagtggtggcttagttttcttaattgttgtattttgctgggttgtttttcaatcctcttcaaattttccttttcttagtctgtcctaccatccctgtcccagatacaacttgtgacttataatttatatattagtattctcatcagatttttggtttttgtgttaggaaccatcagtctggaataaagacatttctcaggtcaactctgccagggaaatctgtcttgtattaaaatgatacccgcttctccagtgtctccagacaatgctgctttctccacttttctctgttaacgaaatggaagaatgcttttcaggccgagcaaatcattctaggtgactttcaaagttcctggcattgcagatacagcttctgttccctgtacacactcatatattccccattatcttcgccgtccctcttgccctttgccatagaccgaagtttctgtaaaaataataggtgagagaaggtgataaattagactctggctgtgattccctcccacgctttcataaggaatgacagattctgaaatgcatcctgtggatacactgtgtgctccttcctgcaaaactgccagttttaacttatccttcatgtgcagtttgagggtactggccaggcggggctcattattcctttggttgaatagtgtaaagtatttgcaatggagattttctctaatgatgtattttaagtgcatgtccgcattgctggtttaatgcactcagtcacagaatgctttaaagtttattgctaatggatgaatcctccggaaaacgggaattttcaacaagattgacatttggagtgtgaaatataaatctaatgagagtattttaacccaggtttgtaattagggctgagtggagtgaatgtgtacgtgcacaccagagaagggcacggaggaaggtgaaattgcatgctctcctctgaatgagggatgaaggcggatggatcagtgtcaggccacgacacggtggagtataaatgatactgtcaccaagtactgcacagggtaccgagggaattccactctagtaaattacattacttagacagacctgaaggcattgtgtcggaacaagcaaagggaaagggggctgttggcaccatgcagaagatattacagtacaactagcttcagggatggaattcactagtttccattatacctgcctattttgtattctccttcgctaattagtttacagaaagttacaaatgtgtacatgtgaaagaacatcatgtgtgcttggagtatgggttaccatggaccataagggaataagtattagtcaatttgtatgaattggtcagagtgagattctttttcttttattcacagctgggtgatattaggtgttcagtaaaagcttgcccttgttttattttctttttgtgagaatctgacatgcattatgaagatttaatcctcattcgctcggtaacataatgcatttcttttccacccttcctttacgtgtctttaaatctcacctatcactggtctcccctcatcaccttccatccctaagggaaacagattgtattgtcacataacatttcattttgtgaaagaactcaaagttaacaaaggtgattcctagagtgggacttgtagagaaaaatcatttttttcgcttcttctattttcttttatccctctgcagcaaagtgaggccagcctttttgggtttatctgtctcttaccatctctggatcgtctcttaccatcatctagatcattgcagatgtgccagtcaccattttccagtttgacttcaaatgctcattcttgaaaaagccaataccaggtgctctggaattagtcacagtcattttttaactaaaaagcaagtgtcttctcctgaatggatagagatcctgaaacaatatccatcctttcttaagtatatgtcatattttgtccttggtgaaagaaacctgagaagtatctctgatcagttaacagagagaatacataagattctgaaaaatgtctccataaggcttccaaatggcaggttttctgaaacagggtcacaagtagattgcagttacgataataatatcttggatttgactttttttctttccaaaataatactctgttggggtcagggtatcgtaatttattttgtagccatagttaacagtcttattttattcatccaatcataaaatagtaaagccaacacacttggaaagccaggtttgagtgtggacaggagaagccttggttaaaaagaagatacatctattttatgccgggtacctccaccttaaaaacgcttttagtttatgattctaaaataatatctaagtgtaaaaggcatcatgtaaaatgtttttgtgccatatatcatcctcagcatagaaaggctgtgcttacagactttgctttattcactgaagtcctacaaaagtcagggactctgagttgtgtgagaaatgagggtctctccctacataaactcactaaaatctttcctttttgtattctgtttactttaatggtagtatgtgccttatatcttatatgttcttttcgtccatgacatgcactgggaaataacattttgttgtttgccacaacattacacctgtgacttctttctttctcctgtcctcttgatgcagcatgctgtcaaactgtatcttttgagttgttctaaattgaatcctggtcaaagggatttaacaacatctaaaacggaactagcttagattctcttccattctgtagaggttcctttgttcctgcttacctacccatgtctgtctgtattctattctttttcttagattaaaattggaaagggagaaagggggagctccttaggagaaataggtctgtggagaattgtgagtactcattcagaagctattcttagttctaaggaatataatgaacttgagctttgagtcctactgaatctcccattaatgatcccgccatcgcttccacctcccatctgattatgttctccccaaaggctactgatatttttcccctaatattctgaatggagtctcttccaaggaaagcatatctcgaaaggaattgagccctactgcagtaatagtgtactggatgattcttaattattctattaagtacttctgtttttgcattaccataatgtctgctgtagcggaaacttttctgtagaccttgacttgtcagaagtcaaccccttaatgtgagcacttcacttacattatcattatggtgtttccaactgacaactgctgccacactgccatcgtccctgagttcccagcgcttcagtaaaagagacttttgttctggcttgttgaggggaaaaatgcaaacaacaacactagctctaccaccagagatcctataaagacatgttcaaatgaacaataaagtcatttgttcacatatgacataaggctataagaatttaaacaataagacctcttgtgaaatgtggcaaaatatgcaccacaaacattgtgaagttctctgtcttgtggaaggcagtttttacatgggcttcaaaaaaccattaacttataaactacccttttaaaaaagaaaagaaaatcacttgtctcactataacattaaagcaatttctgttctaaggaaagcttaaatgcattcatttatacaaagtgcatgcactataatttataaaaagcacagtattctatcaggaaatgcggcacctcttccctccttcacctgaaatgggaaattcctccgtttttgtcaagtcccttttttctttgagtaatattgatttcttcaaaatgaaagaaaaaaatcctttaaatcacttagattcaagacgaagttttaaggcttgataataattctctaaatacttctgacatgggtggagcatggagagggaataatcctgctctgaagggaaattttaattgaatttgctttaatgtgaaccctatccttttttgctttgaacctttaaggaaaacttgttatattttcagacctcagcaaggcagaaaaatgcagagatttccttgtccgctcatgtcagggtgtctggcagcaccttaaaattgttccgattttgatgtttgaaatgtgacctcccaggaaaagtgggaggagaggagagcatgtgttaactggccaaaggtgtttcattgagctgacttagtattaacctctaaaggttttcaagtatttgcagatggatatgtacagcatccttgcagaattctcttaattgaagaaatgtttcatctcgatctctgttgacagaaaagattgcctactgataattgctttccttaagtgtctgataatatgccaggaatgagagcattctgtgttaggtcatctttaattatgcatgtaccacctgtcagctctaaatcagtaccagattagattctcgcagagtcagtttggggaggttcagagggaaagctgaggtgatctcttttagaaacaacaaaaatagacagtagtaaacatgccttctaacctgaagctttttaaaggagcctcatcttcattgttctcgagcaagaatacgccattggtacatctgaaaaacgtttgaaacctcgcccaagcggggataacttactgcgaagatggatgactgtgagcgaggatggtagtacctcctccctcagtaccatctgttgcatttcctttttgctccttctcatcgttgtaaatgagccagggaaaagctcagaaacatttttataagctatgtgaggacaggaaatatgttaacgatgttagatttcatacatttcaggggttttttcagtagcgggttggttttttttagaaggacaagtgtgggttggaaataatgcttgttaccctctgtcagcttttggtagttttattctcacttttcagggttgtttgggactttctggtgggatgtttagggttctttactgaaggctctgttctctcttcttctatcccttgatagaatggatttgtgaaaggtgtttttctttgttcacctgtcagaggcctaagaaaagccttgagtcattgtgcacttttcacagaggcggggttggatgactgagaagctaaaggcagagaagggacaggtaaaaaaataacagatgcgtgaattatcatgtggagggtttctcgagctttgacctgcaaaggtgaggctctgagcctgtctgctaaccaacctgagaaaactgccttgataagagtttgtgactaacagccttagaaatagtttggaaatcctaaaatatctcatttcaacactgctggctggaggcattgaagggaaaaacagatcagctcataatggggcaaagaccctggagcactgtggtccagcctgtggccctgagtgacctttggctgccttttgatacttagggtaccatttgcttttctaacctaatcaaacagttcactcaagtagaggcacaacctccaaaactacttattatagtaacattgccagtgctttggctatttgatgctcacttaatgcagtaaacaagttgaagaactttcaactccatgcaacagatacttcttaaaacaggagaacatagtacaattaacccttaaacaacacaggtttgaagtgcgtgggtccacatatacgtggatttttttctcgatagaagttacactgagtgtacctgcctcttctgcctcccttccacctcctccaccccttctgcctctgccacccctgagacagcaagaccaatccctcttcttcctcctcctcagtctgctcaatgtgaataccgtgaggatgaagccctttatgatgatccactctcacttaggaaatgtattttctcttatgattttcttaataacattttgttttttccagctcactttattgcaggtatataatacatataacatacaaaatatgtgttaatggactatttatgttatcagtgaggctttcagccaacagccggctattaagttttggaagagtcagaagtgatatgtagattttcgactgcgtcggggatcggcgccccaacccctgtgttatgcaagggtcttcccaagccttaactgaaaagaacatccgaaagtgaagctaagtcagagaaaggctgaagaaaggaattgaaaagagaagcaatggggaagaaaaggctgtactgccatgttctctcacaccagctcatctttgtaaaatcttttccatctgcctggaaagaccttccactctctccacctggtttactctcactttgagttgttcttcaagtgtcatctccaagaaggcttctttgttcctttctggcaaaatttgctgtccctcctctgtgatgccatagcccactggctgcctccttcgcagaacttattatgctgtactgcaagagcttggtgacttagctttctcctccacaaagtggctgctgaaaaagttaacattatcctaactgtgacaaaagaggtctcatgcccacagaaggaagagtcatgatttcattagactctgcagtacttagatcacattaggagtattataccagtacatttgaaaaggaacataaactggacgtggtggctcttgcctgtaattccaatgctttgggcagccaagacggtgggattgcttgagaccaggagttggaggctgcagtgagctatgatcatgtcattgcactgcagcatgggtgacagagcaagactctgacttccccccaaaaaaacaaacaaaaaacaaaggaaagaaaaggaaaacaaacaaacttgagtgctttatgaacacagcatgaggaatggagagggtgtcagagactgtcttgtaaccagtggttgaaggaacagagaaaggttagcctggagaagagaaaaacaaggggagacacaaaagctgcatttagatatctgaaagacatttgttattctagcaaaagcagaactaaaagaaattatagagaaagagatttgggctcaaaacaagaattttcttccagatacagctagcccacagtggaacctgtggcttcatttagtaacagtgaacctctgctactggaatgagagtcattgtctttttaggctatgtttgggggctgctgtagacaagactgctgcactgtgtgggagcacgaaccagatagccctaagattttaaagaatcagagtcctcactccatgcagaattacagtcaggaggaccgtgggacatcaaccccaaccgccatgctgtgtctgcttggcctggtactcagcactcatctggccacaggctacaggataaagctgaggatggggtgaaaagaagggaaccagctacttcctcaaggaggctgtttagtgaaacagaaggagcactggatcaagtcccagtccatgtgcttcctggtctcttgctagctgtgcgagtggctccctcaaagcctgcatttcttgccatgcaaaatggaaatgatattgttcacttcacagaattgcctgaggtttaaggaagatgaaggagtcctttgtggatggcagtgtgctgtccgtaggtgggtgcttgtccagaacccctgctccttgaccaacaacctctaaactcagttttgtcaccagtacaatggacataatttccttccttgcaggtggctttgaactggatgattaaataaaatgttatatataaaagcccccagcagagtaactgccacaatgatcgtgttgtcagcctcattccaccctctggagctgaggaagacaggagaggagtgtcctttctcacccacctctgccagtcaagttctccgaaggttctcttttacctgcccccagacctgacctcatgctcacattcctctcctgcttccctgtcaccttagcatggagtcttcttctctgctttttcttcttccttcctcctctgcttccatcttttcctaaaactcttttcttctttatctcctactaatttccctaatcgccttcttgtctgcattctgtaaaggattgttctaatgaatacaaagtttagaataatattctccataacttccttgttcaaaacaagatgttatgtgtagcattttggggagggagtggtgagtccttttccattttcctctgaatttgcttaaagtctttttttctacgttaacattttcccattcttgcatcccttgggcttgtagtcattaacttgccagacacacagcaactgattgtctttatgacgttgctaaagttaggagagtgtcattcacagggaacttaacccatatattaactcagacatagcaaattgctaaatacgtgcctttaaataaagagcttcagaatgccaatttgattctcttgttcacatcctctctcattgaaagggggttgctgaaacagaaaaagcaacgggaaggggaggataaatttcaactgttttactgagtcagaaattggaacactgccatccggatacaggcatctcatccatccttccatccatccactcagtgttcaggaaccaagtccttgtctcagacccagcagcggactgtggggcagatactgaagtgaatgataggatcccgtcttcaggcttcctcccatcctagtctgctactcaagcatcaggaactgtggctcattcatctgtggatgcccaggaatccttatgagatctagttcagtaaatgtgggagtaacagtaaaagcagaaagacagagggaagcaaagaaggaaggaaggcaaaataatcaaaggaagaaaggaaattgtattttacttagtgccggggtgtaaactggtacatgctgtaagtgtgatgtaatgattacggcgcgaatccaggggagcattgctgcatgtggaaatttgaatacagtttacaggaaaacgatgctaattatccttgtccatataaaagtcagaacagaagccacacactctccaggtgcatcccttagaacatgttgaatttcttctggtttttctcccactcagctatgttgctttttacttagcagaataactttaccgctccagtcatttctaatttttaggtcagaaaactgaatttcttcccttccaagaaaacaaaaaaaaaaaacaacaacaacctgtttctccccaccttttatggagcatggtgtttctctgggagccactgactactggaaagagcatggctcttgactcttgggtcagcttatgactcaccagcagccctgggcctcagcgtctccatgggaggtacaggaagagaaatgcttgccttgtgtacacccccgcattgtcctgacattcacatgagaagagacatatgcaaaagcactttgaaaaccaaggtgctaactatgtaaggacttttattgtaaaatataaagacctttgaggacagggattttctgattcatcactactgtactcagtggtgcctgagatgagcttacaaattaggtcttcctaaatggttgcttgagtgaatatattctgtaccatgtcatgtttaatttcaatctcaaaatcaataccacaattttttaaaagctctgaacttaattccataatgggatgtttgatactttcacaataagtatcttttaactctggaggaaaaaatacaaagaaatgctgacttcaattctacaacataattagaataagtgcagtgattttgtttatgctttgggtgtaaactgaatgcacagagatctcaaggaacctcagaaatatttgttatattcactgatatatccccattgcctagaactatgcccaacatggaatgggtgcttaataaatatttgttgagtgaatgaatgagtttaataaacattgagcatctagtatatgtcaagtcctgtggtatactctggggactagctacaatgataaatacactgtgaccacactgcatgcatagtcttttagaaagaacgtgtgtgtttggtgacactccctggcctggggagaagcaaccatgtcttgtgcacagccgattaccaccatttagaagtgttgagcacataacaaacaaagctcaatggcagcttaactgaatgaaccaatgagtcaaccagtcagtctatgttctcatttcatagtgaacttcacctccaccctctccttcccgaccttcactgtttcccaatgtggccagctcgtcctctgcatcctctctcacatgccctctcctgccgttgctgtggccaatccctggaaggggcatgcctcaccttgttcctgccctccttgcatgagtgtctcctgcctccacaccactcacagtgccacctggggtttgatcgtgtcactggcccactcaggatccttcagcagcacctcactacttactgcgtaacatcccagctccccttcctggcattcaagccactctgctgtctgaccctaacctgcttcccagcctcaccttccaccttgcaacagccaaactaaattccaccacactccacaggaggggctccgtcttttatctctgttcccttccacagaacgttttcttttcctggaacgaccttccccttcccctacttgtcaaaatcgtcctcattttttgccaccagaccacatgctattctcactctcaaatccaaagtgactgtcccagccaaaagtgatttttctttctctgccctattacagcactcagattataccattcatgtgttccctattacatgttgcttttattgtaattgtgaatcatacgagtgcctgctctattcagggactgtgctatgcacgtcacccatcctttctataattctcaaccagcctgcaagatgaataccatcatcagtggtgttcatggtctgtccaacatcgcacagctaataagaatggagcccggctctaaggctgtgtgtgtcactgcaaaccttgtgccctgcccattctagcagttgcctcactcacagttcctggttgtcttgtgcttctccatgagtatagtggtggccttgaccttatgtatcttggttccaaatgtaacatagatctacttagtgtcttcatgggctcagaacacatgacttaataataccttgtactcagtaaaggtggcatgaaggaatgcctgagatgtctctcttttcttttgtagtttatgctgaagcacatgatcagctctatttggtgtttatcaggagctgacaccttgatattcccaccatctcccaggctagttgctccctcgttcctggattagtaaattgtcctaactattctccttgcctggaatccaccctaccgtctgccaccaaacttatcttcataaatgtcagctaggtcacatattccagtaacatatagcttcaaatccctgaaagtcagtgtccttcattttgcctcatcacccccaccccatgacccagagtcacatggccagctatagcttctacttaccccaatctcattcttctccctgagccactggtcacctctcttgaatgcaccacgtgaattcctgtgcagtgttctttgatcatgaggtttggtttttccacatagatgctctttctcctctccacctgtggacttattggtttcttcagtaagtacatactgagcctggctgtgaaccaagcactgcactggactctgggaacctagaaaatagaaaataagaccttccctcaggaggctcccagtctgctggggtacatagacataaaagtaggcagcataaagaagggcagtgaaaaggaaacaggaatctttagggaactgtcatattctacccattctttatgaaatgctgcccaagttttttgtgtgtccaaactgatttttcccttttataaatccttataattctaattctcctgcatcattcattttgacatttagtcacatactgccttctatggttatttaaatgtttcccacacgtgtcgtgcttccacaggtggattttaagtgccttgaaacagggtgtatgctttatgtgttttataccattttcatcagttagcattagctgtgtaacaacacttccaaatttagtggcttaaaacaacaagcatttactatttctcacgattctgtgagttggctgggcagttcttctagtttggactggctcgactggggctgaataatctgggatagaggtaggcgaaccatagcccacaggcctgccacctgtttttataaatagggttttattggaacacagccactcccatatcgtctatggctgcttctgcactacaacagcagagctgagtatttggaatggagatgatcatatggcccacaggcctaaagtatttcctgctggtcctttaagaaaaaggttgttaccccccattctaggatggttggtctggggaggcctcccctgggatgactcatctctgttccacatgttctctcatcctccaggaggctagcctggaattctttatatgatgccctcaggggtaaaaaaaaaaaaaaaaaaaaaaaaaaaaagtgggggcggcagggggtggggtggcagcaggacctactgctttacaccaaactgcctgctggacatgcctcaaggatttcatattcaacctgtccagactggaactcgttagtttatcaatgtataggcttttttttttttctccaagtttctgcttaccttacgttttctgttatgcctttggtaaaagcaagtcctatggctaagccccgagtcagctttggagggaccacccaagactctgtaaggaaggaattcttgcagccatttgaaaaacagtccaccacatcagcccattcttcccgaccccagtgtccagcatcaagcacgtgataggtacatgcttgctgaattgaattaaaaatataaatggaatttttggaggaagggagtatattaaatagttattgtgtaagtaccatgtaccaggtgctgggatacaatgatgtacaaagcatgcagttcccatcctcaaggagcacacagtcaaacatcaattcagtgcatcctttctatccatttgtggaatgggctttctctctaggattctcattaaggatctttagcgtttaactatggctctaccatccatttgttatttcctgtctacccctactacccacttattagctggacttttcaagcctgcacaaggcctgctttaggatgcccctgcttccagcctcttcttaactggtccccctgtacaggctcctaatgccccactttcatcaggctgctccttgctcaggagcctaacccattcaccaaattgagcccagatctctaatatcctagagcaagcagcccatcatggtccccatgctccttcttgtctggaccgcttcttgtctggaccatattcctcagaatatttgctgtgcatcctatgtccatgcctcacttgtcctttctgcgtagggtatctccccttcccatatgtgcctgttgagatactacgcatctgtcaaggccaggccaggtgccaccccctccatgctgcttccttggttgaccctactgaaagttatttcctcttctgcattcacaaggtgccaagttgtgaatgctactcaaatggcacatatcacattctgtttagcatttgagttatcctgagtcatccacttcgtgcattgcactcttctggagattaaggacccaatcttattcattttcattttcttctgaatgccttgcataagggagacttttggtaaaatttcgttttatgaataaataactgatatttgcatagcacttttgccatttcccaactctttcatttgccatatttctaagaggccattggtttaaatatattatgtaccaccaagaaagaaagagttaattaaaatataagccaccaactataagatatatccttatttctgaaatatcattagatgaaaaaatgtacagactggaatctgtgacatacagaatattaaatccagttcagatatctatcggtatccaattagacatttataaaacacctaaatatgccaggcattagaatctcacaacagccatatgaaagaggtagggtgggtagtagtattcccattttacagaggaaaaaattgaagttcaaaagggctccaatgcttgttcagagtgaaacaaatataagtaaaagagccaaagcttatggcattaatcttatggttaaaacaaagctgccttcctaaaatcacctgtgggtatcaaaacctgtaagtcacctctaagtcttattatcagtgtgcacctttttctttctttttatagcactacctacccaaaattatatgcacatcatttggcctttcaatttgttttttccagctgtattgttttgtcatgtttaccccaagaacatcctgttacttggcataacataatgtaatgtgatgtgatatttcatgcttcttaggaaaaattagaatgattgttggatgcttagatttttcttgggaagtaattagcaggcagaatctctgtcacacacacacccccataggagtttctcaaccatcattagcctcaaaatagtagaaggctttccaaacccaacacttcacttaattaattacctcatctgaatacttgcttttggattttaagaaatactttgtggaatatgcagttgagagacaaaacattttattggtatattcagatatttgttacattttagaaggaattggtatgtgcacattttgacttttacataaagctcaagctgattttaaagaataggtacactaaaaactcttttccctatacatctggttgtattttcattttattcaaattgccaggtaaaagaagaaaaacgcaagtggaagagacttctcagatcagcaggaactggaatgtgttcaagtcttggcagagccaggtcagcctttcatctgtctaaaggagacgtgttgaaatacccacactgctctcaggattattcagactttgtttgagtagtttgtcaattgctggtcactacactttagggaaaaaaaaaaaacagttggagagaagggaaagaggcaagattagccaaatgatacaagataagatctgtaaaggaaaatcaagagaaagaggttgtttggcttagagaagaaaaagtaaagttaatttctaatttcaaatacataaaggtctttgggtgaagaaaattacagttcagctgtatcctatgaccattaatcacaaaacaagaggaaattgctatttgtgctaaatacgtggcattgtgacagcatcctagaagtaattcccaagggatagtgaggtgtccattctaagacctttaggattcagttgcctaaagtggatacgagaccaaactagaagtcctctaagacctctttagctgtatattgagttaatcacctacttttataactacccaaacaactttcagatcataattatcagatatattctttagcttctaccactagccgttgtgacatgggtaaatttgaagctagggtggagtagacctcatgagaacttggcaaataaagattactcagctcccaagtccttatgtaatataggtgtcctagcccttctgtcttgtaggtcatatgatggctcacgccacacacatgttccacgtcacctcttaaagacttgtgggtgcttaatctttgaagagtattttccctgaaaatattccctttctttcctgcatgatcagtttctccctttgtactaaatctttcccattggcatataaaatctttaatactgccccaggaaaaaacttcttgtgtcacattctcctttagcttctactccactttactgctccctttcacacaaaacacttcgaacttcttgtctataggtattatctagactcatctcctgttatccttgacacactccattaaagtctctgacaccactgcttcaccagaactgttcagatcaaagctaccaatgaccaccttgttgccgcatcttcctcagcttctcaatagcttccagcacagtcaatcactcccttcttcctggaacccacttttctctgagcctccatgacagctcctctcgtggatttttttttccttctcaatcaccactgctgtctcctcctctgttagtttctgaattggtgtgccctgaggctcagtctgtccctatgttttctctctgcactctcacttgttatctcctctgctcccaaacctttatggcagcaactccccaatttatatcttcagcccagctctctcccctaaatatcagacttagatacccaacagggtacttgacatgtccacttggatgtttgataatcatttcaaacttaacatattcaaaacagaactcttaatttctacccacgccctaacctacacaaacactggaaactgtccatctcccaattattcttatctcaataaatgaaatgacaccaccagccatcaaccagggatcctgtacctcaccttccacatccaaactatcaaaagctcctcctgttttatgcccaatcagatatcgagtcatttcacctctttctgtctcctctgctacttctctcagacatgttgcttcaatttctcacctgaactactacattagcctcctacctggctctgctttcattcctgcctccctgcagttcattcttacagagaatctagaaaaagctcttcaaaagcaacaatcagatgtcactctcctactttctaaaaacttttaaagaggacctcttcttctgccagtataacagactttgtactccaaaggatatctctgttgcattttagaactcctaggaagtaatgaaaatatctaagaaaaaaaatacaagtagctaagtgcatatatgtcaacagtaaacaagccagaaaaggcagaattggccatcccttgtgtttgtgtgtgacggtcatgtgggggtgcaaatggggaccgtactgcaactcccagtttaagcctgggattctagaagggagataaaatagcccaggttggtagtaccactaaattccagataaagcaaatgtaatttaggcttctagttttttttcacagattgggatcttgagctttcaaaaaagattatcaaacaaggaaacaaaccaccgtgagtgaaaatcagcaaaactagcgttaatatattaattactccttccccaccaagggctttagatgtttgaagtatcagataagaagaaactagactaccttatataaagaaaaattaacttaaatatagactacaaaaatggtgaatggtgaacaacaatggtctctcacaatcaccaggcacttctgaaaaagagctaaagaaaaccttcagtaataaaaaaaaattatcaaaaaatttagtggataagcttttttgtaatggactaattaatgaactggaaaataaaactaaaatagtttcatgcaatggagcacagacaaagagatggaactataaggaagagaggttaataagtttggagggcagaataagcaagcctaactaaagcctatttagagcgtgaaaggcaacaaaaatatgcagaatggagatgagacaatgtttaaagagattgtggctcagaatttttctttttttttaagtgaagagttttatcttttgtgttttttgtttgtttgttttctttgtttttttttttactgttattatactttaagttttagggtacatgtgcacgacgtgcagcttcgttacatacgtatacatgtgccatgttggtgtgctgcacccattaactcgtcatttagcattaggtatatctcctaatgctatccctcccccctccccccaccccacaacagtccctggtgtgtgttgttccccttcctgtgtccatgtgttctcattgttccattcccacctatgagtgagaacatgcggtgtttggttttttgtccttgtgatagtttgctgagaataatggtttccaacttgatccatgtccctacaaaggacatgaactcatcattttttatggctgcatagtattccatggtgtatatgtgccacattttcttaatccagtctatcattgttggacatttgggttggtaccaagtctttgctattgtgaatagtgctgcaataaacatacgtgtgcatgtgtctttatagcagcatgatttataatcctttgggtatatacccagtaatgggatggctgggtcaaatggtatttctagtcctagatccctgaggaatcaccacactgacttccacaatggttgaactagtttacagtcctaccaacagtgtaaaagtgttcctatttctccacatcctctccagcacctgttgtttcctgactttttaatgatcgccattctaactggtttgagatggtatctccttgtggttttgatttgtattcctctgatggccagtgatgatgagcattttttcgtgtgtcttttggctgcataaatgtcttcttttgagaagtgtctgttcatatcctttgcccacttgttgatggggttgtttgtttttttcttgtaaatttgttggagttcattgtagattctggatattagccctttgtcagatgagtagcttgcaaaacttttctcccgttctgtaggttgcctgttcactctgatggtagtttcttttgctgtgcagaagctctttagtttaattagatcccatttgtcaattttgtcttttgttgccattgcttttggtgtttcagacatgaagtccttgcccatgcctgtgtcctgaatggtaatgcctaagttttcttctagggtttttatggttttaggtctaacatttaagtctttaatccatcttgaattaatttttgtataaggtgtaaggaagggatccagtttcagctttctacatatggctaaccagttttcccagcaccatttattaaatagggaatcctttccccatttcttgtttttgtcaggtttgtcaaagatcagatagttgtagatatgcggcattatttctgaggactctgttctgttccattgatctatatgtctgtcttggtaccagtaccatgctgttttggttactgtagccttgtagtatagtttgaagtcagctagtgtgatgcctccagctttgttcttttggcttaggattgacttggcgatgcgggctcttttttggttccatatgaacttgaaagtagttttttccagttctgtgaagaaagtcattggtagcttgatggggatggcattgaatctataaattaccttgggcagtatggccattttcacaatattgattcttcctacccatgagcatggaatgttcttccatttgtttatatcctcttttatttcactgagcagtggtttgtagttctccttgaagagctccttcatatcccttgtaagttggattcccaggtattttattctctttgaagcaattgtgaatgggagttcactcatgatttggctctctgtttgtctgttattggtgtataagaatgcttgtggattttgtacattgattttgtatcctgagactttgctgaagttgcttatcagcttaaggagattttgtgctgagacagtggggttttctagatatacagtcatgtcatctgcaaagagggacaatttgacttcctcttttcctaattgaataccctttatttccttctcctgcctaattgccctggccagaacttccaacactatgttgaataggagtggtgagaacgggcatccctgtcttgtgccagttttcaaagggaatgcttccagtttttgcccattcagtatgatattggctgtgggtttgtcatagatagctcttattattttgagatacgtcccatcaatccctaatttattgagagtttttagcatgaagcattgttgaattttgtcaaaggccttttctgcatctattgagataatcgtgatttttgtctttggttctgtttatatgttggattacgtttactgatttgtgtatgttgaaccagccttgcatcccagggatgaagcccacttgatcatggtggataagctttttgatgtgctgctggattcagtttgccagtattttcttgaggatttttgcatcaatgttcatcaaggatattggtctaaaattctctttttttgttgtgtctctgccaggctttggtgtcaggatgatgctggcctcataaaatgagttagggaggattccctctttttctgttgattggaatagtttcagaaggaatggtaccagctcctctttgtacctctggtagaattcggctgtgaatccacctggttcctggactttttttggttcgtaagctattgattattgcctcaatttcagctcctgttattggtctattcagagattcaacttgttcctggtttagtcttgggaggatgtatgtgtcgaggaatttatccgtttcttctagattttctagtttatttgcgtagaggtgtttatcatattctctgatggtagtttgtatttctgtgggattggtggtgatatcccctttatgattttttattgcgtctatttgattcttctctcttttcttcttgattagtcttgctagcagtctatcaatgttgttgatcttttcaaaaaaccagctcctggattcattcattttttgaagggttttttgtgtctctatttccttcagttctgctctgatctcggttatttcttgccttctgctagcttttgaatgtgtttgctcttgcttttctagttcttttaattgtgacgttagggtgtcaattttagatctctcctgctttctcttgtgggcatttagtgctataaatttccctctacacactgctttgaatgtgtcccagcgattctggtatgttgtgtctttgtcctcgttgatttcaaagaacatctttatttctgccttcatttcattatttacccagtagtcattcaggagcaggttgttcagtttccatgtagttgagcagttttgagtgagtttcttaatcctgatttctagtttgattgcactgtggtctgagagacagtttgttataatttctgttcttctacatttgctgaggagtgctttacttccaactatgtggtcaattttggagtaggtgtggtgtggtgctgaaaagaatgtatattctgttgatttggggtggagagttctgtagatgtctattaggtccgcttggtgcagagctgagttcaattcctgggtatccttgttaactttctgtctcgttgatctgtctgatgttgacagtgggatgttaaagtctcccattattattgtgtgggagtctaagtctctttgtaggtcactcaggacttgctttatgaatctgggtgctgctgtattgggtgcatatatatttaggatagttagctcttcttgttgaattgatccctttaccattatgtaatggccttctttgtctcttttgatctttgtttgtttaaagtctgttttatcagagactaggattgcaacccctgcctttttttgttttccatttgcttggtagatcttcctccatccctttatttggagcctatgtgtgtctctgcacgtgagatgggtttcctgaatacagcacactgataggtcttgactctttatccaatttgccagtctgtgtcttttaattggagcatttagcccatttacatttaaagttaatattgttatgtgtgaatttgatcctgtcattatgatgttagctggttcttttgctggttagttgatgcagtttcttcctagccttgatggtctttacaatttggtatgtttttgcagtggctggtaccagttgttcctttccatgtttagtgcttcctgcaggagctcttttagggcaggcctggtggtgacaaaatctctcagcatttgcttgtctgtaaagtattttatttctccttcacttatgaagcttagtttggctggatatgagattctgggttgaaaattctttctttaagaatgttgaatattggtccccactcttctggcttgtagagtttctgccgagagatcagctgttagtctgttgggcttccctttgtgggtaacctgacctttctctctggctgcccttaacattttttccttcatttcaactttggtgaatcttgacaattacgtgtcttggagttgctcttctcgaggagtatctttgtggcgttctctgtatttcctgaatctgaatgttggcctgccttgctacattggggaagttctcctggataatatcctgcagagtgttttccaacttggttccattctccccgtcactttcaggtataccagtcagatgtacatttggtcttttcacatagtcccatatttcttgaaggctttgttcgtttctttttattcttttttctctgaacttctcttcttgcttcatttcattcattttgtcttccatcactgataccctttcttccagttgatcgaatcggctactgaggcttctgcattcgacatgtagctctcgtgccttggttttcagctccatcgggtcctttacggacttctctgcattgattattctagttatccgttcgtctaattttttttcaaagcttttaacttctttgccattggttcaaagctcctcctgtagctcagagtagtttgatcatctgaagccttcttctctcaactcagcaaagtcattctccatccagctttgttccattgctggtgaggagctgtgttcctttgaaggaggagaggcactctgatttttagagtttccagtttttctgctctgtttttttcacatctttgtggttttatctacctttggtctttaatgatggtgacttacagatgggtttttggtgtggatgtcctttccgtttgttagttttccttctaacagacaggaccctcagctgcaggtctgttggagtttgctagaggtccactccagaccttgtttgcctgggtatcagcagcggtggctgcagaacagcagatattggtgaaccacagatgctgctgcctgatggttcctctggaagttttgtctcagaggagtacccggctgtgtgaggtgtcagcccgcctctactggggggtgcctcccagttaggctcctcgggggtcagggacccacttaaggaggcagtatgcccgttctcagatctcaagctgtgtgctgggagaaccactactctcttcaaagctgtcagagagggacatttaagtctgcagaggttactgctgtctttttgtttgtctgtgccctgcccccagaggtggagcctacagaggcaggcaggcctccttgagctgtggtgggctccacccagttcgagcttccctgccgctttgtttacctaatcaaacaactaacttggcagtggtgggcgcccctcccccagcctcgctgccgccttgcagtttgatctcagactgctgtgctagcggtgagtgagactccatgggcgtaggaccctctgagccacgtgcgggatataatctcctggtgtgccattttttaagcccatttgaaaagcgcagtattagggtggaagtgacctgattttccaggtgccgtctgtcaccgctttctttgactacaaaagggaattccctgaccccttgcacttcccgagtgaggcgatgcctccccctgctttggctcgtgcacggtgcgctgcacccactgtcctgcacctactatctggcactccccagtgagatgaacccggtacctcagttggaaatgcagaaatcacccatcttctgcatcgctcacgctgggagctgtagaccggagctgttcctattcggccatcttggctcctccccaccggcattccagaatttttcaatgagaaatactgatccagagatataggaagcagtgtatctaaacagacaaataaaaaggccttcacaactttttataccgtagtaaaactgtgaatcactgaagacagctctcttaaaaggagccatagggaaaacagaccacatccacagaggaacaatacttagactgacagcagacttctcaacagcaatgactaaatccaggagatgatgaaatattttcaaagttctgagagaaaatgattttcgacttaaaattgtgttttcagcaaaaataaccttcaaaatgagagtgaagtattttcttcagacgtacaaaacctaagggagtttaccaccagcagacttacactgaaggaacttgaaagaatatacttcaggctgggtatggtgacacacacctgtaatcccagcattttgggaggtcaagccaggaagattgcttgaggccagttcaagaccagtctgcacaatacagtgagaccctagctctacaaaaataaataaataaattagccaaatgggtggtgtatacctgtagtcctagctactcaggaggctgaggcgggagaatcactagagcacaggagttgaagactgcagtgagccttgatcacaccactgtactccagcttggatgacaaagtacaaccctgtctctaaataaaagaaaaaaaaagcgtatacttcagaaagaagaaaagagatagcaaaaggtctgaaaaatagaaattgtaagcaaagaaattggtaaacatgtaggcaaatctaaacaaatattgctggtttaaaatactgtgtaaaactccctatatatgaggaaggagataatcagagtttgcattataagttccttttgttgttctgaaggggttaaactactaactttggatttcaagggtaactgctaaaagaaaagaactagtatataacttctaagcctgatttttaaaaatcaaaaaagaaagaaaaaatacataaagcataggaaagtaggacaaatagaaaataatattataaaaacaaatgcagatatatcagcaatcacaatatatgtaaattgcctaaactttctggctaaaaaatagagtaaacattaagattttttaaaaaatataataccaattcagctatacagtgtttagagaaatacacatttaacaattcgtattcgagcaaataccaatcaaaaaggagctatgtagctttgttgatatcagtcaaaatagactttaagggctgggtgtggtggctcatgcctgtaaccccagcactttgggagactgaggcaggcagatcacttgaggccaggagttcaagaccagcctggccaacatggcgaaaccctgtctctactaaaaatatgaaaaattagccaggcatgctggcctgcacctgtaatcccaactgctcgggaggctgaggcatgagaatcgcttgaacccaggagacggaggttgcagtgagccaagatcatgccactgaactccagcctgggtaacagagaaagaccctgtctcaaaaataaatagatagatagatagataaaagactttaaggcaaaaaaaaatcaggatagagagagcactacctattgataaggttttaattcactggaaaggtataacatttctatattgcatcaaaacatgtaaaacaaaaactaataaaactatagagaaatttcatgtttctccaagatattgcttggtcaagcacataacaaataattagtaaagaaatataacattgaagcagtacaactgaatagtttgattcatagaatcttgcatcaaacaaatagaatatatgtgttcttcatatggaagaattacaaaacttgccctcatactatgcccctaaaacaagtctcaacagatttccaagaatcagtataatgaccacattatctgatcataatacaatttaattagaattcggtaactaaaacataaactccccaaaattccccttatatgtggaaattttttaacattttaaaataattcattgatcaaagatgtaataatggaaaatttaaaatacttagaattgaatgataatgaaaatatgatatatcaacttgtgggatacagtaaaagttgtacttggaggaaaatttatagtctcaagtgtttttcttatttttattttttattttaagttctgggatacatgtgctgaacgtgcaggtttgttactagaaaaggaaaaagtgaaaattaagaagctaactttgagaaggtaaaaaaaaagacgaatgagaaaggaaggatgaataaagatgagaacagaattaattaaattgaaattgtaaatactatgtagggtatcaacagagccaaaagttggttctgtgaatggagttcataatacagggtttggtaaactttttttgtaaaaaggcatatagtaaatatttttgactttgtgggccatagtctctctcactactactcaactctgccactgtagtgcaaaagcagctatagataatacgtaaatgggtggatagagctctgttcctataaattgttgttttaaaaacatggtagactgtatctagtctacaggatcataatttgccagtcctgtactaacagtaagactgatgtaaaagagtaagtccagtgagaaagtttagcacagtgactggatataagatcaatatacaatatatatcaataaaaattaattgccttatataccagtaacacagaaaagtaatgtttaaaaagttattaatgataataacaaaaatttaagtacctcagaacaaatctaacagaacttatgcaagacctaaataaactaaaattgtattgtttaatatgctcaggtcaattgttctcaaaattttggtttcagaatccctttatactcttaaaaattaccagcctgtaaaagcctgtaatcccagcactttgggaggctgaggtggatggatcacctgaggtcaggagttcaagaccagcctggccaacatggtgaaaccccatctctactaaaactacaaaaattagctgggcatggtagtaggcacctgtaatcccaactacttgggaggctgaagcaggagagaatcgcttgaacccaggagatggaggttgcagtgaaccgagatcgcgccattgcactccaggctgggcgacagagcaagattccatctcaaaaaaaaaaaaattaccgagaaccccaaagagctttcgtttatttgggttttatctatatttaccttattagaaattaaaactgaacatttaaagtatctattagttaattttaaaatcacagtaataagctcactacatgttaacatgaataacatatctttatgaaaaaactatatttttcaagataaaagtgaaaagaattgcattgttttgtattttccccaatacctttaatgtccagcatactagaagacatttagattctaatatctcttttagtgttcaatcttgtgatatgtcatttttgtttcattatatgaaaaaattcagcctcacagatgtgtatttggacaaggatagagttaataggtttttcaaatattgtgggtgttcttcttcgatattacgttaaaatttgacaagtggtaacttcttaaaagttagttgcaatatggaatctaaagccatatcaatgaacttttcaaactccattatattaaaattcattactctgccttgcacatcaaatcttttaccaagtatgattttgtatgattggaacatgttgctttatcagcttacacagatcttcaaaatgatgacactattttaatgttcaaaaaaaatcacctattaatgttattatcattcttaacagaaaagcctctcaaatttggggaagctgccaagcttacagtaggaaatacacattttccaaaaatcacgtttttatttgaaagcttagattttatcagtggcaacaaatactgtcagttgttttccttgaagtgacagctcactcaccttgttcaatttcaagaaaatgtctcccaaatgcccaagtctgagtaaccttagtttgtcagtcattctttcaagtaaaaatggtgttctctgaaaacagttacttgtgcagcttgccgctgaatcccacaaatgcttttccttgggatgacaatcttactttggtttgcagcaaaagtactttatgagcacatctcattttgtcacacagagtgttaaaatgttatgtgttgagatttagtacaaataataatttttactgcttgatcaagtccctttataagtgaaactgtcaccctgttctatggtgagtatatggtagtgaagaactgatagtttggtgccactgctttgtttcatgctgagatgccagcagttttacccaccattacgtttgcaccagcagtgctcatgtcaacactgtgaaaaagacatacagcatcttagtatgaccatgaaaataaaattgacttcactggcattctgaaagggtctcgggattcccaggggttccacagaccacacagagattcattgccagagaccctcctgtggctctcttcttcgcgtcattgagatctcagtttaaatgtcatgacctcagagaggtctgtcatccgtagtcacccagtgacttcctatcatagcaccctattttgtttttataacacttatcactacttagtagtttattgtttacttacatacatttattgtctgtttttcccagctagaatataagacctaagaatgtagggactttgtctgtcctgttcaatatagtaactgtctacaaaacttaaaataataacttggcatctgagcactcaataaaagtttatggaatgattggatcagattgagatggtgcatatggagttggtttttcatcatttctcatcagatggcctcatagctgcaactagctattttttgcttactctggattctctgtataacaacaaaaggaacttttgagttccccattttgcttacattaacacaatcctcactagaaccctgcaagttgggttctgtttacccctttttacagaaaaagtatctgaaggtcaacaagagctgttacaaatctaaagagctagtgagtgttagagccaaaaatttaacttacatccttcagcttcttcccaggcaagcagtaactcaatggatacacattaagacatactcataattattgctcagagtgccaaggtttcaagagttggctgccaaatgatgaggcagtagtcattcagaaagtgtgcttgttagagggaatttttaaaataattaaaattgaaactctgaagttataacaaatgagcagcagattttcaaaattaacttttttgcacattttagaaatgtttacctcaaccctcaattcccaagaaaccattatatttcttcagccttttgcccagaagttcttaggatctttcctaggaactgccacaatggcaaattaacataaagttttgtattgcattgacaccaaagacctttcctttgccctggttcctggttgaaacaagcgtgaaataccatgtctgatgacatgccatggcagcatgaaggcttaggcccaagggataccaaggcaggaggattgcttgaggccaggagttcaagaccagcctgggcaatatagtgagaccctgtctctacgaaaaacacaaaaattagctgcacatggttatgcacacctgtagttctagcaactcaggtggctgaggcaagaggattccttgagcccaggaattcaaggctgcagtgagctatgatcacaccactgcacaccagtctgtgcaacagagtgagaacctgtctctaaatatataaataaaaaaaaaatagaaagacctagacctgaaactaatctcggttattataccctcacttcatagaatatgccacagaaaagctacgactgaatttctaggtgtcacaagtcagcaatagaatggaatatgaatcaggcctcttatcatctagacaggtgctctgtttgcttcaggttttatttgaaatctttaaggagagatttaccaagagactttcaggggagcccctagattagccctttagacaccagatgatttgagacctttgagaatcaattgtctaggattgtgtttgccagccctgagatccataacttggaaaataaagtggagtgccaacccaagttctggttttggggtttgctggagagaactcaggccccagcataccccagggtttgatggtgtgactctacaggaggcactgacaaggcctttctttaccacaattatccactaacttaactcaccctcagaatataaatactcctaggaacgtcaggatgggttattataagacagccacggctttcaaaaactgcggacactcgaaggtgctcagcttcatcaaggatactgtatgagtagaggaaagaagtgattcggggaaatggggcatgaagtataggttctgttagcagaagagcactgacatccaagagaatgaacgaggtggggtagggcatctgtggagaagcatttgcctgcctcagcctttccaaggcctttccaggaccatggacgtgccagtataactctagctgacattggattctcaccagcaaccggaaaggaacctggctgtacagcacagaacagttacattataggcccctgccacctctgccccccatccctgataacttcctgaaagcaccaagaggataaaggtttgtagaaataacatgggcaggacaggcacagtggctcacgcctgtaatcccagcactttgggaggccaaggcgggcagatcacctgaagtcaggagttcgagaccagcctggccaacatggtgaaacccctaaaaatacaaaaattagcctgcgtaatggcagatgcctgtaatcccagctactcaggaggctgaggcaggagaatcgcttgaacccggaggcagaggttgcagtgagccaagatcatgccattgcactccagcctgggtgacagtagtgaatctctgtctcaaaaaaagaaagaaagaaagaaagaaattacatgggcaattggcctgggcttggcctctgttaatgagttgcttgggcataagaatatggtttagcttcatccttccctttattcttgtaattacagtgttaaaaaaaaaaaagtcaccaaattctagtagctctgatgcattcatttttgaatgctcgtaaacttgaacttgtttacaaaagcgtctctataggtctgtggaaaaaacatctgaaagagcccatggaatcaactctccagtgtgctcctgccttagtaccttccatattgatatcacccacaggttcacccagaaaaatcggatgctgcttctggctagctcctttgaaatttcaaaatagctactatgtcttttgtcttcttttggggaggaggtgtaccatattcatctttgtatacctagtaccaggcttacaagggagaatgcagttagggatccacaaatattaactgattctccctctgtgccttcccttagataatttctgttttgtccttcagaattcagtttaggcattgccattgctgggaagagtctcatctgtccttgatggcatttgtctcgttagccactatattatgagctccagaggcttgtgtttgtgacccagcacttagcaaagtggctggcatgtggtagacacatactaaatgtttcttagatgcttaaatgactgaatctttccatgtttccaagtttccacacaattttgctcttttttgagtgtgttttcgttcatccatgtcaacgtatccagagctctcattggcagccagcagtcattctaaaacagagctttcactctttcagacgtggatgggacactggggaagacatgagatactgaggcttcattttggggtctttatttcctgttttgagtattacacagagatacagaggaatatctttgatcatagtggagcaggggagcagatatgaacagagtcctcatggtttttaggggagagaagcctgtaagactatgggaatgaatggaaattttaaaagtccatggaagctggcacctttaaaaatgtgccaacttttagtgcctcatgattaaaaagcaaaataagtggcagacaaaaccctgtgtacttggaaagaaatattaattttagaaagtatgcaaaaggaatttttcacagtgggatacctcttgcatcaccatccttttagtgtttttacatgggatgagagtcctgtgggcctgagaagtttttggtattggtaatatgatatttgaagtaaccaaaagaatttggtgaacccactgacttggttttgacttttgagaaatacagcttaactaccccaaattcaatgcaacttatctcggacttacggcaaagattattttatcttagttgtggaagcttacctgcctgtttcttcaatagagatgacaagttgcacgtacagtgttacagatgttgtatttgtgatcttccccccacctttattaatttgaaacgtgttgtgtacatctgttgatgtcgtttctttcctgaaggactcactctcatgggttccagcctgcacaacatgctgtgataagatgctcacccagaaaagtgcttagttaccaagacgcctgaagtaggctgacacaccttgcacacaagccaagcagtggaaactgctccacagagtcatgtggtctgctttgtcctcaataatttaggatgcaggcttttctgcgcatgtaagggaaaagtctggattagccatctagacatggaaaaaaattaattctgtgccctttcatccctgtgtttattatctatttgtccagtctctgtagagtcagatgttatcaacctgataacagtttccttcctgagcataaacttgcttattcattcattcagcccacataagcttactccctggtgatctcatccagtcttgtggcttttaaataccatctgcatactaatggctcccaaatttatctctctagaatcaggctgtgttcagttgcttacctccacagggctgtctaatcaactcctcaaagttgtcatatccaaaaccaacacttgttctgccctcatcccccatacctgatcctcctctggggtttcctctttcaataaatgacacccccattcatctggtcacttaagctgaaatccttggtgccatcgttaactctttccgttctctcaccccacatccaatccactagcaaatcccgtcagctccacctgtcaaatccaggcactttgtcaccacttttctgctccttccatagttcagtccatcatcatgcttaccaggactgctgcaggagcctcctaacatgctttcttgcttccagtctgaccctacagcaacccattttccatatggaagccaaaggaatcttttaaagtgtaaatcagatcctatcacttgcctactctggcttctcataacacttagagtaaaacccaaactcctacctcgaactgcatgcccttcacttcctgactacctctgcagctttcgctggccactatcctccatgcactctggccttttgagtcatcagagcatcaagcctactcctgctgtagggccattgaaccagctgtttatttctgccaggaaggctcttttcccagatatctgcatggtttactccctcacttcatttagaatctgcctaaatgagatcttccacgactgcagtatttaaaacaggacctcaccgcccacatccttcactgctcttgccctgccttatttttttcctctacagcacattattgtagattcattcgtttgtgtgtatattgcccttttctccaatggaatgaaggctccatgacaagcacaactttgctttgttcattgctatatcctcaggtacctagaacagtacatggcatcatgtgttatacatggtagacactccatcaatattgatggaatgaatgaaaacacttattgagtagccatctttgtttcaggcattgtgctccagggaaaaaagaagaaaaaagcatgacttctgtccttggggaacttaaccaggtgacagagacagacacataagcaattttgtgagactgagatggctgggaggctggaaagctccagcatgaatctcccaactgtgcctgcaggagtcagaaaggtaaccaaaggagctgacatttgagattattcttgaaggatgagcaggtgtttgccagacagagaagagtaggcaggacactttgggtggaaacggaacatgcaacagcatggagctgtgataggacaaaggtcagtgacacttgaatataaccaacttatgggagaggtgaatgagatgagtgtcttagtttgttttctgttgctgtaagttaatatctgaaactgagtaatttgaaaagaaagaaagggagtgagggaggagagagaggaagggagggaggaagggagggagggagagaggaagggaagaaaggaaaggaaagggggaagaggaaaaggaaaggtaaggtattttcttccagttctggaggctggcatcacatggtgagggaggttatgagacatggccaaaatggcttttataaagacccactcctgttataacagactcactccctcattaatccattaatgaagacagaaccctcatgacccaatcacctcctaaaggtcccacctctcaacactgctgtcgcaaggattaagttgccaacacatgaacttttgggggacacattcaaaccataacagtgagcttggatagatgaactaccaggaagcaacaatttatttcaaccccagcccccaaacatgatcctcccctggagttttcccttacagtaaatgacaccctcattcatgtaattgcagaagctgaaattctcaaagttacccttaactcttttcattctctctcaccccacatccagtccattagcaaatcctatcaactgtacctctctgtacctttgaaattcatgccaaatcaggccgtggttgccactcttatgcttcctcactagtccaagccatcatcatcactcacctagactgttacaagagctacccaacaagcctttctacatctcttctgacccatattctatgcaaaaacaaatattgttattgtgaactgcttttaagttggaagagcaacttaggtcagtataaattaaatgaatgcctattaaagattataggtatgtatgttttgagcagaagaagggaaattattttatgtgaaagtttgtatctctttatggtttgtatgacttgtccttatgtttctgtgatattgtatatgtgagtatgtgtttttatgtgctcatgtgtggtttccttactgatggaaagacagagaccccttcatgtttattctcacagtagcccacactgtgcctggtgcacctggtcaatacaccatgaatggcagcaaaaggattattcttggctgggcacagtggtcgtgcctgtaattccagcactttgggaggccgaggtgagtggatgagcccaggagttcagtcaataccagcctgggcaacatggccaaaccctgtctctaccaaaaaaaaaaaatacaaaaaactagctgagtgcagtgtcccgtacccatagtcccagctattcgggaagctgaggagggagaactgcttgagcccaaaaggcggaggttgcagtgacccatgattgcgccactgcactccagcctgggtgacagagcaagaccctgtctcaaaaaaataaaaataaaaagaattattcttcaccctacaacagacttactgctgggttcctttagtggtcttttctaacatctttttaaatgatcagtttcccatagtttatttatatgcaatgtttaggtaagtatctgtgtcagtgtgtcagtgtgtttttagcagaatccaggagctgcagcttaaagcagtggtcagaagagaagccgtggcctaaaatatttattttggcaaataagaaaaatagaaataaatgaattaagtgtctaactcaaaacgttagaaaagaataataaaacaaacttaaaatatagcaggaaggaaataaaagtatatcaaaaaatcctgaattcaaaaactgaaaaattgaagaattaataaatgcaaaagcatgttgtttgaaaacctcaacacaatcaaggaaactttagctgacttgattaataaaatagaggaaataataaaaataaggtaaataaaagattacaaaggaatcataaagcctgttttactcaactttttacagataaatttaaaaatccataattgtctaagaaaatataatttagtcactgacttctaaagagcaggataatccatcagaccaaccaccatagaagaacacaattgtaaaattctaaataaaatattagcaaacagagcctagcaccattttgaaagaacagtgtaccataaccaaatgaggttcattccaggagtgataaatattggaaaaatcttttaatataatttatcatattaatagatctttaaggaacacttatttgatcatgttcatagatgctgcaaaggcattgatgtaattcaacatctattttcattaaaaaccactttataaaatcagaagtgatggatacctccttaacataaaattattattatatatattatttattataaaattagcatcacgctttagtagatgtagtgtttatgggattgcagagtcaaattagctaccatttggcccagcagtcccattactgggtgtatgcccaaaggaatatacccagtaatagggaaacaccagaagccatgtcagaaacaatgaagacaagggcgcccattgttatttctttaacattgttctgaacgtacttagcctgtgcagtacaagagaaagaaagtagaagtgtaaaaagtcaaaaggacgaggttaaactaatgtttgttatttgcagatgatatgattgcacacttggatagtatgctttcttctgtgaatcagctggaagatggtggtaacaataacaacccattatgtactaatggattatgtaaaactaaacattcttcatatatgtgatcaacagctgattagaagatataatggaagttaatatcctatttacaatagcaaaaaagaaaagttcaaataaaatatatacacatgtgtatatatatatatgtaatgtgtataaatataggaattgaactcaagaactccttaagatgtaaatctttattcttgtaaataaatgaaactgttttaaaatcctcctgagatgaagagaaaaaacaaagatgtgaataaatggaaagacaatccatgtccttggacagaaaacctcaacatcacaaatttaatgtgaatgcagtaaaaataccaacagaatattttgtaaccaaacaagctgatgctgaagttcatgtaaaaaaaaaaaatcaaaaatagccaagaataaaaagagagaaaattgctctttagatattaaaatatactacaaacgtactcatatatttgaattggcattaatgggcaagtcagtggcaccttatagagtccagaaataatctcaaatacatttgaaattttagtttacattaaggaagcatctcaaatcagtgtgataaaaaaggatgttcaataaatggtgctgggacaattaaatagccttctgggaaaaagaaagtttggtggttcatatttacaccaagataaatcctaaatggttccaaaacttacttgggaaaaaaatttaaccgtaaaagttctaaaaggattcaggagaaaattgtttataagttgggaaggcctttcaaagtatgacaaaaatccagaaaccacaaagggaaagtcataaaatgaattcaatgacacaaaaatcaaaaatttctgagcagcaaataccaccataaaccacggccaaaaaaaaaaaaaagtgacaaagaaggaaaaatatttttgcaactcatctagagatagaactgatttccctaatatttaaagagcttctccaaggcagaaaaagaccaacaatgcaataggggaaaaaaattaaaagaatagtaagactattaacaatttacagatgtggaaatataaatagctgttcataaacatgaaatatatcagtgtcatttattaaaaattaatgcaaattaaaactataattaaacgctgttttttacttgccaaacaggcaggggttttttgttttgttttgtttttaagtttggtaatataatctattagcaagactatggataaagaagtactcttggccaggcgcagtggcttatgcctgtaatcccagcattttgggaggccgaggcgagcagatcacgaggtcaggagatagagaccatcctggctaacacgatgaaaccccgtctctactgaaaatacaaaaaattagccggccgtggtagcacgcacctgtggtcccgactactcaggaggctgaggctggagaatcgcttgaacctgggacgcggacattgcactgagccaagatcgcgcctctgcattccagcctgggcgacacagtgagactccatctcaaaaaaaaaagtactcttgtacattgctggcaggagtataaattggtactgtcccaatggaggacaatttggcagtatcaaaactacaaagtttatatcctttgatccagtaatttcacatttaggagaatgtatggatatgtgtacaaaattacaagattacacgttacaaccttgtttataataacacatactgactacaacccggatagctgccaatagagaattggttatataaattgtactatgaccttctagtcaagtattatgaaaccataaaacaagaatgaagaaactatatttttaagtgaaagcagggtgcagatcatggcttagtatgtaaacttttttttttttttttggagacggagtttcactcttgtttcccaggctggggtgcagtggtgcaatctcagctcactgcaacctctccctcctgggttcaagtgattctcttgcctcagcctcctgagtagctgggattacaagtgtccaccaccacacccagctaattttttgtatttttagtagagagacagggtttcaccatgtcggccaggctggtcttgaactcctgacctcatgatccacccacctcagcctcccaaagtgctgggattacaagtgtgagccaccatgcccgggccatatgtaaacttctgtgtaaaaaaaaggacaaagatctatctataaatatatatatctttgcttaaataggcatcagttctctctggaaggatacacaagagacactcgtggcctctagaaaatggaactggatggctgggaagctgggattgggagatttttggagaatttcagtatttaccattttattcattttaggaaatttgaaccaaccaaagcaaaacaaaagaaaaacttaatgatatttttcaaaccatctttagaagaaaccactcttatacacaacaacatggatgaacctcacaaacataatgttgagcacaagaagccagacacacaaaaaattatatattatttctttaaagttcaaaaagagaaaactaaggtgaaggaagttagaattagcagttctgttggtggaaataacaactgggatggggcatgaaggagaattctggggtgctgataatagtcttcatttgggtggtggttacatgaatgcgtctacttgaaagaaaatcattgattgtgcccttatggttggtatacttttctgcatgtaaattacacttttgtttaaaacaattaccaaaaaggggaaaatcttctttaaggttgttctagtttcctaaggcttccataacaaagtaccacaaactggatgccttacaacagaaatgtattgcctcacagttctagaggttagaagtccaaaatcaggatgttggcagggtcatgctccctctgaaacctatagggaagaactcttccttccttcttcctagcttctggtgctgaccattcatctttggcattccttggcttgtagccacatcactctcacctctgcctccatcttcacatggtgttgttctccctgtgtctctgtctccatatggagttcattttaaaaggacacccatgatattggatgagaggcctaccctactccagtatgaccccatcttaactaattacatctgcaatgatattatttccaaataaggccacattctgagctacaggaggttagggcttcaacatttcttttggagggagggagaatattgtgattcaatccacaacaggggttaatgaacttttaaaagagtatcagagttgctgtaggagagccttttaatgcagttttagtgactgatatgtgaagcgtgctgttgagctcttgcagaaagaggtaggtaatccaatgctgtttccaccaagagtgttagcaccttgacaataattcagctgctggaaaatgagggcctaatccacactgactactgtagttaagtttaaagaaaataaatgaagagcctttcggctcctttactagcctccttcatgattttatagttgtgtaaaactcggggctgtgtctttgtaggttacaggcttggcatgttataacagttcatcttcatcataaagcgatgatattggtttgaagatgggcttttttaaaaagcctcctcatttttcacacttaatccaaggatcctgcatagccccatttttcactgggcatgggtatggattttaatttactattgaagagtcagcaagtttccaaatgagtaacagccgcagggtgtggtatgtgtcttcccttttggttgtgcatctaaattgcccttgaagtataatgaatcccatggttctcaccaccatggaaggtattttcctaatttaatggaataattattttgttgttactggctttaagtgtgtgtctcgttttaggtgctcagtttgtgttgactgaaagaagaaaaacagaacacttagctacttaaagtttcaaaattcaactgttttagggcagacaattagtctgttagacaaactggagcactgattgcctttggaggaggggaatgactgggatggagtataagggatctttctggggtgatggttatagtctatagattgataagatttggtttacatgggtatatgtatttgtcaaaactcaatgaatacacacttaagatttgtacatttcattgtatgtaaattttgcctcaaaagaaaaaaactataaactaatcttaaactctagcaagtaatatcctgctgaaatgtttaggggaaagtgtgctgatttctgcagtttactttgatatgctttgaaaaaaatctgatggatatagatggatggatgtgtaatgaaataagcataataaaatgttaatcgtggaatctaagtgatgggtatgtaggtgttcactgtaaaattctttaaatgtttctgtaaatttgaaattgttcataatatgttagaaaaaattcaaagtacaaaatgatacaggaccttgcaaatgtgggaccaaagtccacttgccatttttatcccctgttacaagcttgaatgtctgctactttaacaagggaacaatatcacctgctaggggtctacttctgaatccaagagcaaatttgcagggatatgcagggagcctgttttactgccctgctgggaataaaaggaagtaggtgaaaaaaggtgaagggaatttatatctagtgtggtgtcctaccatatgatcttgtgccaactgcctgcatgtagcccagaaaaaaaaagctgatgagaagcaatgccctgttttagaattatttttgtgactcaaaggaaacccattttattttcacttaaggaaatacatgaagagctacagttctatggtgttctcttagaatggttcttcctctacccacccccaatcttacacataaccccttcgtagaaatgaaatgtaagtaaatgggcttaattttagaacaaaaattgtctccatatgctgctcatcatgccccttctccttgggtattttctttaataaaatatagtggaaacctgggattcagacatgcttgagtttttcttctgttattgttactaaatggttctgcgaccttgagtaaattgtttaatatctttgagcctaaacgtctataatttttaaaagagcatattcaatcagatgatctacaagttctttctaccactgaaatgaaactgttttttcaccctgtcttcctttatcatcttgttggggccagctgtaatgaaatcttgaattcaaaccctggcatactccagaatgaggaacccccggtcccaacaagacacacaaaagactccgcaaggaactcatttaaataatgcctaagattttagtcccggtgaattttccatctgtttctccatattagttgaacatgaagttagtcagatacttaaggcattcaagagagtaaagccaagatgtcttacaaatctcctctctaaaaatagcgagaagaaagagcagaggagaaagtgatttttatatctgtggaactgtatgtttagttcacttgggctcatccccaggtgaaaattctcatttaaatactggttatgggaagaggccataaatttctagctaggttttttcccatggaatgcaagcagagcagagtgagtatttctagcagctgagtgtattttcattctcaggatgtaatagaacttaaaggcaagagtagtttggtgtgtcataatatgttaacaacccagagagggtagttagataaactttgtattttttcatgtgctatttactcaactgtgttgccagagacagagatttacattatgtgtgtcccttgacttggtgtttaattatctaaggggtaattatacaggtatacatatatgtgtattcatggtcagatatgtcacataccaaatgtgattgtatccctgtaacttttctataggttatgtttctatgtttgcatattttggcatgtattcctacatattgtctttctttgattagctgtaaaccaaatgtgtgtagtaggactagttaaataatataagaggctaattatcaaggactttactaatgttctcagattggagatgttttaggtgaggagagcatgggcaagccatctgatttggtccattattatattttcagttatctttggtgctcaaagagagacattaatatagctgaggatgacatagcaaattaccacagctctctaaccttttaaattgctaacactgttgtaatctgtaattatagaaatcagtgtgagaattgtggcactgcataattatctttcctgatactttattgctgaatgaattattaatcagaatcagtcttgtatattattttcagcaactcagaagaataatgtataattaaatttcattattcctatttttgtgctaatgttttatgatgttgtaattgataattaattggccaaaaactcacacaatacttgggagtttcaggtggctggaaaatgtacagtgtgctgagttcattaagtaatgatcactctgtgaagactacagagtctagtccagtctgtacaataaagcttttgaaattgttatattaatcattaagcatttcatgttgccttaagagaaagcagtgactatgggcatataagaataattaagagattttaatagatttcaaatatggtcaattgtaagtaatcagatgctagttgttaatatcaggctaatacattagatacggttggtatgcttctctgtgtatcagttttccattctaactaaataaccagcagtcaccatataactacagtttcaaaaagagaataacagccatttccttcagcctttgatgagggtaacccagggtgtagcacaactttatagacacagtgtggtctaatcttcttttccagttgtctaaaatactaaatggttatcctcctcacagacacacaggatttaaaatctgaaaggattatgaacttttccttgactggcattctaactaagaattcctagtgtctcttttggtatcatttgcaacctaggtaaccagtaaaagctctgaatccaagcatgtcttttagtcagcttgagttctattgaaaagaaacattgtcgggcattttatgtgaacttctgctgtgccattttgatttttttttaagaaggtgatgctcctttctggttttcaagtgtctcctttagaaacttacgtttttttttaacaggtgagcatctttttctttcaaagaattttgaaagcattgtaatagggaatttaacaacgcatatgctgttatttaatcaattctttgctaagctgctcagaaaaccatccacagaagactgttcctatataaatgcacctccattttcccaggaagatcatgagtggtttgtttttacattggttgtgttgggtccaatgtcttacaattccaaattataagttattaaagaggactttgtcatcagaccactgtgagtagaactaaagcacattcctgtgcgtgaggaaaagttgctctgtggccttcctgctggtctgattttctttttttttttttttttttatttaagtttcagggtacatgtgcacaacgtgcaggttagttacatatgtatacatgtgccatgttggtgtgctgcatccagtaacacgtcatttaacattaggtatatctcaaaatgctattcctcccccctccctcctccccaaaacaggccccagtgtgtgatgttccccttcctgtgtccatatgttctcattgttcaattcgcacctatgagtgagaacatgcagcgtttggttttttgtccttgcgatagtttgctgagaatgatggtttccagcttcatccatgtccctacaaaggacatgaactcatcattttttatggctgcatagtattccatggtgtatatgtaccacattttcttaatccagtctatcattgttggacatttgggttggttccaagtctttgctattgtgaatagtgccccaataaacatacatgtgcatgtgtcttaatagcagcatgatttataatccttcgggtatatacccagtaatggaattgctgggtcaaatagtatttctagttctggatccctgaggaatcgccacactgacttccacaatgattgaactagtttacagtcccaccaacagtgtaaaagtgttcctgtttctccacatcctctccagcacctgttgtttcctgactttttaatgatggccattctaaccaatgtgagatggtatctcattgtggttttgatttgcatttctctgatggccagtgatgatgagcatttttcatgtgtcttttggctgcataaatgtcttctattgagaagtgtctgttcatatccttcacccactttttgatggggttgtttgtttttttcttgtaaatttgttggagttcattatagattctggatattagccttttgtcagatgagtagattacaaaaatttcctccaattctgtaggttgcctgttcactctgatggtagtttcttttgctgtgcagaagctctttagtttaattagatcccgtttgtcaattttggcttttgttgccattgcttttggtgttttagacatgaagtacttgcccatgcctatgtcctgaatggtattgcctaggttttcttttagggtttttatggttttaggtctaacatttaagtctttaatccatcttgaattaatttttgtataaggtgtaaggaagggatccagtttcagctttctacatatggctaaccagttttcccagcaccatttattaaatagggaatcctttccccattgcttgtttttgtcaggtttgtcaaagatcagatggttgtagatatgcggcattatttctgaggactctgttctgttccattggtctatatgtctgtcttggtaccagtaccatgctgttttggttactgtagccttgtagtatagtttgaagtcaggtagcatgatgcctccagctttgttcttttggcttaggattgacttggcaatgcgggctctttttttgtttccgtatgaactttaaagtagttttttccaattctgtgaagaaagtcattggtagcttgatggggatggcactgaatctataaattactttgggcagtatggccattttcatgatattgattcttcctacccatgagcatggaatgttcttccatttgtttatatcctcttttatttcattgagcagtggcttgtagttctccttgaagaggtccttcacatcccttgtatgttggattcctaagtattttattctctttgaagcaattgtgaatgggagttcactcatgatttggctctctgtttgtctgttattggtgtataagaatgctcatgatttttgcacattgattttgtatcctgagactttgctgaagttgcctatcagcttaaggagattttgggctgagaagatggggttttctagatatacaatcatgtcatctgcaaagagggacaatttgacttcctcttttcctaattgaataccctttatttccttctcctgcctggttgccctggccagaacttccaacactatgttgaataggagtggtgagagagggcatccctgtcttgtgccaattttcaaagggaatgcttccagtttttgcccattcagtatgatattggctgtgggtttgtcatagatagctcttattattttgagatatgtcccatcaatacctaatttattgagaatttttagcatgaaggttgttgaattttgtcaaaggccttttctgcatctattgagataatcatgtggtttttgtcattggttctgtttatatgttggattatgtttattgatttgcgtatgttgaaccagccttgcatcccagggatgaagcccacttgatcatggtggataagctttttgatgtgctgctggatttgttttgccagtattttcttgaggatttttgcatcaatgttcatcaaggatattggtctaaaattctctttttttgttgtgtctctgccaggctttggtatcaggatgatgctggcctcataaaatgagtcagggaggattccctctttttctattgattggaatagtttcagaaggaatggtaccagcccctccttgtacctctggtagaattcggctgtgaatccatctggtcctggactttttttggttggtaagctattaattattgcctcaatttcagaacctgttattggtctattcagagattcaacttgttcctggtttagtcttgggagggtgtatgtgtcaaggaatttatccatttcttctagattttctagtttatttgcgtagaggtgtttatcgtattctctgatggtagtttgtatttctgtggcatcggtggtgatatcccctttgtcattttttattgcgtctatttgattcttctctcttttcttcttgattagtcttgctagcggtctatcaatgttgttgatcttttcaaaaaaccctgctggtctgattttcattcgaaaatcagaaaccttcctcctaccatcttctctcaaacccaggccttccagagccacgtctactcccagggcagcagaggcctgggctgtggtcgctgtcacattctgaaagcatcatcctgagggtgccattgagggtcctgtgtgctggctgttttcctgagggctgcggaaaggaagggcataattggtcctctgtttggcagtttgagataggccgtggacataagggggtgggatcagagccatctcttagaagcaagagcacacaagcttttaccaggagagaacagcctaattctactctgcaaggatccacattgtatagagccaatgggcaatgtgtttctggatttgtgagtatttgagcacagagagcttcagaaataaagcacactcaagaccttctactcagcatctctgcaaatgggagcttttccttcactgtgtcaatctaagcctttcttttgcttttgtaccatcccattatcttggctgtgtgtcttggaggttatatcattagttttctctaacggtcgcattgcttagaatggagtaagttttctgtggataaatggataggcaaggcgaccttgaggcccagaaaagacaagcagctctggagagcgtagggatatgtgtgaagaaacaggctggaaggagacctcagcagaaacagaagggacatatggacctgttgggattaggaaaagtcttttttagtcactttcttattaagtatgtattgagtgtagcactttgaagttctgcggcttcaatggtgagcaaaacaggtaaaaattcctgccctcaatagaaaaataggtcattaacaaaatatgagtaaaatatagtgtgtgtgagatgtgaaaacgttataaagaaacataaacagggagggaggacggagagtgaggtgggaggctggggttgtggtttaaacggagcagggtggttagggaggcctcactgagaatgtgatgtctgcacagagacctgaggaggccagggattgagccatcacatttacatctcctaacagtctctcgggagacagtctttatcttcatttcacacataaggagactctaaggacttaaataaattgcccaagtcccctcgttcttggaatggcagggcggggagtcttagtttgtagggttgtttgaaatcagctgtcatggggttaaaatgcagatcgctgaacctgctgtggttaccctaaatctatgcagttagagaactattgttatttccagagataggaagcaggccgggagagtctgggtgttaggtgggcagggccaaaagcaggaaatacttacgtgaagaaaaggcaagccattgtcaaactggaaatgaaacgtgaatggggaaaattggcatggttggaaaagaggagctaatttgatggaccagttactatatgttaaattggtgaattaatgaacaaacaaacacgtaaaatattttaatcctcacagttctatgagataggtgccctttatcaggtacttttagtacagatcaggaaactgaggcacggaaaagttaagtgtcttgtgcaaggttttgcagctagtgaatgacagagtcagaattcaaagccaggtaggctggcaccagagcctccatccacaaccactgcactaccttgcctctgtagaccatctttgtatgcagtatctaatgggtgcttactattctccaggagtcattctgtttcccacgtttgtgttttaagttgcttacgccttgtgaccactggattacagatgagaaatctttacagagagctcacgtggtttgtctgaggtagcattgtggtcatggttcagatgcaggcaggctggccccagagcctgacctgtcaccactgcaggatcctgcccctcatgatgaaagaggattctgatttgggcagaacatacatgcaaaaggtagcagagagagaaaataggaaaagcccgtaatgggaggatagagtatccaaagcacgcacttttaacaaatctgaaggaatggaatcttttaggaaatgttatcagatgagaatcaatacaagtcccccatctgccagatgccttcttttggcatgagagtgaactatatcagggctaagtgcccataagagcagacattctttatataattatgtgtaggattagtcaaatagtggtgaggataattcctgatgcgagcagagtactctgcacttctcagggaggtctcagatctgttgccttatttgaccttcacagtcatcaagggatgttgcagaaggaagtctacatagtgtcatggccgaagttgccagcaagtaccagaatgcacacctatcccatcattctcttgcaggtcttggatggaaattaagcaaattggcccttccccaggtttaagcaagagaatctggcaaacaaaaatatacattattcttcatgcagtccagatttgcctcaatataagaaattttcagcatatgtagaattacaagtgtatataatgtgcaaagaaattaactttcttttcataagaatagcttttatttgtgtttactgtaaaacaaggaccatcctaaatactttattgcttcatctcgtttaatcctcacataagtattttgtacatagaaagaccaaggattacacagtctaacaatggccccaaagccaaagccatgcagctaggaagcaggagagcagggattcaaatggagcccctctatctaaggatggaaggagaaatggaaaataggtgcattttagagtcaagaaagtgcgaaacactgtgtctctccggtaccacctggccaatgagcccttgtggcacccattccttaccgtttggagagggggtattgtctgcccccatggcagtacaattctgactttttataatgagtgaattaaaaaaaaatctcttccttaatatacttggctttatctgaagcatattctgtgaggtgaaatcgtgtgtgagtggcagtggtataggcatataagaccgtctgtatcttaaacagtatactaagtgtcatgtagcatgtgtgtcactaccttttggtcacaataatcgtcattctgagaagctgccaaggacaggacagggacttggaaagctccaagcacattctttttctcccattccttttcactgccttttccccgtgttctctgaagggcatttgacctgcgtgttaacattccagttccatttgacctcctgcttggtgacaggtggtccagatgcttttgttacttgatatgggacttaacagactgccaaccagtggtcttagcctcatggttttcatcatttttaaatggaaaaacaggagtgggtttcaggtgtgcctaggctccagtggaaatcaaacctttctcaaaacactacctgaatgaccctcaagctagatgactttcaccccattagatgctgcctgcctttggtcttgaatttcgattttcttagttaccgggtgaaccaacttgcaatctaaacttcattcgttctagcctgcatccctgcagagatgatgtttcagaacagaatcattttgtccaaaagacccccatgcatgaaaggagcaagtttccttttattaagaatcttttctgtgaaagctgtatttctgccaagcctcagtattcacttctgtttcctttcctacctgtaaaccgcgtgccctcttaggagctggggcaggcaacagtagagatcaggcggatgaacagctgtgaaactatagatattctttatgtataggcagacaaaagtgtgtctggaggtaacccccacccccattccaagaaggagttaggtttgacaatccagtctcttaacatcataatccctggtcagatgaatctaactttggcaggttatacatattagcatctataagcaatacctggcctgggaaacatactaggaacaatggcatgactaatatattgcttcttgacttcacatggaaactcaagcccagcattgtcactgacctggtgggcaaacttctgacagtaattatcattggaaaatcttgcaaaactaatttaagaaacacaattatttaattatagcactttgatagcgttctcctctttcctctctctccctccattcctccttccatcttccccactcctttatgacatctgaagtccactaattactgagctcaattttcaggctgtgtcttaggtttgacagaaatgctaaagttgaaattagacttgcagtctcccctcttttcggcatttgactatctgttgtcttttcttagtcttgattctctgttgtgagttttgacttggtttttttctaagacagaataatttctgtcaggttctgggaactcccctcccacccgatgaagaagttttggggaggagttatgagccctgtgttgaactgtgcactaggtacaaatctgcagtgccttctattaaaatgtaaaatgatccgttgagtcatcctccctctggtttgactcagatgctttatggcgcactttgcatgtcatttctctgtaatgatttccccatggagaagggtgtctgatagaatccaggcagactgaagattgctctgagtcaaatggatctgttattcttttagtattaacccttatctctcagtttcccatcctcgtattttccctgaaggaactttaatgaagtaaataggttccaccaccctcatttagcctcctaatcactgttcacaatttcttctcacattagcagcgtgaagctctagggtaatatttctctggctacaaggggagggaaggggacactgggagagaatatttcacacagatgccctgataaagagaaatgcagaaaagaaatgacttttctctgtcctctaactcctaataggcacgaagcacatgctaataggaagcagagattaatgtatgagaagtgaatataaatggagaacatagacacaaagaagtaataccagagacaaactggaagtgacaatatagaaaagaaggcttgccaagagtagaaaatgacctatcccagaagaatagatggaggctttggctttactcttaactggggggttacacaaaagaagcaaaagcaagcatcaacatataaaaaagaccagtgcgatgatcacaaagctgcatatccaaatctgcccatggctaaattgcacattttctccctggtccacacacccactgccccaccaccaccaaccaccactaacagtaatcatgccccttggatggcctgacatgggctccctttcacccgctgatttcatctcctttttgagatgacagtttatgcaccatgctattgttaaatcccagttgtagccttctctctggcccgctaaacggggtagtctcatctgacatcgctgggtggagacaagaggagaggatggacaccccgcttaattccagagccacatacctaagacggcttttgagggagacgctgacctgcacaccagagcactgttttggccatggaaagagaatgccgaactattgctcagtactgatgggcactgtgttccattaatgtgtgaaagttgacctttgattcatcctttgggttgactctgtttataagggggaaagttcacactgttattggatgggtcttcccctcttcttcatctctctcaaaagttatgtgatggcatttttcccttccagccagttgtgttcttttgagcatctctagcttccttaaaaagtcttctcaggaaccacagttagaaaagctcatgtttcaggattttcctaaagttcctatactttcatagaaccatagaaactagaactaaaaagtcacctagtttatttcctccttgcatagataaggaaatagaagtgcatgaagtgatttggttttaacaagagagaagacaaaacacgagatctctgaaaaaagttttactgcaaagcaaaggcctgggctcagatttcttaccatctcccaaaaggcctcatccctgtatttggcccatttttgtagattattactgaaaacgtacaacttggaattggttagatttgattgcctttaaggaccttcctgaccataagttgtaggatttaaggtgtgggtgtgttttttttcatttgaagcccaaagcgcaccctaggacctttgtgattaagtcacagaacctaaaggaggtgctcaatacttgagttgttaacattctcctacagtctttaatttgggggagctgggatatatatatatatagtagatgtagaaaagtgcataaaacaaatgtataacttaaagtgggaatatgtttacctgtcactcatgtcaagaaatagagcatgcaacagcacccctgaaaccccacggtgtccctttctggtgaacactgcctcgctctaaatggagcctctattctgagtcttttctttatagttttgccacctttgtatatgtcttaattcaggctgccataacaaagtaccataggctgggtggctcaaacaacaaacatttatttctcacagttccggaagttagaagtctaagatcaggatgccagcattgtccagttcttggtaagggctgtcttccaggtttgcagacagccatcttcttgtgtcctcacatggcagaaagagagtaagaggggttctcttataaggacattaatcccattcgtgagggctctacccttataacccaatcactcccaaaggccccacctccaaataccattatactggggattaggatttccacatacgaattttgagaggacacatttactccatgtgttagttctcacactgctataaagaaatacctgagactgagtaatttataaagaaaagaggtttaattggttcatggttctgcaggctgtacaggaagcatggtggtatctgcttgtggggaggcctcaggaaacttacaatcacagtggaaggcaaagctggagcaggcgtcttcatgtggccagagcaggaggagggaagagaggagggggaaagtgccacacactttttaaacaactacgtcttatgataactcactattgaggcaacagctccaagggggatggtgttaaaccacgagaaacctcccctatgatccagtcacctcccaccaggccccacctccagcatcggggattacaattgaacatgagatttggacagggacacagatccaaaccatatcactccataacagtatatatccctagatgttttttatccatttttgaatttgacatacatgaaaccagattgtatgttattatcctgtgtcttgtttctgtagctcagtattcagcattaggtttgtgcaactcctccacgttgctgcatgtggctctaatttgctttgttccgttatatgaatatataaatatatctcagtgtatttctgcattctgctacggatagacatgatgttgtttccagttgggagttattctgaacaattctgtgaacactctttatacagagtttctgttacagatatccaggagtatctctagggtataacctaggcatggaattattcggtcataatctatgcatatcttcaactttgctagataatgccaaactgttttccaaagaagttgatctgaccatcaatgcacttgatattgtcaaactttcttattgtttctaggttagtggctatatatctttaattctttattacctttggaccaatacatacagtctgctaccaacattctaatatttcttccacctcagtttccgtatcagactgtgactctccattttggttaaattcgttcattcgttcattcatttttgaaacggagtcttgctctgtcgcccaggctggagtgcagtggcacgatcttggctcactgcaacctttgcctcctgggttcaagcaattcttgtgcctcagcctcctgagtagctgggattacaggcatgcactaatatacccagctaatttttgtatttttagtagagacagggtttcaccatgttgaccaggctggtctccaactcctggcctcaagcaatctgcccacctcggcctctcaaagtgctgggattacaggcatgagccaccgcgcctgaccgatgtcgattacatttaaatataggaaaagtgctagtagttgccacaagtttattaccagatattttggaaatttgggttattttttattttggcctatttgaaagaataaacaagcagcaataataacaaaaattagcaaaaaaaattgggacttgttacaactgttcctttttaaagtttttggtatatttttcagcagtgcagtaaaaaccattgtcagtttttgaacattgaactttcccctagaaggtcaaggaaaatagaagtttatactgaattacgagaaccattcagagctattaaggatttgatgatacaattgcaagtgcttcctcctaacaacagccttaaatttcagttcccttggcactaactaggatgcaggcagatggagtgtttgagtaaataaggaacacaaaacgttttagctgctccatgtcagtcagggcccttactttagctatctaaggcattagggacattaagtgacaagcactgcagttttccattagaaaatactgaaattggattgcttttcacttaaagtaagaagttttagtcttgatgcattagaaagtgtttccaatccaaaagtaataagtaagtaatttttatagcactgtgcactctaaaatgtctatagacttgaaaactttcttttataagaactaacccttacagttttacagtaaataactttttttaaaagcatgttttataagagcaggaatttactcagcaattactaaataatttagtgtttgattcacagaagtatttacttaatgcactgtttctgggagaaatgtagtttgaatttcaagtgaaatggtttataatttggtctttttcattacctgcaaggcatattcatttcttttcatctgaagcactctagacatgacaggttgtctgaaaatcttaacattctacttttttgtgaattgcagcttttcagatcccactgtgatttttttgttggttttttttttttttttttacttttttgctttatacttttacctgcagaactattagacattttcatttctgaatatgacccgataatgaatgaagagtcaatgagtgagttaatgagtaagtctgtattcattaatactataccttcgagtaataagagttgtggtctgtgtagcttcttaaggggatgaatatactatgataaaataatagtgatttacttttactgctgaaccatatgatgagatgattggggtatatgtgtatgtacatgtgcagctgggttttttggcctgcaaaaggaagaatgagatccagccaaaacccaaatcagaacctttggaaagcttccttacaatctgatttcagctaatgtctacatactttaacacgttgtctaatgcttaaagactggctgtcatactcctccatgctattctgggttctgttactcactataaaccatttcattcttagatcccatgggtcctgctgcagatttcaggatttgctgcatggaggagtggggggcggaggggaatgttgtttaatattagcaaggcaagtgaaaaaagaaaacctagtggaaacaggagaagcagaattcagtttggcattggccagtcaaaagcagacaaattggagggagttcatagaagagcacctgtcttagcctgttttctgatactctaactgaatacctaagactgagtaatgtataaagaaaattatttcttacagttctagaggctggcaagttcgaggtctaggggccgcatctggtgagggccttcttgctgatgaggactgtctgcagaatcccaaggtggcacagggcatcacatggtgagggagctcatgagagagggccaaagtgacttttgtaacaaacccactctcatgataactaatgcactccttcaataacccattaattcattaatccatgagggcagggccttcatgtcccaatcatctcttgaaggccctatgtcttaatgctgccacattggggattaagtttcaacatgattttcataggggacaaacattcaacccatagcaatgcacccatgataattggaggttgagaagggctgactgatttttaaagaaagcagaaaggtatgttccattatgtttgaagaggaaccaacaaggaggggtaggtaaaggccaaggggaagaaagtaatactgacatggcataaagaattattatccagaaataatgtaatatattcaagaaaatcttcagtcaggttagtctaacaacagctccacgaaagtgatatattttagattataccatttgatgaacaaaactaatactttttcagtgttttccaaagctctcaagtaagtttagcccaaaaagcagatgcccatgtttatgtgactgtcacagcctatttcatcaacttgggatgcttatgttgctgtatctttgtttttctaaacctgccctgttagcagaatatggagtctactcttgagaacttcaaccatcttagagcccagaaagagcaggggtttgggtcctagtttctactctcccagaaggctgtggtttccttgtatatttgttgtccaccccattccctgtaaccagctctgcaggggcagttttgttaagccatgcaacatcaacaacaatataacggcacaaaatggtctttagaaggtcaaagaaaactagcttctctcagttaaaaaagacagtatcccgctctttgtgatcaatcaggtatatttcttttatagactcatagaattgtagatctggaagaacactattggtcttctagttcatgcttttcattttacaaacatggaagcaggcccctaaacagttaggcagtttgtccagatccacaaagttggtcaatgctggagctaaaccaaaagccccaaacatgcctggtccactcctgtttccactgcacttcactttcatttctctttttattttctttcatttcatgtttcattaaagaatttatggctttgtttctttcaacacaagcttctatcttggtgtaggcacattaatatgtattacccataaatgaactggaaaaatgagatgtcccttataaatctcctactttttatgaattgaacacaccatccgtgacctagaacattaaatgctccaccaagttttgagtgtttccttatacatgcaagctattatgatttttaactcaataatttctatagactaattgaggagactcagtgtggtaggagaaagaataataatttgaaaactaagaatggagaaaacaaatcagaattgagaccctatatgggagataagaaaatcctgaaaacattccacgaaaatgaaggactaataagaagccagaatagaaaatatttgtcttcttactagataataaagaatttagcagcaatttcctagtcattgacagaagccaggtgaactcgatcttaccccgtggcttagggtcattataactgaattgtgttatttagaatgctattctaattccatttaaaaaatgattccagataacaaacctcacaaatattttatcttttattggaataccaaagaactaataattcttcacagaggcatctttgtaattgggtattacaaaccattatatatagcagagcaaagtttatactatgtggtttgcattgtgataagttattgtttataaagtgtttggagtagctgtagcataaaaaataaacctatggcttttactttcagccaagatggagtaataggttctagatttaccctttctcctaaaacaactatagaaacagataaaatatatgaaataatgatttttaagacatgggacatcaggaaccaaaagatagtaatccccaggaaaggaaaacaaactgaactcagcatactgctttgagagtttctaggccatggcacaggaaggaagaaccaaggaagagctggctgactcttcagttgaagagacagcactaagagtctggaaagatgataatagagttcagaaagcaaggtagcagagaagagagagctgcagagagagaactccagagatcttcagagagtttccctttaatattctgcagagtactgatcagcagatgcaggtaagaaaactacccaaggatggagagacagccacccaaaacaaagggaactcagagaactgggaataacatcatttcctaccagccagactagaaaacacatatatcaggggtcattagatagagtactcagaagtgtcttgaatcagtagtagggagtaatgaaccctagactaaatgctgcttttcctatctaacaaatctcaaaagcaaaacctgaaaggatcaaactgcttccaggtaactcaactgtgtcttagaacaaagctcaagattatttatgggaacacaaaaatatccagcatttaacaaggtaaattttacactgtctggcatccaatcaaaaatgttcagttatgcaaagaagcaaggaaatataactcacaatgaagataaataacaataaaaactgaaccagaagatgttagaattaacagacaaggacattgcagtagttattataactatattccaagtgttcaaaaagttagaagaaagattgaacatcttaagtagagacatggaagattttttataaaagaccaaaggggacttttagagataaggaccacagtgtctgagatgaaaattatgctggaaaagattgatggcagattagaccttgcagaagaagagattagtgaactcgaagggttagcaatagaaaataaccaatgtggctaggcatgatgactcaagcctgtgatcccagcattttgggaggccgaggtgcgcagattatttgaggtcaggagttcaagaccagcttggccaacatggtgaaaccctgtctatactaaaaatacaaaaaaattagctgggtatggtggcacacacctgtaatccctgctacttgggaggctgaagcaggagaatcactcgaacccaggagacagtggttgcagtgagccaaagtcacaccactgaactccacctcaaaaaaaagaaaagaaaagaaactatccaatgtaaaatgtaagagatttctttaaagtaccaaaagaaaaaaaaaatgggcatttgtgagcgacgggacaaatgcagatggtctaatattatatgtaactccccaagggagaagaggggagaagacaaaaaaattgtggcaaaaatatttgaaaaaatgatggccaaaatttttccaaatttggttaaaactatccacgtatccaagaagctcaagaaacatgaggaaaactacacaaaggcacatcataatcaaattgctcaaaacaagtgatcaagaaaaagtcctaaaggcaacagaggagaagaaaagacattacatacagaggaacaaagatgaggatgacagatttttcactggaaacaatgcaggtgaaaagacagtggaatgacaattttcaaagtactgaaaagaaaaaaaaaaaacacctgtcaacctggaatctatacccttcaaagataactttcaaaaatgaaggcagcaggcttttacagagaaaagttgaaataatttatcactagtatacctgcactgcaagtaatgttacctcattatttatatctttttaaaaggtaattgactaaacaaaagtaatgacaatatagtacaggggttttaacaagtaacaagtaaaatgtataatacaatggccaggaagggagaaatggaagcatactactgtgctttacacgacatggtatgatatcactggaaggtagattgtgataacttaaagaagcatattatgatatcactggaaggcagattgtgataacttaaagaagcatattataaatcctaaaacaaccaatgaaataacaaaacaacatgccaataattgaaatgaaattgaatcataaaaaaatagttaacacagagagtcagaagatgaaggaaaagagaataaagaacaaatagaaaacaagtagcaaaatggcagatctaaacctagccaaatcaattgtcacattaaacatacatgttttaaacaccagaattaaaactcagacgttttcagattagatttttttaaaaagcaagacccaattatatgttacttacaagaatcacattttaaatataaaaacacaaaaaggttaaaagaataagagtagaaaaagatatactgtgctaacaccaaacaaaagatggagtgaccatgttaatatgagacaaagtagatttcagagcaaagaatatttccaggaattaaaaggtgacttcatagtgataaaggaataaatactacaagaaaaaataaaaaccctaaatatatatgcatctaataggatttcaaactgcatgaggcagaaactaatagaattacaataactgacagacaagcctacaattgtagccggaaagttttagtactccttctcaatacatgacggaacctatagacaaaagatcagaaaagatattagaagacttgaacaacactcatcatacaacttaacctaattgatatttacaggacattccagccaacaacagaatatacatttcaagtgcttatgtagtatttaccaaggtgggtcacattctgggacccaaaacaagtctccataaatttaaaaggattaaagtcatatgaagtttgttctgtgaccacaatggaattaaatcagagaggattaacaaaaagataactaaaaactcccccaaatatttggaagccaaaaaacacgtgtgtaaatcatttgtgcattaaggaataaatcaaaagggaaattttaaagcattaagaattgagtaaaaattaaacatttcaaaatttgcaagatactgctaaaacagagtgaaatttatagcattaaagcctgtgttagaaaagacaaaaaagatctcagattagtgggctcaactaccaccttaggaaactggaaaagaaaaaaagacccaattaaacccaaagtaagcaaaataaaggatataacaatgagaatagagatcagcaaactagaaaatagaataatttaaaaaaactaaccaaaaactagttatttgagaatgtcagtaaaatggttaagcctctagccagactgatcagaaagagaagacacaaattttcagtatcagtaatatgagaggtggcatcagtacagattcaacccatattagaaggaatatttttaaaaactatatatgggctgggtgtggtggctcacgcctgtaatcccagtgctttgtgggggccaaagcaggagaatcacttgacaccaagagttgaagaccagcctgggtatcatagtaagactccatctcttacaaaaaaaaaaaaaaaatagctgaacatggtggcacggcctatagtcctagttactcaggagcctgagacaggaaggtcacatgagccccaggagtttgaggttgcagttagctatgatcacgccactgcactccagccagggcaacaaagtgagacactgtctctttaaaaaataaaaaaaataaaaaggccaggggcggtagctgacgcctgtaatcccaagactttgcgaggccaaggcgggtggatcatgaggtcaagagattgagaccatcctggccaacgtggtgaaacccgtctctactaaaaatacaaaaattagctgggcatggtagcgcacacctgtagtcccagctactcgggaggctgaggcaggagaatcacttgtgaatccaggaggtggagtttgcagtgagccaagattgcaccactgcactccaacctggcaacagagcaagaatctgtctaaaaaaaaaaaaaaaaaaaaaaaaatatatatatatatatatatatatatatacacacacacacacacacacaattttatgccaataaatttgacaatttaaaaaaatgaatttatagttaaagactatcccagctcagaagtcttcacaggtacattctaccaaacatttaaggaagaaataaaaccaattctacaaaaagaaaaaaaaaaaaaagcttttagaaaattaaagaagaagaaatacttcccagctcattttatgagatcatcattaccctgatgctaaaaccaggccagaaaaactatgtaagaaaactacagacaaatctccgtattgaacatagatgaaaaattattaacaaaatgttagcaaattgaatccaacaatgtataagaaggcaaacacagggctgggcacagtggcttacacctgtaatcccaacactttgagagaccaaggtacgaggattgcttgaggccaggaattcaagagcagcctgggcaacatagcaaggcctcatctctacaaaaaaaaataagaaataattagccaggtatggtggtgcacacctgtagtcctagctactcaggaggcagaggcaggagattgcttgagcccaggaattcaaggttgcagtgagccatgagtgccactgaagaaaaagaaagaaagatagaaaaagaggccgggcacagtgactcacacctataatcccagcactttcagaggccaaggcggggggatcacaaagtcaggagatcaagaccatcctggctaacatggtgaaaccctgtctctactaaaaatacaaaaaaaattagcctggcatggtggcgggcacctgtagtcccagctacttgggaggctgaggcaggagaatggcgtgaacccaggaggcagagcttgcagtgagccgagatcgcgccactgcactccagcctgggcgacagagcgagactccatctcaaaaaaaaaaaaaagaaaaagaaaaagaaagggaaaacaaggggaggggaggggagggaaggaaggggaggagagagggagagaaagaaataaaacttcctcagctcaaaaggagcacctatgaagcatctatagctaacgtcatacaaaatggtgaatggttgaatactttcttcctaacatcaggaaagcaaggatatttagtctcatcacctctattcagcattgaactagagcttctagacaatgcagtaaggtaagaaaaagacattaaaattatccaaattggaaaaaaagtaagagatctttattcacagacaacataatcttctatgtagaaaataccgtggaatctaccaagaaaaaacaggctatgagaactaataagcaaggtttccagatacaagatcaaaatacaaaaattatttgtatgtatatactagcagtgaaaaattagaaattgaaattaaaagactgccatttacaatggcatcaaaaatattcatacttaggtataaatctgacaaaagaggtataaaagacctatatactaccataaaacgttgctgagggcccagtgtggtggttcacacctgtaatcccagcactttgggaggccgaggagagaccaagagttcgagaccagtctggccaacctggcaaaacccgtctctactaaaaatacaaaaattgaccaagcacggtggcacatgcctctttaattccagctactccggaggctgaggcaggagaatcacttgaacccaggaggtggaggttgcagtgagccaagatcgcaccactgcactccatctgggtgacagagtgagactgtctccaaaaaaaattttcaattaaaatattgctgagaaaaaaattttcttttttttttttttgaggtggagtcttgctctgtcgcccaggctagagtgcagtggcgcaatctcagctcactgcaacctcttcctgctgggttcacacaatctcctgcctcagcctcccaagtagctgggattacaggcacacgctaccatgcctggctaatttttgcgtttttagtagagatggggtttcagcatgttggccaggctggtctcacactccttacctcaagttatccacctgcctcagcctcccaaagtcttgtgattacaggcgtaagccaccatgcccggctgctgagaaaaattcaagatgatctaaataaagagactgtgttcatgggtcagaagattcattattgttaagatggcagttcttcctaaattcatcagtagattcagtacaatctcagtgaaaattccagcagactattttgtagaaattggcaagctgattataaaatgtatatggaaatgcaaaggatcaaactaactttgaaaaagagcaaatcaagacactatgatagtaacataaaagtagatatagaggctgggtacagtggctcacatctgtaatcccagcactttaggaggctgaggtaggaggatcacttgacgccaggagtttgagactagcctgggcaatatggcgagacctcatcactcatacacacacacacacacacacacacacacacacacacacacacatatttttttttttgagacagagtcttgctgtgtcacccaggctggagtgcagtggtgtgatctcggcccactgcaacctccgccttctgggttcaagcgattctcctgtctccgcctcccaagtagctgggattacaggcacgtaccaccacacccagctaatttttgtatttttagtaaagacgcagtttcgctgtgttggccaggctggtctcgaactcctgacctcgtaacctgcctgcctcagcctcccaaagtgctgggattacaggaatacaaaaaatatttttaaattagccagatacggtgatgcacacctgtagtgccagctactgctgtgagctatggccatgccactgcactccaaagtgataccctgtctccaaaacaaaacaaaacaaaagtagacaaacataaaaatagtaaaagacagagtccataaatagattcataaatgtaaaaacaactgattttcagtaaaagtacaaataagcaaggtttgtctccaaaaaaaacaaaagtagacaaacataaaaatagtaaaagacagagtccataaatagattcatacatgtaaaaacaactgattttcagtaaaaatacaaaggtaattcaggagagaaaagagtatttttaacaatgctgcgggaatgattggatattcctatgcaaaaggaaaaaaagaacctcaatccatacctgttacctacacaaaaattaactcaaaatgggccatagacctaaatgtaagggctaaaaaaataacacttctagcagaaaacaagagaaaatctttatgaccttggtttagttttttagatgtgacaccaagatggttttttggcttcatcaaataaagactttctgttccttgaaagacacttttaagagaatcaaaagacaagctacagactgggaaaaaatttttacaagtcatgtatctgataaaggacttttattcagaatatatgaagaactcttaaaactgaaaaataagaaaacaacccaattaaaaatgggcaaagaatctaaatagacatttcttcaaagaaaatatacagaggtcaaataaacacatggaagattctcaacaacttcaggcattagagaaagcaaattaaacccaaaaagaaatatgatagacctattacaatgtccaaaactagaaagagtgaccataccaaatgttggcaaggatgtgaaggaactggaactcatacactgctggtggaaatgtaaaatgttacagccactttagaaaacagtggcagactctttaaaagttatgcttacacataccatataatacattctactcacaggtatttacccaagagaagtgaaagcatatgtccatccaaagaattgtatgtgaatgttcacagcagctttatttgtaaataaatactggaaacaacccaaatatccactaatagatgaatggataaaaaaaaagttacgctatatttatacaataggatgctaagtaataaaggaacaaacttgatatatgcagcaacatggatgaatggtgaaataattatgctgaatagaagaagccagatataaaagaatatgtagtttatgattccatttatatgaaactctagaaaatgcaagctaatatagaatgtcagaaagctgatcagtcgttgtagcggtggggtacagagaggtacaagggaaaaattattacaagggccttaaggagacttttggtgatgatggatttgtttactatctttattgtgatgatggtttcacagttacatacacaatcaaaacatcaaattgctcactataaatatgtacagtttattgtatgttaaagctgttttaaaaaaataagaaagccaaaaagaaagtaggactcgctactggaattcttactactctagcaaacattacagaaaaactatgtaactatataaattaattacagatactgtattttaaaatacctcagcggggccaggcacagtggctcacgcctgtaatcccagcactttgggaggccgaggcgggtggatcacctgaggtcaggagttcaaaaccagcctggccaagatggtgaaatcccgtctgtactaaaaatacaaaaattagttaggcacggtggcacatgcctgtaatcccagctacttgggaagcggaggcaggagaatcacttgaacccaggaggtggaggttgcagtgagctgagaatcgcaccattgcacttcagcctgggcgacaagaacaaaactccctctcaaaaaaaagaaaaagaaatatttcaatggatattttttaaagcaaagaaccttttgtaaaagtaatcttgactgttgaatgcatcttttttcatgactgctattgtgatatattgtgtttccttaaaggggatgtacatcaattcagctgggataacgacagcacaattccacatctttctaagagctgagcaactattgcattatggcaattgtgctttgccttgaagtggcagagggcagatgcaatagctgactctactgagtcttcagtgtgcagacagtttggttcacttgttaaatatgtattgtgatttgatgtttactctacttggcatctcagccaaatttcaccttaggaacttacatatacttcatcaagacaacattacaaatacttcaaaatgattcatttcctcttcacacaaatctaagttagtccttgcatagaggctatttacatgtgaaatttctttttcagcctactaacaaaatcagaaccaccaagttttaaaataccaatatgttttaaatgttctattaaaagatctggctttgttaccatggggtaaaagaatgcggtaagtaggaagcataaaagtcagctgtggaacttgactttacagatatgtttcctgagctcattgtacagagtaagcacaaatatgctgattggtaattcccctccttcctgccatgctcatggcagtgggacacaggaaccatgatgttctttctcacctcctctctctgatcctacagctgtggtgactcagcctttctttctttctttctttgtttctttctttctttcagggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtacagtaatttggtttgtgtgattgttaatgaatgtttattgacttacagaaaactggctgactaggagctagaagatgtactaggtgccatgtccccactcaggagttgatgtccaagtcacatgttaggtctgtggcatagtcagtttctatttgatacacttaaagtctcagaggcacagaatgtgaatatctttcttgaagggaactgaacctcacctgtggctcagtcacttgtagtttctagttcacttacccttcaggttttgagtggttcagcctaagtttggcacagtcctagatgtgggatctgaatcattgctatgatttctgtctttcagatggtgtaaggatcactagatttcccttgagagtaaaagatcgaaagcattcacagcaccttctttgcttgggggaaaaataaaagcaactagtaattttcaccattaattcagtaagattctaagaagtgtaaacttgcttttctcaccgttgttgaaaacagcccactcaggtttcttaatcacatcagtgaatacggttattttggcactttgggaacactagtagctggacctggtctgtccagagatgacatttaattggatggtttaagttgtaggaccccaaaagatgggcttcacaatggcaaaccattaaatggtcatcctttgaaccatatatacactacctcttggttcatcatcctgacttccgtcattcctatgggactaaggataatactttgtgttcgggcagaatcattccctgtgtaccaccagcgcggtgtgcatctcttgggccaccaccaacagttacacaagctttgtactttgtaactcccaggagtacaactcacatccatagtttttgcaaatagattccctagagttgtgtggtgtttgactaagcagctcttcacagtgatcttaggagaaaccaaagaccccatcacccagatatgatgctgatggttacaaccagtattaaatcacagaagtcacaaaccagacgccttcaggggcctggcaaataatataaatgagtgaagtaggttgtatataggacagtaggaagtgatggggcaagcacctgctccaccaaaaggcatctaaattcaacaaaaaacaagaagccaggtgcagtagagtgcacctgtagccccagctactcaggaggctgacacaggaggatcccttgagcccagcagttcgagacaagcctgggcaacatagcaagaccccatctttaaaaaaataataacttgggaggccgaggcgagcagattatgaggtcaggagtttgaggccagcctgcccaacatggtgaaaccccatctctaccaaaaatacaaaatattagccaggcatggtggtgtgtgcctataatcccagctactcaggaggttgaggcaggagaatggcttgaacctgggaggcggaggttgcagtgagctgagatcacgccattgcactccagcctgggtgacagggcgagaccctgtctcaaaaaaaataataataataattaaaattttaaaacactatttgtgtttgtctatttgatagacaaacaagatatgggtagtggaggtttcttcaaatcccagacccttgttaagcaacatctgctattacccctgctgagcaggaaggcaaccagctgataaaaatgaggactggggccaggtgcagcagctcacacctgtcatcctggtacttcaggaggccaaagcgggaagaccacttgagttcaggagttcaagactgtcttgggcaacatagggagacccccatctctacaaaagatttaaaaattagctagaggtggtggcacacacctgtggtctcagctactcaggaggctgaggagggaggattgcttgagcccaggagatcgaggctgcaagtgagccatgatcacaccagtgcactccagcctgggtgacagagtgagaacgtgtctcaaaaaaataaataaataaataaggactgcataagcactagcgttttcacattcgtatccttgttacatactcaaaatagaatgctccattaccactccacataccactagcaagtaggtagctagagagatcccaacactagaagcaaaaggacagatcagctaaatgacatactggggctgggataaggagtggggactgggtaccaagtaacgggaaggccgaggaatggcagctgcactgtagccaggggatcctgagctggcctttccttaactgcgctgttggggacatacttaactagctgtcctgccatgaggactaggtgagatgataaatacaaaaattctcagcacagcccttatcctctagtaggcatttgacaaacgtaagtctctttttaaaggtggagtcttgctctgttgcccaggttggactggaactcttgagctcaagggatcctcctgccttgaattatttaccaaaaatacaataccaaggcagtaaagtgtaaaggaaactgggatacaaatgtatatgacataaccttaaagtttctttttagatcaaatccctgataattgcttatttccatggcattggaaaaggcattttaaataagaggcacactgtatagacatcgcacaaaaatctatttggccttttaagtgagaatttgctgtgtgttctcatttaagtgagaatttgctgtgtgttgattttctttcttcctccccctgtaaaatgattatcatccctgcatcatctacatcctcgaaaccattgaaacattctggttgctcacgtatctgaaatcttcaggtagaactagatcctttttttcttatgaaacgcaaattcatactttcagtaatccagctctaagtatcttgttgatggaacatgcaagccagccccagtggcattttcttttgaggctctgtcattgtttctgaggcctcctttgaagagccctccccctctgctcagggcacctgcctgtggacccacgtgctgggcattgttttcctgacttgctgtgtgcacactgaaatgtccctgcaggctcaatggtaattgtcacacttagctcagtgagtgatttcataaaatttgaattaagtggtaaataagcagacattctaaatactaccttagaaagtagctttctggaactaatcggcatttggttcataggatataagaaaaaccattagattagctccttggaaatctttaaacctcatcataatcctatcgccaaatttgaatcaacttctggccctgccctcctcttagtcacatttgacccatctacactcccttggcagccaaccgctgtgctcctcaagggggccagcacagccaggcctgagagttcctcctaggagcctgaaacttccgaacacaaactgccactcctccccccaactccccatccaccttaggccaaacccagatctgccgtccagcgactgtccagttgtgcaattccacccccaaatcccaattcctgatgagccacgccattaccagcacattagagccactcacagagcccagcatagtctctaaactgaaagacagacaaaaatagagggaggcctccttctagaaatcaaggaataattgaattatcttgcgtttttaaaaaaaaacaaatggcaatccctaggatttctaggacttgagtgtttgttccccactgaaaaacacacccaggtaattgtgtcagcaaatagtaggagataagccactgtacttagtactttcattacataataaagcagatcattcaattttataatgagtaagtatatgttttgctaagagatgaagagaaagtagttgatgtgctaagcattgcagggccgttcttccactgctcattagtatgacacctccttagctatagtcatggaggccatttcgggctggatgccagccatgacggaagtagcatcacaactatgaagttcagtcttatggcgtgtcaagttcagaggacagggaggggatgtgcttccttagaagatgctcagcccacagtgggtttgcacatcaacactattcttacgtggctgcctggctccttgacagaatgctaggggaaaagtggctgttaaaaggttactgccaaggtctcaccacctttctctggcttgcttcctgtgtccttgtaccctctagagaaggggacgggttcatgcagggaacagctacaggctgggggtgagtatggcccctgcaggtagaccttatgttttcctcggtataaatagatttcaggtttgtgctcgcttgtgctcactatcttttgctttctctctctcactcaacattttggggcaaatctcacttttcagtgctatacaggaaagaaagctgacccagaaggattctaaagaaaaggcatttgttgttaagtcttaaccacaggctgcaataaagaacattcctgcagcagtactgccaagcacagatgccaacaaggaaattatggaatcttcttgtctggaagtttttagaggatatgaaagctgttaatgtctctgggatggtttaggttcagtcttaaggaagcaataagacagtcatgattatctttgggcaaccctttcagtatgtaatagtacagaaagtagttaacgccacagcacagggtgacaacagcattctgagcctgagggtgaggacaagggaaggtggagttttggtgggaaacaggggtgaagtctttgggaagtggcatgaccaggatgagaagggcaaaacactcacttagcccagagcacagagcctgccctttggcctcaccccattcacctaaacaaaactctgaagaagacaccaccactctttacctgaaaaagagtaatgggcagatttttttaaactaggatcatcagccttgaggggctgggaaaaccacactctgcaccttggtatcactgcatgtgaggtcttcagcaaactagtcttcctctctgggcttctgtttcctcactcatttatttattcattcaacaaatatttgtcaagaccctgctatgtaaccaggagacatcattctaggtgctaggcgaacctagctcacattccagtggggaggaggaggaaaaagaggaaattaatcagtgttaaatatactttgttagatgccattgaggaaaataaaacagagaagggagttaggatacaagtattacaattttaagaagagtgatcaagaaaagcctgttcaagggggtgacttttgaagagagacctggagcaggtgagggagctggctgtgctgatgtctagggaaagggtgagccagacaggaggaatcacaaggaggctgtggtgggcagggcgtgtttgccacccaggagcagagtgagccaaggcagggtggggagaggtgagtcagagaggtgatggtccagactgtgcacctcactgagcgattggtctttttttggaacgagctggccactggagagtttcacaggtcattttgagtgccacgtgaaaataaattgaaagagggccagggcagaagcagggaaaagacacaagaggctaagacagcaacccaggtgtgacctgatggcctacaccagggtgatagcagtgacatggtggttggtgtcagattctggtgatattttgaaggtagagctcatgggaatttcttatatgttggatacaaggtgggagagaaagagaggagtcacagataacatccaggcttagggcctcaactattggaagaatggagttggcattaactgagatgggtgaagcgaagactgagaggagtaggattggggactcgggtagaattgggagttttgtttatttttttgtttaatttttgagacagagtctcactgtgttgctcaggctggagtccagtgacacaatctcagctcgctgccacctccacctcccaggttcaagcaattctcctgcctcagcctcccaagtagctgggattacaggtgtgcaccaccacgcctggctaatttttgtattttcagtagagacgggattttgccatgctggccaggctggtctcgaactcctgacctcaagtgatccacttgcttcggcctcccaaagtgctgggattaaggcgtgagccaccatgcccggccttctattttgtatatattaagtttgagatgcctgttgacatctaagtaaagatgtctagtatgcagttggacttacatggccagaactcatgggagaagtctatcctagagataaaaattgtaataccagaatattgggaatactaaaagcaacaggactacatacgatcaccaaggaagtgagtggagatagaaaggaaaagaagtcccaggattgagccttggagctttctcgaattaacaggtcagggagatgaagaggagccggcaaggtagaccaagaaggagcaagcctgaggtgggaggaaaagcaacaaagcatagtgcgtggtaagccaggtgaagaaagcatttcgaggaggagagagccatcaactaggtcaaatgatgctgactgtaagctaagatgaaggccaaaaactgaccatccggcaatttggaggccatttgtgatttcgttgagcacttttgggggagcagtagaaacaaaaaccaatttgattgtgttctagagagaataaggctttttgagtgaaagggaacagagaagtagatcagtagctggagggaaacggtgtcaaaagaggtttcatttggttttttattttaagtaggaagaaatcccaacatgtttgtactctgtggtgaagattaccattgctcacccacacccagttttcctctttcctagacacacaggaagactaaatttgtaatcaggtaggccatatgactagatctagctgatgaaatgtgaggtgaggactctgctccaaggcagtcaaaagtaggtataagctctttatgctttgtcccatccacttagctggtgtcaaaggactctagagtgatgaagctgtagcctaggtccctgagtcactgttggaagagagccagcaaaatccatctgactcaaatcagactctgacatgatgagaaataaacttttaagttaattaagcactcaagatttggtgtttctggatgtgaaggcaatctggctgcaacatctgtcaccccaacatcgccaggttgattgggctgatctggctggctcagtgggtgtcgtttccctccctcactgctccacgtgtgtccctcctgaagctgcaggcttggttgaagaggacgaccttccctgatagaggaggaccgttcttcattcacaagtatatacatagctgtgctgcctgctagaagctccaaacaatctctcaagatgtggtgttttatctgttagcacagcaaagcctaacctgtcctaatacctgggctgaagggaaagttccaaaagagagagaaaacttgatgatacaggagacagaagttcaattgccttcagtatgcaacagaggatgggatctactaaccaaatggccagactcaataagtcacatcctaatctgaaaatgatggattggggctggatgatctctgagatcctagcctatgtcacacaggtttacagtccttgaacttggctagcttcctgttggaggaagagagaaaaaatcctgttggtcaggaagagtggagggatgtttggattgagaggtagggaaaagccataaagatgggaggcaaactggccaggaagggagagaaccacaggactccagaagaggcacaagctcagttctcccacttttatgacttttccctgacttttcagaaagggccttccttacaggcattcacaggagatgacagctaaagagcggaaagagacttctgggctatctgatcacctagaacataggcggatcatggctctttaaccatgtcagaaggtgttaagattttgagaaaattagttcacatttaatgacctcaatttcaatatgagtgtacaaggagtaacaatgctagttaccagtttgacttgcagggccgctgttcagataaatgaaatgtgatgtgttaaacttcttggaaggatggtgctatagaaacagtaggtgttattattcccctaaaaggaaagaacagtcttctctgatgaaatggctgttacctcagaatcctcattaaaagctgtggtgcaattttccaagttgcgttagtaagacttggcagcagatgaaaaaaaagcaaataaataagaagtcaaaatatttcaggtaactacttgctggcaaatgagaagttttcaagtcctagaatcatactgataattttgaaatgcctaaaggcagaacttatttatagtaacgcagaggtgactgctagccctgaaatgtggtcctcagtctcggatggagttgcggtaaggcagcgccacagaaaggggagctaatactattgtgactccagccctggaggctgtggtgctgatacagagggagggaaatctagtgtgaaaatagccacagcaatagctaattttaaaactgagacacataagctgtttccaaacctcttacattttttaaatcctgaggccagtaagcctatttaaagaaacttatgcagaaatgtgttcctcttttggcatagtagtaggagttgagtagacaaaaacctaagacatatctaaaaatcattttaagtgacctgatttcaaagccgtttttaagatttcttttcactatgtctatttatccctatctgatgtaggatgaccacaataatcaacattttgaaatagatttatgacaaggcctctgaaagtaaacttgtttgcatcaatttttttaaaatagttaccggcgtatctattcatttttaaactcctctgtatatgaacaaaatatccttcatgtttctttctttctcccattatggagtctcttagctatttcaattaaaattaataatagctttaaagacaaagttcagagctataaagttcctcacttgatcagtcatcataactattattttgtcgtagttaatcatagaacccgggcctttaccaaggtacttaattaaactttttaatttatgataagaatttaaatagcacttgtgagagtttttcaaaattatttctacttcccatccagattacaccctacacccttggaaaaaaaaaaaaaaaggtgtgacaaagagacatcatggctgtcagccaagggtattgtaggtcacgccagcacgaactggcagcaagccattgtccaattagcatggcttcatccttgcagagtaatcactctttgagtagatggttgagtcactcacgatgcagtggtgcttcacttgagccagtccttcttagaataggtttcctgttcgctgttaatacctgtcctcatttgccaatacaagtgcaggatcatttaggttgaaagctgaatagaaggcaaacattgattatgtatctcatttctcttgcttcctgaaaactgagattgcagttaaacagtgaaagcacggtgtgttttttaagtgagttacaagaaaacacagtttccacaccaaaatactcagagttagaatccaagagtcagtttttgttctgtcttttctttggcagctttaacatttggcacaaatctgaggatatcaataaagttacctaataatcttaatggattcgcattccattcaaaaatttggaatgtcacccaatgtcttcaggtttcaactccattgttggggtgttcatgacatttctggtgggtgtgcagttataaaagcagacagcttttgaaagaggcccttcttatggtgagaacacctggaatcttggttggataagctgtaagccaggaaattgattcaggaattttttaataaaatggatcatacccaggcattggagtgatgcatggtggtcagttaaaaaaaaaaagggaaaaaagaaagaaagctgtccttaaaagcacaaagaaaatagaataaaattgtgggcactaatcagttaatacttttattttcttgtttgtttgggttctgaaccaaattgcaggctagaaaagaattggcttgttttgctttgaggagtggagaagcaattaaataataacacttttggtttcctaggatctcggaagtgttcttttttgccattaatttggtacacatagtaaaattcatcactttgccatagactcctaaaatatgttgacagtctctgtaactgacattggcatcacctccaagccagctagtaatgcggtgagctttgctgagatggactttcgtgtgcagcctggcgaaggctgtttgtgaaaaagttaatgcattccacaccctgggtgggatggagccaggcctccaacgtgagcacatttttgactgactggcagcaaagagaaatactggcagctgttcccaagcaaggccaaaagttggccaagggaggaaaaaaaaaatgctgggatttagccaatgaaagattcctgggcttagaagaaaaccaaaggaaggatacagaaggtcacaattacaggcctccagcttgttgaagaaatacctatttcattttatcttctgttttataaaggacagctattaaatgtcattgttactcattttttcctgattatttttaagccatcattttctattgatttctttaatttttgtattctttatatgcaaaaccaaatgacagcttattcttcccaaaagtgttacatagatgacatcattcctggaggtggcattaacaaccagaactgggtagggcagggcagtctatgagcagtggccacacccttgggtttatcaagccaggttgagtggcaccagtcaaatggaaggtttatatgggtcactttgaagatctatccagagaaacccttctgatgcctccctgcttatctgtttttcttgttttgtatgatagttaagaaaagagaagtgtaaggaaaacaggaagttactaaaaaggccaggagaatggctgttaacagacaggaccctcaagcgtcttgctctataaagatgaacactctactaccatgagaggcgttctgatgtgtgcactgtttgtttcccactgaatgccttagtctatgtgggagtattctttgtgtttcttatatctgccaagtggatctgtagtagcacaggaattgaattgtaccctacaaataggaaggtggaaagattaaaaatgtggaacacccagattcagggtaagaacttcatagtttgggaaatcagggaagataactgaagttactaagggaagataattgaagcacagttttcgtaactggagattcttttggatgagttaaatgcattcaatttacaaggtgttcatgtagagaagtgcagtaacctttcaaagttctgtttaacaaagtctttccattcctcctatttaaggctgctttagtagatgttgaccagatgtctcattcactgacaagaagaaatagcatcccaactatacaggagggatttcagctatattaaaggaggattttgtaacagtataagatgctagacatgggagagaggcaccaaaaaatacagaattacgttcagaggagcatgcatgtgtgtgtgtgtgtgtgtgtgtgcccgtgtgcatgtgcttaaaccagatgcttaataagacaaaatccttaagtacaacacttcatagaagcagaggaatggaccacaagaccccagaggtcatttctttgggggattaacttagaaatgtaaagcaagattacctccttcaaagaacccacaatacagttgaagaatcaaaagaaaaacatagaaatcaaaggtgagtgattcaagagtattcattgtagatggcagggtactggcagttgtttgtgctgcagaggttcaggtggagggaaggacaggatttttcttccatctctttcatgaagtttatctcacctaaaatcaacacccacaggatggacaggacttcactagggagcaagtggggagagacccttcaggagaggacactggtgtggcaaagacccaaaaagaggcacttgcaggactttgaggaggcatcttttatcagcacaaatgagagatttggggaaataagtcaaaatatggtctcactacatggggccttactatggaagaataaaatttagacaaaagaatttagacttgaccaggtaagcaataggaattcatgaaacattgtgaaccaagaagtgacataataaaaaacagtttaaggaatatctgtctagcaatggaatgcatgttggatggcaacaacaacccaccacagacagagagcacagtcaggagacacagcctgagcctagcataggtgaggaaggtctacacctgggtaaagaactgggagaatgagggggcctttcagagataccaagaaattgggtagggagcacatggatggtgaaagaggccatcaagatggccttgatacgtatccgtagtgctttacatgtgcctaaggcactgagatcacagagccaaaggtatagacagataggaggaacaccagcataggcaatgactggaaacactagaaatcgctgacccctttgagaaacaggaaaaaaaaggggcaggggctgagattgagctccaacatttaggctccatggctggttcctccactaagaacaaggtttactccgaattgctggtgttaagtttatcttcatttatttggaacatatttaagccccaacagtttatcagactgaggaatacatatagagttgctccctaaattaccttttaaggggtatgcctcccaagtgatatcgcgagcatcaactcttacttagcataggtgagtgcaagatcctgcaaggggatgctaaatttctaaaggacaaagcacttgttctcaaagctgtttgtaatctagtgccacgtattgttttaaatgccatgaacaaattcaggtacaggtgatcactcggggtcaaagccattaaggtgaatgtttgatggacactattattataccaaaacaacacatgcggaaacaaagtaacatcacacacactcttttcttgtcacaagcgataagtcagaactgtgcattaaaggatcagactgtcttcacagtaacccgggcaggggtcaatctgagcctggagtgtcagccaggtgttaggtatcttctgatccaaatattcatgaaatacaatacccttcgctgacagccatgatgtctctttgtcacacatccccactggcgtagtcggtatgatttgaccttataaagctttgagatataacttccagtgagaggaaaataaaggattagaggaacaagcttaccaacaccatgaggaagcaaagggacaaatctggggtcgggggatggtggtggggtgggagggtgagggtaattctacaggacaacttcttgcaggcctgatttcttcaataagtcagtgacataaaaatggactgcgctaagttaaacaagatttaagagctttaaaaaccagatgtagttcatggtcctggagtggttactggtttacacaaaccagttataaaggactctggagtgggggaaattggagaaactcaaatatgacccaagtagttgatgaaaggtgatgatcagaaaaagtggttggaggaacgatatgcccagtatgatctcactgtggttaaaaatacaaatgtgagtgcaagtggtgtgtacatacgaagagccatgagaacgtgtgcaaagtaaaaatatcaacagggtgacctgtgaatggtagaaatgtaatggagttctttttctttgtgtgcattttctaatttcttacagtgtacattattacatttctataatgaagaaagggttatttgaatgggtaggtggatgaaagggaaggaagatcaggaaaaggatggggcatagtactggaacaatgaaactctgtagtatggctttgcttgtgatttcaaaggttctgcatgccccatgggatttctctctaaagccaccagtgggacctaaggggaccaatgcttcctggtcccttccgtccaactcggggctcttcattcttctaagaaccaaagtcctaaactttggctgaatgggctttcactcacagtctcattggttaaatgaaaatccaaaaagcaacaaaggaactcaattagatttcttccatttccttctaatttaaagttagaagaccttttcccatatttaaatttgccccgaccattgaaacctacagatgcctttgcattcctgtatgttttctggagttacatctctggaaatgactagtgtcattttcagtggaaataactcgtatgtttttccaactgtctgactctatgtcagacactgtatctgacagacaaggaaattcttaccttctgatcaaatcttgtatgactgtgaaggaagcagggagtgtgaggaaaggtgtctctcctttcccattcccttggtatacacatactgaagtactgaagttgaagaaaacaagactgctttcgtggttattttcaaacaaatataaatgtctgtaagcgtgtgctttggtaagtcactcaataagcataatgtacactttaggctctggttgagtatggaatatctccaagtagctgcttcttcaaggatatatcacaatgttcagtaataagggcatgttttcatattaatcagatgaatgatgacattttaaaaactaatagtaaaagaggccatttccatcctcaactgggttttataaaaaagaagacatttaccttctgagccagtttattcaagtatgaaatatagaaaaaaaattcaaaaaaaaaaaaacataaagtcaccctagatcctggaagtcctgggccctggtgtccttggagttcatgccaccttcctccctatccacatgtcacttgaattggagtctgggaaccatttactgtggaccctgtggtaatgaggtggtttcccttcatcatgcctaagatgtagaagaagacaacttaattggtgtgtgactgagacttcagaagagtgagtcagaatagaaggtgatgctataatggatctgcacctgtaaggctcacgctaatgtttaaaatgacttcacgcaaactactcggtggtccatggattgccagggttttccttgcttccttctcaggagcctccagaaatatcttttatctttttttcacttttttatcactttttttaaatcacagtttatcagactgaggatacatatagagttgctccctaaattaccttttaaggggtatgcctctcaagtgatatcttgggagacaagtttttaagttttattaagttaagtgattttctcttaactcaatccttagcttgttttcatgtgaatctacagcatttagctcttctaatacatgtatattattagttcactcaggctgccatagcaaaataccacaggctgggtggcttaaacaacagaaattcattttctcttagttctagaggccagaagtccaagatcaaggtgccaccagggttggtttctgttagaggcctctctttgggcttacagacagccgcctccttgtgtcctcacatagcctttcctctgtgcgtgtgtggacagtgctctggtgtctctccttcttataaggacatcacttctatccaattagggccccacccttgtgacctcatttaaccttaattacctttgtaaaggccctgcctccaaatagaatcatactggggattagggcttcaatatgtgttaaagagtaaactttataacaacctactaaaaaactctatagcaacctatgaaaaaatagtagattcgtgcagatacaaaacaacatgtgcacaaagttatccacatacagccacacaatcaatcatgtactgtgtagccataagaaagaagaaagttctctgtgaaccgatgtggagtaatttctttgtttttttttgtttgtttgtttgattgtttttctttttgtgtgacagagttttgctcttgttgcccaggctggagtgcagtggcacgatctcagctcaccacaacctccacctcccgggttcaggtgatattcttctgcctcagcctcccaagtagctgggattacaggcatgtgccaccacgcccagctaattttgtacttttaatagagatggggtttttccatgctggtcaggctggtctcaaactcctgacctcaggggatccacccgccttggcctcccaaagtgctgggattataggcatgagccacatcgcctggccccaatatgagtaatttctgagatatatttttaagcagaaaaacaagttgcagagggatatgtacactatatatggtatgcttccttttgtgcaaagaagggaaaataatacataattgtaacacataaatatatatgtgtgatttataaatatatactcatgcatacatttgcatactttgtaaaaagaaacagaaaggataaacaggaaactagtggaaaagattacctatagaaagtaggtggcaacagagtgaaaggtttgggataggagtgagactctgtatctttttgttcagtattgacttttgaaccaattaaatgttttaagtagtcaagaaattaaaatctaatcaacaaagatgaaaatcagcagacttaaaaatttaaaacaaacaaaaatgaactcaccgtatattaaaataataaactaaagaacaaatagattagattaacttttaaacataatgctatgactagacatcctctgtggaacattctttaagacaactggcctgaacttttcaaaaatatcactgtcatgaaagacaaaatgatggggggattgccctagattaaaagagactaatgagaccaaatgtaatgagtgatccttgattggctcccagattgaaaaaaaaaaaatctataaaggacatccttggagcactttggagaatctgaatgtagactatatattaatttataatattgtatcaacattactttttttaggtggaaaaatggtattttggttatgtagaatgttctcgttctcaggagatatatgcagaagtatttagtggttaaatgtcatggtgtctgcaatttacttccaaatggttctgggaaaacatatgcatgtgtgtgtgtgtgtgtgcatgcgcgtgcacgcttacgtgaacaggactgtatagatatacattgagagaagagagcacacaaatttagcaaatgtaatgatttaacgcagtctagttcctcccgacattccagattcacccccagctgaatccagactaaaagtaggtggatatatgattcttccatcttttctgtggattagaattttcaagatcaggaaagttggggaaaataaataatggattttgattggttttgtcatgaaggttctccattcattgaagaagtatttactgagtacctgctctgtgttaagccgttttaagtgctagggttatagcaatggataagacagagtaagttggagttcttatgggcctacaagtattgtggagggcaaataagaaaacaagacagtttaaattattgtaagtcctagaagcaaagtaaagcagagtgatgtgatagacagtaatttagggaagtgcaacgttagatgggatggccaaggaaggcttccctaaggagaagaactttgtgttgagacctgaatgaccagaagaagctgttcattcatttaacagatttgcattgagcatctactgtgtgcactgttgcgggtactagggatacaaaacaggcaaaactctgagctttcacagagcctatatcccaattagggatgacagacagtaagcaggaatacctaagttagtgatcagcaacttaagagaaaataaatctaggaggaggggagtagttagggaggacaggagttggaattttgaatacagtagttaggacagggctcagtgagaaggtgacatacgaacatggaccagaggttggaggggtcggtgggggtgggtattgggaggagagagaccagccaaggtagatgggttgccttcacaattttagtttttcttgcaaactgattagaaatgggatgtgaaataaagaaaaaaaaaagccagtatgactatggattttggcctgaagaagcagaaaagtgtctgggagaggagacacagggttgggtaggtggatggcaagatgagtaggtgaccagcagccatgaagaaagagtctagtggatgaaaaaggcaaaagcttaaagttctgttgagaatttcgcagcagacttgtgcaaggataattaggagtttgccttacaaaaactctttcaatagaattttttcatttacaaattaacctattggtaagttgagctcaatcagctccaatgaaaatgttaactcccagtttgcaccgactcctgtctctaagggtatagctccccacatggagctgctgtaggaggcctcccttgttcttggtgctggatggaagttttggtgggaaagggagaatatgtggtgaagatgtggccctattcacagtgacatatgaggtggcattgtgggagtggccccgcaaggttgagctggagtgtaacagtggttcccagacattttttgccagtgatccctctgacatgtgactaaatttcacagactgtctttcagttttgaagccaaatttctcttccttctatgccccacgcatgagtccatgagggacacacattctaagcatatttcgttcctcaagagcaggctctggcagctttgagactattcattcgcattccattgcctcttctgctctccctccaagattcctacagagactgctcttaaaataatgcagccttatttattcagattcctcctcccccaggaagatgctgagagcatttcatgagaattcttcaagaattgctgaggttctatggacttcagagaatgtatttgacatggggacaacttgggcccttagtagatgcttcttgatggaggtgatgagccttgagcccacctgccaggaggaccttctcctgcaactataatgcatgctgccaacatgctccacccccggaggatatcccaggatactccctttctggccaccacctaagcagaagggaggtggatttgccctctctctctcgctctgtatgccctcccttcccacctccctgggtttattttcaaagctatattgaagaaataagcccaccgcataaaaaagttactaaatgattccatttatgtgacatacctaaagtactcaaattcatagaaacagaaagtcaagtggtggttaccgggggtgtgaggaggtggaaaaggagagttgttgtttaatgggtatagattttcagatttccaagatgaaaaggttctggagatttgttttacaatagtgtgaatatatttaacactaccaaactgtgtacatttctaggtcacatgaaatatttgtgaaaagagtatgattgtcttagcatacagggccttctttcttgctccatcttggagaactggagggacatgctctgtgccagcacagccatctgtgatcaggggccatgagaggtcaagagaaggtccttccactgctcaatgcacagcatgacaccttggttcgattgttcacctcaaatttgtgtctagagttcgacctagatttggtaattaaatcaaggttgcagacctgagggaactacccaaaaaattttaacccagagtcaggtgctaaccattgtcacagaaaacagatggctaaacaggagctctagacaggggacctccaggagttaggcagtcccatcattgcatgaacttcttttttgcctttgcctccagttgctcataagaaacgattttctttcctaatttttgcccagtcttgataaataatagatatgtattggatatcgaccatgagtaaatgccagtacttgcagccatcttttagagtatgttcttcaccctcctctccttatttcattgtcttgcgtcctccaactcttctacttgtagtcagatcttctgctttcttttccatttgttagcaaagattctgagattacccggttctgtcctaaaacctgtctaaggagctattaaggaggaaaggctttgagctattttctcctgccattttagggtgtatagaatggcagggtgtgtacaatatttataacttttttgatggctcagttattatgtcaagcccaagaaaatacaagatggggcaggctgctgtccattcaaacaaaactgtgggtctgtgtgactgactacccttgctcacctgataggcctaagtagaaaaagcttatttttcagtgagggaaactcatgcctggaaaaatgctgtataaatgtgatgaaattcagactgctgtggtcaacatttatttaatttcaagcttctgcaacagtacagatggatttgtgttgaataggaatgatggtctttgaaaacttacataagaaattattgacttgatttttttaaaatactgccttctatttcatcctatcaatgctccctgtgtttcctgcaaattgttcatgatctcagcaaactggttggactaggccagcattccaaactgaagtagatcgaagtaggtgtcattcatagacttataggagacttggagaagttcaagagagctctctttgttttgctagtggtatccagagtaaatgaaaatactatcaaccttgtctttcttcctggtcaactttatgctgagggaatactaagaaccataacacgtgttgggctgttgtgctataaggggagaagcatcaaggattggaggttaaaaaataaggcatgttagagtccaggccccatccaatttggaattttttttttataataatggcataggtacctcttcagcctctgcttgaacacatgcaacaatggggagctcaccaccactgaagagagctccttcctccattttatacaaccgtgactactagcaagttcttccttatttgtggcagaaatctatcttccttaaaatttcactcatgatcccgtttacaccctctggcatgaaagagaacaaatctaatctcatctttacatggtagcctgttagctctctgaaggcaactcttatagggtgcccatgagtctgcctttctcagtgtttaatgtacttctgccattccacatgccacctggggcatggactcagtgatcagtgtgatccctcacacacagccaggactaagttcgacagcctccatctgatttgagtggtaaagagcagagcagaggcgtgactcgctttctgcatcacacatctttcagtgtagttcaggatcatcagggtaagtttcctgtcacctgtgtcaccatactgacccaactccttaagccaggactctcccatcctcttcttacaaagttgatttttttaatcctgatacaggatttgacatctatttttgttaaatctttctgcatttaacacataatatcagcctgggtcatcatttgggatcctgattctatctcctggagtagctcaccagttgccactcacatcttttctaagacagagagacaagttaagtgtgacagagtaggcgacggaaggctgggtcacatcaccagacacttctctttgagctgcagttaacattgatccatcaagcagctactcattgctcaattttactgtctccagacctcattttttcgtatcattcaaagagtgacctaaagatgtcagctgacatactgaaatcctgggatgctatttctgctgcattctctgagctgtaatcccatcaaaaccagaaatgaagttattttggcatgacttgttcctaatgaagcttgaatcatctgccactttcctgtctaggttctgagtgggtgatggtttgtttgccaagctcagaaagatcaagtatacaattcagatggaggtggtgttgaaagactttgttttactcaccaagagcatcagaacattcagagagcgggtggaaaggttttttaagtgccacctaaacattcaaatttagtgacagggaaaatgtcagagaaaagaatgctccattatgtgtattcattataaaaattaaaagaaaactttaaaaaaatcattcactacaattcttgggagaatggctgaaaagattgggatattattaaaaaccagaaatggaagctggatattagggaaaaaacaaaaactttgaatccctgaagcccacagtgctgcaaatctctattacagagaaagcaagttgaacaaaaacgcagtaggaggcagcctctttcaggcaaggccagcgatccagggccagcgtccctaggagaaatatgcccacaaggattctggacaatggaatgagcttgtaaaccccacaggaaaaaaaaaaaaaaaactcagactttaacacacataccgaaaaaagccatccttacagagctcccccatccatggcccaggcactaacagcccatcccctccacaggcagggggctgagttcagttcgccgccgccactatcagtctccccagctttgtctttccattctctggtctctgcctttctcagatgcaaggcttaagaaagccttacaagtccggctataacagggccagggagcacgtgggcagcagcccacacccgcatccctccagccccacactgtcttcccacagctgtactttggtttctcaagcttctttccagcatcagaaatgactgagtcctgaaaaatgccactgtggagtgattgttggctcccttcctcctagccctggtgtctgcctgctcgtccacaaccattggcagctgttggaaggggctttcagttgccttgcttctcactgaactgctttaacaccagtttcctaagagctcagctacacagaaaaggtgagagaaaaatggcagaagagttacagaaatcccctttgtttgagtattccgattttccccccattttgcagggaaacagcctctgacaaaagctgcagagcccctgcccagctgaggccctctggagctaaccagttcagatgatctcatgtgtctgccccaggggcagccctgtgtcactctcagggacatgacccaggagtgccggatggacggatgtctgtgcattgttaatgtgagaatcttagtgtcccgcccccactggactgctgccacctccccacagcatctggagttgtgaactagacagagaggagatggcctgtcaccacagaggctggaagctgccgccagggccccctgaggccacccacaaaacccagactcccaccagccccgccagcagatgagaatcccaggtggccacctcagttgtttacttccctgcaaaggattgagaaccacagtagatgcttggaaacttctgtgctctcctaaacattaatccgttaattctcactagccccaggaaagatagcagtgctgccactgctgttgttgactgatgattaatgcttcgtgtctccaacactttgctacctgttagtacttcacccctgcaagcacccaccgcccaccacacggaagtaactcacagtcctatccctggaaaataggaaaggcacggccaaatgtctcctgcccgaggactcagccaggataattgtttgggttcccagtgtttcccagaataggaatatgtacagcataacctaaaagtgaaatgacttcaggtggtatatggagaatttttttcaaaataattgtgtttatcttaatatgtattgcagaaagtatgattcgtgtgttaaacttgagattttgcagatattgcttaggacaagtttctttttaaactatatttaaagaagaaaatgagttgcaattagagaaaatattacaattctaacagtgggtcctaagtacctgtagtttgggaaacaaaccataattcagtactttttcagtccaccagccctgtctgttttgtataatctctactcaaagaaaaccacagtggcatcttgtcaggagcacctattatcctaaattgtgtatagaatataggaataggcttttagggttcagtacctgtagatgaacacacttgtgtctgcttctttcactcacctattcttggttatctgatatattttttccaaaatatcctagctcttctgcttggattccctaagcatctgtccagcctcctcacctatttctgtagccctctttatggtgagggtagagaatgacattctagcttactagtgctttgtgtggcattacttgtttaggactaatttagataatttacaataatcctctcgtttctctgtgaccatatcttccctccttttctcttttcttgtgtttcagttcaatgaagttatttaaaaggtctgtctgtttgacttttgtggacatcttgtaattgtagatattctcctacagaatggatgtggagggcagtgggcttgatattaataaccccgctttctgttactaaattgtagtttatggagaggacatggtgggagagaggacaggtccattgagcctgatttaaacgagccttgaatgccatgcttgaagggcttaggttttattctgcaagaagcaaagagataaagtcactgtcatcaggaaggtcagtcaggcacctatacaaaggaaggatcggggaagaaagagacaacagccaggttgttgcaacggactaagcaaggagtaataagaccatgaaataagcatgtgtgttatcccctataactgtataaccattctaacaaagtggctctaacacattttcttttccccactcctgctagaatatgttttccattttgattactcttacatgtttcaataccgctaagtagccttttctgtgatgatggaaatgttcttctgcactggccaatatggtagccagtagccacgtgtgtgactaaggaactgacttttttattttatttatttattttttggacggagtttcactcttgtcacccaggctggagtgcaatggcgtgatctcggctcaccgcaacctctgcctcctgggttcaagtgattctcctgcctcagcctcccgagtagctgggactacagatgcctgccaccacacccggctaatttttgtatttttagtagagacagcgtttcaccacattggccaggctggtctcgaactcctgacctcaggtgatctgcctgcctctgcctcccagagtgctgtaattacaggcatgagccaccacgcctggctattttacttaattttaattagacaacatgtgacaaccctattggacagtgcaggactggagtacaagttccaagtgtcatgcctgccttttcacagagctgagcacatagtaggtactcaataaatatgatggaatgaataaatacaaagaagcactataaaacagaagcaaggatgatgtcctattcaaatccatatactcctttcaggagaattttggcacctgcttaaagaaggaggcagaggatggggatttcctataaacatttaggatattcccagattttaaactgaagctctcagcacctgcaggtggggtcaaatcaaggcaaagggaaccaatgaaactgggtgatgggcaaggccagggtctgtcctgtggtccctgccttcttggtctctgtttctgggtcttccaatgcctatgcttttttgaaacatgttaagggtaatcatcaaaatgaaaaacattctgcaggaatggggaaaagaaaacatttgttagaatggctgaagagatatgggggagattgtgcgtaatttggaatgaggggctcagaacccaagacccggccctgcttgccatggctctgtaaccttgattaagttacttatactctccaaaacaccgttgcctagaaaatgagaataagaatcataatacctcatttaccgagttgttgggaggaacaaataataggaaaatcgtgttttataatccataaagtattgttcagatatttattatggtacacacaagctggagtgatatccgaacgtactcctaaaaagcacagctatattaaaatataattcttatatgtgcctttcagaaaaagaaaaataacttatcaaattctatctgcatccaaaacagaacctaaacaatccaaatcagacttttatctcttttaatattaaaaaccctctgagaaagctgatgccacagcctttttctagtaccttgttatgattcagtatgcgtgctgccaggatgttccttgtgtctttccatcccatctctgcccttttagatgcagtagtgacctctctaccccacccccacgtgcccaagaccacctcccacttgccactgtagcctcttcactctcttctctcatcttccctgctctatattttaccacctgcctcaggcccactgttttagactcttttctctatgagctgacctccctgaacttacaaattctcctgcagcacttgtcacctttccttaagaaatatctttttggccaggcacagtggctcacacctgtaatcccaacactttgggaggctgaggtgggaggattgcttgagcctgtgaggtaaaggctgcagtgagcagtggtctccccactacactccagcctgggcgacagaataagaccttgtctccaaaaaaaaaagaaagaaatctctagcaacctgcatctcacagacccatcacttcccctcctgccctacccccatatccctttcttcagtctctgtaattatagcacagagttggttatcaggagctccgtataactctgtcaaataatatattgcattgatttaggtgtatcaaatcacacgcttcctctaggtaactccttacaagaaaggctcaaagctttgcctgtgtgtcaacttctcatgctgttccccagacccaggatttttaaagagaatccacttgaaaataatgttaccactagaattattttctcgctaataattccatttctccaagactttcttaactttgacctcttttctgatctttttatttttttctcagttttaatatgcttaaataaggagccataaactgtagacaaatagatgcttgtcaattcagggaacatgaatatcgattggcagtttttgtcattatattccccaatactttctctcactgagaatgtgttctctctttaactctgtttaaaacaggaatcggccaggcgcggtggctcactcctgtaatcccagcactttgggaggccgaggcgggcaaatcacgaggtcaggagatcgataccatcctggctaacacggtgaaaccctgtctatagtaaaaatacaaaaagaaaaaaaaaattagccaggcatggtggcgggcacctgtagtcccggctactggggaggctgagacaggagaatgacctgaacccaggaagcggagcttgcagtgagccgagatcacgccactgcactccagcctgggcgacagagcgagactgtttgtctaaaaaaaaaaaaaaagcgaatcacgatgaaccctattagtttttatcatctttaagctaaaacaactattgtctatcttgcatttgggttatattttttttcttcccaaaataccaatatctaattaagcctaatcagaatttagaccatttgtcatctttaaactttaattcaaacgtctctttgtggttaatacacaaggaagaagaacattctaaccccattcactggttaaaaaaaaaaaaactgaaaattaacaccatacacagtcaatagtatgacacctgattgtgatgagaacaaaaggttaaaatggtaaatatgctaaaactacacaagataaacagaaagaaaccaatacatttcagaatcctatgatattaagaaataagaagtgtatggacttcagaaaagactcaacaccttccagtggaggccagcagggttctgcagatccactgttaggttattaatagacccaaagtcttctcaggtgaatgtcctcagggccaaaaaacagtaaagaaaaaccacacctagcccttctcctccctctagatggtggccactgaggcactgtaccaggtcataacattagcccttgtggtctagctatgtccctggaccagccactgtgggcagcctcacttgatgattgtcatcataatggcaataatcataacaatagattaacctagggcacttacttataatgcacttttctgtacagagcagcacatggccaaacagagccccatgctcatgtgtgtgtccaggtgtgcttttcagttttcattttaccaaggatgatgtgaaatgaggatcgtcccctaaaacagatttttttttttttttgagacagagtcttgctctgtcacccaggctggagtgcagtggcacgatctcggctcactgcaacctctgcctcctgggttcaagcaattctcttgcttcagcctccggagtagctgggattacaggcgcacaccaccacgcccagctaatttttgtatttttgtagagatggggtttcaccatgttggccaggctggtcttgaactcctgacctctcaggtgatccgcctacctcagcctcccaaagtgctgggattaaaggtgtgagccaccacgcctggcctctaaaacagatatttttaatacacaagttatatgactgtaagaagaatcttcagttcatatttgcactacttgaaacatttccattatctcatgcatttggttcatgcaaatgcaggttacattttcggtagcccagtgtctaaggaaggaagattaaacagtttggataaattacatttcaaaagtttgtaaagaaattagtttgaacccagaatgtattttttcctagaaacaggttatgagtaatggttagtttcctaagtcagctcccaaactcatatctgtatagcatttcttttttgtttcggtttgttcaatgaacagatatttatcatcaatgagagacagaaattaatcctatggtctaggtataagtgaagggctatgaaggtacagagcaggaacacgtaattctaatgagaagatgagggactacatcgtggagagggagatgtgggtagaatttcagtagatgggaaatggccatttggggtttagtgtccctctgctgtatgtctgtagtaccttctccatatttgtcatagcagctgttacactgtattgtcattgagttattgcttatctgtcttctcatttggacagttagttctttgtgcaagaattggaggggagtgttttcggtgtacaaatctaccctatatatccaggccaacacaatagccatttggtgaatgtttgtcaaataaatgaaagagatcatttagcaaagttctagaggcaggcaagtatgtggtttgtattaggtgagaatgagaggaaggattgaaaccagatcactaagccctgaagccttgaatgccagcaaacatggtatcattggagaaagaaattctgatgcgtttttttcatccacacttctgtccatacagttattttttatgggaaaatctctttggtgttccagctaaggaacccatctgcttccagtatcaaggaaacatacactttccttagggaaaggcagagatcacaaggcagcagtaatttatctctatagattggtataaatgagctagcggctctttctccaccaaccccctcggagttcacaattggagaacaaagggtagttgctcccacgagctttcatgaggacttgcctgccattcggatttaagtacatacagcttattcagaaagtaggggatgtttataagtcagggacagcgtgcattttataaaaatgttttcagtctcagattctctttatttgtaccacccacagaaacatacatagaaaattttgttcaacttttctttgcattatcaatttatttctctccctcctccactttaaagtcttaagctaatgttctgctgtttattttgcttttttttttttttttttttttttaaagccaacacaacccagtcagaaaatttaggtcagagtggcactcaccccagctgatggcaaacagccttgaatcagagcctgagcagccttctctggctaactgcagagttcgctctctaggcttcagtttcaccactgtaattatgagcgagaagcctatagttaattacaatgcatgaatgggagatattcctggacttatttgcattcattacttgctggtagtttctctgttgaggtctccatccttgtttttacagagcttttggcagtgtttctgcagttggtgtgtgaatttttatgatctgttgcatgttattcatgcaatttcctgccctgtaatggtatcagttttccagacgcagaggaatacagactaaaacccaggagcctgtattagcataaaatgtcccagttctgtcagtttgattaatttgtctctttgtctccactctatatgataagtgctattaatggttgcagcacttcatatgtcaaagtctttcttcctaatgacttgaaaatgcggtttatttcccccctttttgtattatttttctcatttagcattccactcaagtatagatttatgccatgctctttcattatcttactggttgcagcactggagtgattacatatggtgtagagtatgcgtaaagatgtgatcccaggggcagcagctgctgatgcaagctgaaaatagatccagcgtacgctcagcacttttcccagaggccttttatttattagtaacagtcttcgtacaggacagcttggatcctcatttagcaagatgactttttgcctttctgaacactgcagtgactttgctctatttactgacactgctgtgtaatttttttcaaccgccttgtatctcagcaatgacttaacctaacataaattgtaatataatctcgatatataatgaactcaagaagcgataggctccatttgaagtaatagagcttgacagatctaaggtttaaattaaataatcctatttgtaagacagcatttgtacatggtacactgctttaaaatgaatttctattcttctccagtggttcttacaccgtttttagtattctccctttcaaaaggacttttcttcagaaagaaatgcattgcaaagccagcagctctttcataaggaaagaataagatgaaatgtttttttacccagttcaatcactgaactggaaccagcatcattaatgatttgaaatgggtagttattaatccaagctggcaaatccaatagctcagacttctctatcagcacagtacatctgtgatacaaatataatagcagaatttaggattaagataatagctaaccttctgtacatggctttaggttcaaatatatattttttcataaatttgaaaagtcccaataatgaatatatgtattcatttttcaaataaatccaagaagggctcttattttgtattctttttgagaggtgtactttcagtaggataaggagaaagttcattgtatatcctagcagatagcatctagataataatttctcactgcatgataaaatttgccaaattgcaaaaatgaaaaagtattaacattaaaagtttacagacaaatgacaaattgagagtattacttatcggcaggacctagtcatatgaagaagctttaaagaaaagtgaatttgtaaatagcgagcagacctttttctggtgaagtagtagataagggaggcaaaaagctcaggcaagttaataaatttgctttttgctattttatgtgtgattttttttacctgctccagagccaacgaggtatctggacaattatctcctaaaatctgttattgcctttgggctagtaccatgagttttttctctttggtaatagagattttatatgatcaaacagggctaaacccatgatttcctgctaggttaggttaaaaattaaaacagtgattcaggatagagacataaagtgtgattgtttcgttttagtgggtacgtgacccataatgctgttgaaggaacagtcattcaaaccgtttctaaaataagcaaagcaagggacatttgagttgagtaaaagagaagacccccttttcctgcccacacacacaattgcaggagcaagtataaggccacagcatattgtcggctgtgatcattgtggttcatatatctttcaagtttgttttggagtttagactgctagtagcccactgtaatgagagcagcagcttgcccctgccttacagatgccccctaaggcagtagtgagatggtaataataggatagaaggcaagcgggagcttgcctgcggctaatgtgcctgcatttttacgctttatttttgtcttcctttctttctctcccatccggcttcacgctcttgcgtacaaagagcacccaagccagttctccagactcatccctaattccctccttgtgacacagtaatgttatagctgattttattctctgtctagtggcctcagaacagcgggcgatcttgcttgctataggagaagtgatactcaggcatgacaagatggattcaggatggggtttaagtattaactcttaatttcctagctcttgtggttctaaattagattccatgttgttataactgtgagagaatgtgagcatttatatgtatgtgtgtctgtcgctgacacagtgtttgatcaattgaattgaccttgtttttctcctgaaacacatagactgtattatgaagaaagcagtccaagtgaagaaaaacatttcacatatcttgtcaaatattttattgggacctctgaaagatggtatttcgtttctgccaccagatccaaaacgagaacaaaagcacttcattttgataagtgggactttgtttttctctgcaaccttatttccaggatatcttaggagagttatctctgtttgggctgagcttcccaagaaatgatgtaaactctgaaggaggctcttggagccaattatttaacaagtagtttgtaaaccaaaaaataaaggaagaagtacattaccagacagcggccaggcagaggaagaaggaagaaaccaactttattgagtacctactgtgtgccaagtgaatatgaaggtaacttgagcaaaattgcaaagatgtgagagtctgagaaacaaaagaaagctgagggactttaatggaaacactgtattttgcagaagtgtttgaatagaagagagaaaatggaaaaagacaaagaaaaaaatgaaattgttaaagtctatctaaaaaagttaataaagtgaaaggcttcagccactaggacagaacagtatcagtcgagttccataccaagatagttgctagcaagtagaaatacaatattcatttttatccctgtattccattagcaatttctgcctcttcaaattccttggaaaataaaagaaaaaatctgcatctgaagctttgcttggctctcaatctaaggtctgcctctcccagaaaacatcatcatgaagcccaaaatcaatgggatttttttcaatggatagtgcaagccaattttgagtctgatttaaaattcactgtataaattcatcctggctcgctacagctgtgagtgtactctattttctgttgctgactctttcagtaaaacatgcatccactccactttccgcacttcagatttcaagtggaggacagctattggaaggcctgctctcaaaactgacttgttagaccttgtagaacttgctttaaaagctaccatgaagatacatacgtgtctactttttgaaaatgatctttgatccaagaaaattatagcatttgtatttatgggtatgcaattatgcattgagctcttttaagggacggttgtaaacaagctggagcccatatacctctagttttggctatcccttgtcccacgaaaaagatacatatgcctaattaagttaggatttattagcgaggccagaaggtgctaatgggacagtaatttttacgtatcaactttgacttggtgccctttaattggcagcaaggagaaatgttaaaagatcttgctaacacagcatgatgcatggaacgtgtgaggacatcagggcgttttttctcccgtgatatatggggaatcgtaaaaccttagtcttaaaaaattatctgacccagcactaagaaaaggactctgttttatcttttgcatatcccttgtgtctaacacagtgatgatgatgatgatttttttaaataacctttactgagcatccagggtatgccaggcactgccctgtgcactttacgtgtttaactcattgacgctatgggattgctaccattattatctccatatggcaggtgaggaaactggagcaggagaggttaattaacttgccaaaaggttagctcctaagcagaggagccaggacttaaggccaggcagcctgactccagagcccaagttctcaactccttgcttcaatgacaagagtaagactcactaaagatgcaaatgtctgtgtttttaacaggtgggaaacaggtccagggtcacaaaccagtcagcggtaggtttggagactcagtgagtatctccagctctagttcaagtttctctgtaccacacagaagtcaccatgaacccagcactagaaatttgcctttacacaagaaataataggatgctgaaaaaaaattgcaatgtaaagtgataacagagagaatatctgaaatctgaaatctgaaataaattttcatcatttttctttcactttatccattaatggctctcctcaatttatgtcagttgatcacatgaagacattaatgcctgcatcactttaacttacataagaacctacctttgccagggaactcctctattttgagacaccgagagaataagactcctctaggaaaccagctaggcagattttataacccggtatagcaggcaggatactggcccccaaagatacccatgtccttatccccaaaaacctgtgagtgtgtcatgtgacatagcaaaagggactttgtgggtgagattaagttaagggtcttgaggtgggggagtgtcctgaatgattacaagggtccttaaaagagggaggcaggagggtcggaatcacaaagtccactttgaagtttgaagtccactcaagtgttgaagaagcttctaaaggtccaagtggagaccctggtcatagaactggtaggtttggtaggttgctccacaattatcatggaaatcaacaaacaggtcctgggaggaaagtcaactttcccctgccttttccccgtttctgaccatggctgtatgcagcatcatctcacattatactagctcatctatttttccaatcacctttattttttatattttcttatttttttattttcattctttagagatggggtctcagtgttgcccaggctggtcctgaactcttgggctcaaacgatccccttccctcagcctgctgagtagttgggattacaggcccaagccaacacgcccagccatctttgtttttgttgttgttgttgttttgaaatggaatttcgctcttgttgcccaggctggagtgcagtggcacaatctcagctcactgcaacctctgccttccggtttcaagcgattctcctgcctcagactcccgagtagctgagattacaggtgcccgccaccatgcccagctaatttttttgtatttttagtagagacgggtttcaccatgttagccaggctggtctcgaactcctgacctcgtgatctgcccacctcaccctgccaaggtgctgggattacaggcttgagccactgcacccagcccgtcgttttttttaaagaccctttacatcctgtgagaactttcacctctttctcattgccagatcagaatgacttactgggaaagtgtgctgtttttaaaaatcctacattaggcagaaactgaaacaacagactgacatcaaaggtgtccatttaaagaaagccccaggctacagaattctgagccctatcctcctccaaaatttatgactctgaaacctaaactgccttgggtctgcctgggaacctgtacataattcctattacacactgtaaagcgtcccaaatagcttccaaagataccttgttttcgtcaatggggtatccaggttgtggctttggttagttagaagcaacatgatgctttttttagtcgttctcagtcttgaattggcctatactctcagacttcgccaactcttcctcctaatggcctctctcatctgtctatatttcccttcccaacaccactgcctgtatcccggccacagtggtgcttgcctggacttctgtgactggcttgccgcccgtctggcttgttccccaaatgcagccaaaggagtctccctcatactctcctgcgcaacagactccagtgaggcccctgggccagcctcggcggcggacacggaaggaccttcccagcccgtccccttgctcccttctccagtttcacctgtgcccttgccccagctgctgctcctgccacaccacactgcatgctatgttctctcttaggtctttgcacatttcatttcttccatctggaacaccagctcccacccaaaacctaactaatcctccctcaggctgcagctcatttgtcacctcctcagttagatgcccttccgccagcagctgtacttcccctgtgacatggtttggctgtgtccccacccacatctcatcttgaattttagctcccataattcccatgtgttgtgggagggacccggtgggagataaactgaatcacgggggcggtttcccccatactgttctcctggtagtgaataagtctcatgagatctgatggttttataaggagtttccctgttcgcttggctctcattctgtctttgccagcggccatgtaagatgtccctttgctcttccttcatcttccaccatgactgaggcctccccagccatgtggaactgtgagtccattaaacctctttttctttataaattacccagtctcaggtatgtctttatcagcagcatgaaaatggacttacacaccctgtaagtaagaaccgtactgacagttcttatcatggctgtgttgtgattacctgttgacttgtctctgtcccaatagcctagaacctctcagaccaagtaccgtttccttcatattcattgttttatgcccccagcacctaagacacaatagaaccatgcaaagtggtcagtatgcattcgttaaagggataaggtgatttgtatcttatattgaaaaggtgcccaccagtgacatcccatattgtgaattcctgtggaggagaatgcctggtgtcattaccttgttctcagcctataaacttaatccagctaagtgctgtagtgtcactgaaactcactgatctgtgcctggggctgcatgcttgtcgtctgacgcagttgttcccatgttactgtgtggcaaaggtgaactgaaacacctaggggaaggcagctagctgtggagtgttaataattgctgacagatttggcagttcataaagtaatgatatcattcaggacaaactaataaataaaatagcctttattctgcattaaatataatttgctaaaaatgtattctatgtgatgaacaaaccataagttccaaattccctttttattgcacctaaaaaatacaccgttaagatcccgcatatattttttgaggcatttgcttctctttgccttgctctctttctgtgactttccctgcgacccagatatagaaatatcttgtgttcttgtgctccctctcctggtcttttctgtctttcagccagagcatattcctagaattgcgcaccacccaggtgggggcctgggcatatgaacaaagaagccagccagctcggcagtgcttgttgtaagatctggggggggccagaaacaaatttccttcttcattgtttgcagtccagcttgactaagtgaaaaagggccgtacaggtgcagaaaagaaacatgcctggtatcctttctgagaaataaaatgttctttagaaaaacacacatacacacaaacattataataaaaaacacctgatattatgtttttttgaagctatgcctccccggagatatacaaatgcatgtataaatgtgtccaatctgttctgttaatagtgctaattacctgattatctggtcaggtacagtaataaacccctttgacattctgttccttccatatgctagataaagtgttctaatatctggtctgtgactgtatgctctgcccgccaagagtcaggaggtggaaagatcatcaaagcctgtcggcggcgcttcacttcggggcacagaactgggaacagggcactgccaggccctaccttgaggtggcaggacagcactgtccttactcctcacgagggtggcctgtacttcacagggcctctgttgcccttcacatcctccgaactctgaccctgcccaccttctttctcctgttggagttgcttttagacactttataatttcacctatttatctaacattcttcttttttccccatttgactttctgaaatgccttctttgctaactctgtggtctttcctactttagtgtagaagaggatttttattttttccaagctgatctaaaagacagtcatcccccaacccccaccatctaaaattctcttactctaacttagcaggttaaggatgaaccagttttgctcactcaactcacccagccttcatttccaagccagcttgcagtcttttctcaccatcctgcagttccagcaggactggtatatgtgtcctcttccatctgttttgctccatggttttccgagcactgtcagcctcttcccaacagatcgtttctcttcctgtcatgtcattcccttttatgagccccatttgaagtttcatttaggtggggtggagggcactggtttctcaggtagagaagggtgttaatcccaggtgcatatggcagagcctttcctagaaagcatgaggctgccaaggtcagggtcacaatatttgaaggacaaaggctgactcctgttggtgctgcgctctctgtcccccacctgctcccatccaagcgtagtggtagagtggtggcagcccacatccgtcccttgtctctcatcttctgctgcaccaggagtctcaacaatggataggtcagcatcaattattctcctatttgattgtgatacattgtgagttcctccaggaattcttaccttcttaagactacatttttgctgggcacggtggctcacacctgtaatcccagcactttgggaggccgagatgggcggatcacctcaggtcaggagttcaagatcagctgaccaacatggagaaaccccatctctactgaaaatacaaaaaaattagctgggcgtggtgacacattcctgtaatcccagctactcgggaggctgaggcaggagaatcgcttgaacccaggaggcggaggttgcggtgagccaagatcgcaccattgcactccagcctgggcaacaagagtgaaactcagcctaaaaaaaaaaaaaaaaaaaaagactacatttttaagacacattctttttttattatttttcgagacagagtctcattctgtcacccaggctggagtgcagtggcacaatctcagcttactgcaacctctgcctcccaggttcaagcagtcttcctgcctcagtcccccaagtagctgggactacaggcatacgccaccacacccagctaatgtttgtatttctagtagagatgggatttcaccatgttggtcaggctggtctggaattcctgacctcaagggatcggccagcctcagcctcccaaagtgctgggattataggcgtgaaccactgtgcccagcccaagacagatttttaaaactacattttttgcttctttcaagttcacttcagcatccagcacagtgaatgctcaagtaaattttttgcattgattatttagtaacatttatgcaaaatgcctcatctgtacacaaaatacttatggctttagcctttctgtgatctaatgatgttttatcaatttaacttttcttaaatactgtcatccaactagcatgaaaacgtggacttttgttaattctttctaaacatgtaatgttattgccttcttaaaaaaatacactttcatcacaatgcagatttttaacagattttattagaatttatgcagaggacatgtaagaagtgtaagacttggtccttgactttgaggaatttctaatcaagacaggtccagtggaatattcagataacaacgcaaaacagccctcctgtgattaaatgcccaaactgatggtctgtaagcaagtgctgattgtccaggtcatagaagggagggtccagtttaattgccacctcctttgccagggtttcccctggccctttcattccacattggtggataccatcttccctgtcctccacagttttcatatgttggaattttacagttggaattggtgaagtagagtcagcagtgcatctaggcagtggtcatggcttgggcaaatgctagtaagtcaaagaaaaggctaggagtcaggatcaagaggataactggagatgagactgaaaagggagtagatttgggggaaatttggaaggccaggcaggagagaatcaggtttgctttctaaaccagggagttgctgcttgaaacatagtccatgtcagaagcattaactcagagactctccagcctccctttgattgactatccagagagatcatggaggggcaggagagaggagagatggcatcaacagagaggagagttcatgagcacagaagtgggatataaaagcagtattagttttcccttttgctttgagtctctgtatttttaccacaatggtgcctctacctagagattcttaagccctggcctcccacgcttgttaaagaaagaaatgacgatgccatccagacacctgctagcttagttgaggttttcaaagctacgcttctctgggaaggtgccattaaactactgtggatgagctctatgaatcctccctgccatgaaccagacatttcttgctataatagtgcaaggaaactggagggcttatttttccttaaggtttcttaggtttctgatttgcaacctcggtgactaaaattccatccaaatactggaacacccgggatgctgtaggtgctttaactcacatccttaaaggtaaactcagaaatagtttgattcacccagaaaaagaacacctggtgttcttgagacttggtatttgtcaaaaaccaaaggttcattttcaggaagtttggatatctttatttctaggagaaaaggtgttttcccagttacgagctataaataatgaggtctttcataacagtcccaagccatgttcaaaatagatggcccagaacagcctccaaggtaccattctgaagcacctgtgacttacttccttttcttaccatcccctgtgttggtgtgaaaagcgtgtttcagccccacagaaactggacacaaccaaccagtcattgttagaaatttctttctcccctgcctcagcatctctgctgctgccagagatgacaccattgtcaaaaataggaccctaccggcctataatcctagcactttggaaagccaaggaaggaggattgcttgagcccagaagttcatgaccagcctgagcaacagagtgagacccctaactctacaaaaattaaaaataaataggaccctgccttcatgccccagcaacctgaagtcctggacacactgctcttcccagcaaaggcttgcacccagtcactgtcaatgtcatttatatgcctggaaccctggtgtcctgggggaagcttcaggacaagaacccaatggcttcaggtaaaaatggcacccatggctgtgctgatagatggtatcggctcccgtttcatttcctcccttgacagacaggaataacatatagaaaagattcaaactcagttaagaagcagggaggggaagtgggtgactgacaaacctgacttcatgctcttattcaggggcgtgggtgttggatcataacaatttctgcatccctaaaagctacagagtggtatgttctatctgagagtcctgtagcttcagggcagccattgtccaattcacatatggggttttgtgttaatggctgctgtttaaatcctcacagagcacagatggtgcctgcattgcatcagcattaactgttctccattggcagagcccattgcagaagcacaagaagggaggagaaatcagaagtgtatcgtccctttggcaaaaagtctggtttccatgtatgatttttatcccagcttactgtacagctttgagtagcccagtcagcatatctcagcttgttacatgatggttggtaaaggacttagatgaaagagactaaagactgtagaaatactatcattgctgctgtatcaaccatgctgataaggcatactctgtagctttattccttctgtaagccacagtaacaccatttctattgccaaggaaagggctctgcttgagaagctgatacatacatcttcagaatttttagtacttttctctcaaaagcctttcaagtatattaactacctacatgtcttcagcttgtccctatttattcctattttgcaaatgaaagggacaaatgacagcaggtatcaaggtcagattgctttccctgctaaagaccagtgggcctcccctggtagcacctgggttctcaaggctattggaggattagtggtgtgtcaagctacttgcttccagaggcaagaagaaaataatattttccataagagacgtgtgatctgtcagttcttcagttctgatttcaggtggaaaatatgacttcagttcttgaagaaaaaattccctaaccaggtatgacagatgtcttcaaatatgtgatggattgtcatgtgaaagagggattcaaattgcttgcccaagtgggcagtactagggctagctcggtttagttcaactaatagttattgagactctagggtgtacaaggcacatgctttcaattgaaagtgatggagtggggaggaagagagaagaatatcttgcttaactcataataccaattaggtcagaacccagcaagtttgatattggtaggaaagtaaaatatttggtaaatcatgggataaatcaagaagttacagtctccaatgtctattcatggttgaagcaggagtaatgtaaaaatggacttggagattattgccacagtgataaatagaatttctcagagaacccaagtaacctggtaagcagaaggacatcacagtgaaatatggctatgggaaggaattccatattcaaaataaaaatgtaaccactggaaagacaagcagagccaaaagtatatctaggccagtcactgtggcttatgcctgtaatcccagcacttcagaaggcccaggcgggtggattacttgaggtcaggagttcgagactagcctgaccaacatggcgaaaccccttctctactaaaaatacaaaaaaattagccgggtgtggtggcacacgcctgtaatcccagctacttgggaggttgaggcacgagaatcgcttgaacctggaggcggaggctgcagttagccgagattgtgccactacattgcagcctgggtgacagagtgagactccatctcaaaaaaaaaagaattacatctaataaggtctgtaagcaaatctagaaacatagggcaggggccctctgaagagcactaggagattagaagagagaggagcaaaattgatattgtaggagtttatgggtcctattgtcaggacaattaaaggttccatgttcctattcccatgtacagaattaggtcaaatagctaccagaattctcctcgaccagtagttgaatacctgagtggttattgatttgccacattggcaattccaccttccagaaagtagaagatgcaaaggtagaactgctattcgggtcgtaatctggctaaaaggaattaataagagtacacatgagaagatctttagaagaaagcggcagtatcatcttaaagaacatgaagtcaaagaagattttgtacggtccaaaatatttcaagaccttttttattgtgattttaaaaaaaataacataaaatttaccatacatgtttatgtgtacagttcagtagtgttaaataagttcaatactcttaagtattcacattgttgtgaaacagatctccaaagttttttcatcttggaaaatccaaaactctgtactcattaaacaactccccctctttttcttccccctagcccctgataaacgccattccactttctgtttctatgaatgtgactacttttcttttttttttttttttaattatactttaagttttagggtacgtgtgcacattgtgcaggttagttacatatgtatgcatgtgccatgctggtgcgctgcacccactaactcgtcatctagcattaggtatatctcccgatgctatccctccccactcctcccaccccacaacagtccccagagtgtgatattcaccttcctgtgtccatgtgagaatgtgactacttttcaatgcctcatataagtggaatcacacagaagtttctttttatgattagtttaattcacttagcgtaatgtcctcaaggttcatccatgttagaacacgtgacaggattttcttccttttaaggctgagagtccattgtatgtatctaccacattttgttgatccagtcactcatgaatggaaatttgggttgctttcacttcttggctattgtgaataatgctgctgtgaacatgagtgtacaaacacctctttaagaccctgctttggattcttttgaaaatatcccccaaactgggtttgctggatcatatggtagttctatttgtaattttttaaggaaccttcatactgttttccatagcagctgcactattttgcaatctcttcaacaatgcacaagggccaaatgcagtgactcacacctgtcattcctgcactttgggagaacgaggcaggagaatcacttgagcccaggagttcaagaccagcctgggcaacatggcaagactctgtctctacaaaaataagaaattaaccgggcatgacggtatgtgcctcctgtcccagctacttgggaaactgagatgggaggagcacttgagcctgggaagttgagcctgcagtgaactatgatcatgccactgccctccagcctgggtgagagtgagaccctgtcttaaaaacaaaaacaaacaagaaaaataaaaaataaaacagtgcacaaggatttcaatttctccacggcctcgctgacacttgttactctgtttttttggtagtagtcatcccagtgggtgtaaggtgagatctcattgtagttttaatttttatttctctgttaattagtgacgttgagcatcttttcatatgtttgttggctatttgtatgtctttggagaaacgtctattcaagtcctttgcctacttttagttgggttattttatattttgctgttgggagttgtaggagttctttaaatgagagttctttacataggggttctttatatatcaaccctttactaggtatatgatttacaaatattccctcccattccatgagttgcctttttactttgattgtatcctttgatagaatcagattttaagtttgatatagtcccatttgttcatttttgcttttgtttcttgtgcttttggtgtcatatccaagaactcattaccaagtccaatgacatgaagcttttcccccatgttttcttctagagttttataattttgggttcaagacatttttaaacagatttttatgttaacaagaaaaaggtagaaattatgcatctgtggggaaagatgattcaggagggctagaagtgtccaaaacaaagttcacatgaggacccttttcttgaaaaaggagggtaaattgtgccagcagttgtgtttcattcagagttttattttaaacactggaaaaacacgaacaactatgggaacatgtatggaaccacaaataaggcgttcaagaaaactcaagcccaaaatgagtggagacctttcgaagaggaccacagaaaacaaaaatgaatttgtggttctctttggagcgtaaagatgagggaaccaacagctgctcattggggctgactgtgtagtactgaggatggcaaaaagcccagagttaattttatattgtgcatcaaggagaatgactgaatgaatgaccataagactgaaaagtgagaaaaaacttggaaaagggaaaggaagccctaggtagatgaacaaaaagaaaatgctaagctcccagactggatgaagtaaagcccccaaactgcagggggaataatatgattatgatacaacttgctatggtcaaaatctttcagggactgtggagctaaggaaagtgtcaaaagactagagatcagaaattgcatcgtaatttgcaaaacaaagagaagaaagtggatctttaaaaatttgactgaatagtagtttttataataggaatgatttctgagtatctagacaagtacacactcttgggtcaaaaatttgattttgcaaggttaaaatggacacatggcttatcaatagatactgggaggaaataagctcagagatgttaattgtaaataataagtgacagtgaaatctgagcatttctagaaaataggatatagacagagagaggtgatagtgtgtcctctgtaccaatgattggagcatttattcaatccagatatctgccaggggtgtagtcgcaggcagtgtggttcagaggagagtaacaagaaaggtgtaagaactcataactgactaagccaaaacttccattcctgaaacttaacatgaagaaccattagaaggtgctaatgaggggccaaacttctcatcactggaagccttcaaaaatgttttgtattttctggttgaagatcaagtggttcatagttggtttgaaatgactagaggggttgagagggtgaaaccagaccttgagtcaagaaattctcgcctaggaaaatcactggtttctggaatgggaagagggtcatttaaaatggaaattaggtaattttttctaaatcttctttttaaaaataattttcttttggaggcagtttttcgaatgaaaccataaaccttgatgcaggttttactacttcattaccagtgagtgggatgcttttcacttttattttacactgaaaaacgtgaaacattactactatttcatatctattttaagacctacacttatattgaaattggatttttaaaaattattctgtgaacttcattttataatctttcagaagggagattttctgttttcaccgtatgcttttagggtaaatatgaatatagttccttgtatctgtatcatatatgacttttgcctgtcactaacctaggaaatataaccatctatacctgaatgggaaaattatgagcgccacatatgaaggaggtgagatgagatgggcaaaaccacccagttgaaacgaaggttccacatacccaaggtgtcgccagttctcaggaaagacaatatggaatgtttgcttttgggaccttctcctgttcccatcaaccttgaaacaaccaaagaaatacctaaggggcagtttcagccattatatagccccataaccattctgagccgactatcacagagaggggacacgtaacgctccccctagacatcagcttcatccgactgccattccactgtggaacaaagctctggtgccatgtggcaccccgccagaagggcatttctgctttgtcttctagattctaaggaccaatacttagctaggcctgataatttaccaaatccccatgtggtaaaagggcttcgtaggatttgcagagtttcattgagcaggaaagggacacagcagttatcttcatccttcaggaggaatgcagacactggaaaaatagaaccaattatgagattcaccttctgcataccaaaagatgtactgcatccaattggccagacttctttggatagagctatataaaacaatattttagagagagtaataaaatttacaataacatgtttccatatgaaatagcatttctttcctagttcacttcagagaaacagcaacaggtagaaagggagcatgagagttgaactctgcggtcggaagacatgagtttagccctggccaggcagccctgtgactttgggtaaatcccttcacctttctgggccttggcctccttgtctgtaaattggattgttaagtcagggaactagaaaccatgccaggtgtttcaaatagaggggctataaaacaggaaattggttacacaggtgttggaaaactggaagaacagaaaagggaaggagagctaacctaatgattaatgaccgcagaaagtatctaccactcctagggctggaggggatgaaagggacctgtgagcatggtggaggggcgggtgcctcgggagctgcagctgtggggcagacagccccttccggacactccaccacagagtcagggatgcagccacttccagaacacaccgccaagaaaggaaagataaacagagcaagagacagaaggagccacagcgtcttcatgcctcccaccttctgagctcacccacctgtgcacctgttggcaggtccgataataagttaaccagcaaaagagcctaggaaacaagagtttttgaactcccagcctcagcaagagggaaatatgagaaaagtggatgtgagtccgagagacaatagtaaataaccaacatatgagtttacaacatcaaactaaaattcagtcaaataatagaagtcaaaattagtagttggtaaggactatttcagttttccggttatgtttgtattaaggtagttaagttgtattaaagtagtgttacagagatacacacgcacagagagagtgataatagttttggttctggcctcaacagtttctgaataatttttttaggtgttttttaatttaaaaagtttgtattgagtcatgatttaggaaaaaactacaagtacatttcggaaaaccctgtgacaggagaaatcatagcaaaaatgtgggttatggtagggtctgtcctcaagaattcctgagaataattgcagggagtctgagtctgttaactgattcaagtcatgactctctatcatggggattcgagtcaggcctttgctcactgagcctacatgattttcctttttttactaatcaaaaagtaccttggtgggctgaccatgtttttcagcccaaagttgaagtcaaatggtggtctactgtttgacctccaccctgggatgccatcaccccctcctcaaatcagggagtccatttcaactgcagggaataggtaactgtgtgtgtgtgtgtgtgtgtgtgtgtgtgtgtgtgtgtgcacttgtgcatgcatgtgttattgacagggccagcttcatgagcataaaacctgtgcaactaattgcacagggccccatgctcagaggggtcctgcactttgtttaatgttctcttgtcacttgaaattcttaatctctgaacaagaggctaacattttcattttgcactaggccctgcaaaccatctagccagttctggttttgtggtaggggagggcaattgtgaatagaggaccaggaaaggtctcagtgaggaaatggcgtttgaggaaaagccggaagatgatgagggagtgagacatgcctttcttttacttattctgaagaacttcaactcagccctcaacacttggcaagtgttacctcctctaagtagccttacactaattcccttagcagttactgctccagccctgtcctcccagcatcctgcaaatacctctgttacgtactcaggtgacactgtaaacatttatattgaacatctgtctccccagtcacttgttagctccttggagaaaaaggtggtgttttattcatatttgtagcaacagcaataatactggttgttacttaatgccaggtcctgttccaaaggttttactataaggcaggcactgtcagtatccctgtcttacagttgtagaaactaaagcacagaaaggttaagtaaccagcccaagtgacacagctggtagacagcagagctgagacttgaatccaagaaagtggagtccccagaccttgcatagtacacagtgagtgcctagcacatcgttggagaatgaaaaaatgagtatggatggacacagtggctcatgcctgtaatcccagcactttgagaggctgaggcaggaaaatggcttgagcccaggagttcgaggccagcctggacaacatagtgagacctcatctctaaaaaataaaataaaattagtaaacaaaaaaattataagtgactgaatgatcagatagagtctcaggagtaaaacttacaaataggggaaggatttttacattatggctgcagatccaagttcaaacctgcacaggagagaaaagacactccgtttatgttttaagacatattcactaagacaaataatgattttctttagctaaaagaaccaccatatgaaatgatatatgtataaatcaatttcaatgttgatttagtttttatattattaccttaggaatagaacacaaaataagctctatctaaaattcataataaaattgcccaggcacaatggctaacacttgtaatcccaatactttgggaggtcaaaatagacggattgcttgagtccaggagtttgagaccacctgggcaacatagtgaaaccccgtctctactaaaaatacaaaaattagctgggcatagtggtatatgccgatagtcccagctattcaagaggctgagttgggagaatcacctgagccccaaaggttgaggctgcagtaagtggcaagatcatgccactgcactccagcctggacaaccagtatgagaccctgtcagtaaataaataaataaaattaatacgaggccagatgtggtggcttacacctgtaattctagtactttgggaggctgaggcaggaggatcccttgagcccaggagttcaagacaagcctgggcaacatagggagaccctgtctgtaaaaatagataaaataaaaattaatactaaaataaccagaagctttgttgaaatagtaaggtgaattaatttgacaaatactttctaaatgtctagcatgctgctttggaagaagaatgtgataatgtggatatgaattatagaaaattaagatgaggagtgatgcctgatcactaagtcagttttcatcctgcagagtgggttgcagtgcagtaagagagtgggaagggagagttaattgtcaccagcattgctttcatcatttgacaagtgccttgctgtgcaaatacaacccagaggggttgtcagtggtctagcgttttaaaaagcccttgggcaggggttcattacctttatcttcctggttcctgcagtgtgtaagagattcagcttcatcaggaaagtgtacatggtgttgctgaagatgtaagtttcccttttttgtgaagttgtgattaagggaccttgagaagcgtgccagccctctcccagggagcagtcacctgtcctccggattcatctgatcagccttctgcagatgggctcaatgctacagccatgtgtatatactgccaaaaccaactggagacaccttagtcatgtagcttatatagagaatgatgttccaagtctcaaaaatcctcaaaccctattttcaataaatgcctgaaggctgactgcctcatccctatcatagtccagagatggaactgttgtaagtatcctcataaactctgtcctgcagcaaaatggatgtctcatgaaacactgagctccccaaaacactgagctccccaaaacactgagctccccagctttgcaaacagtgcccaaactttctctacaaattgagttttcatcagcccatcttcctttcagcagagagatgatatgttagaatccaatgtaatgaaggattaagggtcatagttacagtgggtcaaatttcaacacattgtcagcatgttgacttgcaccatcggacacggtaccctggccttatttctttcagggttgaaccaactatgtgccaactgctagctgaggtcatcacctcctaggaagcagtctgtgggaggttggagggttaactttctgccttctccgaggtctcgcccccacatggcacactgtattctggccccaatgtgtgatcccatctcatctgtatcagaatgagtattgcacagtatgagaccaggtagttacatatttaagtgcaatgaaaaaatgttcttcgaaatgaggcattcaaaatattttcattcaaaatgcaagactgttatcccaagttgtccctaacaccatattttgcatttgtttctcataccttgaggccactgctgaccagtggattttagtctagatgggtctgcttagagcagagggatgcaactccattaacatcagtgagttggaactattcttctatttatagccacttcattccattttaactttatgatcattactttttaaaataccattttatgagttgttagttttgcgtgtaattctccacctcccacccccctcttattttttcccattattagagccttatttgttaagaacaaaaagtaagtaacaatgcagacttgtggtcacagtttcatgaacatacagcttttcactggtacctgaatatttgccttctgagtataatgaatgaatttaaatggtccctaaaaatgggtagacagtgccaccttctcaagatggaggctaagccagtatttagaaagcctctgcctgttgtaacacttgctggcaggtgtgatgggcacttgctttctgttttgtgtatctggagcgattaccactgccgaaagtagaccagagatgggttcctgggagggacccttgtgacagttccgaaagtagccatcgtatcaaagcaacccttgacctagagcagacactcaaggcgtgctgataaaagtgttcaaggggcccccttgctagtcccctcagcctcagtagtctcctatcctgaacttgtctggatttctcagttgacaactactcatataatcttgcaatggcttttccattgttgacttgcttacattgttacttagttaacttttcatcatttgtacctcttctacaaagctaaatcttagatctcttgagcacaggcctgagtcctacacatatccttccctcacaccactagcacagaagaagaaacagactggacttggtttggaatcctagctctccactgactagcactgaccatggataaactccttcacctccctgcttcatagtttccttatctacagaataagggcagtcatgcctgccttgcagggtgttacaagagcacagtgctgggcactaggagatacttggtaaatggtcattctggctcaccaaacaaagcctcacacacagaagctgagcaaaatcttgcagacttaaatatgacaaagcaggactgaaaccagaatgggagaagagctagttatgagctcttgaactttcatggtgaggacaccatttcctctgcccttgggcttaagtgacagtttacaaaccagattttttatctatgactctttcatgaccatatgacgatcatttcaagctcaggaagtttcctaagcctcagtgatctaaggagtgccattgatttgtgatgtggagactttgctcattcacctccttggtccaattcatacatttaagcatcagctcgtccctgagcggagatgctttctccagctccttgcagccatgtggcagagggtgactcccagtactgcttcctgatctacagatccccatggatgtccctggcttctttagaaattttctttacaagaggccacagtggaagatagtggtaagacttacttagacctacagcatcaaaaaaaaaaaaatggtgataaggatgggagtatgagaaaaactgtgtgaacactctggggactgttgtggggtggggggaggggggagggatagcattaggagatatacctaatgctaaatgactagttaatgggtgcagcacaccagcatgacacatgtgtacatatgtaacctgcacattatgcacatgtaccctaaaacttaaagcataataataataataaaaaaaaagaaaaactgtgtgaacagtataaatagcattgaaattagtttcctacatttcccatatagtgagcacctttgccaaaactcaagaagtgtcttatccacccttttggcaactggcacattacagaggagcataggatcattacgagggcaggggtcaactctgcattgatttcaccatttctttctttgtggtggagccatgtggcagtaaaggaataggtcatgtgacattcttgtcatcttcttcagttacctataaatacacatttccttgcttttttactttcttttaaagattcttggaagaaaaggacataaaacagatgtattgtcagtactacatttgctgaacctattaccatgtcagcttagcaggatacaaaagtgtcggtcagacctcctttttaatactggtactgtgacacggggcaaacaaagacccttgcctgcctgcctttgatcagttgatcggttcagttagttggtttacatgatgccttgctccaaaagtaacttgagacaacactctctaaacatactgtgttgtcaccttgcatacacagtagtagtatgttaggacacagtttgactcatgacatatttggtaacatacaagcttttaacaagtatttaccatgtgagagaccccaggttagattagatgcaaggttacaaagacagacaaaaccattcctgatctgaaggagcttgctgtcttatggtagaaacaggcacaattaggtataataaaagggagatggcactgattgcccatatagaatttataatgtgggtctagcagtcatggctttttgttttgtttttttaaccaaatatctctggactcatcatctgacagaaaaatttaatgtggaatcttacttgagtactttaaaaagattaacaattaaaatcccgttcagttacatgtctaagaaatttccgttactggaaagaatgcaatgatatgaaatcagtgctgccctggagaatccagcacgtctcctcatctggctatgagagctgagaggacaatgtcattcattctctctaagaggactggagagcactcccaaaggagtgaatgtccaggttgaatcttgaacatcaattacaggtccttgcaagaattttggctctgtatgctgcggtgagtttaatacacacagaagtcagctacaaagtttaccagttcaccttgctgtgcactcactccccccgctaaaattttgtatcactgctaccatagcctctagcaaggaccccatgattgctgctttcatttgatttgtacaggatttgtagacatgcgtcaccttcctgtgtggtcagcagtgcttgcaagaacctagaggatgtgtggttttatgtgcagggtaaggaagcttaccctgatgaacaccagcaagtttaatccatttccatctgaaaaaacaattggccttaggcaacatattcttaattgtctaagtcattgtgtgtgagcaggcatgcgtgtgggcacacacgtgtttgtgtgcatatgcaagctgtgcataaatagcacactttcaatctttgtaaaatataacagataagcagcaaatgacagtaggcttagcccctgaagatttaccaggaaaaaaagacagctgcatggcaaagctgctgctaataattagggaaggaatagcccataccctgtgccactcagcagcttcaaccatttaaatgagagccggtttgtttaactctgcaacccccattcattatgggccaggggttgatttcatcttgagcacaccacttttgattgttgtcatctctggtgagataatgagatcatcatcatcataagatcaggtagacatgatgaccgaaagtctcaagtagaaactgtgatggatgagcaaaacaggagttgttttaatgtctcttttaacattgtaagtgaggaaaacctatttttacaactccctggagttagttttttgcagggtcacattgccatttttgtggttgacaagaaaacgttaaggctctcttgggctccagcaagctgcaagaagtgtcacaacactcccccctcgtgtagaatggctctcaacaggactgattgggagggaaattaataggctccccattgtcaccgtgcatttttgccaggatatttcattagtgtaaacactgaacccgttgtcatcttgtttagccacttgaccctggtgattttcaattctgcctgtgctgtgatggagtacaacagtggcatgcacgagacaggcactaattattggaagcagaatcattgctgacccagtactacaagattaactgcccctttgcagtctttattctgggacattagcactgtctggttatcttgcttcagttgagggattcgggacaatagcagtgctgatggtaatgttggcgatttccctgtttgttttgcaggtcacggccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtaccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtagggaacccacataaattcaagcatgtgacccactctctaggccctttatctggactactccctgccccccaccactcccacattgttcttacgtgctaagattaaagatgacagtagagagactgccttccccatccacagaggcaggatgctgaaggtgattccacattaaccacttctgtcctagaaaagcacttgatatttgatctggatctcaatactcgacaagcagaggcaagctgctgagtaaaaatatactgaagtctaatgcatgaagtacactgaggcactccagacccccctctttctcctccctctctccccctcctacacctgctttgaaaggatgccatgttcatcaccctcatccttgcccttcacccgttcagcgtaaaggaagatatagaatctctttccagattgattgattgaaaccaaatagatcaacactctcccagcaccttttagattttccttgtcaacagaagaccccagggccatcccatgtccatcacagtgaaggtgatggaagcctcaccgtttatcccggtcctggggtcatcacagaagcaccctagtcagccacacataatgtataatggatcatttcccaagctccctcaaatgctaggaagacattttgagaagtagtggggtagagtagcagtttcatccaccctgaaagcaatgtacttgctaggaaaaatgtccagaggctccatgtgtgtcttaccattgctggaagaggggaacaggggcaacagcagccacatcgtgagcaagactcacaagactaaggagaggaaagaagaggacccacctccccaataacatgaacattccctagaaagacctgagagagtctgtgtcgtgacctggcgttcactgcactgtcttgctgattgacaaggtaccagcttgagactgctacctgtgtctcagacccccctcaggagcgggattgaacaaacccagtgacaagtcccttctcagagctgtgtatcccaaaaacacaggaagaaatgaaacatggtcctcctgaggccggcaaccttggtacccatctgtgctctctggatgttaccagcctctgtaaggcagagatgttaacccagccagaaagcagaaatgccatacgggatgaggtggcttttcacagagccacgtgcagtttattcagcctctgcaagattggcgagaagcacatgaggttttagtttgggcgtgttttgaaaatagatgccaaaggcccctgtgccaactgcaaaaatgccctgtggtcactttctttgcttgctagcctggtttctgcccctctcttaactgcctagcagacatggagaaagagaaacactgcaaggatttaatttaaaataaattagaaaggaaatatgaatgggagctattcccatgcgaatataccacctccccttaggtttggggtggtgggttgtgcccagtgccccaagccaggctcacatctgtgtccctgacattgggaagattgagctttcccgaaaatagtgaaaggctgtgttttctctctcctcactcattctttccctctgacctcttttgtgaggttttccttttgttctgaaaccgtgaatgagcgtgcctgatgtggaaggcaagtcactgcgtccacctcatccgcatcatggcttcctaccaaggactggtggagggagaagagcacaaaggcctgcagtctttgttttttgtctctcctttaagaggagcctggggccgggcatggtggctcaggcctgtaatcctagcattttgggaggccgaggtgggtggatcacttgagctcaggatttcaagaccagcctgggcaacatggtgaaaccccatctctaccaaaaatataaaaaaatagccaggcgtggtggctcgtgccagtagtcccagctacctgtgggactgaggtgggaggatcacttgagcccaggagaaggaggttgcagtgagctgagatggtggcactgcactccagcctcggtgacaaagtgagaccctgtctcaaaaaaaaataaaaggctggccattaagctcaagggagggtggtgtttttatgacatttgcatatgttcaaagaactgtcagtttcagatacatcttcttttgtgtccccccaccctcgccgccaatatcccaaaagagagcttaaagtcttggggccacagcaagaacacattttttgtgtgtatgttgggaccatgtcagttgtttactttagaactaaaaatattaactcaattaaaaggaggactcattcaacctgtaaaatagtcatgaacaggactagccttccccccttgagaaataccgctacttttaaaaatactcttatttttacctttaaaaaaggaatccatggctgggcgcggtggctcacacctgtaatgccagcactttgggaggccgaggcgggcgaatcacaaggtcgggagatcgagaccatcctggctaacacggtgaaaccccgtctctactaaaaaatacaaaaaaaaaaattagctgggcgtcgtggtgggcgcctgtagtcccagctactcaggaggctgaggcaggagaatggcgtgagcccgggaggcggagcttgcagtgagccgagatcgcgccgctgcactcctgcctgggtgacagagcgagactctgtctcaaaaaaaaaaaaagaaagaaaaatccatcttctgcattcctgaacagtgaaagaagagacatttaccaaagctctatgccattttggaaaacatagcccctctcagtggtacagtttggacaggacagttacagtaaagttaaggtttttcccaatttgacatcttagttttcctagagtagaggaggttaggtttccaagaactgtctcagggacttgccatgactgctgctcgaggagttgataacctgctttagggagttactttgaccctggttgaagtattatccccagtaatagtgctcaaggcagatccttctccacaagtcaaaacttgttttcctgaactgatccagaagaagccagcatctattgggctaattctgccctgccctgctttcatatgggatccaggtgccttctctttcaagtgaaccccacggagacaccagagtcagaaatcaagacaggagtttccaccccttgccagacgccagtgtaatacttcgcgtgtgttttcccaatctgtcttcctccaccccgtagggagccaaaacgttagaccaaaagtgaagtgttaacataccttgtattctgtaagatgttgtagttataccgtgttaagcagcccttccatctcacagtcgttggcttctcccatcctttttaactgttccctggcttcgagaaagatcaaattagcgcagtattatcctttatcaataatcagcttttttaaatgacattcttttttaaattctagaacacagcatacccagccccaaacataccaaatttaacaggctttctctttgcctacaacaatatacaaatatatattcacctctctatgggtttgggttttattttaatggcattatgttgtagagttagcagcttccttttttcacgtagctgtctaccatgcacgtggctgtaggtcgatcacacagggccaagacatgtttctccaatatctctcgttctcgtaaatcgtagttcattcagctgtcacttatcaccagacatttcagttgttttcagtttttccctctgataaacattgctgcaataaacattttgtgaccctactgttagtagtggtgcatttatttttgtgggttagtttcaaagatgggctaaaggttgtgcccatttattaaatactacctaatgacctacccaaaatgttgtagcaattcacatattcatcagcaacttagagtgtccaatttcccctattcttgcccatactagttgtcaccagtctttttaatttttgccaatttgatgggcaaaaaaatggtgactactaatgaggctgacatcttgttttatgtgtattgaacatttatatttcctttcctgtgaattgctggtttacctctttgcctatttttcttttgtattgtttaactttaaatcaacatgtaggaatcttaatccctaatattaggaatattaaccctttctcataaatgttgcttagatattcccttagtctgcttctttatttattgtaccttttcccatataaaaaaatattagttttatgtagtcaaggtataagtctttttctttatgacttctggatttgctatattccttaagaagtcaggttgggaatttttctcttccagtaaaaaaaaatgaacaagtcacataagtgaaaatcacaaaacagtatgcacaaggtcctagtttgtttcctaaatatacacaccatataaataaaatcagcatagagaataagaaaaaactgggagcaccgttggagaggagtgtagggaaagtttcatttctatgtatgtctgtaatgtttgaattttatgtatgtctatcttgcacaggtttattttttaaattaagacataattcccatatcataaaatccaccctactaagatgaacaattcagtggttgttgatatatccacaatgttgtacaaccatcaccactatgtaattctaaaacattttcaccaccctaaaaggaaatgctgtacctattagcagttactcctcattgcccactcccctcagccccaggcaaccagtaatctaccttctatctctgtagatgtacttgtttggggcatttgtataaatagaatcttgcaagatgtggccttctgtgtctagctcctttcactttagcataatgctttgaaggtttacccttgccattgatgtactcaccaggtatattgtcatgtattagtactttgttgcttttaattcctgagtaatattccataatgttgatccattttgttgactaataccacattttgttgttcattggttgagggccatgtgggttgtttccactttggggctattataaataatgctgctgtgagcatttgagtacaagttgtttttaagacatgttttcagttatttccataatattcctaggagtggaactgctaaatcatataactttgtatttaaccttttgaggagctactagactgtttccaaagtggctataccatttcaaattcccaccagcagtgtatcaaggatccagtttctctgcatcctcgccaacacttgttattgcccatcttttttgttagtgccctctagtgggtgtgagtagttatggtttatctcattatggtttataggtttgtttttagatgttggaaattatagaaaattacagtcattttccaaagtagtaagcctcttagtaagacagctttgtaactggaccatttctacttaattgtagattttagtaaagaagcaccacagagagtttctttgcacagtcaaaagtatggatttttggacttgctttattaacatgttttacactgagagagataaaagtgtatgagagtaagagagtgtgttgggggcaggcagggggcgggagagagagagagagaagggaagagagagataaagtccagagaaaacatggaaatggtacagaatagaagagccatctgactctaactcttcccaccccaatgctgactttgagacacatgttgtatgtaaaattttcacaatcatttttgtggtttggtgaatcaggcaagtttttagaagtgtctgtaattggtctgcttaataaaaagaaaccttgctgggcagcatagaaatcagccatatttctaattaaaacagtgtttttatgttgtctagaacattgtaagtgtctggaattccaaagcacatgtctgtaagacgaaaccatgtgacagagatagatagggctaataaacagaaataataataccttgtatctatcaggcagttgaaactttcccaggcactttctccacctgtcatccagttgtattcttcatagcaaccctgtaagctaagtagggcaggcgttatcgccctgtgactcctagatcctccaagaactttgggacagacagaatgaagacttgcctgagatcacacaactaattaattgacgtatcacaactgaatcccaggtgtcccatatttgtgctagaaactggaccatgagaagagggcgtggaaggacaattgcgcgagaaacatttcttcacctgggaggggagattttgtcattgccatctgcccagcactgagctggctgtcctggttccagcagcactggaatcatctccaatgggcatattgcttcctccctcgacagctccctgggatctgagggtctcctcagagtacaggcgttaaagacttcggagagctgaccacaccatcagtgtctcagggtatcatgctaatgtgaccctactcccatgggtttcaatcaacatctggtaataaaaccaagaaatgaagtaggaaaaaatattaacaaactagtcttccactgagatttctacaggaaatatttgtttctggctttttctgcaaaatttgcagctactttcctgcttttccagtaaacttcacccagcaaagcagagacactaggcaagcgaaatgtttgttgggtgagatagatacagcaccacttgattgcaactcctaaaaaagatgcagagaaaacaaagatcacggggaaatctaccagagcaagagagtcatcatttggggatgagaattttttttcccttcttttgtcttatattttatgaaagctatatttatataatatgtaatttttatataatacttacagaataatctataattatataatacttatataatttttcaatgtttccttttaactgggaggaaggggatgatggtttaggctgaagaatggtcgtggctgttggcagggaagagaaataaagcagccgatttctgtttggtgagaaggaagcaccggcattccagggcccagcctacagcctcccctctgcctcgttggtgcagacagcatgcaaggagacatatgtaggttccatgcactgtccagatgtcacacctggacctaagaatccctggacacactgcagggactatccattttactgactgctcaggagctggagcctagccaggcgtggtggctcactcctataatcccaacagtttgggaggccaaggaaggaagatagcttgaggccaggagtttgagaccagcctaggcaacagagcgagaccctgtctttaaaagaaaaaaaatgtgtaaagctggaatctccagaagaactaaccctcctatagccgtgcttagcaggacagggcaggtaccgtgctaaaaacccacctcggtcctgctgctcctgtcgtgttccagagggggaagagtcaacactttgctgggctgaataaaatcaacagcagcttattgtgccaactgtggcacaggcctctggtgccctgtttggcccttggcctgctgactcagtggctgccctgattctccgattctccactgagaaccaaagtggtagacccctggctaaagagtggcgcccatgaatccctcgtgcccttccccttatatgcagcctgtgtgtccggagctgtgtgtgggtggctgagtataactagtggggatggcgacagtccacaggactcttcacctcatcacattggctgttgggactctttaggaaaccaagccactgctgggaagtgagatcctggaggagcaagtgtgtggagggacagttaataagatgttaagcccaactgggcctgtttggctcagaataattatctagaaggaaaagaggtgggcctcaaccttcttgatgtgtttccgctttccaaggtctgttggccttctctgactcctcagccccatttgaggaatgttttgagtgccgagagcctgggagaggcatgtcctccacgggaccaaacagtcagtggctactccttatttccagacaagatgttcttggcttggaacttattactcaagaaacaacttggatgtggtcaagttcccacccaccccgacccggtgcctgtctgagaacacctcagagacccccgcatgtcagtgaacataagtcctcccttgctagagggggaaccaagacttgtaaagagaaacaagagtgagttggggtttttttcacctgggagaaagtctatagttgacccattaccttttcctctgaccctctttaaaaagcagattgtgttgcagcagctctgctgaagtgttgtatggctttttgtctcaaggactttgaaactagcattggtgatttttttctttttcttggcaactctccctcctattcccctagtgttttatattcactgtctggatgatttaaatacagtagctcttggtatagacatccttttgactttccctgtggcctgaactatagggatatcttctttctgagagtaagtaaacacatttagagcagaagcagaatggctttgttgtcatcagagggaaaactccacaagcccccaaagcgccaccacctctgctgtgttggaacatccacatctccaacagacagacctctgtgttccggagacaccgtgcaggatctgagtgtgtttgttatccaacgggtataagagggaaatcaaacattctttcatatcattagaagccctgtgcaaacacagccccgtgcacaaaggcctttcccgagcccataacaaggaactgtttgtcctggctgcctgtctttagcagtcggagcagggccaagccgacagtggtgtcatgggccctactgcgattttgctttcttggaccaaaattttacaggtgtcatgggacagagctcaccaggtagaagttgaatcagatcacctactgggaaccttcagtaaatgccacactgcacaagctcggagctgtgatggaacctgacaaagagcttgcacccaaccacagaaaagtcaaatgatcattttgtacatttgcctttgtgcacgggaattgactagccacacatgccggcagccgggactcgtgtctgcctgcaaatgatgtaaccaaagagaaacctgggctcaggatcaaatgtcttcatcctcactcccttgaagaacacagacttaaccctgcagcatctgaacactatcgaggggttggtttcttcacccaagagcattttgatcagttcagcccagacccatatgtttttctggctgctgggattcattgagtccatttattctgtctcctagagtggcactgtccagtccatttgcctcatgctgcacgtggctgttgagcccctgaaagtggctagtctgaattatgatgtgctgtaaggataaaatgtgctttggatttggaaagtttagcacaaaaaaaaaaaaactgtaaactatctcattaataattatattagctatatgttggaagtatttttatctattgggttaaataacatacagtattcaaactcatttcacctgtttctttttacttcttttaatgtagctgctggaaaatttaaaatcacaaatgtagctcgtattgtttgtattagacagggctgggctagtgcttgaaggaagtttaggtttgtagtgccatctgctggctcatccggagcagacgtgaatgtaaacaagaatgaagcaatctgagctaacccacacgttgtctcttagcctggcagcacacaacctttttattccaggagcttctgaagcaggaccagactgaacccagaagctgctgaatccccaagagcctcgggaaggggagtgacaaactgctcaaaggtgcaagcctgtgtcacctcatgggtgccaaggaggctcttgagatagagtagtggtttgctgctcaccttccgcacttggggctctttcatgcagtctttttcactggttgctattcttaagaaatatttcaggccaggcaccatggttcacccctgtaagcccagcattttgggaggccaaggcgggcggatcacttgagaccaggagttcaagaccagcctggccaacatggcaaaaccgcatctctactgaaaatacaaaaattagctgggcatggtggtgcacacctgcaatcccagctactcaggaggtgaggcaggagaatcgcttgaaccagggaggtggagtttgccgtgagtcaaaatcgtgccactctactccagcctgggtgacagaccgagactccatctcaaaagaaaaaagaaaagaaatatttcaggccaggaatagtggctcccacctgtaataccaacactttgggaggctgagtagggagaatcacttgagcccaggagtttgaaaccagcctgggcaacattgtgagacttcatctctttttttccccttctctgtggcgcaagacctcatctctacaaaaaaaaaaaaaaaaaaaatttaattaactgggcagggttgtcccagctacttgggaggccaaggcaagaggattgcttgagcccaggaggttaaggctacagtgagctgtgatcataacactccactccagcctgagtaacagagcaagaccctgtctcaaaaaaaaaaaaaaaaaaaaaaaaaagaaatataagcaatcatttaacaacatagtaaggatacaaacccatccttcaggagactgctgtcctcgctttagataatgcttatttgccttgatttgtcaagaattggaatttgtcaagatttggaattttgctgacaagtacctgcatccaatgtctattgttgcataataaatcaccccaaaacttaatgacctaaaacaatagtaatcacttaacacctcttacagtttctatgagaaatgtgaatgtgagtcaggaattcaggagttgcccatctgagcagtttgggctgaagatctctcataaggtgaagtcagatgttggctggggctacactcaactgaaggtttgactggggctagagaatctttccagggtggcttgttcacatgactggcaaggtgatgctggttgttgactagaggcatcagcccctctccacatgggcctctccacagagctgcttgaatgtcctcgaggcatggcagctaattttcgacctagcctcagaaactatacaccattactactgctgcattctgttggtcaaaaggcaggaaaaatgcatctcaccttttgataaaggaatgtcaacatttcattgtaaaattggaaaataaattcccaaagtgcccaacacttgtatagcactgtacggcttttttaaaatgccctatttttcagatgaggaaattgaatctcagagaggtggagtagctagcctgaggtctcatgtctggtgagaaggatgaaagcccggttcttttgactcctactatatgctagtgaagcctatccaagttatctcctcctatctcccatatgctattgtaactaagaatcacactgggttttttgtgtctccagcattttcaggatacatggggctctcttcattcaggggctttagatatgtccttatgtggtatctccctataacttgtcattttattgagttaggctgtaggtcttatggaagtacatttcaactaactagaatctttcttacaaaagtgctacatcaatgaaaaatgacacattttccaatattgttcatgtcatttgcttcaaaaatctcagagacaataacattgcaatatatgtgttcttattctgtttgattatccaggtattattacatcttatctgtctttaaacaggaaataagtaatcactgcttgctttcagtagtttccatattacttggtcatcataaaaaggaggttttatcatttttgatgttccgcctgccagaattaaaatccagctgccataatcattttctgttattcttggtttcaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgagttgacccatccattgtgatcagcaacctgaagtgaccaggactaatgtaaagtaacagcaatgaaagttggaaaagtagacagaagggtcaccctttggggaagtttgggtttattttttaagaagtttctcaacagaaataatagctttacatctgtgcgtgtgtgtgtgtgtgtttgtgtgtctgcacgcgcatgcatgcgcgcaggtgtgtaatagtgtgtcaatattttatatccttcagtcattattcatatagaggtagttattttttattttccatccaacatgtgaaaataactgatgttggccagatgtggtggctcacgcctgtaatcctagcactttgaaaggccaaggcgggtggatcacttgaggtcaggagtttgaaaccagcctgaccaacatggagaaaccctgtctctactaaagatacaaaaaattagccgggcatggcagcacgtgcctgtagtcccagctattcgggaggctgaggcaggataatcacttgagcaggggaagtgaaggttgcagtgagtggagatcacgccactgcattccagcctgggtgatagagtgaaaccctgtctcaaaaaaaaatgaataaataactgatgttgattatgagcatctatggtccaggtattcttctaaactgtttttatggatgatcccatttaatcctcacatgaacgctatgactcaggcactcctttatccccatttacagaggagggaactgcagaagggctggaaaacttcccagtacttggtagaacttgaatgcaaacccaggtgtctgattccaaatcgtgtcttgtaccactgctttctcctgcctcctggcagaagagaatggaatagagataggacgcctacctgcagaggggccattgctcaggagatgatctcctgacattctttgcaggcccagggtcctttcttttgcagttctgcctcaaggtggctgtcatcgccatccctgtgcctgagagtgttttgtcacagaaaacaaactcccgtctcccaggctcccccatactcagagctatgtgcccccgccccttctccttgataagcaaccataaactacagaaagtaaatccaggtgacctctggctcctgactgtagctttgaagacaaccaactcaacctccttcagctccacctttctgccaccaaataacagaaactcatctcaggtgccatgtctgtgtcaggctgaagaagagggaggccacatggtatggtcatgatctaagtgtggctcctcagactgtttgcagcacctcctggcctcatggtgagccaccagctaatgagaacgaaagcacaaggatgaaatgttagaaaagcacaggatgttatatgttatcaagatagccctggacgtcagggttttttgttattgttgttgttgttgttttgtgggtttctttgacactcaccaccagggaaaatgtctgtgtttagcagctcccatcaccaacaaagaaagtccaagcttcttagtaggatatctcctgccatttgtgttccagtctgtagctacctctccagtgtcaccatccactcccttcctaggacttgatccctgataaaatcaaactctgcacttgtgcctatgccatttcctctctgccttggacattcctccactttttctatctcctttgttctttaagagtcaggtcatggctgggcaccatggctcacacctgtaatcgcagtactttgggaggctgaggcaggaggatcacttgaggccacaagtttgagactagcctgggcaatatagcaagaccccatctctaaatgaatgaatgagtcaggttatgcatcacctctctaggaagcccctttcctgagtccccagttaggctgggcacctgcctgtggaagcctgatctgacctctggcttagtgcttatcacttactcttgagttatctatacatttgtctgtctccccagccctcaactgtcagttcctcaaggacaaggacagtgacttgatcatctctgaatatccagtgttggacccattgctggcgcccagaaaatgtctattgccctaaaattcgctggacattgtgactattcagttcaggggattatgagtttcttctttctttcaaatattgctttaacatgtttaatgtcgttaaacaacaaaatttaatttaaatcacataaggagacgacattcctgctggtgagtgtgggtcttctgaaagcctgctgggcttaggtagttaagtccactgggtgtgagtctacaggggcctaggcacatgtctatagtgccctgcactcctcttaaggtagtaaaataacttcagtcacccacatttgagaaatgcctggttttggtaatttgcattctgcttagtgtaattttgtgatactgaacaaataaattccaagccacagaccaggcagatatctaaagcgctttgctagcatttttcaaccaaaaaaccaaattagagcatcatctagttctccaaccactttttggcatccccttaaataacacgttgtgtttcagtgccgaataagaacacattcatcagtgtacgtctgtgactgagagcttcatggttttaaccaaggcatgatttgcaatgccttcccctgctgctgtcacacgcggcacctcattttcttccccctagaaagtggcctggaacatttaacagatgagtaggcctggaggggtccgtgctttggccggggtaatgtggcagaatgatcctggggttcctctcccagcgcccaagcagtattgcccctcacattgcagatttctgtactaaaaggggagagctccaggttgcacagccacccatataagttttttccctaaggagacatcccagatgtgttttgtttcttatctgccaccctgtggtgaggatgctatgtcctgacagggatggcgctggtgggcggagcagcttccacctctccccaagtccctccctgccctgcccggtccccagcaggccctgcactcactccccactcccacgccgtctcccacacacccgccactcagctgttgcaaactcgcataatgtatttctctcaagttgcacttgtacatctgtttatttttcatttttaaaacatattttcttgataaatttataaatattttaggaggtgccctttcccggtgtaaatctctctttccgacacacatgcccacgccgcctgccagattgcattcatgttacggcacatgcagctcccgtgtcggagacctgttccttgtgcgtgtcgcatgcctgctcctccctttctcctcttcattttctctcccgtcctcttctcctgcctgcgcttgcaaagggttggtgagaactgacttcatgctgcttcagatgccccttttcttcatccacttcattgtgtgtgcctcatggaaccccatctcctcccctcaccctcacgcaatttttttttcttttttttgagacaaagtctcgctctgtcgcccagactggagtgcagtggtgcaatctcggctcactgcaacctccacctcccggattcaagcaattctcatgtcccagccgcctaagtagctgggattataagcacgcaccaacacacccagctaattttttgtatttttagtaaagacagggtttcaccatgttggccaggctggtctcgaactcctgacctcaagtgatctgcccatctcagccgcaaagtgctgggattacaggcatgacccaccatgcccagcccccttctcacaaatgttgatggtaaaaccttaattagtctccagtctgctgctgaagtcacctctctattgggatggtgaatttcagtaacacaggagcatgtgtaggattttgtttaaggagaagaacatctcagaaccttgggctagtactcaagggttcaggctccatccttacttctcccttcccaagtcggggagaatcgctgctccagactgcacttttcccagctgtcctagggagggtccctcctgttcagtctgctctgctaccaaggccagagagcctgctgatactgggttctatatgaaactccgtatgttaggcaacgacaggaaattgttgatgactttttttttgtctttttttttaataaacttttttttggtgcggggagacagggtctcactgtatcacccagggtgagtgctgtggcaccatctcgctcactgcagcttccaccacccgggcacaagtgatcctcccacctcagcctcccaagaagctgaaactacaggcgtgtgccaccacacctggctaatttttgtattttttgtagagaaggggttttgccatgttccccaagctggtctcaaactcctgagctcaagcgatccgcacaacttggccttccatagtgttgggattataggtgggagccactgcacccagcctgacttacttttttaggagcagttttaggttcacagcaaaactgaacacactatacagagagtttccatatggtcctgttcccacacacacagcctcccccactgtcagcatcccccacaaagtggtacatgtgttagtcaatgaacctacactgacacatcattatcacccaagtccatagtttgcattagagttcactctcggtgttgcacgttctatggttttggacaaatgtataatgacatggatccaccagtatagtgtcatacagagtggcttcactgcccccaaatcctctgtgctccacctgttcaaccccttttacccctaacaaccacagatctttttactgcttccatagttttgcttttttcgaaatgtcatacggttggaatggtagatttttgcctttcaaaaatggcaacctgatacatttgggggagattttcagtcacaagattgggactgagagtttttcatttaactctctacaaaccccaaattccaggaaaccaaaacatggactctgaagttttctgattcgtgacgattttgccggttgtttgcccgggccttggagagggatgaagagatgtcctggggaaggtgttggcatcagatggaaggtgtggcagaagcctgtgtctgggccccctgaatatgtatctttaagtttctagagcctgacctagtcattcttgagttacattataatggaggatgcaaaacaaaggctggaaaacctgaaacgaggccttctgtcctccagttcaggcttgatcaacccttctctttttttctctactgtccaggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaatatatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacatggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtatactgtatattctttgcttttagttaaaaaagtaaaacattttagctaattaaaaagcactcaggtgataattatgtaggaaaaacaatcttgccaaataatgaattcatcctaggatgtgtagacaataatctgcttgaatatttttatatttcacctcctccccacctttccctaagcaaagtttaaacgcagatagagagttcagagttgatgctggatgttcagattcctaagtggggagagagtttggacatctcactcaaaagtacatcagaaaaacaggaatccgtgattttataccagaactcagcaggcattggctcctagaaatcaagttagaaagttttcacccagggagtaagtcccattcatttcaacacgtcctgaggcctcggcttgctcttggaagtgttgtgcagtaggacctgctcccctgaaggacggggccaaccagccactggctttcctgcccaggcttggcctcccaggacatctggcctgaggggatttgaatcacagccccgaaggtcctgccttcaccccattgggagagagcagggcatcctggcatctgcgatccatccctgacacaggctgacacattctttctcctttccttctccaaaggcttggagttttcttctgaggtttttctgccagtgtcttgtctgaaggcagacttcattctgaggctttggacaagctatcaccgggaaccctccctgtccccttcccgaatcacacacataccctaccctcacctgatgataattttctcttcttgctgcaaaactggttggcttgcaacccagagagagcagcttcccttggctctggggccgtgttggccccagccacgtttacaggaaggtgtgccccagaggaggaggaatcagctccctcgctccagtggccttgggtccgggtctcactgagcagcccgagggccactccagcccggctggggaagagagtcctgaacggtttgatgtggggatggggtggtgggcagtggggaatagatggttgactttgtttctttatttgtgccattgtttggacaatattaaagctgcatgtaaaaggggaaattagtatatgatgtaggctaaaagtgaaatcatagtaacatatgttttagtattattaacttttttctgtacaaatattagcactaaatgtttaaatatgtatgaatgccagaaatttgtcagttcatgcagtaggataaaaaaaaaaaaaaaaaaaaaaaaaaaaggcttttctttttaaacagttccacttttaaaacctgcctctgggtttttgttttttcttgtttgtgtgtgtgtgtgtgtgtgtgtgtgtgtgtgtgtgtgtgtgtgtgtgtctgaaacagatcttgataaagctctgtgttggagctgctggtttttgttatggttgttggaatttcttggcctactaggacagttctgtgcttcaccatgaggtttgcctttgtggaaaactggtgacagtgagaatataaactcaatgtgaatcacgtgatacttcgcaggcgtgtgttacagtggagtcagctgacagtattttgctttttaactctattgttgcctttccaagtgacctctcctcttcttttaaaaaaagaacactttctgctcatatcataaccaggtccaacccagcttcttggcatgaggtttaccctggtaacaactcatgtgcaactggtagtcttgaccacattccatccatttcctcaggtttctgtggttcagtagcccagacctgtttggcagccatttctagcaggggcggggcctctttatttctctccaccctaactcagacctcaccttcctcccacccacccctgccttgcttttcttcctcttcccccaacctaacttctgccatgggaactggttaaaaacactgctctaaaaaccatcttccaatttcatagagatttctcacaagttatttcattcataatccaccatgaacagtgactagcttcgtgcagttgttcatgtgatgtgtgtgtgtcttttcctattcagaactatgtgcttgtcaaaattatttctgggttgattcaaagggaggacttgctggggaccagaatccaaacggcctcaagtggaattttaaaacctagcctgtctcttttccctgggatccctctgtcaaccccacgccttttaggaaaaagaaaagtgagtgaacagcaaggaagagtgtttgcacagtacagtaacatttggttgttcttaaggctcttttcttacaaaaataagagaccctccaaccacgggctgtttaggaggatgcctgcttgggtctccaaatggctggggtaggaatggttgttggggcagagccagtggaggtgagtgaccctgagactaatgaacatcccacctaaatccagtcctccccttggatctgcctttgtcctgcttgtgtatccaggcaacctcttttcaagttggtcaggctttggacaggtgagtgatttgctgtatgtgtttgtttctctgcgttacctgggggtgccttgattaaaatcgaactttattacatactgattctggaacaaaacagttagaaaaactttaaaaaaaaaaaaccgacaaagttacgaggccatcctgctatttatcttctgagttcccagcaatgactcaggcatcagagatgatgctgcagtggaaaacctgactctgtgtgtctgcaactgaatgttgtgcgagtaatttattaactgtctttctaaaggtttgctgcttttaagatgcactataattcgggatgtaatccttacattgcttttccaaggaagggaacaaaagtctagtgattagtatgccaactgccactactccttcaaaaggagccaggaccagcgacaagactcatgagaggactggctaaagtgaagtgtgcacagtgtgaagtttaatgctgttgtcaagaggcctaaacccacattttctcttttaatattttatgattgccatcaaagaagaagaaaaagaaggaacagacaaaggtttgaaaatgataagcctgttaagacaccaaaaactcctgtcccgtgaagctgcttgacatcctgtggagtagcataatcctctcaaaatgaggaagagctgcctgcaaagctttctcaagtccctatttggctacctacttctctacattatgccccatttaaactaggagctgtcttagaaatgacttcaaactgcttcactattgcttacagtttaggaggagtctcagatccagaaggagcaagaatcaagtttggtcctcaaatgactgtaaatagactaaagaacaaggtgttttttgtttttgtttttgttttctaagaataaagctgttcgttgtatcatgagttagtgtttcttccccaaactgaagactgtgttggaagtgcaatttctggtgagtcagtccacaatacaatgccctgtgtggagttggtattcatacaggaaatctgtgtgcacgaggcattgtgtgttgaaagtgtatgtttatagtactgcctgagccatctcatgaccccagcgtccaaaaccgatgctgtagaacagaacatatctgtacacaaatagtgtgtgcaaatagcatttgtacatagaaaagtctcattgtggcagattgagcataaattattcaactgacggtgcaaaaacattacttgcaaagaaaagtttatagtattttcctacactccaccctgggagatgatatttctatcaaatgaatatcagtgcattttaaatgtaatatgaaaacgatgctgccattttgtgaagaatacccacttggttgcagaggccaactttcatagctttgatttaatgttgtgacacggtgtatgcattttgctgtcaagcaatggataaacagctctgactttcattctcattccagtttattgacctcagataaaacactggcccttcttagaagcagaagtgtgcaccaagaccattcatttcaggtagactcacattcagtgccaagtgctcccatgggaataatcagacgcatatgttgcgaaagagtgaagggacttggacaaagaggggttttcctacagatggatgctcagtcttctaccaaaacatgtttggaggcagaactatgacctccccttaagtcctaacaatgtattttgtgtgtgcaaatcctgggatgcccgtttcacgctctgacataaagacatggcacctctagtgagtgatcaggaagattccatatgcatttgggagcttcaggtgcttgttagacacagtgagccattcaaggcaagcaccacctttgctagtgaggccaagagagcctgtgacaatttgacaatttgttccagaaccagtctgatgcaagtgcacctctaatatatgccttacaaactccagaggccatattcaaaacagggtcttctcagtgtatgcaaggggctgcagcccctcttctcttcctccccaggttgaacaatacggacagttttcacacatatctacctgtataaccctctgtacctctcataactggtcaacgactgtaacaggttacatcaggtgtttttctacatactttttacacagattctatgcgattaatgtaatttaattcaatgcatcattttattgtactagttcttaggcttgtccttatttttttctaagtgattgtggtttttctcgtggtttttattgtaaaaaatgaaaggctgttgatgcttattctctgtaactaagaatttttaccttttgggggaaaaaagcattgctatgaactaatgaattgaaacttcatttactcattgtaaatacactattgtgcaaaaaaagttttcactcaattgaattgctagtgttaactgaattttgtctagacaccatttctgttgatgaaataaagacatatcattatgcattgtaaactgattttctctgcctctgatccctatgttccaaattacagagtgagaaacctcaggaaatcttttttcctagaggccatttctcttcctctagtttggacccttacttgctacctgattaatctgattaggaatctttaaaattggataatattaatgtgattcctaaactctgaattttaaaaatccctagtgcctgtgagagtagataaaaggctttaaacccaatttctcggttttgatattgtgctatcgctatgcagaatgttaccacgggagaaaactgggtgatgggtatcatttcttgcaactgcatgtgaatctgcaattatatccaaaataggctgaattttttaaaaactaaatgaaagtaaatgagaaagaacattaagccaacaccaagatgcagtgagttgcaaggaaagatgtttagaattgtggttgaggaatccatacagtcatgcattggttagtgaagggggtacgttgtgagaaatgcatccttacgcaatttcctattgtgagaacatcagggtgtgccacaccaacctagatgagaaagcctatgacacacctagactagatgttcctagattgcaaacttgtgcagcatgtaactgtactggatatggtaggcaattgtaacaccagggtaagtagttgtgtatcttaacatagaaaagttgcagtaaaaatagggtttacaatcttatggaaccgctgtcatatattcgtcccatcattgaccaaaacatggttatgccatgcatgactgtacagtttaaaagttgtattctaaaagtgtatttgatagttatgtcttcgattttgatgtaaagagaaaacaagatatcaaatggtgggcaggtcgagtgaccatgagcgaacactggactggagctcggaggtgagagaaagccactagagcagagcaggggggtctgagctgtcagcgaggctgtaaccagtgcatgcgcatggtatccgggcagggcagggctgtgctgccgagattcacgcttcaaggagtgcatgcgaccgccagatgggaaaacggaaattaaaaactgccaagttctgctccctcgggcgagtctccatgggcacctatggagtcaaggaaggcttcctgagagcaggtcatgggttttgcaaatgtgtgctgctgtgacaacgtcgcagtcataacattttcggtacaagaggcggattacctacgcctgaagatgtgaagttaatccactctgagaaaaacaggtgggtcagagtcccaaaattttctgtgggaaaacctggtaatttagaactgatggtcatgtgcaccttcaaccctgacatctgctcttgtgatacaaataatggtcatgcattgaaggaaaataaacctcaccagctgttgcgtcctgcaaaacaggcgtccccgacccctgggccgcagactggttccggtccatgacctgttaggaacaggccgcacagcaagaggtgagcagctggggagtgaacattactgcctgagctccacctcctgccccatcagcggtggcactggattcccataggagcgcgaaccctactgtgaacggtgcatgtgcgggatctgggttgcagctccttatgagactctaatgcctgatgatctgaggtggaacggtgtcatcccgaaaacatccccccacccccgctgcctctggtccgtggaaaatttgtcttccacgataccagtccctggtgccaaaaaggttgggaatcgcggctacaaaagagcttttaagcactgtccagccccaggtggacagcagccattttctttcctactttacatgtgcttcttatgggaaatttgtatctgcctctggggcagtgaggacaggttccttctacaccaggccctgccagcagttttgttgtatgtatttggaaataactgagctgttctttgaaatcattttagagtctttcactcttctccaacccaccacctcacccaactctgccccacca

SEQ ID NO: 15869 - DNA, 15412 bp, Human
ggtcagcagatgagaccatcctggctaacacggtgaaaccccgtctctactaaaaatacaaaaaaaattagccgggtgtggtggcgggcgcctgtagtcccagctactccggaggctgaggcaggagaatggcgtgaaccggggaggcggagcttgcagtgagccgagatcgcgccactgcactccagcttgggcgacagagcgagactccgtctcaaaacaaaacaaacaaaacaaacaaacaaaaaaacggcatgagggaaatttccatgtttattgtgttcatctttgtatgcctaattccaaactttccaagctcggcacccagcacacagtaggttcttaatatttgttgagtgaatgaataaatgaagtaaattggaaatgtaatttgtctttgtctaaaggcaagaactcattcaatataacctagtcacttgtcttgaccttcacctctttttttctttaacaaccttattgagggaaaatttacataccataagattcacccattaagctcctcttactaatttttttctctctcatttttgtgtgtgaaggtcattttctaatggcaaaaatggaaagaaaatagaagtagaatgttgtggaatcttagataaagaatgggctcttggagcccagtttagcagggtttacttctcagttttacttttcaattgtgaccgtaagcaaattaacttctctaggcctgggattctgatctgtaaaattgcactaatatgagtctcttcacggctcctctaaggattaaatgagagacacatgcaaaggatccccaaaaacaataactcaaaaaatgttgattccctcccttccctctgtcatctgttaacctcaacttcctaaatagaaggtctattcttttaccatcatcattattctcttcggtgcctatttttaaaaaatactcaaccttcttgcttccttcgctacctaagtatttctgcaagcccactttgttctgcagcttagctttcctggcacaattcttatagattttggtcccttttaaaattcattcttcagcaaatgctttctctctccatcttttgactagagatcattagagatcacctgagatcattagagaacagtggtttccttggttgccattccctttcttcttcattgggagtattctgcggtgaactcagacattttatttttcaaagcttcccattcttttaaaaatgcttttccttttacagcctctcgctcaaaatcatacccatcttttccctggatctgttttctcaagtctccaatcgcctgccttctttgtgtcttgtattaccctcacatcccccagctttctactgctctcccaggaccaaccatttcttccgcgggagtcacattacatcagcattcctaatgcagtatctgttatctaccagattctgttttattctaggtagtcacttaaaaacgaacctcggtactggtctgacttaacatggaggaggaattgtctaaggttaaacgcaaactgctgagagatttggggcggggggcacacatttacattcattcgtattaaatatatacctgttgaatttgtgctttttctcaaatgcttcagagactcgagctttagagtaattgggatggtgaaaggatgggtttccagaaacttcgcccaaaattaaagactccatcgaaaggactgctccatacactcaaggaacacccaccaacaaatcccgtctccacaaccaccagattatctcaccggcgagtgagactgcaaggtttgggggcccggccgtaccactccgcgctgcgcacggggggttcgtacccatctggccgcgaccgtccgtttccccctcgcttggttctgcccctgctccccctgcacaggcctcacagtgcgtctggccggcgctttatagctgcagcctgggcggctccgctagctgtttttcgtcttccctaggctatttctgccgggcgctccgcgaagatgcagctcaagccgatggagatcaaccccgaggtgagcgccaggtgcaccgctacccggagagcgcgaggccgagggagggggagccgagtcgctgatcggttcggttttgcctttttctttgcatttgcctttcagatgctgaacaaagtgagtggcgtctcgcgccgtctctggccccctcccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgtcattgcgccggcccgggtgggggtggcagggcgggactggggctcctcccaggctcgggtgcgggcgcggagggcgcgcgcctcctggccccgccccctggcaggtgcccgcgacccgcgtgtccccgtgcgcctggccgccttgtctcctctccgcaggtgctgtcccggctgggggtcgccggccagtggcgcttcgtggacgtgctggggctggaagaggagtctctgggctcggtgccagcgcctgcctgcgcgctgctgctgctgtttcccctcacggcccaggtagggcgtggggcccaggatgcgccggccgccggcagtgcacgccgctccccagcttgagtcctcgggggctccccgccccgccccctcccctgtaggtgatgcggggcgcgcctacaaggaagggaggagcctgcattttcgtggtacctactccctgggctcctgttccagcggtgcctgtcgccttcttgcccatccgtccacaattgccttaaatttggaagagaggcagtatctcagttccatctatcccgttatccagggaaatcattcatcctactcatgagttccctcgaacttgggctttttcgagcctccggttccggggaatggctgctggtttccctttaagggctataacctgtcaactcattgtttgcttctcagactcccacctagctgtagaatggagggggaagggctgacctaaatcgcagggaaacaattaggttcgctaattctccgcctccattacttgggtttctgatggtcttaaggggttcttctctcttctccactcccaccacttgcacacttggtttttagcctcttgaatgtatttcttaaagcttaatcattttgtgtatggtttctgtgtgggaacctccttcctcttcacttatccttgttcatctctgaccttgtagctaactgaaatagggggttattagctcagttttgaaagcacctttgcatttcccttgaaatgattttcctcctacaagtgtgcatggatagatgtatctgaaagacagcgtcagatttttttttttaaaggatagctaggatatttgcagtcttgtgatgtatggaatcccagtcattagcgcatggcattgtcttatctcctattgctgtcacttgaccgctgatgtgggagtgactgaaattagctttagcaaaacttggggcatcactctaaagagtgaggttaactgaagcaccgtcctaaggctaggtgttctggaagcatctgtagccaaaatcaagagtatgggaagttccaagccttcctcctagtaagtaagctaagtattgtgggtaaaaacacttatttacagctaataagatgatctcactgacatgtttttattgctaaagtcttttacttgggctaaaaggaagatgccaaattgttggaagtcgaattagcttcctggttgaccaaatcagtctcctgtctccagttgagcatcacacagaggttttttattagagcaaccatgatgactcggaggttttgagcagcattcagaggcaaggcctctgggaggcagtggtgcagcatgtttgcctttaaaagctgactgttctccttttgctgaatcttgtttagagaacattctagtttgtgttatgtttgaaagagctcgatactttgtcctttagtttcaattcaacctatcagatttatcgagcgcctattctgctacacagaatgcctactggacaaaacactgaagccgattgaaagaaaagttgaggttttataggttgactccaaagatgctaatgttaatttggaaggcatttaatttttgactaagggaatgttatgaccccctacatggaccacttctgaaacattaagtgctagtagactatttacagaatgatttccatggaagagctcaagcagccctaaaggatggtgctatcccattttaacatttcatctaattagcctagaaaatgaaaaacacttactggtcaatgaatactaagttgaggatccagttagatagaagcgaaaaagttctgctagttggagtttaagttgatcttctggggtaagagatcttactcttctattagtaccagagagcaagcttaaacttcagttcatgtacagaaatgcaaagctactagaattggaaataggtttctgatggtctgtctggttttgctcgttatgggaaatcagtgtttctatagtgttagtaccctactctttaactgggaagtcctaacttatttattatatttttattttttagagacaaggtctcaaactcctgagctcaagtgatcctcctgcctcagcctccctagtagctgggattataggtgcaagccactgaccctggctcaagaaatcataacttctaaggtctttaaagctagttagtgaaaagtccagataggcttactaaattactatacagaaagctagcagatgctttgaggaaatccgtttcctagtccgattcatttaccagtctctatcctcctcctcaaattgccagtctgtcctcaaagtaaactgtttagctggcaaggacaagctagtgtcacatcttcctcttgtaaaatcacagcccaataccctggatcagttgtcttttccttaaaaagagggcggaggtaatggttaatttctttcacttgttcttttcagcagttaaggccgtttttgtttttgaagcgaagtgtacttaagccgagtagaagtagaactttaaagaataatgaaatgtaaaccagctggtgctcttgttgggcattcaattgactgaagcttgatttaggatgcctatgtgaaatagttgttaagtgttaaagggagaaaataatgaattggtttctttgttttctgacttcgtgacaccattttgggctgaaaggttgcagtggtgtctagacacagccttgggcagtatccaaggcagtcactgcactgcagcaccagggtggagtctccgaacctctcagagccccactggctggcgtgggtggtgtgggaggcagacagacgggcccttctctgggagtcagccaacatctagaaccaggggttctggtcacacatcccactggtgtttccatttagttggtagaactcatgtgctgccatctgttctttgcactttcattctgagatgtaaaaacgctttttacattcgcagcatgagaacttcaggaaaaagcagattgaagagctgaagggacaagaagttagtcctaaagtgtacttcatgaagcagaccattgggaattcctgtggcacaatcggacttattcacgcagtggccaataatcaagacaaactgggatttggtaggtgtgggttttgaggccagccatcctaagcttgaacttgaaacatggagttcagaaacagctgttttcccgaggtcagagatgctgtaccttttgaaaccattttgtaatgatggtgtcagacacttaatctgactcacagtcctcctcagaaaggattcctagcacttccaaattttgaaatggtcccatttcacaaattttagagctgaaagttcatattgaggtcttttgaaatatacattgttattgctataggtttgtaattagtgtctcttaagcattttgttaatgctcagtgtggataagcctatgtcagtggttagccagtcagatgtctctatgctggactattttgtttctttacatttctattcaagatctttatttttctatctgaataaccgaattactaaagttgaattttctaccccataatcttggtttgggaagcatttttattagaacatgattatagcgtcatgtatataatagatgttaactgtacattcttagatgctgtagatacagcaggtaaacaaggcagccccggcttttatggtgctagaaatctcaaatatgttttacaaattaagaattgctgtgaaaaagtgacaggagatttgagagatgagtgaggtgggagggaaaaaggggtccagggtagaagggaacagaggcaagaaagagcttggcatattgggagagcggagagacctctctggcctgaaagcagtgaatagagaggggttagaaaaagaggctaggggaaaaggtacagctcatccacaaccctggaggcagtattaaagattcaggttgctcagcatgttcagcaaaggcttaagtcaacaataaatatgtacccacttgtattattttacctatactaacacatccattttttttttaagaggatggatcagttctgaaacagtttctttctgaaacagagaaaatgtcccctgaagacagagcaaaatgctttgaaaagaatgaggtaagagaacttacagagcatggcctttaaataactctagagatttttgtgctaattattttcttttttccgcaggccatacaggcagcccatgatgccgtggcacaggaaggccaatgtcgggtaaatgcaaatacaaatcggagccaggctgcctgggtgccatctgtgtttctactgaaattgtgcaggaatctcttactggaacacagcaaatgttatccacccaaggccaaatgacaccagaaagttctacccaaataatgctttgactagacctgttcataaaaaaagttttcttcagaaattgtattggtcattgaagtcttgagtaaattcaaattgacagtattttgtttagatccaaatgagtcttataggtcaggcatagtggctcatgcctgtaatcccaacaatttgggaggccgaggagggtgaatcacttgagcccaggagtttgagaccagcttggccaacatagtgaaaccccgtccctacaaaaaatacagagtagcgaggtctgtagtcccagccacttgggaggctgaggtgggagaattgcttgagccctagaggcagaggttgcagtgagctgagaccatgtcgctgcactccggtctgggtgaccctgtctcaataacagaaacaaatgagtcttatagagtgtacacctctcctagtaagtgagcatttcaaataatcttcacaggctgttggggagaatgaaatgcccaacgaaggacaagttctagaaggcttgaatataccataatctgatgagaacctctgagtcagctgctaaatttaagtcagatctcagtgtcctttttaaaaaaaaaaaaaagttgacaaggtcagcctccatttcccaggctggaatgcagtggtgtgatcttggctcactgcagcaattctctcatctcagcctcccgagtagctgggattacaagtacacaccaccacacctactaatttttatattttttgtagagatggggtttcaccatgttgttcaggctggtcttgaactcttgtgagctcaagtgatctgcctgcctcagcctcccaaagtgctagtattgcaggtgtgagccaccgtgcctagccagatctcagtgtctttataactacaactggctgccactttctagcattgaccttggttgagatagttagcctctctaagcctcaattttctcctcagtaaaaatcctgtagtaatagcatcctcatagagttgttctgacagttaacagtatatttaccttagtgggcttagaatagggcttaatgtaagacatacattaaatattagctataatttctaaaaatcaagtcagttcaagcacatttcacttgaattgcaagataatttttaaaatacagcttacactcattttcaaaaatttcttgactttctttaggtagatgacaaggtgaatttccattttattctgtttaacaacgtggatggccacctctatgaacttggtatgttttactccatttttggaacccagtgtagtttcatgtgttctttcagactgaatttctcttgatatattgtgtgactttatggcacttggcatatcattgtttataaagccacaataacaaagtattctcatgagggcacttaaccccttatcatccccagagcaacttcctcaggcaactgactagcatcccctagtatcatcctttctgggcaaagagtacgtctgaaaaaggatcagtgcctgaatatgaccttacttgtctaaaaagaatctgaacatgttggaataacttctattaactagtttatggcatcaagaaagacgacccaccttgtaagattcattccttttgtattaatggagaaagacttgtaactcttgtctcaagccaagatacgacctacaggcttacaaaggcaaaggaatagtgaaggcaatctacagtcattggagggcagataaaatctcaggcgtctcctcctctcgcctccatcttccctatccccagagactgcatctgacttttgttctgtggccctttccaagggttggggcacaggcccctctattagggtagctgacttgagcttgtgcgatcttgtcaattgtagactagaattgcctgggatggatgcctagggacacttgaacctcatttgcagcctcttgcttcataaccaggcttccttctgtgggtttggcagtggtttttggaagaatctaaaacttccatctaggctaggtaagcacggtagccagaaaacatgcagagaaaattgacatgcctggcttctttgttacagatggacgaatgccttttccggtgaaccatggcgccagttcagaggacaccctgctgaaggtcatctttggaatgcatctcttcttaatgtgcctcacaattctttggctaaattttctattctaaagtgctaacactcttccagtatagccagcatcagttgcctgggttaatagcagtctttagggctgcaagatcctcttagtaactctatctaccttattttattgcaagtggttttaaacagggcttcagagacaccctgagtaatctgtttcatgtgttgtctttagtccacagttagaattagcctgaaagctgttgctttgcttcctggtgggattaaggtgaccattgtcctcccatcagattacatcatagctaaagactcacaaaacagcagcctttcataatccctctaagacaacgggatttgggtcagtcttggaggtagtgtactatagattctagttaggtggttaaatttaggagtttttccttcccacatggtctactgttacaagaacaaaataagcagatttaaaatccacctgacaaaaactgttaatatccaggatcactttgtaaccatcctggacagaaaagtgattctgggcaaaggttggtagacgaccctaggcctcttcactaaaaaatgagcctctagagttgaatcaatttgctattataaaggaaaattgcttaattatgatacacaaaatactgtttttagcttgctgtgctgaagaaaaatatacaaactgctattaagatataactatacttaatttgagtagtaatagtataaaatctttgcagaacttactgtgtgcagaccaggactcagcaagcattttctataaagagccaaacaaaatattttaggctttgtatggcatatggctctgttgcaagtattcagttctgctgttacaactcagcagcccatagacactctctaaatgaatgtatgtagctgttttccaccagcacaggctgggttgggcccacatgctgcagtttactgacccctcttcttaggtgctgttctaggtgatctacgtcttttatagaaatcctttaatgacacagtgaggtaggtattatccccatctcagagctgacaaaactcaagagtttaaggcctgaggtcaaggacttacatggcaaactgtgattcaaacctagatagtctggcaaggtgcagtggctcatgcctataatcccagcacttgggaggctgacgcgggaggattgcttgagctcaggagttcaagaccagcctgggcaaaatggtgaaaccccatctctactaaaaatataaaaattagccagacctggtggtgcattcctgtagtcccagctgcttgggaggctgaggcacaagaatcacttgttacctgggaggtggaggttgcagtgagccgagattgcaccactgtactccagtctgggcaacagagcaagactctgtctcagaagaaaaaaaagaaaagttagtccgcatctagagtctgtgttcttagccattgtacaataccaatatgacctttctttagaaaagacctctctttggaacttcacagacctgatagccctaagatgctagtggaccacattatgccactcttaatagggaaggttgatttctctcatctgtcagacacacctgagatcagttaaagctaattcttggtattcaagaggtatgtgggaatagtaatatggaatgaagaatagacctggagagccaggatgggatggaagggtttcatgagagtcagaatttacttggtgagaataagaaaacaggcagaatttctggtctttgatccatttggaggaaagagaccctggtccttcctagtaaagcttttaaggtacatgctaactcatctaacactgcactaataccataaaaatgtgtcccacataggatacaagtgtcacatgagtagaatttataaggtgtggggaaggtaaaatttttgtatagagatggggcggggagggactcactatgttgcccaggctggtctttaactcttgggctcaagtgatcttcctgcctcagcttcccagagtgctgggattataggcgtgagccacagtacctggctaaaactttttttttttttttttttttaacttttctaattagaaccttatttaaaattaaaagagtttctaaattaaaccagcattttagttaaaattcttaccctaagtaaggctggttctatatggttaaggatgttttaggttgtctaaatgtcacactaaattattaaactggttagaatatacatgcacttaacccaaatatcttaagcttgaatgaattaggtccctgcacgttagctctatagaagatggttattctctttaaaggtacatctttaatagtgaaatcaatattgtatgtcctatagtaaggtcaattcagggaagacaggtctggaatactgatatattaaaaaacttggtagaggataaaatgttgatgtcaatccagatactctttggttgctttttttgagaaagggtctcgctgtgtcattcaggctggagtgcagtggtgcaatcatggcttactgtagccttgaagtccttgctcaagcaatcctcccacctaagtcttctgagtagccaggactagaagcgcacaccaccatgcccagctaatttttaaatttttagtagagattttgcccaggctggtcttgaactcctgagctcaagtcatccgctgcctcagcttcccaaagtgctgagattgcaggcctgagctgtgtctggcccaaactcattgagttggtgatttctaaattttaggagtgatgtttcattaccattctgtatcatagagcattccttttctccttcagggtcttatactatggtttacagagctatctttccactgggcttttttacagattgaacagagtaatatttttgatcccaaaacaattatatcctagaagttggtaaataacactgggatcagtttcctgttaccagtctttgtcatctagatcttagaagtagtaacgcatgtcacttcaccatcaatctctaaggttccatgcttgtctgtacctagaatatcaggtaaacgttaaggctgttttttttttgtttgtttgtttgttttctgagacggagtctcgctctgtcgcccaggctggagtgtagtggcgcgatctcgcctcactgcaagctccgcctcctgggttcacgccattctcctgccttagcctctcagagtagctgtgactgcagatgcccgccatcatgcccggctaattttttttgtatttttagtagagacgtggtttcaccatgttggccaggatggtctctatctcccagcctcgtgatccgcctgcctcagcctcccaaagtgctgggattacaggcgtgagccactgcgcccggccacgttaaggctgttttttaaaatgtttatttgaaagacaattttctttattccaggaatttctgagttacaacttttcacttatgccaccttatggaagaaagatcaatttccaatctttagatttgaggaaaataacgttcatagttgtgtttttgttgttgggtttttttgtttttgttttttttaacttttccaaaaccaggtacaaagtgagagaagcacaaaaccatttggtggaagtgataagtcaaatccatgatgtaaccttgtctttcccatcacctgattttttgctttaagccctggttttcaaattaatgatggaattaaagttgatgagggtgaactttgagcattaatagaccttggagcctttccctatgtgactttcattttgagctcttgctgtttggattttaatgacatttctcctttccaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagatagccacagctgattctcattttcttttaccctctcctcaatatgtcaggttattttggtagtaatatatgaatgtcttccacataagtaactcatacagtgctgccaagaattaccataaaagcattggtttgatgtgtctttggatttttttttgcatttgtattccctatgtatacctgtagaaactaatttttaaagatttttaaataggcaaattttgtagcacaattttagacttataaaaatattgaagacaaaaagaaaatactggacattgtagaagtcccataaacccaccacccagtttcctctattgtattaagcggggttttctagaggacagaactaataggatatatgtatgtataaaggggagtttattaaggagtgttgacccacacgatcacaaggtaaagtcccatggtaggccctctgcaagctgaggagcaaggaagccagtccgagtctcaaaacctcaaaagtaggaaaaccaatagtgcagccttcactctatagtcaaaggtccaagagtcccaaagctgaaaaacttgggagtctgatattccaggggaggacacatccagcacaggagaaaggtggaggtgggagactgggccagtctagtcttcccatgttcttttgcctgctttcattttggctgcactggccgctgattagattgtgcccacgcagattgagggtgggtctgcctttcccagtccactgactcaagtgttaatctcctttagcaacaccctcacagacacccaggaaaagtacaataccttcaatccaagttgatgctcaatattaaccatcacagttattgacatatcgatacactgctattaagtccatagcttgtttagatttcctggctgttttccctaatgtcctttgttttaggatcccatccgggatcccacatgactgttagttgccatgtctcaccaggctcctttgggctttgtcagtttctcagacttctcttctccttggatgaccttgacaaattggaggagtaccatcaagtattttgtaaggtgccctctattgggatttgtctaatgttagactagggttatgggttttggggaggaagaccacagaggcaaagcgttgttttcatcatatgctacaaagggtacataagcataatttatcactgattctcacctcttacctggctgaggtcgtgtttgaaagacttcaccataaactcacccccactgccttttccatgctgtactcctaggaagtcaccatgcaaagcccacacttaaggagtggaggtgtatgttctatctccttgagggccaagtatctatatgaattatttggaattcttttgggagagttgtcttttttctcctatgtaaccatttttatcagtatgaactcatatcatatactgtggatttatgttataatccagtactacctgttgcccacattgttctgctttagttgttgggagctctttcagttggctcctatgttgctttgacataccccaatcagtgtagcatgttttgtttttcttagcaattccttactgtctagaaattagtttttttttttaaaaaagcaaaagtctttggcatttgttgttaagctttactttatagatcaatgtgcccttgttttatagataaggatacactattatgtaatgtataggttttcattaaatattaaaggaggacgtctgttctcaacaatggacgttgaatgtaacagttcacttccagttacacaaaatgagggaagcagggaagaaacccaatgcttcctgcctatactgtgatcctcacaaaagggctctgtcctgtctggtgccaggaatccagataacttgggtctcaactgccttattcacagttctctaagccctgattatggtggtaatattcctgattccaactttttttttttgggggggggcataatttacagaaaatttattcat

SEQ ID NO: 15870 - DNA, 45418 bp, Human
ggattgaatcgaaagagaggtatatttggtatcaggcgtttgtggtggcatgtgaaatcattatccacgtttgataacagtttgactttttgcctgctgtaataatagtagtaagtatgtatttaacattcaatgggtaccttgtgtgggggaggccctgctaaatgctttacatggacgtacgtccttacctctatgaggtaggtggccattatgatgctcatagaggctggacagctaatatgaggcggagccggtatttgagctcaggcagtctgactctggtgcccctgctgtgaagagctgtgccctgctgcattcctcctgtagctgcacgaaagggtgtggaatcttctagaagcagtgagttctatatgagtggagtgtggtggtgggagatgagatggagtaaagcctttggtgtaaacataccatgctaaatactaggagatagaaatgaaataagaaatatttcttcctgacaccaagatacttaacattttaccggacaaagaaaacctaacatgaaacaatccagattcatatgatagaatatgaagatactgtctctacttaagtacaggtgggaggaagactggaagatgttcctttgaattaagtcactttaaaacatttgctttcaaatgttagcgcttcaccatgggcacaaaatttgtcttcctccaggcttttggcctggcaaacaagaaccctgtccctatagtcagcagattcatccattttgagttgggaagcattatcttcagccttttcttcctgacaacgatcctgacaatcgtcgtcaggatctctaaagagatgaactcattagcctagtgaaccaacagtctcagctgtttatttaccagcacattaacagtttttccatttatatccactgcctgtgtgacgatcagcctggaaatggtttgagcatagggtgggaggggtggttacacacctggttgtaatccttggtttatttttgccctgtttccatctatacttcttgagagcttcctgtgttacaggcactgacctgggtgttggggcagagtagtgaaaaaacagactgggtcccccgcccaaggcactgtcttttcctcagatttcattcgctcatgtacattttcatagttgatctaaaagcggcatttggtgtgaattctaggatttcacacttttaggataatacagtgatcacactccctttctcctttgccccagccagtcctttctgaataaaggtcgagggattgggggaggaaggcagtgatgcgaatgggcctgtggggaggtcgcacgggcttgaggagggcagcatgtcgtagcgggccatatttgtgtcagggttgggaacggcacaaggcacacctgtttcctagtgctgcagaaccctcgtcctgggatgagcctgcccgctagtctgcatcctaatcctgctgttgattggagataacttcagcggtcacagggcacctcgtctccatggcaacccctctaaatattcctctagtgacttgtgctctacattctggctggatcagagccctcctgtggcaaaatattctaaagatgttaaaagagagagagagaaaaaaaaaggctcaactaataaatctattctaaacgactgagtcatttgttttgattacccgggtgattgccaaatgttaatttaaaactgaaataggccatgagctcactcccctaacaatgctgagtgtttgagctaatacggcttgataatgagggagccagatccactgccagtgctcatgttatatgataaacagacatttggagaagtatgcagaacatcttggcagttttcctttaactctaagggttgtaaatacaaagtagaatgtgttaccatgagccatttcataggaagttgactttatttttttagaattcagaactttgcttctaaaaaggtaactttgcctcttgattctcatttttttccctaacttaggcaccttggaagttgttttcaaccatatccagcctttgccgaatacatcctatctgccacacatccagcgtgaggtaagttttactaattgccacaaattcttacactgatctccaaccttctaagttgtggtattaggggcggcattgtacaaagggctttatttgtacaggaggtttcagaaggttcattttaattgactcaaccaatgtcactgcttaccctaaatattagctctcgggggcaatgtcttttcaagggaaaatctcatttgctttcaacttgggcatatgaaaagggaatttgccaggcacaacagaactatttgaatgtctgctttaaagtaaagatctgctcatgtcgttgcacgaacagtagggagcaggaaagctgcatggagcaaatgctgggatgggacagaggagactcctgctgccagccacgagaaggttaggctgacctgatcagctattaggaatctttctccctgggtggaaggagccaaggtgcaggactggcattgcaaaatctggtgatagaaggccaaagagtgcttctgctcggtgacattaatagggtccaggagattttcttctgatttgccctcaagttcagaacaacctgtgggaagccagtgtaagaatgcttatactggataagcgttctctgtcctcttcatttagccacagtggcttgtttatactctgtgatgactcagggttcctcaattttctctttgagagagggacattgacctttgaaaataatgaaggaatctaagagaaggctcatccaggcacgatacagtaatggtccctcctttttggtgccccggtctctgtgcgctcacaagagggaatgtaacctttgccagcaccatacctgtcaggctttgccatttcatccctcaaaaggttgctgcgtttttgccttcaccttcaccctgcccacccctgcatgcagccacatggtcagtgtaggtacttagatttcagttagggtacatgctcagcaggtgacaagaattgcctttgttatgtctacttgctacagaattctccccaggttttaaaatatatatcttcaaatacctaaatgtattaaaccttaaagagtaaaaagcataggacaaacttttagaaatgctaaacctgaattttatccatttcatcaattatggtggtagtcggaagtccttccaaggccctcgggcttgaagcaagctcggtgatacaagctttcagcagcttccctctgctgctggagatggaatcttcatttctgggtctaaatcctgccatagctctcattcatagcctttacctataatggttgttttcaaacttaaaaaaaatgatagaaacctatcttcaaaaaatacaaatctttagatctaaccccaatagagaaaaccaaagctgaactgctttggctcaagtaggaggctgtgactctctgtcaccctcctctaagggtgaaccctattgaaagagcagagattttagctctgtgccctttcccagctcttatttttattttcccacagaagaggctagattctttaaggagatataaagaagggagagagaaagatataaagattctttaaggagatacaaagacatcctctcatcagctggaaatgccagctaggtgagacctgactatgcatatgcattgtttgcccttagtaattccatagcaatctgcaaattcaatcagcttcatcagcagaaaactttgatagaaaccatgtgtaaaagggctgtgttcttaaagtggaacatttaaatcgaagtttttcaagcacacatttcaagtggttttatgataccaagcacaccccagtgacatctttacattgaccaaaacttggtatccttgggttttcttttaaagcactgagtttctcaggtgtgtcagttgaatagaatctgctaaattctgttttttttatttttttaaattttttattgatttatttttttttatggagtcttgctttgtcgctcaggctggagtgcagtggtgcaagtgcagtggtgcgatctggctcagtgcaacctccgtctcccaggttcaagcaattctcctgcctcagcctcccaaatacctgggattacaagcgtctctacatcaacatgcctggctaatttttgtaattttagtagagacagggtttcatcatgttggctaggctggtctcaaactcctggcctcaagcgatccgccctccttggcctcccaaagtgctgggattacaggcgtgagccactgcgcccggccaaatctgttaaattctgtttccatgtaacagaaatatataggattacacaactgcatcttgtgttctttcttcctttcttttattcattcattcagccctactatgggccagggcaggaatgtagtggtgagcacaaaaacaacaaaaaaataccttttgggtttgatattcttcaagggtgggacatgcctagattattttctcttttgcagacaaggaaactgaaaattgctttgcttttctcaattacattgcccagtattcagtagacaggtatggatgcaggggtacagttccaagtccccatctctactctattctttgagcctatgatttatgccacttccatataagcatgtgcaaataaagtattcagtaattgccatggatgcagctgtccctgggacccgaaggccctaaaatgaaaataaatgtaaactgtgcgtttcacactctatttttaaaacgtttgtttggaataattgaatagtttagtaaaatgggctttgctgtttccacatgaggatatcttgttcttttattttttattttttttgagacggagtctcactctgtcgcccaggctggagtgcagtggtgcaatctcggctcactgcaatctgtacctcccaggttcaagcgattctcctgcctcagcctcccaagtagctgggattacagatgcgtgccaccatgcctagctaatttttgtatttttagtggagacggggtttcaccatgttggccaggctggtctcgaactccttacctcaagtgatccgcctgctttggcctcccaaagtgctgggattacaggcgtgagccaccatgcccggcctattttgttcttttaagtgatggtgtgtccccttttaatacagtatttatcatagataaactttattattcagaaacttagaattattccatttggctgccttttagtttacagaattatttggaacacaagcttgaacacataattcttaacacatacgtgaactgggctaaatttgagtatttgtaccatagtagtgacaatattgttaattaaacatgtgtttcacatgtaggagatatttgtatcactgacatatggtcattttcattattgatttggcagttttttaatattcacaaaacacaaaattttgaaatacagtagtcaaagtgatttgatctgtgccatttgtattgatgtaacctctcttcttggtgcactagcaataagaaggagaatcagcacagatgggttacacagacttagaggatttggaaaccatcactttagagccaaggtctcaaactgatgggctggatctggcacacagaggtgttcttttaaaattttaattgccagcatttaaaaattgaaaggtttcatattttttgaagtccaaatttttcagcttctcttgaaatatcagaagatctggcaatattgagccctcactcctgtttggctacactaggctggagccaaatggctgctgtttcttttctttttttttttttttttcctgagatggagtctcgctctgtcacccaggctggagtgcagtggcgtgatctccgctcattataagctctgcctcccaggttcacgccattctcctgcctcagcctccccagtagctgggactataggtgcccgcaccacgcccggctaattttttgtattttttagtagagacggggtttcaccatgttagccagaatagtctggatctcctgaccttgtgatccgcccacttcggcctcccaaagtgctaggattacaggcgtgagcccccgcacctagccagctgctgtttctttagctagagcatgaactctgaagtttgccacagtctctggcagtatctgtaatctccttgacactaaggacaagggttggttgccattatctgaatgtttaacccctatagacatgtgagttttcaatcccaggtctagataaaattgaggttgcaaacttaaggtcatcctttttctcaagatatcagcttgctaattttcaggggcacgacatagggtgacagtcatattaaggaggtgctttaaaagggttgagggcaaacatttcagaggaaggttactttctgatgatggtacctgattaagaaaaggatacatcgacaggtacgggtgatttattttattctggcagattcctgtagtctactttggtgcttctcacactttaatgtgcagattctgatgcagcaggtctagagtagggcctgagatcctgcatttccaacaagcgccaggttataccactgctgatctgaggacctccctctctttgagtagcaaggggactctaaaagcaatcctaagaaaaatcagtcaggcagtgatggtgctaatgtttagaacattcacttttctctagcctgagaaagaaaaagagatacgaaccagggtattttgggttgaatcttcccagataaatctggatctactttgagttggagcagaggagatgaaaaatcaattattttcaatacagtatagcacatgggaaagataaatctaactctgattttaaaatttgttttaaattaagtgcttctggtaaaaaaaaagctagatatgctcaggaatcatgaaatgtagggattagagcttttaattttaggaaaatatggggctgttagcaaacttgtaaatcagaccacagaaaataggataattatcaaatccctggttatatgataaccttgtaagctataaaatgattttaaaaagttggaaagaaagaaatcaacagtttcaaatatatacagtcctatattgaaaagtataattaaaatgaaaaagcacaccaggaaaaatctgtggcacagatgacaagatacataatttctatatcatgcacagacctcatacagattgtaagaaaggtgcgcacaggcctagcacgtggtaggtgcttcctaactgttggctgaatgaattatccaattgatagatgggtaaaagacactcaagttatatcacaatgtaaagaaatgcatggaaaacactcagcctcactggtatgcaaagataagcatatttgaacgtcagcaaggcacacttttactaagttagcagaattacaaaaagaaaacacaatgttaatatggttaacttgaaatggatatgcacttattcactgctggtagcaaagtaagttggtacaaagccttttggaacattgtttggcaatatatgcctaaaggcacaaagattggtaccctttaatctagtaatcatactttgggaaatgtgttctgagaaacaaattattctaagaaaagaaaaaaagctgtgtaagcattcatcacagtgttatttgtgaggacaaaaagaaagaatttaaatgtctaatgtgaaaaaaatagttcatttattcaataaatagttttgattgagtagattatgatacatctatgcagtggaatttcatgaatctgttaattataattttcacacttacattagcaatatgaaagaatttgtataatacagtcttactaaaaaatgcaggatgcaaaattgtatatatgctgtgattgtaacttgcaaagtgatatgtacctgtggacaagaactagaaggcacaaggaaaaaatgtaagtatcactttatttgaagttgtattcatgttgtgatgttgtttgtacattttgctattacttagatgttgagaatcttccacttttatgtacttaactccatatcacaagccggatattctaatctatcacagagtgcttagtaagtaaccaagaaacatgaggactcctgtctagagcctaaacatggggttccagtgctctagttccttctcgcttgttgtgtttcatcatccagagcccccatttctctttcttccgtatttggtggttggtagaggcatcttggtatataccacatgacaccaagtataaatatttgtttcagagcttttaatgaatgtctagcagtgccaggcagggaatgaattttcatgtttaaaggtccagtgtccacttaaggaacatcttaatggagctacagctcaagagcaagcccatttcatcttctgatttccattagataagcaacaaaaattggctttaaggtcatgagcctccttacagcagtccctctcaccttcagctgtattccctatttcagatatacttgtttctctgctgtaagtacacttttcttttctaattaggtcagttacttcatgtctgtttttcttttttgacatggtttcttctggctttggcaccacatattttccccatatgtcattgcctctggagcttcatgttgcaatagtttttcaaggggaacggagagcacattgctaagggtgggggatggcttttgcctcttttgcctgccctttgcttcagtgagtgttcgtatttctgttgggcctagttctgtttggttttgtagtcttcagagtcagttatgtttggactgaaagatacttaagtaaaaataatggcaagtcagagatatgtctggcaaaggtgcagcacatttgttaaggttactggtttatttatctcccttgtctctatggtgactaaatctgggtctgggatttaatggacttagttttgacctcttgtaacatctcctaacttttcccagcctctgatttagaaagaattcattttcacttgaggagagaaactgtctcacttagaaaaggggtcctaactggactctcgaaaagtggaatctctagtctttgattcttacacagtcttcaaccagagtacccattgtggttgtaaagaaagctaagaagtcatgtagaaatacacacacacacacacacacacacacacacacataatgtctcaaggaaatacttttctttttagtgaaataaagtattatttagttaatgtgaatgaactgtctgtaaagagaaccttttgtcagaataccaaatcaatggaaccattgactggacattatgtttttattttttaaaagtatctcctttacccattacaggattataaatttgcacacatataaatgtttgaaccatatttcagagttcaagtgtattaaattgtgccatggaagtccacaataaagattgggtttgaccaggattctcatggaagaagtcagatttggacagctaagttcaaatctagtgttccatcttcacaattgatgtgaaatgaggacatagatatctgatctctaaggtaggtagagtcaaaccatcttggacttcagttggttcaaatgagcctttaaaactttttctcttctcctgtatggtgctttgagacttataaaaacattccagctgtaagaatttactaatttgttcatctgtttacaggtcttttcagcttctctaagaataagctcacatgtgaattttctttgaaaccccaaaacaaaggagtcagtaaatgattgattatcaagtattgcacagagactgaggcaagggaagtgacaaaagtcctcttctgtccttactccccaagtataaaatattagagttcagatctgtcatcaagtttagttcaagcccaataggaacttgtgattacttagtaaggtttttgaacatcataaaagttcagtgcatatggaagttgttgtaagattttgtccatcatgaacgctcctattaataggcaaagatttgagaagccaacaacagatgctcacttgtaagagagaaccatgcctgggagatgaatgttggatgctccttaacttctgagtttgaaaccttgactcacttgtcttataaccgtggacgtagaatatttgttagattaaggtcatagctaagtcatacaaattttattatgatcagtacagtaagcatagctggggtcaaagcttttatggaaatcacaatgttaaggcctgaagtccttaataatgcttgagaaagaatggcacttttatcatcatcattatcattgtcatcatcattattatcatatcaaccttatatcacatgttgaaagcccagtgtggtgaactgtgctaataattgttataatttatgtatttcattattgatatttcaattttgtttgaacaactgtagggatcaatttaaaataaaaaggaggaaatatataaaaatgtatttagaatagtagcctcattgtcctgtcttatcagccagataagctttgtgctttgtagagcatctctcactgaaggatacctaattattggataaacaattagttctttaacagttcttaggctgggtgcagtggctcacgcctgtagtcccagctactcaggaggctgaggcatgagaatcgcttgatcccaggaggcagagggtgcaggatgcagagatcgcacgactacactccaacctgggtgatagagtgagactctgtcaaaaaaacaaacagacaaaacaacaacaacaacaacaacaaaacccaaaccaaagaacagttcttcacctaagtagaaaagcagaaaaacaatggtttgaggtctttgtgagtctgtggacatctcttaaaccatgtgtgagaggaccatttctttttctattctttttttttttttttgagacatagtctcactctgttgcccaggctggtgtgcaatgacgtgatcttgcctcactgcaacctcttgctcctgggttcaaatggttcttgtgcctcagcctcccgattagctgggactataggcgtgtgccaccaggcctggataattttttggtatttttagtagagacggggtttcaccatgttggctaggctggcctcgaactcctgacttcaagtgatccacccgccttggactcccaaagtgctgggattacaagcatgagccactgtgcccagccgataggaccatttctgtacacattcattagggctacaaattcataatttccataaggtactctctgtgtttctttcccaggaccggtagagtttttcctatgggtggtggtgagagtttgtgtacataattgtcagcgtgcacaggcatagggatttataatccagagggtcttttgctccctacagtggttcaaatggaaactaattggagagggtgagttccaccctttgcattgggctcatgggacaggtttgaactggaaaacagtacaacatgctccagtatttttagcctatcccttatgttcccagctctgccgtttgaactgtcagttctcatagacttcacataggatcttgacctgacttttggtcctctcgtgggtgttttccattttccttactggggcaatctaaggcacaaagagtaaaggatttggtcagagttactgtcttaaattgtactctgctttctccaggaaactggaagcttctgaggagcaagaagcctgatgtttcctcttatgtcctttgtatcatttattatttagtgccagagacttagtaggcatttgctagagatacaattaattgaatgaaaggcattatgtaaattacaaaccatagcattaccgtggtattacacaggactgtcttaggatccctgttcctctaatatccatattcctgaattgttggaggatatgcttgaatagaacaatcccttttccttcactgtagcatgacattatttcttcccggcctgttatcagcaagtttttcgaacagaaaagttgaaattatacagtgaacgctcctattcctaccacctagagtcagcaattaaacattttactatatttgctttatcaaatatccaccatttacccatcttaatttttggatgcatttcagagtacgctgaaggcatctgtacgctttacccctaaacacttcagctttatcattatgtggtttcaattttgactttcttagagctgctttcaaatttgttgagatcctgacatttattttggtggtggctaagaagacgtagtaactcaaatgtgcaatatgctcagttttcagaccctgggagtttctctttgtttgtaactaccagcaagtatacggacacatacatatcgctgtcccttccccgcttcgttatatggtcacattatttgtattgttgaaatttggaaagccagcctaggaaatgcagttgaggggcttgtggatatgaatgaaatcaaagaattggggttgagaatagtagggcaaaaggttagagttagctactataaagggaggatagagttgggtataaggagtggggaagagattcagatcaggaagttatcagcatgataccactttcatatatgaagtctagagagggtttggtggctgttcatatgacctaaaggtcatggattgaataaacactaagagtgcaaatagtccttccagtctagtggttttcatattgtattccatggaaccctagaatttatagacatgtctcagaggttttaccaacatttgaattatactttcgcaagtatattgaactatttttaaaaacactaataagaaaacccaacaaaaacacttgactgtgttttatagaaaattttatcatcctggagaacacatactgattgactttattttattttattttatttattatttttttgagacagagtctcactctctcgcccaggctggagtgcaaaggcgtgatctcggctcactgcaacctctgtctcccaggttgaagcgattctcctgcctcagcttcctgagtagctggaattacaggcgcttaccactacgcctggctaatttttgtatttttagtagagacggggttttgccatgttggccaggctggtcgtgaactcctgacttgaggtgaccccacccgccttggtcccccaaagtgctgggattacaggcgtgagccaccgcgcccggccctgattgactttaacataagtaaaggttattaatgtcaacctaaaataaagttttgactaacacttatctgtcatccatcaaagtcggggtagtatttctatgtgggaataaagacaaaaggtccacagcaggaccattacactaaagccatgggtgttaaggcattggcctgcaaaagctgaagttacgttttggtttccagttaccatgagcacttatccatctgttatatttagatttttttttctagtacctttaggaatctgcaaacagacgagtatctgctttaaacttgaaacgaccataaaaggagagagatggttaggatgccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactctgacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgaggactaagttgatctatgcagggtctgagtccaaaccctggtgtcaaggtgttaagtgcaaattattattattattttttaaagaaaacactcttgttacaatttggacagagagaatggtatggagatgaaaggttctcgtgtatggcttttgctcctatttatgtggaaagcacgccctacattctttcaaagctgtgttgttccctttattctcagtccccagaattgtgtgcaaacacactctcttggcccaggggtttggctgggtgtgtttccttctggaagtcttcactagcactcttgagttagctggcaggagatcccttaaaaccatttccaagcagtttttctcacttccctataggggctaatcctgtactttccacttcagttccagctgctgttgcttgggaagaaacaaatttctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctcaaaaaaaaaaaaaacaaaaaacaaacaaacaaaaaaaaaacagaaaatatattttgggcagagattagttgggggatgtgggtgggaaacctggtgattagatatatttaaacgtgtcatgtcagtatagagcgtgaattaaaaataaattatatttggagagttgtaagaaatttaccagtcccttcagacagacacatgaccctttaaaactcattaaaactccttggcacaatggaataacatgcactttggtcttggaagaaaccattaggttgcaatgtttttgatttctctaccactgacttgctctttgatcttggaaagtgactgacttgtcctgtgattgtttcataatcacccataataaaactgacttactgtatatagtgaatagttaagtttaaaactatatctagtttccgttatagctcaagtttatgtattattttattagcgtttagatgttaacattaagctttcaaatcagatgaaatttaatttgaaaaaagttttcgtgtatgaatactttatattctgcagttcatacatgcagtaccacccttaattaaatgatatttccacaaatcagtttggaagattttcttcctgcaaaatgtatgtttaaaatacataaaaattgatgggaccatgtacttatggctagtcggaaagtggaaagttttttagatttatgcttaggacaggtgatagtacttgagcttctattcttagtttgaccttgcctcccccacccccttaaagcaagacacttaatctctttaatgtctcagtttattcatctttaacacctgtattcttatttcatgaaaacaatacctggtttatatttggtagcatttaaggacttgatatagaaggtggtatggaagttcaaattatatagaaagtatttgtatgctgaatgataatcttgacaaattactgattactacatttagaaagttacaactctggagggaattgatatttgatattgttttcctgtgtgttctaagttaccaccataacagtaggaaaataaaccctatcctggctgtgttacaaagggattaactcacttcttcaagttgttactaaatctccagccctttaaacaacagaaataaaaagtgttccttattttaatttttccgaaatgaaagtcctataactaaccttggcttaattttttcttttgttgagggctttccaagttattttctttgtgaggaatggaggctaaaccatgtcagttgcttgaagcaactaaaaataccccgtacaaatatgcagaggagtatgcttttgatttttagatcaaaacgaagaagcaagattttatggagcttgcttattatacatttattatactgagctacttgtgccttttcaaataattaaatattaactaaatacaagaggattaaatagctagactttaaataaaactaaaatagccatattagtattttctaaattctgtatcattgaaagtttaggctgatatgaaagagagggaattcctatcatggggattgccagtcttttcacaaagacctgccactagattttgtagtatatgataaatgtgtgtgtgtttattgtgaaaattgtgtgagtcatatgaaaaattaagtctacttgaaaaatcaaaagacattacctacttgggtacaaagcctgatttatatatatatttctttaatgaccatattatgttatgttaaagtttgtatagtacttggacatatattatttaatttcattcctaaaacaattcaatagggaaagcaagacagatattaatattcccatttcatagatgaggaagaaaaaataacttggcttgtaagcaattcagcagagtcagagattgcatttgagatttttgattctaagtctagtgtgctttccttgggttacaacacaataaagtcaaaaacatttactgttattttcattaattgaaagcttaaaatcaatttaaaattctaacagtataaaatttaacagtataaaaatattgttaatttaattttatgacgttaatttttaaattgatttttgaatttgctaaaagtgttttaaaatcagtatcctgtttcacaattcctgaattaatctcttctctgtacatttcctgttccagtatgataatttatataggctttagcatttacttatggtattaaatgagtagacagttggaagggaattaaaattaattaggtcttgcagttcttataatactcctggtttgccacactgaattgccatgacgtggctggggatccctgttttaacatctaacaaagatagctgccagtgtacttaattttaaaacggtctcatctattaagctgctttataaacatcagccccttttctgaagtccgaagttagttttttaaaatattcactgataatggagtgggggtgctggtgacgtttctctttcttgtttatctgtaaagacagggaggtgcaatctaagttaggaaattggtgacaaatagtcatagaacatgggtcacctggcttcaattagttatgtgacctttaagaaaacaagtgcccgtttcagaaaagactgacctttgaggctagagacatcaagctactcctctacttttaggaaaaaacaatgacagggttaatttaaaactctgatgcagacagagttgaaaaatccatgacagatttatataacgaacgtggatggtgttttgttttcccagaatgcagttttaaggtcagacctatgactcagagctgtgcacttccctggtggtatgcatcagtgacatgttgccagtctaatcgtccagaagggcttgtgcccagctcggcttgctccattataatccccagctgagaagccacctttcattttttttaaatagataaggaagacagcatgaacatttgaaactcaaatactatatgtagtttataacttttcagcctgaagacttgatgcacactaagttgcctctttaattttgagaagtataatctccattgccactaatccatcatggtgtggcactgcatgaggatatgttgtgtgcattgtcagtatcggcgttttgctgagtttactgttttttagttcattggcaaggcatcgtgggttttggtgcaaagagcatggatttggaatcaaaagccacttcctctctgggtggctgattagctgagggtaaccttcatatagctggcatgggatttccagatggcatcctctctgcatgaacaaaaacaatgtgccatttcagtaaactttggtgggtgctccctcatccactccagatcttttcatctctttccttttattccctccctttccttgtaaatcaaaactcccattcctttagtgctgctgatctcttttgggggttagaagaaagcagtctgattaaactaacttactactgtttttagttggttcatcctatctttaaaaaatgtatatatttcaaggctgggtgcagtggctcacatctgtactacccagcactttgggagaccgaggtgggtgggtcaggagttcgagagcagcctggccaacatggtgaaactcttttctctactaaaagtacaaaaattagctgggcatggtggcacgcacctttagttccagctactcaggaggctgaggcaggagaatcgcttgagcccgggaggcagaggttgcagtgagccgagatcgcaccattgcactccagcctgggcgacagagcgagactccatctcaaaaaaaaaaaaaaaatatatatatatagatagatagatagatagatagatagatagatttcttacagcattgtgataacaaatatttgtcaataagagactaactgtggtatagctttacaattggatactatgtacatgttcaaaaagtagaagctctttacgtactgacaaggaaaattctctgaatataaataaatagaactagcaatagaattaatagaaaaagcaaggtgcagaggagtatgtatagtataccactatttatgtttttttttttaaaagaggaaaaagaaaaaatatatagctgcctatcttttataagcccagtatctccagaagcataaagaagacactggtatcattggttatcagtggagagggggaagtagatgtctggggatagatagggggaagaatacttttcactatgtattctttcatacttcttcaaaaatacatctttggaaataaacccatgcaaaaaaaagaatgttcacagcagtattatagtggctaaaaagtggaaataacccaaatgtccattacctgatgaatggttgaacaatatgtggtgtatctgtacaatggactattattcagccataaagagaactgaagtactgatgcatgctatagcatgaatgaacctcgaaaacattatactaagggaaagaaatctgccacaaaaagctgcatattgtgtgattccatttttatgaaagcattatgctaagtgaaagaaatcagccacagaaggccatatattgtatgattccattgccagaagtggcacatccataaagacagaaagtaggttagtggttcccacggggtgggggtggggtatgcagagtgatggctaagaggtccaggatttctttgggggtgatgaaaatgcagaatcagatggtggtaatgattgatatacattatgaatatactaaaagctgctgaattgtacactttataaaggtgaattttatgatatataaattattttaaattttacttagagatggggatctcactatgttgcccaggctagtcttgaactcctggcttcaagcaatccttctgccttggcctcccaaagcacaggcatgtaaattatatctcaataaataaaataacatagcaaaacaacttgaagtcatgaacatggaaacttaaagaatcactgtgaacatataaaacaaaagttttcacctaagaaatgtttttattctaaaatattttacatattatctctataatgacaaaggacttcatgttctttagctaccttcactcacactcacctggaattatttcattttataagtgaagattgttaacccaaatgaagccctgattgataaaattttgggtaaaataactaaagaaagaatgtgtgattatctggaattgagatgttgtagctgcaggccttgcccaggctgtgccagtaggagaggaggtacggagcctcagagaatcttttggaccagtgtgccctttctctcctcacagctcatcccagagctgtccctgcctccttaggctgatatgcccctgttcccttccttgtgttctcctgcagtgagctgaggcacagggtttagggagcctattatgataggaggagattaactttggggttctgggatgagatctgtggacctgaaaatatagcctctctgatcctagtcactaactgctcatgcatggagagtgacagctaagaggtccggggtttcttttgggtggggatgtgaggtgctgggtcattatggacatacggcaatggtctgtctacacaatggtcagataatagtcttcttacagtcatcccaactctagatgctttagccggagttcatcttggggtgggtatgggggattgaccacaacgtgtttttggtcaagagtcgggtagatggtgcatattttggttctgccacccctgggaccttgggcattgctgtactcacccaagctatgtctcggcacaaacagcctcatctcctgagctgtagagtcatttctgtaagtggcttgatgagatagggtcttttagatccatgtccttggcatttattcagaattaactcacataatatgatgctaatctgcattctggctggagctgcatataggtagcctcttttcattgttggcctttatagccaacttaagctcagagatgtgaatcaagggtggcctgcctgatgaattagtgcttataaggtaaacccttatttgttgtgttggaaagtttattgactctagccagaaaaggtctaattagccactgggccctttcctggcagggaggatgtagggaagaccctctgcagctcaagactggacaggtgacctagacctattgggtatttatttcattagaggatcaatagagcagagatttgttctccccaggtctccatcatctgttcataaaccctcctgacccatgttgagtccacagctgtctccactgggctgtcaagctgctgaggccaattcctctgagtccctaggactttgagttttgctctctgctgccccagtcattctcaggcccatggtccttgcagctgggctcttggccaacatcctgagcccttatctcttttccacatattccctgtgaattagtaaacttgataaattctatttgtaggaatctgctgcttgggtcggccacatttttagcgtgtagttgaattaataatatatagtgcttactgtgtgccagccactgctctaaatgttgcaaatatttactgctgtatttctcacaatgacccttttacataggtactattatcatccccattttacagatgggcaaatttagtcacagagaagttaagtgaaacttgccaatgtcatacaaccagtaagtgatagaggcaggattcgaatttagatattctggcttcagtctgtgctcttagccactgcactatattctcttgaatcattataaaatagatatactaatctcagggcaaatttcctactatttgtcttggaactaaccatgttaattgttcaaccaatctcatataaagttaagccttaaatttctttcatggaagccttcaaaaatagttatggtccagtctaaaccgttttacctgaatttcattgaatgcaataggacaatcactccttgtttcactctctgtaccttagataatctggtcttatttataccagttaggtacctacttcccatgtttgttcttgttgattatcattggaaatgagcaagaagggtggggatgtgaggtgaatggggtgtgatctttccacgtacatgtcctttgatggcttctgctcctctagctgcagactctccttgcgttctcctttctggacttcgtgttcctgtcattctgtttcatgtacttgctgcctggcatggtgaacttgttgtttgacttcaagggctttgaaatcactcactcttgttccttaagtgtcagctgtttaggtagagcctctgcttccgcatccaacctagtccatatctctctcagctctgcgtcaactactgcttccaagttagccaaagtttatccataaactttgtttttctttttaagtttaatagggtttaattgagcaaagaacgattcgcgaatcaggcggcctctcgaaccagagtaggctaagagactccagcattaaccattaactgtggctgagataacttgactggactcttgctgctgcatgagagaatctgcaaaatgtgtcatctacacacacaactgtcccttagtctcagggtctgtgacccagcttaacctctgttgatgaatataaagtcaagggataacaaaccccctttaccatacatagcattcctaaggtttacattgtcatgagtaaagatcccttgctaatacggtacaaggaatagtgccttcggagtccagacactcagcttctagacctggagcagctgttaactcagggaagcaggtgatctctccatctctgggcctcagcttttccatctataaaatgaggtgattggattaggtggtatctaagaccatttccaactctatcatgccatttttatgaagctggagacaccctcagacctggcccactttatcttcaggtccgccaatcctctccaacttgtggaggagcctatactctgtccttaccatgcacaggttgacgaacagggaagacaagctgccattgagggtggtaatctaatggcagaccacacaccaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatttctggttataggcccataaagtatctgtaggatgtggttaggatagttcctacctcttggtaaaagtctagtagtaacacaggaagggcacagactttggggacaagagacatttaaaactgttactgatcatgacattaccaaaaatcaaaagacaggggccatggctcatgcttcgtaatctctctgtgaatattataaggaaaattctaagccctggtcaactgtgaaatgaacaggtcttcagtggagttaattagcattttccaggtgctttgctgtttacagtgtcctttatttcatgtatcttctcatttgttacaggtcttctttcataccttttccttttctctgagattcagagaccctttggggaggctgaatttcaggtttgttttcattaggaccttacatgaccaaatcccccctcttggggttccaggggtgctccttcattttactctctgatgggtatgccatgaattgtgacatttaagcagtgactttgcaaaattggacgtgtcagtaggaaaaagtactcttcccaccttaaagattgacaggaacatgagatggctgaagctgttctgagcttttttctggcaagagtacataggacaagaaatactctggagagctcaacattgaatcacatcatatcatagtgcatgactagttgccttaatcttgcagttggactcactcaggagaaattgttggcagagggattaagtagcctgacaaaattatattgagaaaaaaacttgcagtctattaatttattagtagtagatatgagggaaagaagagtcatgtaaaaaaaaaaaaaaacaactggacatgaaaccacggagaaatccacaaagactccattacagtttgttatcagcctcttgcccctggccatgactaatggccagtaattgtctgaataagtttttaaccatttggaaatttcttcaggaaaagaaaaatctagtaaagggagaagggtgaccacaagtcaagctgtgaatgaggaagtcctgaaatgtgggctaagtgggtcactgaatttgccgtgtttgattcttcggttgcaccactttgaacttttgaagtttgatcctcccagtggtgtttctgaggtagagaggctaggattagattgcagtgtgagaaatcccacaaacgtgattctactgtaatcttactgttctctctcgctccttgataactgggatcccattaaagggggttcattattgacatctcagaagaaactcattgtgaagtctaaaataaagtgccattcttccctacaccagctctgcctcccatattccccattattttcccagtcacccagagtcacaacctcagagagatccttggctccttccccttctttcagttcttgtagccctgtcacagtgtcccttatatctagtttttcctttccatgcccattgcccctgcctctcattctttcagtctttccttgcatctcagtggacaattgcattaccctgtgctgtcttccctgcctcctctcttctctgagatctgctcttcttatcactgcttgcatgactccatctcattctccccttgcaccagttgcagaaagatcctccgtgtgtggctttccctcctctctagctttcggtcctactacttccttatcttgtgcttctgtcacaccccaaccccccccagctgcatcctgcttcttgaacacgtcctgtgtttttctcataccttaggtgacatggtaccattttcttggaacactccctcccccttgtctgcatgccaaagtcttaatcattcttcagggaccaggtcaaatgccgtgacatccatcaagtcttttctcatctccaaaccagatgtgatctctccctgtgataaatgtcagtaacactttatacctttcttgtaatacttgtaaggctctgccttgcatagtagtcatttgcatatttatcttgttacacttgaaagtaaggactgtattttattctttgtgaccagtaaaataccttgcaccacatagtagggcatctgtccaataaatgcttgtcatatacaataaagcaatggctggggcggcattatctacaggttaacccaataataggtcataatgtatctgcagatagtaggaccataaggatgtgtagataaaccctgaagtaaatgattcgcagagggtcacatggaagggaaacagggagtttgatacctagcactcactgaaaaaagcgtccggatactgctagagtgtgagactagaaggcctgaaatgtaaccatcatacaccaaagagagttgctcccaaacaccagccaactccaccaatagtatataaaggtgcgttgtaaacagtacagtgattcttaaagatattattaaacatcatactgttaatatataacaagattgactaatatgccaatgaaacccgtgactccaggtacctgtgaaatagccagcaagggttctgagccactgatccaagacaggacaaagttaccaactattcttcctaagaaattgtttctcatcatgcaaggggctgtttctgtcttggttttgtggaaggtctaattctgtggcttgaggacatctgcagtagggccagatgtcagagcaggtagtggtcatgcttcatgaagtttttaggagggcacagttacctggttgatgcaaatggaagtaactggaataaatgctattgttgcaggcccaagctcccagtccatcctggctggtcatagttgactaattcatggtggtcaaaaagtgattctcttgtctttgaattttctcttgtattttaggcaaaacagatttgttttttgatactttcataaagctgtctatccatattctgttgtcacttttcaaaatgatcagaaacctaaagaactaccatacttgcctaaaagaagacacttcctgatgcatagcttgaaacaggaattgacttcctaaaggaaagtatttggcacaccaagcctattgttcacagcgctgcaagagaggcatttcaacatacatgggctcttcctaaaaatataacttgctaaaataaaaaattcagggttcattaaggttaatcatctaataaagtaagagaatttcctctaggtgaaaagtttcagtttattttaggggtgtggtgttgttacaactggctaatctccgcaccataatttaatcaggctggatgagaaagagactagaaaggcgtggagccagagcacagtgtagcttctcttcttttcccaggcttatttttttcctctaacatgtaataaatttactcgtaacaacctggcttttattgtgtcattttctagctaactgggagttactgatgtcagttgtcttttagaataacttttccttaaacatttgaagatcgtaagaattggggaactcattcattcatttattcatggagcatttactgctcacctactgtgtgctataggaacatgaagacaagcaaagcactgccctggccctcaacctggtaggggagatgtgtgaatagggccaaaaccacttaaacaagacagtggctataaaggtgtctgtaccagcgagaaggtcagctgccttccttgaagttgagtggccaaaaccactttcaggattgcaggtgggactatgttttggaggcttgatggatttttcagttatttagttcattctttcaaggaatagttattgagagcctcctgggagctgggcagtgttctaggctctggggccactgcagtgagctccagtactaaatccctgccttcatggagcaaagcaggagatcagacagcaaggagagaaatcagtgcaataccagcagacttgaagtagggaaaggaacaaccatgactctgggcacaggggacagtgaggaggccagtgaggtgggagtgagggaaagggggctaagggtaaggccagagaaggaatgtggaagaaggtcctggagggacttgggggctttcttttcctagaacatgctcctaatagccagcccccagacatctgatggcctgttgagctattacaacattttaggttgatgtcttcattttcattcatgtttttccttttattgtccctgatgctgaaaaacaagaggttgagtttgtgagacaaaatgtcttcattgtgtgtgtgatggggataggcatagtctccccatcttgttctgtgctgtctgccgttaaggaggtggggagattacgatcactctcctttcctgtacagtaatctgctgatctctggaacatactaaggaggacatagagtgacaacatctataatccccttaatctctatattcatactgtctaatctccttgagttacactggtaacataagtctatctcttagagttacttttatcattaacagcacaaaaatgtattatttacagggccaaatgcaagctcttgaggcatataaagtggattaataaggttggctcagcgttaagctatgccagagccgagtccaaattttattccggtacagggatgactttctatgtggcctctctggctctggagctaatttggatgctgagtagccccgcaggtatttatatgtagcgtttggtatttttactgggtcctattcttctcccttggatcacctaaaatggttaagaattttctagtgggattaaggttgtgatctctggggaggggtgggacatctgctctcggttatttttgtgttagccgcttccccttaaatgtatgttcacaaatgagccacagccttatcagctggggttgagggaagactggtctaggtgctgctcctgaacttggtctctgagccatggcttcccatagacactcaggtaaaacttcatgctctttatcttatattgagcacagttttgttagggcagtgaatccgtcattgggctaaaagatggtttttgatgaaatgattttagtcttgtctgaatagtaaataaattatagcttgtctctgttttgcctttgcctttcatgctatttcaaagacaaaatattgttcaagtacaatgaacagtttgagtgatttattttaaaaagaagtatataaacatgttaccactatatttttacctttttcaggacatctcatgaaactataagagattgtgggaggaaaggtttttctggttaggaatttttggctttcttttttataagatacaattcttcatcttgacagtgctttacatccaaggtgtttggagaaggtaaatcgaatgtggagctgaaaggaggaacatttgtaactaagaaagtccataatgacctagcacatcttcccttttgctgacaatgttttaaatcttcccgaagtaacagctatgttccttttgatatgctaagtatgttattaattgtttttagcagaaaaaggggcacattttggactccttgggacatgagcattttcttctggttttgtaaccttacaattaaggaagccctttggccatcgacaagaaatctatgaactaggggctgaggggccaaaagcccagttatttgaagccaggagggtggctgtggccctgtggccctctgcctaagtaacggttccctttcttggggctggtaaagtcagacggttagatataaagaaggcacttcatcctgtctcccagctttcagattaagggatgtcattatctatgtttttttttttttttgaaaaatcattttttaaaactcattgcctgtcaatatttaaacaatggaaatactttaggaaatttctctttttggggttttaaatatgctgcaatggaatgccctaccttaatgaattaatatgtaatgtcttccctgttcccaagtgttcaaaagttgtctggtttttttttttttccaaccctcaggagctgtttcacaaacatggtaccaaatgcttgagattgtggttatcagccaagatacacattctctgggtgtaggcaaactagtcagctgtgctagttgtcctgatgaaccttaaatgcatgttacctggtagaataactctcattttgtttactaattaagtgacagaatagtgacagaaagtttaaaagtttaaatagtgacagaaagtttatagcatacccaaccttgggttttaaattgcaccaaattcttatgtcgttcttgtgtatgtaagtctggaggctctaataactgtggctaaatgggaccaattatttataccttttagatgatttttgaattcaggaaattgcattttgtattgcattaggttaatagattcatgaaagcagagaagaatcagtccatgagacagagaagtcctcatagaaaatcagtgttgccctgaaacgggctcagtatgggcaaaatagaagctaggataattggatccaaatccatttttagtgactatccatatactgagaggacatttcaaggacaaaaacaatgtatactcttgacattgaagactttctgtctgcaaaattatgtagattcaatttctttagcctttggcctttcaagtcgaaaaccaggtttggggtgtggagggggatcaggtcacttgccatattacacagccatcgattcccttcaccagctgctgctcagtgggccgcacaagcccgccagtcttttctcagggcagggatggaaaatgagagggtaggatgagaggaaagtaatccaactggattggcttcttaaaatacagaagatttgagtgagagtgaaactgaacattttgtgcttttgatgaccaccaaatgactacctactacttcaccacagctggagaaactaaaaacacatgctcttttgctgccgggtcagaaatgctttttttcccatatgaaagaggggctgtgttgcacgtaatctgtgcaacattatgaaaaatcttcatatacagacaaaatggtactagaattgaatctggactgcaggaagttcagtggcacataatttttcttttaataatctatatcgaaccctcctgacacccgatataatctaaaatggcattagttatacatcagtgacccaaaaaagatttgttttttttctaaatgcagcataccagtgaagttgctaattacattgaatcattctgtacacgttctattttgaagggaaaaaacactttctgatttttgtatgaaattgtatgaaagactacttttcagccgtgactcatgagctccgtctcattgcagctacttaggtatttattcccaaatgtctgacgacacctccaggtgcattagcatgtctattacacaagtgtcctattcattggctaaggctttgctccatctgttgaatgttctgaggaaagcattataccctttctttagaagccagtgtttatatgtggagtcactaatgtactggtaggttggatttagtgaagaacagatctgaaataacctgatttttttccatttgggttgttgttcattgtttacactgtacattacacccttcatggaaaacacatagaaaaatgctacctactcatgatattcacattctccttaaatattcatagtttgagcaactcaggcatgagggagaagatgaacaataggaagaaatacatgagaaaatacatgtaaaaacacaagcaagatttattaaatacaaatcgactgtaatgagaggtttatagtaaaaaagaaaaaagaaaaaaacaaatgttgtaatgttatattacttgtatgtgtacatgattaaattgaaagccaaaacttttaattaagatactgaggtttatttaggcacctctcagcatgttggatgtagttcaagaattttctgaaaaaggaagcttgtttattaagtgaaaatgatgtgtcttttgaagcaggcatagaaagtcaggctacccttttggaataaatgtctaaaattttatcacccagccacatttctaactgtattctaagcttgtaaaactttaatttagttaatttttaattaaattatttaataatgatgctttctgtcttagaaaatcaggggacatttatgtggacctaaggtgtaggttagacttcagcaccttacacgtcatataagatgatttttaaaatcaggaaatagtatgtcatattgcattaggttcataagtccatgaaagcagaggagaataggcccaagaaagaagtccttacagaaaggaaatcagtgtggtcctgaaatagggttggtatggacaaaatagaggctcagataattggatcagaagccactttcagtgactatccacataccaaagttttagaaacttagttgtggtaacatatctccatctgtcaatcaacaggcatatactgagtgattcctgtatacaaagccctggattaggtactggggccccctagtgtatgagcagaactttctgtcatagagaaaccccacttgttagcactagggaatgtatccaagtcactcggcaccaaagtatgttagcagcggggaatctgtgggtctgtagcaacctcatttcttgcctcctcaaggaagaacaaggcagagggagaagccaaggcaacttttagagcaggagtgaaagtttattaaaaacttttagagcaggaggccgggcacggtggctcatgcctgtaatgccagcactttgggaggctgaggcgggtggattacttgaggtcaggagttggagaccagcctggtcaacatgctgaaactctgtctctactaaaaatacaaaaattagccaggcttggtggtgcacgcatgtaatcccagctacttgggaggctgaggcaggagaattgcttgaacctgggaggcggaagttacagtgaacagagattgcaccattgcactgcagcctgggtgacaaagtgagactccgtctcaaaaaataaaataaagtttcagagcaggaatgaaagtaaagtacatttagaagatgaccaagcaggctacttgagagattcaaaaagtgcatggtttgacctttgacctgggcttttatatgttggcatgattcgggtgttatattacttctctcctgattcttcccttggggtgggctgtccgcatgcccagtggcctgccagcacttgggaagtgccgcatgcgtggtgtttactgaagttgtgtgcatgcttactttaagcgatttttcccttagcagtagagcattcccagaggtaggtcttataccagttaaacaccgcaattttgcctcttagtgcacatgcttgagcccaattacccacctcctgagatctcatggggacgtggctgagcatcagtttcaggtgtttctgtctattagggaccgtgtttccttggtgccagctgcaaccaattattattttagcgagagatagtttaacaaccatctgaccttcacctgatggccgcctgacattcctggttgggtggggggccctctcttgccctgctcatgtctaatacctactctggcatccctactatgtacagatgagggctacaccgagacattaaaattagtcaaagagctgcccgagggcaaacatgccctccacaaagacaagtggtaagggaagaagcatggtgatgatgtgtagcaattgtttccttcaatgatggctgacactcccattcccggataacagcaataggtcaaggcagacatatctagaagttctggaagattaaaggccttcacatttcatgtacttagaaatagctaaggggataaaaaattattccctaagaaataaatgcctaagtacatgtaattctgtaaggttgaagagagcccaaaagaagaggtaaaatgctggctgggcatggtggctcatgcctgcaatcccatcaagttgggaggccgaggtgggcagatcacttgaggtcaggagttcaagaccagcctgcccgacatggcgaaaccccgtctctactaaaaatacaaaaattagccaggcgtggtggcattcacctatagtcctagctactcaggaggctaaggtaggagaattgcttgaacccaggaggtggaggttgcagtgagccaggatagcaccactgcacttcagcctgggtgacagagcgagaccctgtctcaacaacaacaaagaggtaaaatgctatcttcatttttccctattctctcatttcaaacaaaagaaagtgcaagctgggatggacgcggtggctcatgcctgtaacccctgtaatctcaggtgcggtggctcacgcctgtaaaatgcactttgggaggccaaggcaggtggatcatgaggtcaggagatcgagaccatcctggccaacatggtgaaaccctgtctctactaaaaatacaaaaattagctgggtgtggtgtcacatgcctgtagttccagctactcgggaggctgaggcaggagaatcacttgaacccaggaggcagaggttacagtgatccaagattgcgccactgcactccagcctggtgacagagcgagactccgtctaaaataaaaaagaaagaaagaaagagcaagcttttctctcctcatgaagtcaaagcttgatagtagctcagactcagggagcccacactcaggatctttgcatgtgtgtctcagcattgtcatttataagctggctttttagagttgttttggtcttgtgcacatcagcacatcattcatattttatacaaaattgtgacgtgatcagtatctcctccaacttcatcctgagcacactgcgtgcatgagggtttgaaattgttttgtaacaaataatcataaatttagaagtacgtgacgtaagctaattcaggttgcccagagttccacttaatttgatttattgcaaaacaaatacgaaagttcatgaatttgacatagacattgttaacatactttaagtatttctagcctgtttacttattatgcaacaaatccaacattcctagaagtgcctattttatctagactaattgtttccacacacattaaaaggactcaagtgaattgtagaaatgtattctaaaagaatatgccctttgaaatgattctccatctggatacagactgcaggtttaagtatagagtggtggggaatctaaggtgtaaggtgaccctagagttttcaaactcagagtgaaaaaatcttgcctaaagctaggattcaaaaataccaagagatgaaactcttcttatgggtactattaacttggggttgattcatttaattttccttttgcttggtttaagaccatgtactataggaatgatacagtggccagtgacttcattgtctgacattttcaacaccctttgttacttctatcttcactggtgagctgtggattattttatcatctggatgcttagaactctgagcaagtcatgttctagaactatgagactaaacaatgaagaactttgcactggtaatatcaaagtactgaaagtgtgtggttttaaagtgtgaaaaacatggcagttaagatctctcaggtactttgaaccataatgcagttttccttctcttcaaaacctctacttctaaatggcattcattgtgttttctagtgttttttctttggtatgacactagttaacctgtatttcttaccataaagctaggactcaaatactaagaggtttgactcaccttaggtggaactttatatagtactttaacttagaaatatttggaatcaatttctgcttataaaggtatcaaaagcaagtgatactaaaacgagtaggttcaaagttgtatactaaatagagaccttggtaagagagaatgagggattttcaaatatggtccagaagatagtctctgaaaggctaaaccagcaatggttactagccatgcaggaagccagtgctgtctaatcttacaaattctgttttcctgccaaatggcatttaggagcaactgataatttatttcttgccacttgccgttactggagatttatttggtttctcaactcagcccttaacaagaaagcaagtctttgttgagggcacaatattatcagtatggcaaagctaagacgaggcttctgtgtgacactggaaagaccaacaagaatggattaaagagagtgattttccatatgctgtcactgggacaggtacttttctctgtagacacacaggctaaaagcagtttaaaagcttccttacctaaacagtacatagttcaaggagataggccctgtgtccattgcgtctctagtttttgtttctaacccattatataaagaaacatcccagtttgctttttagagaaaagttcaagttagaaccattctctggtcttgctaagtctcttaattgtgacacaactgtcctaagcaactgtccttgcacaagaatgtcactcatctgcttcatctgccagctccttagagatgaggggggtctgtgtgtcagcaggaggcagaaggccctgtggctcatccagtggcctgatttcctttgtttggaggcttggttctgagtgagagttcaacagcctttgcccaggcggcttctcaaacacagggtgtggtttccttagctcactctctgctgtttggttgctcatggcaacaagatccaaataacttggacatgtgtttgtataaaaaaaacctgggaatggaacccaaagtgagactttggggctttcagttagtggaagagctgcggtgagtaccaggcaactgctcatttattttctctcattctttctctctaaattacgctggaagtttgctagcacaataaccatgtttgtggatagttttagaaagtagtctcaattcttgtatttcctgcacaaatgaaataattgctatctatttacccgtgcaaatttctttttcgggggagaggaacaaattagcatatgtttaaagaagttgaaagctaatagaaactcatatttggtaccttttgggtggcaggattctataggaaatgccttggcaaagggagctgcagagtgccttagtaatgcttgggattgcaggcgtgttgtctagggccacagccggggaggggaccagggagggaagaggggttgttcatacggagggagtggaagggattcttggaataattttttccagactctattttaagattataatttttaagacagcaaatatcccaaatggtaatactggttacacttctatgagcatattgattctcacttgcttgactcaagggagggtttgattttggtcacaaagccacccgtgactatgacagataattcaaggttgccaaacttgcctgtgccaattgacaaagccatttatataagtcctctcttgctatattgctctggcctcaaaaggcagtaaactctcttggacaaaactctttaggatctattcagggatttaacacttttctgctaaattgcaagtaaatttaaacattttaaacaaattaacaaggattgcttaggtacctggtgtggtacagaatgagctgtcagtttctattctgatgaatagaattttatagataggaggaacgggaggcctccagaggatactaccctccctaaaaagagacggaggaagagctgaaagcgggcagagaggcttcttgatgacaacgtggtgggcttagagaagctgctgcctgcaggcggggcccctgctttcctgcacccctttgagcctctgccccacactcttcctttgtataaaacaactgcttcttgcctgcctgccccatcacacccctccactccatcgggtcactgctcaatggcacaatagcactgctcagccatacctcccagcatcctgtcccctatctggtgacttggccaacacaggctctgatccacttgccccgctccgcatcttttgtgaatcagcacagttgatatatctgagcaggggcttctaccatctccccagggaatcactagccatcggccatctggccccgcggggtgcttttgttcctggaatcatagtgaagtatctgttgtcttggtgcctggtagtcagctcggctgaaggggaagctgggtcttggtcctcagaccccatggactccaaggcagcattgtgcaggtgcctctgggagccactgctcagggtgctggggcatttcctgtggtcatttgtcctgtctgcttgcccccgcaggtccctccagctacaaggtgggcaccatggcggagaagtttgactgccactactgcagggatcccttgcaggggaagaagtatgtgcaaaaggatggccaccactgctgcctgaaatgctttgacaagttctgtgccaacacctgtgtggaatgccgcaagcccatcggtgcggactccaaggtaacgggcatccccatgtgccaatgggaagggctgggttttggagtgtcctttgcccacaaccatggcagcagcagctggctgttaggatttcccagcatcactgcagccaccttgaggcctcaaggaagcctcctccactccccaggccacagtggcccgagctgtttaatgtggggcttgactggatgggcgccagcgcccttgccagctcttttgattgcattctaaatatttcaagaattgtgagatttttatcctcacctcagcgtccctcctataagaatagtcactgtggggcagtcccaggtgtaagggactgtgtcatctcagtggtcagtcccagggaaatcagccttatgggagggctcctgccaccacccccagcacccctcatggtggcccaccctgtctgcttggtttccaggaggtgcactataagaaccgcttctggcatgacacctgcttccgctgtgccaagtgccttcaccccttggccaatgagacctttgtggccaaggacaacaagatcctgtgcaacaagtgcaccactcgggaggactcccccaagtgcaaggggtgcttcaaggccattgtggcaggtactgcctccttcccaccccgggttcccagggaggaggccctgagggcagacgtgatgtgggcttgcttatcatggtggggctaacgttgctctgagctgctttgagatcttagcatatatatgtacacatatacatacacgtatatatgcgtacacatatatgctcgcacacacgcacacactcggagactaaagaacactggcgagaacagcctgtggcaacagaatgaagtgaacagtatgtagcgctttctcatttgggcgtagtaagtgatgaaagcatgcttcttcctcagggtgtcattctgggccaggcagtccctgatttaatgtctaagtgcacgcagggtatagaggtgggggagtgggggattcaggcactggatcctaaaataataatgctggggtccccacccatgacagaaatcctgggttggcacaagcacaagtagaacacaggtaggttagttggaggtgtgaggccagtaactgcagggcctgcatcccctcacctctggagggcctggggaggggagctgagtggatgcagccccctgcagagcctgtcagtggggctatccaattgcttccctctgcaggagatcaaaacgtggagtacaaggggaccgtctggcacaaagactgcttcacctgtagtaactgcaagcaagtcatcgggactggaagcttcttccctaaaggggaggacttctactgcgtgacttgccatgagaccaagtttgccaagcattgcgtgaagtgcaacaaggtatgctttcaagggagttctgcattgaccgttgtttctagaagtgtttgacagtttgcagagcacttccacacacactatcccattccatcctcacgacagccctgtgacgtaggaattattattcccgttttacagatgaggagatcgtggattaggaagcagtgccacagccaagtcaggctgtcagtacgcatcctcagcctggtggtgcgggtggcccgtatggcatgctgagctgggcagccctggctctagaagcctgcctccaccacttaggggctgtgtaacctcacataggggctcaccttctccgagccttggtgtcttcatctgtaaagtggggataataatagcccctgcctcccatggctgttgtggagattaaatgagatattgtataccaaagcgcccagcacagtgcctggcacgcagtaggcattcaacaaaatggttgttgaatctgaatccggtgctacactccctggtctaggccatcacatctggaggaatcacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggtaggctaaagagtccttgctaagtctgccaggctaggttttgcgcatggtaaccatctctcattttcctgtcgtcggtttcatccacaaaggcccccagagaatgcccttctccccctgctattgtggtcccaaaggccccccaagagtttggattcgtccccaggccaggttagcctttgcaatacagaacacttcctgactgttgactaacaatgctgagagttcacaagcctgagacctgccagccaacaccggcaggcactgccactttgcagggggattctggggggaggggtgggaggagggtagaaagaagggggtgggggagggtggggaaggggtaagggaggccgaagagtgataacccgggattgtaataccccatagctgaaggctagttcagagatgcctgttggcagggtttcttttttttttggtttgctgtttatttgtttttgcgatcagcaaagctaatcacttcattcctcatctcgcggccgcgatccacgtgccctgggccctttcccttgcctccaattttcccatcttcccggggagccttgaaatgtacatttgagaagacttttgccatcctcagggaaaaggactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaaaaaatcgaagcttagcagctcctcgaggcccggtaagtgcacaccccacgaacagcccaagtttgcctcctggtggccactttgatgtcatggccctgacctaaatcaaagaaactggttatgctgggaggtcggtgcgcgtcacagggcaatagcgtggtggcatgggaacgtggggtctttacatcagggaagcccttggccgggcttcagcatcttctcaggtccttgagagccacagcagggttgcggcggcatgggggacaatggcggcgtgggggactgtgcacgatggagtggaggagggggtctgggagccaggcagacctggctcttgcgtgcttgtcggtctgtgagtggggcaggtcgtcattttatctctctgaatcgtggtttcctcacctgtattcattcagctgtttctcttgttttcttttcttttctttttttttccccccagggtttggtaaaggctccagtgtggtggcctatgaaggacaatcctggcacgactactgcttccactgcaaaaaatgctccgtgaatctggccaacaagcgctttgttttccaccaggagcaagtgtattgtcccgactgtgccaaaaagctgtaaactgacaggggctcctgtcctgtaaaatggcatttgaatctcgttctttgtgtccttactttctgccctataccatcaataggggaagagtggtccttcccttctttaaagttctccttccgtcttttctcccattttacagtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccaccgtgtagacacacgacatgcaagagttgcagcggctgctccaactcactgctcaccctcttctgtgagcaggaaaagaaccctactgacatgcatggtttaacttcctcatcagaactctgcccttccttctgttcttttgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaagcttaacaaaactaaccctgctgtcctttttattgtttttaattaatatttttgttttaattgatagcaaaatagtttatgggtttggaaacttgcatgaaaatattttagccccctcagatgttcctgcagtgctgaaattcatcctacggaagtaaccgcaaaactctagagggggagttgagcaggcgccagggctgtcatcaacatggatatgacatttcacaacagtgactagttgaatcccttgtaacgtagtagttgtctgctctttgtccatgtgttaatgaggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagcatatgaataacctgcctcctgtcttttcattctgcctggtggaatcgctataaggtgatactcctaatccagaaacctaaatgacttattttccttccaggatatactcactttagtgcaggcgcacagaacataggaattataaacaaacctgtaaaaaccacacttgattgataaataaataattaaaaacaaacagaaaccactctgacctaaaatagtatttcccagattttcacatccctgaaaaagaaagaaaacgatgaattggtttgatttggccaggggattagggagggaatccctgatgaagcatggcactgagaagccatcttggtccctgtttgttgggtgcttcctcggtgtgcctttccccttgtgccctctggagcctggggtccaggttgaacgtgaccatctcaactgcggctgcctccacctgccagctgaatgacaccctcgctccttcttgtggatgtggctcactaaggaagctgcccatttgggcccatgcacttcagttagggggaacatgcagggatgccgtgggcagaggcagggggttggcctggcattgaggctccccagttgccgctgcttctagactagcaccacacaccagtgtcttttgttcacctctgaggctcgtgttcttgggtcatccaacctgcccacacccatgtggcccttacggcacagcacaagaggccccatgcgacaggtgtctgctgcactctcctggtggaagaggcttcagaccataagggcccctcgtcaaagtacaagcagaactgggtgggaggagggggtgttagtcttaactgggccacatgctgagggtgataaaagcaaaggacagaagccctttggtgctaacgtttgccttctgagaagggaactgaacctgtcagcaagaaaccatgagcacttttaggaatgtggcacatccccttgtgtgtgtttccttacagaaattagccatgaaaaccttgaaaccaatgaagtctgtccagtcatgtggggccccagggacagtgaggctggctcaggggatggggagtggctgccctcactgctcccaagggagtgggctgagttcctgaggctgcagcaaggaaaggagccccacggggagaggggacagaagacaggcctgggatggagagggggccccatctgccttcactaagggctttggccccggcttatgctctcaatccatttcggctgagccctgggccttcagcatccagacgcatgctctccttcctacccacgtgctctttcccattccggaactcctcctcactgcgacagttcctttccctccagtcctcggtccaccctccttctcagccccttcccaccctaatgcccctccgcatctgccctacattctatggtttgcacttcactcgtttccctcctcactcctgttatccctttgcccttctagcctgcttggcctgcaaaacctgagtggatggcttgagctctgttgaggaaaagcaccctggcctaaaattccccgtcccactactctgccacttggcccaaagtcccaagaccgcctccaccaccttcctcacccgggagactgaggtctatccggagtcagcttctaactattgcttgcttcgtgatgcctgcctgccgttcacacttcagcatcttgtgaagcacctacacgcatcacagctgacacgcaccatcactcccgtttcccagatgagaaaacaggttaagaagcttgcctaaggtcacacagctaataagtgacaagccacaccctagacacacctctagcatatcactcatgacactaaattgtcgtaaaaaatagacacatcacaataaaaccatcgtgcacagtgctcagtacttagaaggcatttgtttgttgaatatgcgattttaagagtgacacccctaaggctcaggagaaatgagggtaaatttccccttaacaatttgtcagcagagaaacattttctccctcataattaatg

SEQ ID NO: 15871 - DNA, 65745 bp, Human
  misc_feature (1)...(65745): n = A,T,C or G
aagtatagagcagtgctggatggagagagaagtacattctcgggggagcagaagcctcagggggattggctgcctggtagaagttactaccatttcaagattcctcctagaactcgagtacaaagagattgctgaggggcatactaagttgctggggccacataaacagaggtggagtctggtgcttgaagacatttcctgactctggtcagggaagcaatctgtggcttcgggtttttttttttttttttcaagttcccaacactcagtgaaaagtgggtttatgctgggacaaaacagccttggaatgagcagttagcaggtaagctcatttactaggtcttctggggagaggatgatggggagaatgggaaggatcctcacctaggtttcttgcttccacaaagcccagctctgtgtgaacaggacagtgtggttcaagtggagtcagggtataggggaacaggcagccatgaggtttcttgggaagacacagacccaagtactaatagcagagaatgggcacacagtcactggctctgatttgggacagttcctgacctgacagggacagaaagtggaattggacatcgtttgagtgctttttttgtttagctcatcatcctgagagcttagagagctggttagtgagggtgaatacacacaggggcagcttggagttgcctgagtattacttgttttagcaaggaggttatatggccatgagatggaaagaaccatttgagaatcatgagttccaggcagaatgataggaattgaactgacagtggtaccactgatggtatgaagaatttgagaaggaatttgtacttgcagggggaactcatttcaaatgagctcatttcaaaatatttttagttttgagggtggtaggagcctcaacagggtatgctcagaatccaacaggtagaggcctgaagttggggcagcaggccagggcttgagacttgtagatcattcatgttgaaatcaaagtcttgagaaaacaaagagcccacacaaactaaggagcgatcggagaaatacagaaaaaataggaagtcactgttctcaaaagacaaagctccagtatggaggtgagaactgtgaaaattctggtgagagaggttggacaggctgagaacagaaaaaaaatactgtcctgaggaatactaaagaggagagatgagagataggggtcaagggtgacttcggagctggggacatttgctttaaaacagcagtaaaaaggagcaagaggagaaggagaaatccaccacaccacccaagattttttcttcgggagggaagtgtttacgagcattgggaaatctaagcacaaaccgatccaatctttgctgtaaggttgatgagtttctgtgtacagattcctagcgtgagagatgacttatatcagatgtttacatgtaaagaaaaccgactacacagacacacacataatccatacctttgagtcgattgttttatgaactgctacagtgctctgtgtgtgtgtggtgtttttttgtgtttttttttttttctttcccgatgaggacaatacaaggagaatccgatttaaatttaaattacagagatggagattgaggctcctcccaaggggacaacttatcctgttaagagacactgggggacgatattgagatgggttatgaaagatcaattcctatgaaagatcaattcccctgagagctctgagaataggatcaaagtagaaagcgcagtctgcctctgcttggttacactgagccgatgtttctttagccaaaggcagtgggctagtttagacggcctttcattcccggcagcgcctgtgggtgcgtgtgacctgggacagaggggcaaaggaacctggcagagcgagcttgggatgccgcggcccctttaagagcggcggcggcggcgcgcgctccgacggctacccccgggccccgcccctttcccgtgagccctcggggagtggtccgaccgcgggcggccgccggtgaggtaggggcgggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggcaagttcctcaacccttgtcagccccttggcgctgcccctttctctgcccgccggctgcttcgcctcctctgctggccctgctcggcctacgttcggctccccttctaattccttccattttctgcctcgccttccccctaccccgcgtttctctgcctcaccccctttcctcttcagcctcgcgccccattttatctgcctctccacacctttttcgcttccgaccccaccccctttttcctccgcacccccagccccccaccctttccctgcctaccaagctcgggacccggggctgaggatggaaaacgagtgggcgcggtgtctggaattgggctgggggctgggggaggggagacaccattgcgatccatttctctggggtgtcagtttgtttaaggttcattgaaactgcagtagtatctctactgcccagaatctggcgttcttttggagccagagtcgacctttactcaacacctagctcctgctacgccctgtcctttcgaggttgcaaaggaaaatcttattcttgtggagtccgaaaaaaaaaacccgaacgtgaaataggctacagaaggcttagggcatttttaatgacatcccatttattgtactatgcctctaatatctgatatggatacctgtggttgacccttccaattcaggcatacaaaagtgaggacgaggaagagttaaggtccttccagaagtatagtgtactatacgatgatcaggacagttcagacaaacagtaattacaaacaccatgcatatgcagtatgggtgacttgctgttggcatgaggttattgaccgattgtagaataaatggcttcgattcttgtgtctcagtctgctttctgaggtttattattattattattattattattttggtgacaaggcgagaaggggtaaatcaaagtgtgggctcagaggcattttgagctgtgctggggcctcaagaggagaaaagatacatattgccgactgtattaatctgtgcgggtattgctaaagagatgagggcggacaaacaattctttctgtgcagtacatgtgtgaagattatcttcatttggagcagttaaaccgatgagcttgttgaggtttgtctctcagacttgcagataggtagatgaagctttggcacaaaagacattgctccatgcaaacccccgccccctagtaaatccagacttctgtaatgtgcatctctcaaggatagcaaggaaaggtagttgtgtgcctcaggaagatgcatgaactcaggcttatttttcatttttaagagaatacagttctgagcctgcgtgtaaaatatctctgctcactaagattcctagtttttagacatattagatggtttttatatttaatatgttttgcatttcatttgcagtgcaccttaagccaaattggccagataagctatatatttctatataattttctgcataacagtgtgtgatttatttactatcctcaacaaacatttgttgataaaccttctatgtattatgctcagaaaatacaaagaggtataagatctttgccttcaagtcacttataggcaggtcatataaagaaaataatggcatcttaaatttggttaaatgccaaatgagtattataaagtaatgaactgatcagagatacttcttttatagagagagatagtatgatgtggtaattaaaggtacaaggctttagaccagaggtcagcaatttttttttttttctgtaaagggccaggtagtaatgattgttgatcttgtggatacgtagatctctgtcgctgttgcattttttttctttgatttttttttctttttataaagttttacaacataaaaactattcttagctctcgggccatacaaaaacagaccaagggctgtagtttgccaacccctgctttagaatcagacctagattcccgtcacactctgcccataggtatgtgtgatcttagacaagtcccttactctcttttaccatcatctatatgttggggatgatgatagtaggattactgtgaggaagaaatgtttttagactagtaactgacccttaagtaaatgcccaagaaatgatagctgtgctattattattattattgctgttacaactgcattttctcagattaggcccagaacaactcttttaattggtcagtctcataagtcaagggacaaatacagtctttttaagagaatcaaataggggctttgaattgccctggaaatattttctctttggtagctggtatcattaacctcatctaactctaggactgaagtagaaaaggattaccgattgcattttgtgaggtttctaagttaataaaaagtgatagagcaccttggtgttagtattttttgaaggaaaaacaagggtatctcttgtggaatgtaaagtgcaagagtgttagtctgggagtcaaatctggagttgacttggcgttctttagcctgtcctattttctcattgtgggcaatgggtgctgtggaccaaacagcctcctaacttaactcgcaagtccagttcgagaatagatgggattgggtcaaagtttctttctttctctctctttcttttctttctttctttctttctctctcttttctttctttctttcttttctttctttctttctttctttcttttctttctttctttctctctctttctttctctctctttctttctttctttttttgtggagggtcaaagtattttcaatagcatgaaaattgaagttttctttttcctttttttatttttgatagagtgttgctctgtcgcctaggctggagtgcagtggtggggtcatagctcactgcagcctcaacctcctgggcttaagtgatcctcccacctcatccttctgagttactgtgactacaggtgtgcatcaccacacctggctaattttttatttttatttttgtggtgacgcgagtgtgggggggtcttcccatgttgcccaggctggtctcaagctcttagctcttgggctcaagctatcctttcaccttggcctcccaaagtgctgggattataagtgtgagccacctcgcctggtcagaaatggaagttttctagtcctatttattgtctgttatttttcttatagctctcacaacatcatagctatcttattattattaatatattattttaaaacctttatttttcagcatgactctggggtcaaaatgggatgcctagacctctaagattcagcccactggtgatcttattcctgtgatattgggttagctacgtaaatcctggaaaatgctattaaaaataagcttttcctttatctgagaagcaggagtaaaaacagtttaaattgccaaagtggtcagtttctagattgtaatatagatcaattgctccagttacaaacacacaattgcaaagtacccacatgttttgctccttgggttagctttcttaagaagcttaaaagtgagtcactgttagtaaaagttgtcgaggtagttaaattaagtctgaaaagtgatcacgcactacactgtgcttacagatggtataaaaagcaaaatatggcagaaatatttgtattgccttaagcttaaggcatctggagtccgaggtttaaccaatgtgattcatcaataaatattgattagatgtctatgatgtatgggatatgatgagaaatacatgtttgagccacagtatctgccctcaaagcacttatcatctaatgactatggctcataccttatttctcatcatatctttcacaaaactaatctgtagaaattgtatcagttttggtcacacttaatgccctagtgatgttcttcctatatttttgactatcagaggcttcaggtgtgattggctggaataatgggctgaaatccatgaggaaaccagtcactgccaactgggagaatcacacattagtagggccttgggtgatgctgattttttttatcactgggagacttttcagcacaggagggtcaggaatgtgtaggagggttaggacctctctgttttgtgaaagatatctctttgtggttgtgttttttttgtttttgtttttgttttgagacgcgttaggacctctctgttttgtgaaagatatctctttgtggttgtgttttttttgtttttgtttttgttttgagacggagtctcgctctgtctcccaggctggagtgcagtggcgctatctcggctcactgcaagctccgcctcctgggttcatgccattcttctgcctcagcctcccgagtagctgggattacaggtgaccgccaccacgcctggctaaattttttgtaattttagtagagatggggtttcactgtgttagccaggatggtctcgatctcctgaccttgtgatccacccacctcggcctcccaaagtgctgggattacaggcatgagccacagcacccagccatggttgtgttctttgttgcctgttagtggtcatttaaagtttcataatataaatattttctgtgcctccctctatgtaggaggctagaagtttctgctttagtctcttaacaaagctctgtttttgtatcctttcactgagaattgctttgactctatgactaggatttggccttttacagaaccctcgttaacttgatctgtgaatttttttcaaataccaatttttcagatgcctggtgccataataaagggatcttgattttgttttcaacctaaataattattctccatgctgttgttttatcgaccaaggtatgtgtttcaaatttgcccaagtgctgagctctcctcagggtacccagtgatgcttcagcatagggttgggcaaacagtagaaccagtgggcactcgggaggcggaggttgcagtgagccgagatcacgccactgcactccaacctcagcaacagagtaggactccgtctcaaaaataaataaataaataaaataaaaaaaaagaaccatggttgggcttggggacatggaaggaatttatgctgccattattagcatttgtagtagcttgtctgtgatttttgcatgtaaatataagaggacagcttttactgagcctcttaattagctcttgtggaatagtagagaaaagagctgtttctgtctcatacaggcagaacgactggatctacaggcttttctcttctaggttatgtctgtcaagtgcagttgctatctaacagtcagtttttaattttgtttttggaggtgagatatttttaaaaggtgtctttcatttattttaaattcgaacctttgtttaaacgtttttaaagttggtgtcattatactactgttcacgaatgaatcattactactctaaaaaatatatgtgactataaattgaccagaaggatccctcctctctgctccctccctgcttcctgggcaactactgccttttttttttttggacagagtttttgctccattgtcctggctggagtgcggtggcatgatctcaactcactgcaacctccacctcctgggttcaagcaactttcctgcctcagcctcccaagtagctgggattacaggtgcctgccaccacgcccggctaatttttgtatttttagtagagatgaggtttcactatgttggccaggctggtctcgaactcttgacctcaagtgatccacccgcctcggcctcccaaagtgctaggattacacgtgagccactgcgcccggctggcaacgactgctcttatacctcctcatttctgcttcatcacttctcacttgggtctggtttccactcctgctactccactgaaactgctcttatcaaggtcacctatggcctccttgttgccaaacccaatggatacttctaatgcctgccttactcgactttactatagcatttgatagtttttatcacttccttctcctcaaaaatgaattttttccctttcttcctgactttgccaccactggttcctttttttttctactcctgtgggttttccttctcagactccttcatcagctccttctcctctagcagccccttaatgttggctgttaatagatcaaaccccagatctatatcatagtcttcttcccattttacttgctcccctggcgatctcatctacatctgacttcaaccatcttatgactgcacagtgtatatctccagttgagacccctcgctttagctccagataccacatactcaactatgcgtgtgtcacaagtacatccaactcaacgtgtccaaaactgaatgtagccttttcccctgtaaatctgttcatctgtgtatgttccttacctcattgaatgtccttgttatccccctcggtgctcaggccaacttacccacctggttaccaaatcaattaaggttcctcttagtctttcatctcccttcctcagtcactaaatcttcctaaaatataataccttcaaaaaatccttctcgcctcctgtcagtactctcttaggttaggacctaaactcttattgcctgaatgcctacagtagccctgtatctagccttttagaccctctttagtctagaccagtctttctaaagtagaaatctgctatcaagcctctgccttctatgacttcattttacttttgggataaacttcaaattcccttccccaacagataagatcttttatgattcaactcctgccaatctttcaaacctcaactcttgtcactttataagccagccatactaaactacttgattcactggatgggctgtgttgtctccatccttgactgatatgtactactattcccctacgtggaatatacccatttcttctagtttgttacctgcccaggtgacatctctggaaagacttccctaatgtcttactcccccagggttgcatagttgtctcttttctgtttttataataccttgtatacatatatatatatagcattatgattgtttattcagtctgttttcaccaactggaccgagttttccttgacattatgattgtttattcagtctgttttcaccaactggaccgagttttccttgaaggagggaccttgttttcatctctgaaccctggaggcctacctagcatagtacactcattcacgtattaaaagaatggctggctagtcagaatgaaaggcaataggaaggtaaaatgcagctagtagtggtatactatgcatggagttaaggaaagttccagaagtttgggttttatttgtagttgaggtatgtccatacaatgaaatatcgtttggtcgtaaaagtaaatgaggttctgatgcatgctacaacatagataaaccttgaaaatatgctaagtgaaagaagtcagacacaaaaggccatatattgtaggagttcatttatatgaaatgtctagaaaagacaggtccataaagaaagaaagtagatgagtggttgccaggggctgtggattcgggcatgggggaatggagagtgactgctagtaggtgtggggttctttttggagggaaggaaaatgttctagaattagatagtggtgattgatgttcaactttgtgaatacactaaagaccactgaattgtacagtttttaaaaggataaacttttggtgtttgaattagatatcagtaaagccattactaaacaattatagtcgatcaatatagttttatagggctgggcatggtggctcaggtctgtaatcccagcagtttgggaggccgaggtggatggattacaaggtcaggagttcgaccttggtcaggagcctggccaacatggtgaaaccccatctctactaaaaatacaaaaattagccaggtgtgttggtgtgagcctataatcccagctacttgggaggctgaggcaggataattgattggacccgggaggcggaggttgcagtgagccgagatcatgccactgcactccagcctgggcaacagagcaaaatttcgtctcagaaaaaaaaaaaatttagttttacagtacctagaacattgtgcatatttgaatgtcagtaggatgatccagcaatctgtttgatgtcatagtgccagattcaggacttctattccatgttttgattttgaagcagatttttaaaattaaaatctgatcttttagaagtagaagaactcaatcaacctacaaatattattgacttttcaatttgttaaatgtgcattgtttggccagtcatgtgctttgggaataaacttgcgaagtgcattgtttaagtcttataaattgatgaatggaggtgaaaaacaaatttctttttttttttttttgagacagggtttcactttgttgcccaggctggagtgaagtggcatgatctcggctcactgcaacctctgcctcctgggttaaagcaattctcacacctcagcctcctgagtagctgggattacaggcgcccgccaccacgcccggctgattttttgtatcttagtagagttggggtttcaccaagtttcccaggctggtctcgaacttctgagctctcaggcaatccacccatctcggcctcccaaagtgctaagattacaggcatgagccaccgcgcctggccagaaaacacatttctaacacgattgcactgtcgagttgggacacattggagcatattctgtctacagatgatttgaagatattttctccttttgttaccttcctcattacttatttaaatattgatctagaaatgcagtgatctgtgctgttgtcctagggaatgtttttctctcctgtttcactggattatatgaagattgggctgtttgttgtatgaatttagtaatattttaaaacataactgcatttcatctaaaaatcagttctgagctacagggaactaccgtaagagattttctcttatccatagttatgcgtggggtacaaaagaagtggtctctgtcggcaagaagagcttatgttgttcttttttccaggtcttttggtgggccttgtgcttcggtatggcattcatgttccgagtgatgtaaataatgtgaccctgagctgtgaagtgcagtcaagtccaactaccttactggtaaatgttagtggaaaattttatgagtatatgctgaaaggagagattagttcacatgaactcaataatgttcaagataatgaaatgcttagaaaggtaagttcttaaaggaaatctttgaatcttttttgtgtctaactagcagcaaaatgatccaggagaaaataagtaatggatttttaatgatatttaaaataatgagtctttttcaatggagtaaaacctcaattaacaaatgtaataatgtaaggaaatggatatgtctgtacaactcattttctgattgaggttaagtagtataactctttttgtttctctctggattgtttacagcttgttgtgataaatggagactgggattgagttaagcagaatttataagcgtttctttccatttgcagatggtccttatagttttctttttctttttctttctttattttattttttctgagatggagtctcactctgtcacccaggtagagtgcagtggcatgatcttggctcactgcagcctctgtctcctgggttcaagcaattctcctgcctcagcctcccgtgtagctgggattacaggcatccaccaccacacccggctgatttttgtattttttagtagagacggggttctaccatgttggccaggctggtctccaactcctgacctcaagtgaatcccccgcctcggcctcccaaagtgctgggattacaggcatgagccactgcgcccagccggtccttatagttttatagtacttcagcacattggctttatttgataatacctaaaatattctattaatatttctttcaattctttcttgccttgcttgtattctataccgatcacaatttaatctttctttgattcacaatctgacacaacttcaggggccctaagtgtgagtctgagttattgtaccatattgtgcataaagctttatgttagagtttgagttgcaattgtactggctcccagaaatccctggagctgctttctcctgtctccctcataggtttatcatgacgtttctcatgataaacggctcaatgccactttgctcatgtctctttgttttctcctacctttgctgtttgccttcacttctgtctgctacattggcaggacttgacttttttttttttttttttttttttttgacacagggttttactctgtcacccaggctggagtgtagtggcacgatctcagctctctgcaacccccgcctcccaggctcaggtgactctccaacctcagcctccttagtagctcagactacaggcacgtgccaccatacccggctaatttttgtatttttagtagagttggggtttcaccatgttgtctaggcttgtctcaaactcctggactcaggcgaaccacccacctcagcctcccagagtgctaggagtacaggcaggacttgatttttatagctacttggttgtgtttctgaccatctttaatgcttttaaaatttcatatgaacttgaggtttaccttgcagcaggagttctttccacctgtggaaaattccaattccttaaaagttctagttaacgaagttttagcatgggtttgtgtgtagctactttgtgttcatgtcacattctactgcagccttatgaacagaagggggtatttacatttttatggtgactaggtcttaaaatgagtgggctatcggaagtagaaatctgagctgtacagaaactttttactacaatattatacaactttagagatgttatctatgtaagaaatctgtttctttttgccaacaataatactgtactcttaagttttatattaccagtttggggtttcattcattcatttattttttgttgttgttgtttttgtttttttttgtttgtttgtttgtttgtttgagacagagtctcgctctgtcgcccaggctggagtgcagtggcgtgatctcggctcattgcaagctccgcctcccgggttcacgccgttctcctgcctcagcctcccgagtagctgggactacaggcgcccgccaccacgcccggctaattttttgtatttttaatagagacggggtttcaccgtgttagccaggatggtctcgatctcctgactttgtgatccgcccgccttggcctcccaaagtgctgggattacaggcttgagccaccacgcctggcctcattcatttatttttgggatggagttttgctcttgttgcccaagctggagtgcagtggcacaatctcggctcctccgcctcccaggttcaagtaattctcctgtctcagcctcccaagtagcggggattacaggcatgcaccaccatacctggctaattttgtatttttaaaagagatggggttttgccatgtcggtcaggcaggtctcaaactcctgacctcaagtgatccacctgcctcggcctcccaaagtgctgggattacaggcgtgggccacagcacccagccaggcttcttttatttaaagcgaaagtaatgttcatgctttctctttttttttttttttttttttttttttgagacaaagtctcactctttcgcccaggctggagtgcactggcgcgatcttggctcactgcaatctctgcctcccgagttcaagcgactctcctgcctcagcctcctgagtagctgggattacaggcacacgccaccacacccggctaatttttgtatttttagtagagttggggcttcaccatgttggctaggctggccttgaactcttggcttcaggtgatccgcccatccgcccacctccgcctcccaaagtgctgggattacaggtgtgagccactgcgcctggccctatttttaacttttttcttggtttgtttagatggagtcttgctctgtcacccaggctggagtgcagtggtgcagtctcagctcactgcagcctctgcctcccaggttcaagcaattctcctgcctcagcctcctgaaacattttttaatgacatagtattttaatacactttccacagataggccttaactgattgttccaatgctatctcctggtcgtttggttgagaagtagaatagaaactatcctatatgaaatatttttaagttagcacagtaatgttcttgcctttgactagtttaacatatagtattttttctttttgatcatttgataatggaatatgaggtcttctagggaattgatctaaaataactctttattttaacaggttacttttgatccagaagtatttttcaacatattacttcctcctatcatattttatgcaggttatagcctgaaaagggtaagtccttttgtctttcatatactttgaataatcttaaactcagtgggctttgtaatatttgacacttcagaaatgggctgttctttccagattaccctcctttctcctctccttatcctttttagatgctgaaatttatacctgtacaagaatgctttctcttatttatcctagtgaataatgcatttaatcctagtgaataatgcatttcatattagcatagcatagaaaaccttttctttttcaagtaactggtaagtattctaacagtgtaactttttttttttttgtcagagacatttttttcgaaatcttgggtctatcctagcatacgcttttcttggaacagcaatttcttgtttcgttattgggtaagtattttaagcttaaaatactttgtggccttcaaattataattttaaaataatatatttttgatttatgcagtgttatatattcctgactgggtctaaagacttttgcaatattcacgtaggtaataagttgtttgaattttccttaaggccaaagtattaccatatttcaatgacatgaattaaatttgggattagtcacaaagtactacagtaaacccatcttcttactttatcctaatttttttaacagttgatatttttttctaaagtaggactgtgtttattgaacaggtcaataatgtatggctgtgtaacgctgatgaaggtaacgggacaacttgcaggagatttttactttacagattgcctactgtttggtgccattgtatcagcaactgatccaggtatgttttatatgagtggagtttacatacttgaggtgcattgttttgcagtcaaatacatgtgggtttttctttctttgaggtgtagaattcatgattagatacttccttagtactatactttctaattgtggaggaaaaaacaaaattcatgattccttttggcttcagcacaaatttgttttccttttcctttttttttttttaattacatttgcctattactggtccacaagttgacgctgtttcaacaaggactataaggtactttcttcagaaattcatgttggtctttatccctagtgattgagtatagaagatgaactagattatagattagtttaaatgggtaataattatatatttcctttcaagcttttagaaaaccagttccctaaaaatctttcagtttctattcagctgtatgcatttaacagtaagaaaaaatgtttacaaatgattgttagaaggcagttgtgctaatacaggtttgatttggagtcattggaggactttaatatacattaaagaattgtttttataaaattggctttatgattatacagttgtttgtttaatattaacacaacttgttcccctgtgctttaagtgtcagatcttctaaaagttgtgttccagaatgaatttaattgtactgagttaggttttagttttcctgatagagtattggtaaacttaacagctacattcaaattaggaatttggagaagacacagaatggaaaggttggggtaggaacatagactgatgtttttgaactaaggatggaaattttcttttagcatgctttaagactttcgttgaagctcattttgttttactttttaaccttgtaagttaatcatctttaattgtcatccagcacaattaaaggtagaatcctaaggttatctctgcattcctgtgttaactctgataacacagggctttatgggaaggagaaaaatgtgttcaatactctatgagagatattttggctggacacagtggctcatgcatataaatgccagtgctttgggaggccgagatggtaggatcacttgagactgtgagttcgagaccagcctaggcaacacagtgacaccctgtctctacaaaaaaaaagaaaaaaaatagctgagcatgggagtgcgtgcctgtagtcctagctacttgggaggctgaggtgggaggaccacttgagcctaggagtttgaggctgcagtgagctgcagtgaggctgcagtctcattctgcctgggcgagaagggcgagaccctgtctccaaaaaaaaaaaaaaaaaaaaaaaaaaagattttaaaggattagttagagggccattttagagaatttgtgtagtttagcatttttaaaactggaaattaaattgcttccttaaagaccaccaaagctgtcctctcattgtttgtagctactcccattatcaacatgaaggtaggatggttttggcaaggagccggtggtctctggtttctgtgtcctttcattataagcaaggttctcaacttttcaaatcctatgagaaatctgagtccatgagtccattggcttggctacattatttcaactttctggttttgtttgataggactattgcctgaatagcccaagcaaatatcttttgcttatataaagttggactgttatttttttctgaattatgtaagtacttgccccatttctattattttaccattgttagcttgctcttagaagggtgaggtatgggtttcttttagaaattctgcactattgctctactctccttctccccctctcttgatgagctttggtatcagtatattccagctgcaatgctttgtagtagaaactatatcttttaaaatatactggacatggtggctcatgtctttaatcccagtgactcaggaggctgaggcaggaggatcacttgaacctaggggtttgaggctgcagtgaactgtgattgtgccactgtactccagcctgagtgacaaagcaagaccctgtctcttaaaaaaaattaaataaataaaatgcaagtttcttgtttttatgattggcatttgaaaaggctctctcagctgggtctggtggctcacgcttgtaatcccagccctttgggaggctgagacaggtggatcatgaggtcaggagattgagaccatcctgactaacacggtaaaactctgtctctactaaaaatacaaaaaaaattagccaggtgttctggcgggcgcctgtagtcccagctactcgggaggctgaagcaggagaatggcgtgaacccgggaggcggggcttgcagtgagccgagattgcgccactgcactccagtctgggcgacagagcaagactccatctcaaaaaaaaaaaaaaaaaaaaaaccaaaaggctcacctctcgttatattaatttttcatgtccgcttgggtttctttagtaactgagctatgtgacttagtaattaaagttataatataacttcaatttcatctgattttctaagatttctcatataattgctttcctaaaaggaggatttattgtttttcttcttaagctggaatattctcatagttggctccttattaagacaaatccagcagctgtaattctggtcataaattttaccccaaccaaaaactaaacctatgttttcatttcctactgtctttgctaaacctttgtgcttgcaatttgtaagtcaagtacaaatgagttgtaaggcccaaagaaacaaagtttgcaacattagattcttttcataatattcttcttcattaaagattaatgactacatggtctataagaaattctgaatatattctttgtgggaaagaaatgtacaagacacgattattaacatctgcgtgaagaatgtaggccaactcagttcttcagggttactttcagccatttttaagagagagaggagaagtttgtgcaggtacacaattagaaaagaaaaatatttatataaaattacggggtctttaatatggtaagagaatgtttattaggattgaattctaggaggaaatgaatttctaaataactctcagagtcatctactgaggagaatatgttatatttgtaatgtctaagtattcctctgactctttttacttactagtgactgttcttgctatattccacgagcttcaagttgatgttgaactctatgcacttctttttggtgaaagtgtcctcaatgatgctgttgccatagtgctgtcctcgtaagtgtttgttttcttattatattctgaatattaagtgtgagggtactaggaactgaaagtcacttattgaataaagtacattatgaatggaaacatttggaagaatgaggcatttttttccctcttgaagaaatccatattttatagataaattggaaaatacagggaagagaaaaatatgtactgccaccacctaaagacaattactgtaaacattctagaacatttccttttctatgtatgatattgttacatagttgtgattgtagtgtctgtataattttgtattcggttttaacattacaacatgagcatttaattttttaaattagatttaatattttctttcttttttttttttggagataagagtctcactctatcacacaggctggagtgcagtggcgtgatctcggctcagtgcaacctctgcctcccaggttcaagtgattctcctgcctcagcctcccgagtagctgggattataggcacccgccaccatgcccggctaatttttgtattttagtagagatgggttttcaccatgttgcccaggctggtcttctcctgacctcaggtgatccacctacctcgatttcccaaagtgctgggattacaggcgtgagccactgtgcccggccttaattttttctgaatacataatatattcacgtggctcataaattaaagtcatgtaaaaagttacacacagaaaattcacactcttacatctgtcctcatccacctgtccccctagttccttgtagataactttttttttttttttttgagacgaagtctcgctcctgtcccccaggctggagtgcaatggcacggtcttggctcactgcaacctctgcttcctgggttcaagtgattcttctgcctcagcctcctgagtagctgggattacaggctcctaccaccacgcccggctaatttttgtatttttagtagagacggggtttcaccatgttggccaggttggtctcaaactcccgacctcaggtgatctgcccgcctcggcctcccaaagtgctgagattacaggcgtgagccaccacgcccggcctagataaccatttttattagtctcttacctatcttagtatttctttattcaaatgcaggcacaaccgtgaataaatagtcttatttgcctctcatttcttatttttaaagttacatactgtctatcttctggagaactttgcatgtcaaaagagtgaatattctcattctttgcagctatatagtattctctgtgtgaactgcattattgtttatttgctcagtctcctatagcaggacatttgaagggtttttaatcctttgctgtcccaaaaggtgctgcagtgattaaccttgaacttaccttgttttatacatgtttaggtataatggtaggctgaatgtcccaaagtgagattggtaggtaggttaaagggtaaaatccatttgtaattttgttcgacattgttaaattgctcatcaaagaaattgtagcacttcgcactttcaccattaaattattggtctgtttcctcacagtttcgccagcagaatatttgtcaaacttttatatttttgctaacttgataattgagaaatatctcattgtagcttaatttgtgtttctcttatttgacataatcatttcaaaacatttttaatctctagaagtgttaatatatattatagatatgtagttatgtattacttataccaatttaattgcagacaattttgaatgagcaatattttttatctaattatagaaagtactatacatgttactataaggtgtttgcaggttgaagaatgagtctgaacctctgaggaattcaatcctgcctccctaatcttttttttttttttttttttttttttgagacagagctttgctctgtcacccaggctggggtgcagtggcgcaatatagactcactgcaacctccacctcccaggttcaagcaattctcctgcctcagcctcccgagtagctgggactacgggcatgtgccaccatgcctggctcatttttgtatatttagtaaagacggggtttcactgtgttggccaggctggtttcgaactcctgaccttaggtgatccacctgcctcggcctccccaagtgctagaattacaggcgtgagccaccatgcctggcccctgcctacctactcttattaggcaaatatctaactctataggcagttgcccttacttcataccagaactttctatgagagagaagtaagagcccttcacattttctctttatttttatttctctccttaattttcactttgttagttatgaaagaataaaacatcactggctctgttttgcatagcctgattgtcttctgcaaagttggaaattattatttctcagatgtaacattaatcccttaaacgttgtatgtgaagatatacaaaaggccatatccttttttgtgaatgcaatgtatgtaaatattaccccctccccaccatatttattgccagattttttttgcagctgtctgcaactaatataaatttaacttgagaaataaaacctaaaggctgtaactcatattgatactgaactttagcaccttcaatgatgataggtgcagaataagagttttgtattatttgaagtaagggagaaatggatagtatggttataaaaaatgttataaaaaatgaagcaacaaagattgttgaagcttccagtacgtaggtacatgagcgattaccagcactacaaagtaaagagagtaggtacaggcagtcacttttagcatcgattccctatcctagacaactattctactgttcagtcatcttactagtaactgttgtcttatcattgccctaatggcctaatggattaagagttagaaaatctctgttctggtcttatcttaaactgatgtgccctgtgccttagtttttcctattaataaaattgcctgtttcctgcatctttaggaacagttgattagcgttagaggaaaagataaaaaccctcattgaaagattttgagcttggagttataaataatctatttcctgcaacattaggaatagttgattagtgtgaaaggggtcaaaacctcattgaaagattttaagcttgggggtgtacataccagtgttggtgaagaataaatgctaaaaagagagagccggctgggcgcagtggctcatgcctgtgatcccagcacttcgggaggccgaggcgggcggatcacctgaggtcaggagttcgagaccagcctggccaacatggcaaaaccctgtctctactaaaaatacaaaaattagtcaggcgtggtggcacacgcctgtaatcccagctacctgggaggctgaggcaggagaatttcttgaacccaggaggcggaagttgcggtgacctgagatctcggcactgccctccagcctgagcaacggagcgagactgtctcaaaaaaaaaaaaaaaaagagagagagccctttccatagcatttctcacaaagggccatacttcttctcttgcagcctttctcaaacagggttttctgtgagagaatgaagccttataggaaacaatttgagtgagtcttttctcatttcacctaaggatgatagcgagctagtgccattttaaatttgtaagagataatacgttaactcattacaacctcagtgggattctggtggagaaggactgtatcttgagaggaacataacagagaaattgttagctctgtgttttaatagaattgaaaaaatgagttactgcccaaaagctgaagggaaagcagttgtgtgctcgctgtgggagtttactagctggaatgatcagtggtatcatgctcatcattcttcatttaccttttatgtgttttgaagtgggttagatgcagatagtctactttgtgttgaattttcttagtttgaggattatctactgtctgcattctgtgtaagcagctttgcatcaaaggggagggaacccctttttgaaggagttctgtttggcagttaacaggttaaggcaactcatcttgaaatttatgttggaggttgtttttgtttctgtctggtttttttttttcccaacttttattttaagttcaagggtacatgtgcaggatgtgcaggtttgttacataggtaaatatgtgccatggtggtttactgcacaggtcaacccatcacctagatattaagcacagcatccattagctattcttcctgaagcactgtttttttttttttttttttaacctattggagtagcagttattttattttattttattttattttttaaaataatgcttttaatccagtgagggtgaagtgaaattgactccctcatacatggctgcatgaggtagatctatatgtatattgatatattatgttagatacggtatatgtagttagagataaagtatacgttgcatagtattccactgaatggattaccgtgattagcctggggacctaaatccatattagtttaaaatatgttgtttacagtcatttatatttttatgaaagaagatgtacagagagacaacaaacgtgataaactgtttaacttcactaattaccagagatacatgctaggatcagtagccatttctacctattcaattaacaagacataacttttttttttgagacagagttttgctctcgtcacccaggctggagtacaatggcgcggtcttggctcactgctacctccgcctcccaggttcaagcgattctcctgccttagcctcccgagtagctgggattacaggtgcacaccaccatgcccagctaatttttgtatttttagtagaggtggggtttcaccgtgttggccaggctggtctcgaactcccaacctcaggtgatccgtccgcctcggcctcccaaagtgctgggatgataggcaggagccactgtgctcggccagaattgttaatgataatgacatagtacagtcattcttagccaggggcaatttgccaccccctcaccacacacacacaggagatatttgacagtgtctgggggcattttggctgtcatcaatgggggggggttcctattgacatggcctagtgggtagaagttttcaatgcacaggacagcattcccctcaccccacccccatcacagccaacaaataaatacctggccacaaatatcaataatgctgtggttgagaaaccctggtgttgtaaaactagaccactcatacattgttaacattgaaattggtattaccttttatcactatttatgataatgttaaaatatgtttgtggcaaaaatttaaagcatttgactcaaaaagtagaaaattcctgaaatttcagctcagaaataaccactattaggattttaatccagactttttccgttaagatagtagtatacatataaatatgttaataatctttataaacaataaaggcatagtagtatatatacttttctgtagcttttttacttggatattatactatattaatacctctattatcacattgggtggatgcattacaaatttacctctccaatcccctattgattgattaatatttggtattttctaatattgtattatgactagcatggcagtgagcatatttatgtgtaaatctttgtgaatccttgtaaatatttctgtagggtattttttaggagtagaattgctaggtcaatggtatgatcattaaaaaaattgggagatattatcatatttccctccaaaagtgtaatggagaccttttggaaggcagtggagcaacatgtaaaatgagccataggtatagtaatagtctatttttagaaatatagtgcaaggaatagtctaaaatatataaaaagcaagaagatgttctttcagttatttatagtagcaaaaatagtagaagcaactttcaaatgtctaacaatgaggaaatggttgaataaattgtgctgtatccatttggaccattgtgaagtcttaaaaactgtagttataaagactatgaatttttttttttcttgagatggaattttgttcttactgcccaggctggagtgcaatggcatgatgtcagctcactgcaacctccacctcccgggttcatgaggttcacctgccttagcctcccaagtagctgggattacaggcatgcaccaccatgcccggctaattttgtatttttatttttagtagagacggagtttctccatgttggtcaggctggtctcgaactccccatctcaggtgatccgcctgcctcggcctcccaaagtgctgggattacaggcatgagccactgcgtccggccaagactatgaatatttttatgtcattgtcagttaaaaaagcataattcaaaaccacacattcactgtgattacagctaaataagaattagcatgcatgtaacacaaagaggggaaaggaatacagaaggaaaataaaatcgatctatcagggtagtggaatgatgggaagatttttccacctaaactgtacattttattactttcagggtttaaaaaaaagtattcataaaaaatgctactgcctcaagataaaatatcaattgatacagaaaagatgagttaagatttcaatccagaggctagtgtctgcctaagagagaacaaaacgagcctgtcatctgttctcagcccatcatgtttcccatgtgtccttatacattttaatgattaaagaatgaaataatgattagtgtgaatcttgaatttacatgaactaatccagggaaagcaacctcaggaggcatggcataggtattttgttccagagagcattttgaaaaataccaccaaagaaaaagaagattgtatagcaatttttttcttttctccagccagttactgtattttcatgttataatgaaatcagatctcatttatggtagtgggaccctttatatatatgtaggtaaggtagcatggtgttaaaggccatttcatatttatcaaaatgatatcaaatctactgttccaaaatgatctggttgctttgcacatttaaacgtaaatgtttaacattttcaatttagagtgagtctcagaaatttctggatcccattatcagaaattaatattagtgctatatttcaataaaataagtacaaattaggagattttagtttgatcttagattttttttttaacctgggagatatgaaaagaacttgtatatggtatagcaaacatttttcagccttgaatcagaaaaaaacattgcagcaaccacagggagaattcattatatttttaggaatgtgtttttccttcttttctttgacgtgatttgtatgatgttgttgagtctggactttttataatgctggtctctcaattaactgagatgagaactgatttagtaacggtaagcaccgttgccaaagacctgctggcaacagcaattttctcaggcatttctatttcctggggtggtaactgttacaaaagaagctttttcagaccaggtttggactgtgagttcaagatggagagcatctcctataattgcctgtcttggcctggtatagagtgactttctttcagaagtttgaggtggaagatccagctggttatgctgaaagtactgttgagtggattctaattccttgggaggtctttcgagtgctttttcctataatagtccatttcagtgaatgaatagatattaggcatttggcccattctagaattctaaaagttggaagggtccttcagttacctttttttctcataggaaaaacaaaatgtgactgggttgagtattgaataatgttctttatgttcttatgcctctactggaaacaagtgggatttttcattagtttgttcacattagtatgttaaggctttcggacactcagtactagtaattctgaaacagaatcacaaaagaataatactgcacagtatcttggggatgggggaaaaagcttggtgcaattttcatatagaggattttacaatgttctaccccccccccgaaattaacatttaagggaaagccaagttttcttgctagccagatacattgcaggatttttgggtaattttgtccttattttggcaattccaatcgaaagcttgtttttcttctccctctaatttcatctttcaagctctatactacataatgtttttttaaaagtaaaggttgttttcagaagtaaaagcagtctctcttctgtagctcaatagtggcataccagccagctggagacaacagtcacacctttgatgtcacagcgatgttcaagtctattgggatcttccttggaatcttcagtggatcttttgcaatgggtgctgctactggagtggtgacagctttaatatccttttgttatatttatcttttcttgttaacataatatagtagttgaatgctgtattccgttgtttttcctagttctatgattagaattatgttagaattattaatcttataactaagtacttggtttgaaaacattaagcaacagtctttgccaataaataaataaaagaactgtattgttctgcatagggtttggtgccctaaaactttcactgcaagtgtataattagagatgatatctctctgagggtgaattttatagttgtagattaaatagctgtaaaggtagacatattccaaagagcctctgggtgttctgtgttgctggtcagcctggcagtcttttgctctttgtttaataggacaaataggaaatgtacaacagcgacgccgaatgaacaaaatgtgtttccttggttaggatatgtaagagttcatctcagctctcccgattttaaactttgtgctctagagccctggacgggaagcccaaaggacctgagttgtagtcctggtactaccacttagtcaagttattcttgtgttcatgcaaaggccattttatcccggacttcaccaccatgcaatatatccatgtcataaaactgcacttgtgcatcctgaatctataaaaacaaattttatttttatttatttatttgttttttgggacgggggcgcactcgtttcgcccaggctggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcctcagcctcccaagtagctgggattacaggtgcgcaacaccacacccagcaagtttttttatatttttagtagagatggggtttcatcatgtcggccaggctgatctcgaactcctgacgtcaagtgatccacccacctcggcctcccaaagtgctgggattacaggcatgagccaccgtgcccggcctaaaaacatgttttaaaccccccacccaaaacaaaaagccagaaggcatgtctggatcacctgctacatgtgctgtgctctgtgtatcaaagctaaagaagacaaacatgacctctgcctccctggtgctttcgatatagtggcagacacaaacatgctagaagctttgacacttcacctctttggatctcagtgtaggaaattggagggtggggacggtaggaaagaggagtgggactagatgatgtctaaagagtttccagctctggcctggtgcagtggctcgtgcctgtaatcctagcactttgggaggccatggcgggcggatcacaaggtcgggagatcgagaccatcctggccaacacggtgaaaccccgtctctactaaaaattcaaaaaattagccgggcatggtggtgggcgcctgtagtcccagctactcgggaggctgaagcgggagaatggcatgaacccaggaggcggagcttgcagtgagccgagatggtgccactgcactccagcctgggcgacagtgcgagactccgtctcaaaaaaacaaaacaaaacaaaaaagtttccagctctaaaacttctatgatacttgtataaaacagatacgttattctttgtcaaggacttcttagtttggtatacttcagccttgtgctggaagaggcttcttttatggctttttataagtgaactgaggcataaagcagcagtaaaaagagttctgaaggtgatgccaagagtgatagtatctcttccccattacaagttccttgagggtagaaagtatatcttgttaatcattttgttgtagtgcctagttgtagaaatgactctagattctagcctgagattggtcgtaacttggcacaggcccttccactgtcagctaacaaatacttgttaaactagtataaagcagtgaagtgcctcaatttcttcatcatggaatgaatgctctatatcatagaagtggtagaggatcaaattcgtgtaaaatctcttggaaattatgtatttttataaatgtaaattgctacaattatggaagctgtctagctttgggtctcagattaatagaggtggcatgttatagatctgatctgttactcccgtctctatctatcctttactgcatggtttctggcaaggtgtgtgatacccgtgaaacaattggagtggctaagccgtaaggcttcctcactgaagggaaggcagctgactcctcagtaagatgctcattttaaaagtctccctattctggtggtaccttattctgagatttctgtgttagagaagctagagaacctttctttcatggttgccttgcttaaactgttattttttctagtcacacttttgtgttacaagatctcattactagccttaacagtcttacgtgacaaagttcaccaaattacgggagttccagttgttggagacaggcctgttcttcttgatgtcctggagtaccttcctcttggctgaagcatggggcttcacaggtaggtgacttgctccctttgattgtcaacccttaaaaggagtgactttgccagtcaattttgctccaagtggatcagctccgttagtatttgaacatacttattgtggttgggatttaggttgttgctttagaacataaaaaaaaattttcagtggaagtggttcctcttaacaaagtaagtcacaaatgagaatttccagacaaagcctataatctactgtgaagaaagaacctcagtataaaaggtgggaaccatccttttatgtgaacttggaatttgttgtctttataggtgtagttgcagtattgttttgtggcatcacacaagcacattatacgtataataatttgtccacggagtctcagcatagaactaaacaggtaagaggaactttatagtttgtgaataggcttttccttctttcagcaaaatagaagtcttttttactaaaaaaaaaaaatagtctttgatctgttcaagatgctatctactcattttggctcctcttcctttgactctaaaagtaggtgggattggcaaaatgaagaatgacagcatttagggtggaaatagatcagcagaatagccagagactgttactattgtggcttcaataaccagtgaagtagcttccctttttctcagtgttttcccaatttaatggcttttaaggggaatgttttggaagctcactctggttttacttgaactactgctgtgtgacgtagataaggttaacttctgatctgaccagacctactaagagatgacataaagaaaattaacttctgatattactagaccttctaagacatgacataggtaagattagcttctgatctgattagacctactaagagaagataaacttccttcagtccgctcaggtgctgcaaagctactatgtttccaggaatgtcaggggactagtcagtggtctggttttatttggtactgaatgatcagttgtgcagggtatctgaagggaattataaaggagataggaatacaatttttccagtcttaggaggtatgtgggacaaatacatgaaaaaagtgtaatgtctggaatagaaataggtgcatacttgattatggctatagtgagaaacagaaggtttaaattttgccaaatgacaagaaggttgtgggattcgcctgaaaaggagtggtgctaaaagcaggagcaacagtatttcttcttccggctagagccacaaatcaagtttatgacctatgcttttccccagcccctcaaaagagattaggctttttcccccaagtgtatacattagggctacaaatcctttttacaaattaattcagtgcaataagtaaagagaagaaaatcagctggcagggggcggtgggggaggggagtcagcatttttccaggtcgtgggaagggaataaaaaacaagaacaggccgggcgctgtggctcacgcctgtaatcccagcattttgggaggccaaagcgggcggatcacccgaggtcagaagttcgagaccagcctggccaacatggtgaaaccccgtctctactaaaaatacaaaaattagccggatgtagtggcttgcgcctgtagtcccagctactcaggaggctgaggtagaagaatcgcttgaacccggaaggcggaggttgcagtgagctgagatcgtgccactgcactccagcctggatgacagagcgagactctgtctcaagaacaaacaaacaaacaacaaaaaactagaacagggtaagagcttccagtgttgttggtgatatgatatgaagcttatgtacatttaagaaatatgaggaataggaatcctagattatgtacttcagattatatgtcatagaagacatcagagaagtaggggaaatggtttgaggcttgaggatctggaaagtatcctagaagaaacagtacccttagaaggatggggaagatttaggaaggcctaggggaggcagtacagataaaggcaggaataaaaagaaggcagtaaagtgtagagcagagggtggcggactccagccctccggccacatccggcccttgccagtgagctaagcatggttttctttccatccatttttaattggttggcaaaagatcaaaagaagaatatgttgtgacccatgacagttatatgaaattcacatttccatgtccaccaataaaattttcttggcacacagccacacccattttttaaaatatatagtctatggctgcttttgtgcttcactggcagagtgaagtagttgtgacagagacttcttggcctgcaaatcctctcatgtttactctctggccattcatgggaaagtttgccgatccctatgttgcaaagtaaagctgggactctggagtcactgtattgttttaaatcctggttctactacttgctggctgtgtgaccaggaggaagttccataacttctctgtgcttcagttttgccatctttgaaaatggagataataataatacctacctcactgagtttttgtgggattaaaacgagataatgcatatgaagtccttagtatagtatcagacacacggtaaaaactgaaaaaggtatagctgttatcattagtataaataagtagtaataatagcatattaaatcatttaaagaaaaataaatatacgcttacttattttaatttttattctcatttttgggtaataaggcaaccctggtttaaagagattaactaatttgcccaaagccacacagccagcaaaggggaagacagggctcaagcctaagcattttcattcttaagcccatgttcttaaccactattctgttatgtgtcagagggctcattgtagataactctggtggccagagggacacgagattatgaagggccttaacttcattcagcaagtatcatataccattgccaaggctatgatgtgaatgggatggggcaggcgggcagcagggtttagttccccccacagatagttctgctatcctacagatcgatctcttccacaatgtggaagcccctatctgtaggacgcttactccctatacgagaggaagacccacgcaaaaagtgaagtcacagggcaagctgggagtacgagagttctcacgaagcactctatgctaggatcagaaagttgaaatgaatcttatagcttgcaagaggaaagtatcttgaaactatcagttttagagattcattggtttgggggagctggaggatgagggatggttagaggtcctttctcatcattatgggtaggaagtgatgaaagtttgactaaggcagtagcagggacacaggaacattaaaaaaaactgacagtttggaggaagaggagaggaataattgaagatggggctttgaagaagggaagctgttaggggaaatgagggggcaacattcctggctttttctgcaggactagaaatgtcgtctccacatttgctcccttctgaaccacatattttgtgtgtatgcatgaagtttatatatatgagtgtctgttttaatatcttagtaatactcatgctttcaaattatgtaactttatttgctggactaatcttttacaatttcgtttcagttgtttgagcttctcaatttcttggcagagaatttcatcttctcctacatggggctgacactgttcaccttccagaaccatgtctttaacccaacatttgtagtaggagcatttgtatcctttattatgtgttttattttgaaaatatttttaattgagattttcatgtgggttttgagtatgtggttcataagaatacatttaaatatatacagttttcctctgagtaaaacaaataaggattccagctcttttttctagtctatttattttattatattctatttcaatttgtggttattgcacaaataatgttgacagattaaaatgacagacaagtgtcccactgttctgccaaccccaaaagataagtgttttccctttattactacagggaaggagaggttggatactggggagcagttagcagtctatgccacagggcagaaggcgaaagataaggaaacgttgaatgaggccactttctttctctttctctccctcccccaacccctctctctccctctctctttctctcatatatatacaaagagtcttataaaataaaaaccccaacctgggcaatgtagcaagaccccatctttacaaacaaaattttaaaaactagccaggtatggtggttcatgcctgtagtctaagctacttgggagggtaaggtggaaggatcccttgagcctaggagtttgaggctgcagtgagctgtgattgggtcactgcagtccagactgggtgacaaagggagaccctgtctcaaaaaaaaaaaaaccaaaaaaccaaaaaacagttggaaggaagaaactgagtatatgaaagagaggaggcaatagtgaaagcctcttgagaaggcaggaatgaaatccaaagcatgtagagagaaattttgccttcactggaaggagagacaactccaccatgactacaggagaggatagggtatgtagaaatgaaggcacatttgtaagatggagccatcctctctgatggcttctatgtttatctgttaagtaggaggtgagatcatctgctgagagtaagatagggagttatctattgtgtaacaaattaccttaaatttagcagcttaaaacaacagacagttattatctcacacagtttctgagggtcaggaatcctggagcagctcatctgggtgattctggctccaggatctcttaagaggtcgcagttgtgctcttggctgggactgcaccttctcaagacttgactagggccagggaatccactgcaagctcactcaactcacatcactgtcagcaagaggcttctattcttcacgtggatatctccatagggcagcttacaacatggcttcttcccccaaactgagtgagctgagagagccctaaaatgaaagccgaagtgccttttgtaacctaatctttgaagaggcataccagcgtcacttccataatattctgttggttatacagaccaacctggtacagtgtgggtggggactacacaagggtgtgaatactaagaggcagggatggttagggactatcttgggggatggcttacacagatcatagggattttgaggaagatggaggttcgtgaaatagttgttgtagagagtgggagaataagttgaccaaagaaactcaacaggactgctaagaagtactagggatccattgtgtttgagaaataggaattagcagtagaaccaatctgccccattgaatgagtttgtccagcagtacttactgtaagcatggaaaaaagagatagttggctccttccaggtttggagttttttcaagtgggtgcaatgaaaacagaaggacaagagatcatagtgttattacatgactgatgcactctaaacacttcatttaatgtttaacattaaaaggtgttattaacatgatgataagaagggaagtgaggaaagaagacattgtttaaggaaagaatatagggatctttggactgaaggtcccagtgctatggaggaatgatcagagtgggatagttgaacacaaaatatggaaggagcaattgtggtcagtgggaatgtttgaataaggaatttttaaaagaaatattttaaaacctcacatcagaatgaagattctgccaaagagattagtggaagtttttttttttttaattaaaactctagataggatctctgttagaaagcgaagtattactgaaatactattctgcagagccttagtctgtgaatgaactttaggcaaaaaagataaagtactgttaataagagaagttcttagctgaaagataaccatgagatcagtaacttaatgtcctgctagtcttggagaaaatttggagcagtaaagtggctcgatccactatacttagtctggaaacaaagctaaatattctctgtaggtttctgagtctgttaggaattaaaattcctcaatacaaaatcctaccatgaaaatggcctcgtaacaggagagagttgctctatttctggctatgttagttaggacataggttggtttcatgtgaaaagactcaaactaatccaggtttaaacaacatagaaatttctttcttatctaaaaatctgaactggtatggcagttctgctgcatagggtcatcagggactgaagcaatattgttgctaacatccttagggacttgctgttgttcttgtgatccaacgtggctcacccctgtctgcccgttgccttgaagggcttgacccagaatgtgcacacgtcccttccacttaacatcattgattacacctactcacaagggaggctaggagttatatactttatctgggtggctgcataaagatgaaagggaggagtgccaactaccaaggaagaaagcaagaacagatgttggggagaactagcagtcactgccacgttggcccacatgtttcgtggttacattttcttttctttttagggaatcactttttaaaataaatgtttgattttagaatagttttaggtttacagaaaaattgtgaagataatacagaaagttctcatatgccccgcactcagtttcccctattattaacatattagcatggtacatttgtcacagtgaatgaactaatattgatattactaactaacgtttgaactttattctgattcccatagtttttccctaatgtcctttttctattccagggtcccatccaggataccacattacatttagttgtcatgtccccttaggctctgcctgactgtgacagtttctcatatgtgttcattgtttttggtgacccttgacagtgttgaggggtactagccatgtgttttgtagaatgtcctgcagttggaacttgtctgatattttccccatgattagactggagttacatgttctttgggaggaagaccacagaggtaaaatgccattctcatcacattatatgaagggtatatacttaataatgttgacgatagtcttaatcacttggttgagatagtgtttgtcagatttatccattataaagttacacattccccccccttcccccgccatgttgtactgcgtggaaggaagttgctatgagcaaggattgaggaatggggagttaggttccacctccttgaggacagagtatcagcaaaattatttggaatttttcacacaggagatttatctattcttcctcatttattgttttattcagtcattttttaattattattacttttttttttgagacagaatttcactcttgttgcccagactggagtgcaatggcatgatctcagcctactgcaacctccgcctcccgggtccaggcgattttcctgtctcatcctcctgagtagctgagattacaggcatgatctgagattacaggcatgcgccaccacgcccggctaatttttatattttcagtagaggcagggtttcgccatgttggccactctggtcttgaactcctgacctcaagtgatctgcgcctctcagcctcccaaagtgctggaattacaggcgtgagccaccacacccagcccagtcatttatttatatcaatatggattcactgatatttattttatactttgagttataatacaacttttttattttcttgctgaaactgttccagcttggccattgagagctcttttggcaggctctcctgtgtgcctttgatatatcctcatcattgtttttaatttttatcttcatcattgtttttaattttttttttttgagtacttccttactccctggaactataagatgcttcaggctcatcttgtatctgttctggctcagcccaagaattggccatttctccaagaagtcctggttccttttattggagaatagtattagaaaccaaaatctgagcactaggtgtgctcagtgttacttggtgtctttgcttctaggccgtctcagctgacagattgcttctaggctctctcagctgacagagcaaggagttagatatgtatatatctatatatccatatatgtagatatatatactaactcatatatacacatatatctatacatatttctgcatataaccatctgtatctctgttaagctcaatatgggttcatactgatgtctccaactttaattcattaccacatggatgattctggcctcctcctctttctgaactgtaaactcccattctaacagtaagaaaccttgttgtcaccacttgccatccatttacctaattgttcagtttcagtatacatgtataatagtttcagaattgttaaccagtgttcccatgggaaacagctttgtcatgagcatagaatgcttttgtgcagtgtcttctgtctttagtcttacagattcttctgttttccaaagttacttagaccaacaccattccccctaccttgtttgttttgagacagggtctcgctcttgtcacccaggctggagtgcagtggcacgatctcagctcactgcagcctccatctcctgggttcaagcaattctcgtgcctcagccaccagagtagctgggattacaggtgtacaccaccacacccggctcatttttgtatttttaatagagacaggtttttgccatgatggccaggctggtcttgaactcctggcctcaagctatcctcccgccccggtctcccaaaatgctgggattacaagtgtgagccaccatgtctggccttgttctgtttttaatcttagattttcccttatatttttctcaggaaatgggatggagactgtatcgtgactcctgaaataaaaattgccatcataaagcaggagtcccatagacagcaaactggagaaaaagatactaaaattggtttctagttaaaaccaatctgaattcacattaaactttccctttgaagcaagttggaagtataaacttagtggagtacagtgggactggtagccattttagtgctgtgaggtggtgattcagctgcccttttctttgttctgaggaaggaaggggaagttttctcagtattactcttcttcctaccaacactgacaatgaaagtgaattaacctattctattaataatcttaaaagtatagtaaagaaactgcttttaaacgtgtttctcttaatctagtaaatttcctgcatgttacacttgctctgtctgatttggtagcaactagccaaatgtgattattttaatttgaagtaattaaaatgaaataaattttcagttccttgatcactctagccacatttcaggtgctcaccaaattggacagttcagatatagaaaatttccatcattgcagaaagttctgttggacagtgttatgttagacaatggaaccaagagactgtgtgttagaaactgagttccctaaaatagtctttcaccatcttgagtgtatagtctaaataatattaatagtaaaatgaaatgatccttaacctattaataattttaggttgctattttcttgggaagagctgccaatatttaccccttgtccctcttacttaatttgggtagaagaagtaagattggatcaaattttcaacacatgatgatgtttgctggtaagttgtaactttcttctcttgcccacttcaagcaaccattcacaatgcgtgtgccagcttgatgtaacactgagatgttatgctggtcatataatactcctttatttttatattatttatttatttagagacactgtttcactctgtcgcccaggctgtagtgcagtggcacgatcttggctcactgcaacctctgcctcccaggttcaagcaattctcgtgcctcagcctcccaagtagctgggattacaaggcatgcaccaatatgcctggctaatttttgtatttttagtagagatggggtttcgccatgttggccaggctggtcacgaactcctgacctcaagtaatccacccaccttggcctttcaaagtgctaggattataggcatgaggcaccacgcctggcctataatactcctttaaacattgaagttgcatccttgaatagaaaaagaaaatgtatatatatatatatatatatatatatatatatatatatatatatatatatatatatatagtgtcccattcccttctgtgggaatttttcatattctgattccaaatccttggttcagaattatgtcatacaaagtgagaaagataaggatgaagtcattttcaaacaaaaaccagtaggtgaatgtatagcagttcttttcataattgccaaaacctggaaacaacccacttgtctgtctctcagtggtcaaatagctaatcaaactgtgatacatccatgctatggaatactactgtgcactaaaaagaacaaacaatttacccatacagcatggatgaatctcagaggcattatgctaagtgcaagaagccagtcttgaaaggttacctgctgtgtgattccctttatatgacattcacaaaaagacaaagtcgtagcgatggggaatgcatcagtggttgccaggggtttgatggagtgacaagaggttagactaaaaaagggtaatacaaagaaatttgacagggggagggatgatgaaaccattctgtgtcttgattgtagtagtagtcacacacacctctatgaatttgccaatattcatgtggctatagaccaaaaagagtgaattttactgtttgtaaatgaaaagtgaatttaaaaaaattactgaaacatcaatgcatgtcagtaagtaacatacacaaattctatttctgtttgtactttttttttttttccgagatggagtcttgctctgtcactcaggttggagtgcagtggtacaatctcagctcactgtaacctctgcctccctggttcaagcaattctgcctcagcctcccaagtagctgggattacaggcatgcgccatcatggctggctgatttttgtatttttagtagagatggggtttcggcatgttggtcaggctggtctcgaactcctgacctcaggtgatctgcccacctcggcctcccaaagtgctgggattacaggtgtgagccaccatgcacagcctggacatatttaagtatgttaatatttactgcatatttgttcacatgcttctaagtttttagaacgtgctttcttgctctgaatttatgaagcttgcattggtaatgagttattgaagaaataccttttctgttcccctgtaggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcaggtaagtactaactagagacctcattttaagattaaattttaatttggtttatttttctgcctgttttcaatttttaatctttggagaatctgtaatgttttattttttccttttaaaaagtatgtaatatatagtacagaaaaaggaaaatatatatgcaaaagaaaaattcattgttaagactttgagggatatctttccagatcttttgctatacatgatatatatttttgacaaaaaggggcaacactgaaggtactcttgtagcctgatttttaaatgtaatatagcatggacatttacattgtaaatatatttacatcattgctttaatggctgcatatgtcctgatttacttaatcaaaaccctgttgttggacttttgtattgtttctaggattttgctattaccattaccatttgaggattttgctgttactattaccgttaacgatgtgaacattcttaaatgtatacaccactgtgtacttgtttgattattttttagaatgcatgtctagaaatgaaattgcttgctcaaaaggatatgtatatatttaaggcttttgatcaatatcaccaggtcagataaaaaatttgccttccacctgcaatgtatgagacaatgcggtttactccaaccctaatcactactagatattatcatttttctcatcagcactgtttttaacctaacaatccaaagccgagatcgtgaggtcttagtcttgaatgtgtaccagttaatgtattcaatttgaaagctcccttgtatctcaagagttctgcatttgtttccatggatacagcagcctatgctgctaaagcctttgtagatttgagttctgtgtttggctgaaacttcatagacattaagagctaccaagcttccagaatacataggactcattagagaaaacagtatttcacactttatagatcctgtcctccatttttttaaattctattacaccttttttaagacttctaaaaaccagccagccctaaatcacactttgaatgttgttgttattgtcttaatttctctttactattcaaatctcttataatttctgtgcttttattgtgcatagtataaaatacacaaaaataatgttcttataaccttaattattactttagggaggacctggcatttattgaacacttactatgtgctgggcattgtgctaagtacattttacatatttatccaaacatgataactccattttacaagggatgaaatagaggcttagaaaggttctgagttgttcaaggtcatctggataattaaatggcaggcagaggagcctccagtctttcttaatttttttagaaattaatttcatcaaataatggtcatggtacattttgaaaggacacagttcctttcttttctcaagagcttgtagatgaagactttccctcattgtcctaaggataacaaaattaaatgtaagaacaaaccaaacaaaatatctacgcttaccatccccgcaaaaagaaaagacaaaaacgtacctactcacacaaaatttaatctacatcactagctgtcaaagctctttggccgcatagtgcctgtcctgtaacatagttggtcacttaattataatattgtcttatagtcttaggttacttcttattgccttcttgttttattggcattattcttggcctcttcgtgaacaggggctgtattttaagcttttcttccctccccccaaatttgtctagtacaattttaagggcactgcaaagtcctgaaagtttaagattcatgcagacttagacttggctttgagttcttgccccttcactgatgaattctgtgatctttggcaagttctttaaccttttaaagcctcggtttcctcatctgtaacatgtatgttatagtacctacctccttgggttgttgtaaggattcagtgagctaatatctgtaaagttcttagcacagcatttcaaattaccttttattcattcattcaataaacatttactgaacaccagccatgtgccgggcactgtaggttacaactcagtggttctttttttttttttgagacagagtcttgctctgtcgcttaggctggagtgcagtggtgcaatctcagctcgttgcaacctccgcctcccaggttcaagcaattctcctgcctcagcctcccaagtagctgggattacaggcatgcaccaccacacctggctaatttttgtatttttagtagatatggggtttcaccatgttggccaggctggtctcaaactcctggcctcaagtgattcgcccgcctcagcctcccaaagtattgggattacaggcatgagccatctcacccagcctcagtgcttcttaactggggagaattttgccccccgcccaagggacatttggcactttctggagacatttttggttgtcacaactggaagagggggcctctgctggcatctagtgagtagaggccaaggatgctgctaaacatgctacaatgcataggacaggctcctcaccacctgccaacagagaattatctaggccagaatgtcagtaatgctagggttaagaaatcctcctctagagaagcacagtgatcaaaataagatagaaaaggttcctcgactcataacatccatactttagtgagagaagacagacaataagctagtaacacataaatgaacctgataactgcagatgatattaaatgctgtgatgggaatcgggcaaggtactgtgatagtgactggggatgggggtgtttttgatacaaggaggccagggacggtttctttgagaggttatgtttgagttcagtcttacctacgtgactagatggtgccagttaaacagtcatcaggaagaagagcagtctaggcagagggaagagcaagttgtacaaatgtcctgaggaagggacaaacttggcctgttgaatgaacaggaaaaaaactctcatggccggagtatagtgactgaagggtagataggaagtgaggttggcaagatcctatggaagcaggggttctgcacacttaactgtcaagggccagagagtaaatatatcaggctttggaggccatatggtctgtctcagctactcaactctagtgtgaaagcagccctagacaatatataaatcaattggtgtggttgtatcccagtaaaactttatttacaaaaacagaagaggtgctgatgtggcctgtaggctgtactttgtggacccctaatgtatagtcttgtggaacatggtaagggatttggattttaaaatacaattggaaatcctggaggattttaaagcaagggagtgacatgaagtcatttacagtgtaaaaggttcactttagttgtcatgtgaacggtggatccacagtaaatttgaaacagccagctattcccatgtcctttcacatagtttgtgacagtcacatttctatcatttactacacatgctttgcacttctgcgtctctgagcctttgctcatactgttccctctgcctggaatgctctttcactgtcagtaaatgacacagctaagtgccacctccttttccctctgttcttttccctcggaaccactcttatgttggtgcaacattgggcctcttcattgtagcacttattttattcagtcttgtgataatattgttataagagctgccacttagtgttaatgtttcagatactcttttaaaagcttttcatacattttctcattaaatccttgcagcaactctgtgtggtggatattagccccattttccaggtgataaagtgatgatttataagactgcctcacttgactgagttcacacagctagaaagcagccaagtccagatttgaacccagagctccctgatagaagcccttagggattatgccctagttgtgttggtttcccccactagtctgtgagttccttgagggcaggggccatgtttaattcatttctatgccctgtgcctagtacagtgcctggcaaataataagtgctctataaatgtttattacattgacttagcttctaataatgtaccatctattacaagtgtgctatcttcaagaccactagatgtcactggagatgcataaatgtggttagagtttaatgtgactgagaagatgttaaaacagctcctggccattttaacaaaggaaaaatgagccattctttgaattatgaatctggtcatagcaatctgttttcaggtccttgaccatggttcccttgctttccagatgcagccttgcatcattttctcccttcagtgttatttgtgttctgggatgctactgctacagcttctagtactgctattttttctgtgttgtctgtagtagttaatttaatcaataaacatttgagcacctattgtgtgtcaggtactgtgctagactctggggatacagagatgaattgagacatggcctttaccctcaaggaactcacagtctttttggggagactgacaggtaaataactatactctactgtgctaagtatcataataaaggactgtagaaagtgctgcagatgcacagaggagaaaatgattctgcttgaaggggtcgtagaatggttactttggaacttgaaaatcgcttaaaaaatgagggaaagcacattgcagctggagagaacagcatgagcaaaggcatgggaggcacaggagaggatggatttggggagatgagcaggcaggtatagctagaatggggcatgtagaagagaatgatgggaaatgaggatggaaaagtaggttggagtggggtggggatgctagtttgtagagagtcttgaatgccccacaaaagacttcagacttgaccctctgggttgtaagccactctcagagtcctttgtcaagggagtaacacagcgagctctatgctggcgacagctgactctcggggagagcctggcagctggaaaagcttccacgacagagcccgtgagcctcaggatgagggctgcccttgagcagttgggatggaaaggagagaagacttgagagaccgtttagaggaggaatgaacagagtttgtgagtgcccgtgtttagggaatagagaggagccagagaactttgtagtgaagcttttccctgggatacagaaagcaggaattttaaacagataaaacaagagttgtgaagaagcaaggctaatgtctatccattagcctatgaaaaacctgtaattgggccctctcttcagtcatcgtaacagaatgttgccatgagagctgcgaagtgaattgcactgtgccatccttgtttttggagctagccagtaattcttatttagcaactggggcagtgctgctctccctgattccgcttcgagtggacctatattcagagaaaaaaaatgctgtttttttctgaaactggtaagtaagattgcaggaagagaatcatgggtacaccctgcttgccttagaatccaagctgttgctaaggaaagtggcaggagccaaaaatctgcatcaacagctatagagaagcaagaaaacattaaccattccatagcttctgtgttgagaaaagtagttgcctgacaatgtatatgtgtgaatagaccattttttggcttcaaaatctcatttgctctttgtctttctcctttagggttggtgttgattcagaccaagaacacttggtaaatatgcgtttttgttgttcctggcatttctgtcaaatgtgcagtcatttggaaagaaaacaatctactataaacttcaaccttctatttagatcctgtcctctttgcctcagctttggaggaatgatatcattcctggcttttctcactgctccatagagacaaaaccaagtttgccacagtgccatagtgtgtggttatcaagggtgacagctttcatgtctctgggccatcctgcctgggcttttgtcccagaggagagcagtcttttaagcactcctgggttttcgagtgactcctctggcacggggaggctttttccactttggtttgcgcatgaaggcttgtctctgatgtaagccccactccagctgctcttcctgtgtaactttcaaatcgaatgaccagcagctgccctagagaactgcctagaagcttttgaatcttcaaccagtcttccctgcctgctcagggaaacgcactttcttaccttgcccctcagccttggccacgtttccttgcttccttccttctgttgtgtcagtttctcagttgttgctatgaacttgagcccgttggactgaatgcattgtaactcactgccctctctagactgactacccttgtctggtattttccatctgtttttcaattgcttctgagcaccattgaatatgtgtctccatatcagacgttagatgagaaatcacagaaattagatttttgaacatggaaagcatctctttcaaaacacaatttttttcttgtcagaaacaaaccacagtcagtatatttgtcttcagggtgaggttaaaaaaaacatttctcagattcatttcctaaatgctaattttgttagctgttgagtgatgagtgtgaatgtatgtatgagatatagtaagtacttgactcttgtggtcagagccttaaagtagaattccatgggcttgacatacttgtaaaaaccaagctggataaattcccatgatgccgggctcctggtgtagtgtccaaggggtgataattcctcagtgcctcctccctgtgtgaaaacaagaataaagttaatcatgcagttcaaaagacaaatgctcgatcactgtgtaagtctccaccagctgtgtcacctgtgtaaccacagaggagaaatggaaaaggagtgacagggagagagccaggtaggtgagtgccagtcgtgacatacagaacaaaggaccgttttttttcccataccttcaaaaccctatggctgggccgggcatggtggctcacgcctgtaatcccagcatattgggaggccaaagcgggtggatcacacgaggtcaggaattcgagaccagcctggccaacatggtgaaaccctgtctctgctaaaaatacagaaattagctgggcgtggtggtgggtgcctgtagtcccagctactcaggaaactgaggcaggagatcgtgccactgcactccagcctgggcaacagagcgagactctgtctggaaaaacaaaaacaaaataaaaaaaaaacaaccctgtggctgtcttggttatattgttcctttaatattttgaatgtccacgagaaagcacagaggaaccttatactaagtatggagtgtgtgggggtggggtatacaggtgttcatgtggtgaggggtggtgaaatgttgttcttcaagaggtggaggcacagaaagatacttctatgatgtgaaaggaattgcaggtgttcttcagctttcgtaagcccatacagtgtttccaaacatttttgtgttatatataagttgatacatgacacgtgacacgttgaagcagagagaaatttattttgagcattaggaaggacaggaagaagccaaaacccagaatctaaactctgtgcttgcttgcttatttatttatttatttatttacttacttactgagatgaagtttcactctgtcggtcatgctagagtgcagtggcacgatctcaggtcactgcaacctccacctcccagattcaagcaattctcttgcctcacccttccaggtagctgagactataggtgcctgccaccacgcccagctcatttttttgtgtgtttttagtagagacggggtttccccatattggtcaggctggactcgaactcctgacctcaagtgatatacccgccttggcttcccaaagtgttgggattacaggcatgagccactgtgtctggcctaaattctgtgcttttagaaaagaagattatggaaacatagaacatgagcactggaaagggccttcagaattctctaaccctcatcatgtttttatacatgaagaaattcgggcccagagagagaaagggacttgcttaaactacttaatgtcaataagctgggactggaagcagattgcctaactgcccaactgctgactgcaccatattacaaataaagacacagtttatatttttggaaacttttagaagacgcctacttgctatgttagtttctcctcctagctggtcaggcttaccatggaatttccctacttgtttttattttgctagtgtttcaagaacatagtagcaactttgaagttgctagttattttcgagatccatgacgactcccaaatatagggatgttgatgtgatattttctaaggtgctattattacattgagagttaagtctttcaggttcagtacatgaattataccacattgattttttttcttttttttgagatggagtctcgctctgtcgccgagtctggagtgcagtggcacgatctcggctcactgcaacctctacctcccgggttcaagtgaacttcctgcctcagcctcctgagtagctgggattacaggcaggccccaccacgcctggctaatttttgtatttttagtagaaacggggtttcaccatgttggtcaggctggtctcgaactcctgatctcgtgatctgcctgcctcggcctcccaaagtgctgggattacaggcatgagccaccacacccggcccccacattgattttttaagtgagagtagattcgtaagttagcaagcagcctgagtaatagaggtgttcagaaaaacatttcaatttcctattccaaagctgcaatatacaaactattaaatttctaatgttacccttgttggagagtgtcttataatatagtagcctctatttctgattctccaaaggaatggctctaaataaatgttcatatctttgtatagatattgatttctgtattatctatctgcagggtgttcctgaaaatgaaaggagaactaccaaagcagagagtgcttggcttttccggatgtggtacaactttgatcataagtatccttaattgagggaaaaaaaaaaaggataatgtggacatagataattacagtttaatggaacaagtgttttgactattctcttcctggagcagaatataaaacctacctttcatcttccctttccccatcagtgctgtggaaaaggaaacccacacagacagattcctcttcaaacccatgaaaccgtagggactggtcatttcagaagctggctgtgtaaagggaaccaaagcccaaatgacatactttctttgatatataggtttatttattgagcaaactttaatatttgttgtcctttagctaatttagtgaatcccacagaaggtatttcttggttcttgtctgcgtacttggcagggtaagagaggaaaggcttgggaaaaagcatgagaatgaaatcaaaatgcgataatgttcaatactgcgctgttcagcaatacacttttttttcccctgacctttccaaagactaggagattctctctgttcagcatgccacagatagctaatgtttttgtttgccagatttccttcttgccctgttgtaagtctgtttcatagctgtactttgagtagtgttgatattctataacctctttaaatcagggatccccaactcccgggccgcggaccagtactggtccgtggcctgtcgggaaccgggccacacagcaggaggtgagcaatgggccagtgaacattaccacctgagctccgcctcctgtcagatgagcagcattagattctcacaggagcccgaaccctgttgtgaactgcacttgcgagggatctaggttacatactccttatgagaatctaatgtctgatgatgtgaggtggaacagttttatcccaaaactgttttgttcccagcccagtccatggaaaaattgtcttccacaaaaccggtccctggtgccaaaagagttggggaccactgctttaaatcatgccttttaaacattttatcattattaaaattaatttcttatttgaaaattcacctagcaaaaacagccatggagttctttcaggctctgatttatcagtaaatgattcaaaacttggtttatgttctattgaagcaaattggagacaaccgtgtaagaaatttgtccttgctttcaactttctgatgaaagccttgtatatttaagaaaaatcacttgacacttaatgattagaagctactacttaccatgttctgtttggtaatttttgcattcactgcttgcaagtacttcaaaattaaattattgtatggaaacaagaatgcaagcatatctggggtattaagactcccattagagaaagagagcctggctcttaaaattttttaaagattatgtcattacttttggctccattgtcagggttttggatataagccactctcatatctcttggggctttttcatccctctaatttagcaataattttttagtgagttttctgcataaaatgttttgtacattttctacataatatataaaacagttcaatgatcctaatgttgagaaagcgtagaataatagcttattcttctgtatattttatggaagtaaacaccaaggcttgtttgactcagtactgccctattaagtcctactcaatgaagacctgatcattttaatacctagtgccctgatataattaaatattcattattttagatttcagttcatttgtgtaggcaaatgatttgttataattgagctataacttgaatacaataaagtacacgaatcttaagtgtacagcttaatgaatttcaacctgtgtcaacaactgtgtgcctcccacccatacaaagatacaaatgaacattctctatccccctccacaaaggggtaaccatgattctgactttcatcaacatgggttagttttacctgattttgatctttatatatatggattcatatattaggtattcgtttctgtcttgcttctttcactcgacatctgtgtaatttatccctattgtttcatgtaacagcaattcattctttttttattgctgtagtagggtagagctctgtagtaggaatatactacaggatttttgtttgtaaccagtctactgttaataaatatttgggttggttctagcttttggctattacaaaaacctgcatgaatatatatcttttggtggacatagcactcatttctcttgggtatataccaaggagtgcaaagagtggaatttaggacaagtatatgtttaacgtgttttttgtttgtttgtttgtttgtttgtttgtttgcagtagtgtctggctctgtcacccaggctggaatgcagtggcacaatcttggctcactgcaacctctgcctcccaggctcaagtgatcctctaaacacagcctcctgggtagctgggactcctggtgcatgtcatcacacccagctatttttttttttttttttctcaatgtagagacatggtttcaccatgtttcccaggctggccttgaactctgggactcaagtgatccacccacctcagcctcccaaagtgctggaattataggagtgagccacttgcccagcctgtttagctttaaaacagacattgccaaccaaccagttttccagagtgattgcaaccagtttaattggttttaaccaacttggtgaatttatgattatttccatcagcaaattaagggagttctatttttcagtcttttaaattttagccattttgatgggtgtgtagtgatatctcatatggtttaatttgcatttctctgatgaccagagaggctgagcaccttttcttgttttttgaccatttagatatcctcttttgtgaagtctaagtctttcgtccattgtttaactgagttgtttttttctctcattgatttatagttctctctatattcctgaattgggttttttgttgttgattattgtattttttctcagtctgtagcttgccttttcattttcttaatcctgtatttaaggagtagaagttcttcaatttaatgaagtctattacattttgtttatttttaagataagttcccactctctcacccaggctggagtgcagtggtgcaatcatagttcactgtagccccaacctcctgggctcaggtgatcctcctgcctcagcctcctgaatagctaggactacaggtgcatggcaccacatccagctagtttttaaaagttttttatacagacaggttctcactttgttgcccaggctagaagtccattttattcaccttttatggttagtgttttctgtgtcttaagaaatcttccatatcccaaggtcgtgaagatattttcctgtttttttctagaagtatgattgctttaactatcacatttaagtctttgatccatcacaaattcatttttgtgcatggtgagagatagtgggtgaagatctacttttttccatatgcatatccagttgatgcagcaccatttattgaaaaatatcatccttaccccactgaattgcagtacaatctttgttgtaaatcacttggctgtataagtggggataagtttctggactctcttttttaatcctgtttctctatttttatatcaataccacaccctttttattactgtactttataataagtcttgctatccagtagagtaattaaaatctggctttgttcttctccagtatagccttggctattttgggtgctttgcgttttcctttaaattttagaaacagcttgtcaatttacacacatgtgcatgtgcacacacacacacacacacaactgctggcaagtttattgggtttgtattgaatccataaatgaatttggagagaaatgatatcataacaatattgagacttccatatcataaacacagcatattgctccactcatttaggtcttttaaaatttctctcattaacgatttgtacttttcagtacacagctcttgtacattttcattagatttattcctaagtatttgatgtttttgatcctattgcaaatggtatttactctgttttatacttgtttgatgtaaatatatagatagaaaattggatatttatttatttatttatttatttatttattgagacagagtctcactctgttgcccaggcaggagtgcagtggcacaatctcggctcactgcaacctctgcctcccggattcaagtgattcttctgcctcagcctcccaagtagctgggactacaggcgcccgccaccaggcccagctaattttttgtatttttggtagagatggtgtttcaccgtgtttgccaggatggtctcgatctcctgaccttgtgatctgcccgcctcagcctcccaaagtgctgggattacaggcgtgagccactgtgcccagcctaaaatttgattttatatatggaccttgggtccagcaatcttgctaagttcacttatgatttctaatagatactttttggtcttctatatacataattaaatgatctatgactaattatttttttttcttttccaatccctgtatttcttttttgtgtctttttacatcagcttttttaggggacttcttcagtgcaatggtgaatataagtgatgatacaggacattcttaccttattcctgacctcagagggaaatttttcaatatttcaccattaagtacgatgttagctatacgtttttggatatatcctttagcaggttaagagcattctcttttatttctagtctgctgagagtttttatcatgagtttttgtctgctgagaatttttagtatcagatgctttttctgcatcgagatgatcatgtgtttatatttttcttctttaatctgttattttgattttcattgattgattgtttgaatgttaaactagtcttgcattgctggaacaaattccacttggtcatgatgtgttatcctttgtgtatatctctggatttaatttgctaatattttgcatctgatttttgtgtctatttttatgaacaatattggcttgtgattttttcttatagtgtccttgtcaggtttctataacaagattaagctggcctcataaaatgaatcaggaagtattccctcattttctgttctctgaaggagtgataagattagtgttattattatttttttttaatgttaggaaagttttaccagtgaagccatttgagcctggagctttctgtaggagaaagtttttaatttcattaataaatacaggactatctaggtttttttttctttttttttttctttttttaaaaccatttgtcatcatctggcgagtttttttttctaaggaattttttcttgtagagtcaaacatcaagacttgttagcctcagtactacccattcagtaccagaagatgaagacctggtcatttctttactcaaaatgctagaattcatcattccagttttttagtagctttgtgtttggccagatgttttataaagcgtgtttatatgcagtgttttaatctttacttagaatttattaatatgaggattcatgaaattttctctgactttctcatttttaactgagaaccaccttagggtctcattttagaaaatgaggagggagggcatggaggctcatgcctgtaaacccaacactttgggaggctgaggtgggaggattgcttgaggcaggctcagttcaagaccagccctagcaacatagcgagaccctgtctttgcaaaaatcaaataaaaaaaaattagttgggcattgtggcacgtacctgctatgatcacccactgcactctagcctgggtgacagagcgacactgtctcaaaaaaaaaaaaaataaatgaataaataaataaagtggggaatttgtgtgtctgtatccttttctcctttttcttgtgattccctcttttttcttctgagtgtcatatattctcatgtctatttttattttttggcaaataaatgaatactgaaatgagggcctatgataaagggcctcatgatacatagttttttaaaatgtcttgagatttgacttgcctttccttcttatagcttcctaagtaaacagtcagtctgatactgaagtttcaacttataccatgcaagaggccagctgaattcacaataaatgatgaaaaccattttattactatgttctactggaaaatttaatttcctctctggccattaacattgtttactttctcccttatctcctgtagtgcccaatttacagtgatgttccttttggttttagtaaaatcagaaaagcaatgtgatgtagtggaaagggcacaagatttgaaattcagaccaatttgggctagcagattggtccccatttacctcattgtgtagctttaagcaggtcattgacctctctgagcctcagtttccatatctgtgaagtggagatgataaaatacccctttgctgtttcactgccatcatgtgaggaggaaatgagaccatagatgtgaaagccctttgctgtcctccgaagtggttactatactatgatggtgattattatcaaacgagttgctcttttaaatttgtaaagaaaggaccacagctcttccttaaccaccgcagctatctgaagcctctgctgacccacagcgggcctccgctgacaacaacactccctgcctgctgtggacccatcgccaggtgcctcaccagcccccaggcttacgaagtaagttggttttatccaaaactaaattcttcagtaagttaaatttatctgctctgtggatgagtcactggttttattttattttggtttgtttttttgcctttgaggtataaattccatgaaagggaatttaagcatattttgctcaaccagaaaatacactgaaacctataaatataattcacagcctttgaaacagcatttgaaaacagatatagaatcgtgcctcatcttactgtgggtgattttagtaaatagttctatttccctgctggctttcatttctttgcagtatgtgtcctgagctcagcactaaatgtgtatgctttcctccacaaatgagggttgtctcagttacattttgaggattttaaaacaattttgacatccctaaagtgcaacagatggtctattatttcacacctcccaacctttggatgtttgggaaagctatctgcctctgttccacatttctgggacacatgagcatatctagatagaatctgaattccatattttttccttagctaccaaaatgtgattggtaatttgataaatattgctactaagaaaaaaataacagaaatcctagctgacctttgtttttaaatgtgcacgtttttatttttcaagttcttttttaaaaaccttccattctggccaggcgtggtggctcatgcctgtaatcccagcactttgggaggccgaggcggcagatcacctgaggtcaggagttcaagaccagactggtcaacatggcgaaacccagtctctaccaaaattacaaaaattagctgggcacagtggcgtgcacctgtaatcccaactactcgggaggctgaggcaggagaattgcttgaattggggaggtggaggttgtgagcagagatcatgccactgcactccagcctgggtgacagagtgagactctgtatcaaaagaaaaaaaaaagaaaaagaaaaagccttccattctaaacaaacctttcagaaataatctatgacatcatataggctcccctgttaacaaagcccaccagttttgactacttaggtgcaacacgcagaaccttgagaggggaagctgtagtgaagctgtgtagacatgcaccacacacacctccctccccgtgcccccattccctgtgagtgaacctcatgtgaaaccagattgtataagaaatggacaggagagagtaggcagagtaggggtggcatctgggccagggaggagcatcctacggctttgtgttatgtcgtgtcagtgcatgtttctgacagactgtgcctgtgagatggggcacacaccccatgttgcccctcctctcccttccacattgcccaggctcgcctctcaaacattgtctccatttccaccatgccctgttaacccacataactgtgcagagaagtcagccagctctgttggttcaggcagtgaagcttggctcttggattccagagacccactcgctgtcaccaaaagccagaagaggtccacaacaaacctgtgtccttggaatgtagcgaaacacaacaggctccctagagcagctgtaacaaagtaccaaaaccgaatggcttaaacaatagaaacttatcatctcttatttctggaggctaaaatccaaagtcaagttgttggccgggtcagttccttctaggctgtgagggagaatctgctccaggcctctcttctaactcctggtggcttcctggctatcttggaccttccttgacttacagatgcatcactatgtatctctactttcatcttcacatggggttctacctgtgtgcatgcctacttccgtgtccaaatttctcctattcataaggacaccagtcatattgaatcagggcctaccttatttccaaacaagaccctatttccaaacaaggttacattcacaggtgctgggggttaggacttcaacatcttttggtggggggttggggagggacacaatttaacccataacaaccatcacacttaattttttttttttttttagacagagtctcactctgtcacccaggctggagtgcagtggcgcgatcttggctcactgcaacctctacctctcaggttcaagcgattcttatgcctcagcctcccaagtagctgggattacaggtgtgcaccaccacacccagctcatttttctgtattttttagtagagacgaggtttcgccatgtcagccaggctggtcttgaactcctgacctcaagtgatccactcaccttggcctcccaaagtgttgggattacaggcatgagccactgcacctggcccaaacgtaattttttatattatctttgttaactgctttttttagttataacactagcaagctcatggccaaatatccatacagtatggaatgtacaaaatgaaaaatcaaagttgccttcctcctacctgcagtcctcgaggcagtctttattataggctcactgtggatacttcctgatatattttattgcaaataaatatgtgtatatatggctttgttattgttttacacaaatgggattataataggcatattgtcccattacttgctttttttttcaattactgacacatcatggatacctttatatgtgagtatgttagatgtcttaccttctcttttcatggctacgtcctattccatttcatagctgtagcaaaattcatgtattcagtctcttatggatagatgtttcagtcatttccttttttgctattataaacaatacttatagtgaatattcttttacatataaacttacctaactatgtaaaagtatatagaatagattttaaaggtaaaatcactgggtcaaaaggcatgtgcattttaaaatttgatagatattgccccaaacctcaaacttaataaagacactagaaggtgctgaagagcccctgtggacctgtgaaggagccacagagcttgtgagtattgctgaattaagtgatagatactggttagatagacttactgtcctaactagattagacaggaagggatttgggctggttggtggatatgagtttgtttgtttgtttttgagatgggttctggctgtgttgcccaggttggcctcaaacttctgggctcaagcagtcctcctgccttagcctccccagtagctaggacaatagacatgtgccacccatacccagccgtttatttttcagttcacactttttttggtctttgagtatttaggggaatttctagcaacagcagattaaattcctttttagattttgtctaatagtcttctcagtctatttgatggtcttagacaaattcaaaattttcaaacagacatgggatttagaaagctggagaatatacttccctcaaggagcatcaatgacagactgttttatgctagatcaatgtgaatatttagaatgatcctttctctttaaagtcatttagaaaaaatgacttgttctgttttttaaaagtaatatatactcattataataaaatttcagataatacagaaacataaagaagaaaagacttttctatacacacattttttatttgccaatatgggactatgtattcctgattcttttcccttttgtagaaccttatttaagtatactattttggtcgtaatatttccatgagaaccaaagcttatggagctgcagtgagggcttgatatgtttctctgtaccccaaactgtattaggtggttggactacgtagcattcaccctgtgtcttcaccacatgtgaatcggtctgctcctgccacacactagactctaagcctcttgagggcagattgatacacacacagttatagctcaagggtaagtgccactacagggagagggccaagtataggatgccacgaaagcacacaggaaggacagctaacctagtcctagaagctcaaggaagacttcagagcaaaagtgataaaaggatgttagtcatttgaagggaaagaggggtcatgtagaaggacctgaaggtaagagaaagcacgaggagtctgggcagctgtcacacttcagtctggttggcagacaatggggcctttggtgtgggaggggcagattgtagcaggagaggaactaaggatgccaagtcacgctgtattttaagccaaggtatggactttagactttatcctgagggcagtgggctaccacttaagggttttaatgggggatcctcgaaaatactcctattggaaatgtctcttgaacttctcaaaaattcttaaatcttactttatttgcatttagaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtgaggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtcttcattttcatggtacgttttaatattaattacctaagctgccatgcatttttttttttacagttctcaaggaagagcacagaacaatttctcatttcatatttggagtatgaaagtagattctattttgtaatgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgcaaacactccttgagattttaggggaattctaatgttgtaccctttcgtggcagctttgactgttggcatagccatttgttatgtagtggtagcgactttcctgctatgcaggaatccctcccatgacgtgtatgttttacatgatgtgtgcctcttcacgcagtaaatagtttcttgttaatgtatgtttgaggagtttgaacgtcagtgtcacttacccacaaagttattcaagttgtaaaaggttatacaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactcacagtatttgagtcacagtttattttagtgagacgtaaagagtgctgacttcatttatttttctacctatatacctagtggaaaaggggaagactaatgttttcaaataaacaaacagaaacctaacagaacttaacttatgggttggcaaatttttggtgcttatgtgtaagggtggatgtatttgcttatggtcacaattggactctttaggaaatatgactcaaagctgtcaaattctattacattgatttgtagcctgttagcttagtaatggataatgttataaaaatgctggtatggggaaagagaattctatatccagttaggtgggaaggcagttccaagtatatccagttaggtaggaaggcagttccaagtttggctaaaagcatgatcacacaaatacaaatagtcctccttccaagttaaagacacgtctctctgtgcatgagaagttttataggctagagtctgctgactgcaagtttgtctagtccagcaatggcaccaaccacactgtctgttgtgttttcttgtcatccactccagcttccttgtttatggcccagtgagagacattggtgggggatggtccacacacaacaggctcttttcttgaaggaacccatgttttctaattccctacacaaaaccctacattagatctgagcaggtacagttgttaacctgacccaatgcaggagtataatgagatgagagtccccgacaggacgtacgccacacagatgatgtagtgtgaggcttgaaaataaattggaaatgataataatagttctcatttttgagcccttcttgggtactggtcatgtgtatacaaggcattttaaaatctataatcatgcattgagggcacattctatcatcctcagtatacagatgaaactgaggtgcagagaagtcacacagcgagtaagtggcagagtcaggacccaagtcaagtctgactccaaagcccagatgcttactattttgctggccccaaaggcaggctctgctgattcatcctgattgtaaccagaaggatgaagggaattgcagaattgctttctagcctgctgcccccgacctgcttgtcatcaggccaggctaaggcatgaagtctcagctctgtgcctccacttgctgctgtgttcttggctgtcttgttggcgttccctggttgggagggtcctcgcattcatagcaaagggccctccagtgtcttgttgggcccatgggcgagcagcctgcctagcagcatttcttcatgctctacctcccaacattatcaccaaggggcccggattttatagcagagtttgcagtcctgaacaatggctttgcatccccacagttaagcatagtagaaaaagcccaggctctggagtgacacagacctgggttcaaacccaggctctgctgcttgcttattgtgtaatgttgaccacttacttcactgagccttttagttttctcagctgtaaagttaattcattcaagaaatatctgagtgcttactttgtgccacacacagtagagatagcagcaaataactaaacagttccagctctcatggagagtattctacgggagatgtagcaatctcatggggttcttaggaatcattcatgcaggaaagactgattgccttcttgccttctagcagggggggatatcttgtttttatgttttgttttgtttttggttttttgtttgtttgtttgttttgagatggagtttcgctcgtttcgctcttgttgcccaggctggagtgcaatggtacgttctcggctcactgcaacctctgcctcccaggttcaagtgattctcctggcttcagcctcccgagtagctgggattacagatgtcgccaccatgccgggctaatttttgtatttttagtagagacggggtttcaccatgttggcctggctggtctcaaactcctgacctcaagttatccacccaccttggcctcccaaagtgctgggattacag

SEQ ID NO: 15872 - DNA, 26933 bp, Human; identical to SEQ ID NO: 12045
  misc_feature (1)...(26933): n = A,T,C or G

SEQ ID NO: 15873 - DNA, 30502 bp, Human
ttgctcaatccactactctctggcttccatcttcaaccaaatcacgacagtcaacaaaatcaccaccttccccattctcaccccactgccaaatctagagaattttcacttcttacttcggtggtcctcgggactgcatctggcattgttggttggctctttctggtttatttcatgggtttctcttcctctagccctttttaaaacaataaattctggtgttctctcagcttccaacctgttttcattacccttctctttacacactcttcttgggttgagcttacccactgtcataatttcatccaccacgttatgtgacgtggtcatgtctacctggcacttccccagagctgtggacttaaatatccaagtgactcatggacatctccacttccactcccataggttctcaaatttcatatgtccaaaattgaatttagcatcttccccttaaatctgtctgatttagtttgaatatatgtccctaccaaatctcatgttgaattataatctccagtgttggaggtagggcctggtgggaggtgtttgggtcacgggggcagagccctcatggcctggtgctgtcctcgccacagtgtcttgtgggatctgattgtttaagtgtgtggcaccggcgccgcaatctcttgctcttgctcgggccatgtagaggcctgccccttcttcaccttctgccatgattgtaagcttcctgaggcctacctggaagcatactggagctatgcttcctgtacagcctgcgtaactgtaaaccaattaaaccccttttcttcccagtctcaggtatttatagcaatgcaagtacagcctaacatactgtcctcttcatatagactactacctctggttaatgactagccagccactgaagccgaaagcctgggccaccttcgtctcctctcaatctgtgaatccacttatctaagtattccttctattcattccttcctctctatcctaacttactacttacctatgtcaggcccccagcatcttctgattgagccattttaatagtttcctaaatctcctgctaatggttttgataccgcattttataacatgagtctgaccatgctttatcagtcgcctgctgaaaactcttcagtgggtcccccattaatgcacccaggattaaaaggccacctatttaaggtccttcgaaacctagcctcttccaatttttccagttttaattttgaggccccaccctaaaggcaaggcatccttcaatcctccttcacctgccacaaaggccccagagctgagctagatgtcccagctctgtactcccattgcgaccagtgcataacttttatagaaattcattagtttctaagatgggaatgttggctttctccgtttgagagatgcaggttctggggatatacataataaacactgaaactgacaaaacaactgtttaaaccttgaattacttacagctaaaaacaaaaaacaattactgtgcctccccgtcggggaatcgaaccccggtctcccgcgtgacaggcggggatactcaccactatactaacgaggaaccgcacgaaagaaagccttctgataggccttttctacgtttttgctccgccccgccctcgctatatgcaaacaccaatgaacctgattttcttacgtttgccaccacagcttccacgaaagttgaacagagccaaaatggtagtgttcagttttatctccccctccattctcatcatttcccttcggccacccttctaactgcccctactcccctcctcttcttcagctccaggagcacgcttggtccccctcaacatccctaacacacacgctcccaggtagccaagcgcccgcttgccgcgcggcaccatggaacttgtagttccttcacccatcccccaacgctcgtctgactttaagaaacttcctttcccggcgtgcaccgcgaatccctcctcctcttctttacctctctccctcctcctcaggttctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggtacagtggggcgcctgcccagtgcccgcctctcccgggctccctgcccctcgaccctagtccttgcgggctcccggatctccggctcaccccgccgcggcccctgcctagccccacgtccccgtctgctcttctgtagcctccatccaactcatgttgtgcacttcagcccccagatctctcacagcaccccttctcaaccccgcttacgcctctgcatcccttccctcagcccccacttatacgtatgtctcctccgcccctcgcctggatcctctctccgaggtccctgggcacatccagcgcctcgtccactcctctcaactcacccagcccttaggtgtcatctttgcagtagcccccataattttagttcctggctctaattactccatggcctccccattgcttcggcctgcggcccagaacccccttcttcaggccccagacttttcccagccccctgggcaccttcctcagtcaacaatctcacccaagtctcagatcccatgtcctgtcgatccctgatcccacggttgcctcccgggaacacttatttcaatccacaggtctgcagggcaccacccatccgtctccctcctagttccctggatctccctgctagtcgttctcaagcctcttaggatttccagccccggccgggcaggcctcttctttccgccctactttgaaactaacagtccctgcttgctaactctaggcgcagctctctctcttcagggtcctttctactttttaatcttatcaactttcttctaataatttaagaacggatgggacgttcaaattttctaaggatgattcaatacgcttttttaatagttggttccaaggagccaagtagttatttcacttagaaaacacatacttctacaaactctataaccattggaatgaagaaaggttgtagattcatggaatattattcaatgattttatctgtatcataacctatatttaatgttcttgctcaaattgcccaatagtatttggtttatacctttcatctgaaggtacctttcacctgaagaatttcatagaagatcattttaaaaataagagggtcatgaaaagacagccaaattcggcttcttcaccagggcaggatgctacatgtgtattttacacagtgtagcatggtgaaatctactaaagcacatcaataagcaatcagatcagatcgggcagataagaattggtggctttcaggcctctttttcctacttgtgtaggaaggatctgaattttgatttcattaatatgaactaataagtacttactttcttactcttcatccctcaacattttgctaaactgattgatttgaaaaataggtcgattcctctatgtactgataggtaatcaacaaaagtaccataagaaagaaaattaagatattataagcaggaaggcatctatttccttgcagatcgcactttggtcttcttgaagtaccatgctatctttaattgcagtagcaactttgcctgggcagggctgaagtcctatttcaatgcagtttcaaaactaaacaccgcatgttctcactcataagtgagagttgaacaatgagaacacatggacacagggaggggaacatcacacaccagggcctgttgggggtaggggcctaggggagggatagcattaggagaaatacctaatgtagctgacgggttgatgggtgcagcaaaccaccatggcatgtgtatacttatgtaacaaacctgcacgttctgcacatgtaccccagaacttaaagtataataataaaaaaagaaaaaccacactgtgagactgccatatttgaacatgagtttatacgtcctacattcaaaagtactagagatttaaaaattaagcaattcaggacacttgtgttcagatgtgaataattgcaaaccaaaaccgaggtcgctagtggaagaaatttaaagaggtttttctaatatatgaacagcaaattcttccttgaatctttagctgcaacatatatttcagaagaaatattccaattggtttaagatataataaaaccttgactaagccccaaacccactcaaagctcttagttaactggaaagttcttgttcttcacctttatttaaaaaaattaaattataaactatgctgataaaagtaaaagaatgaaaatttttatagctttttgctgcttaatgtgacctcacacttacctttgttttgtaaaataaaaacttaaaaaatttattatttgaagttcaggtgtacttcaaatgtgcaggtttgttacataggtaaacttgtgtcatgagggtttgttgtacagattattttgtcacccaggtattaagcctagtacccattagttacttttcctgatcctttcccttctcctaccctccaccctccagtaagccccagtgtgtgttccccactgtgtatccatgtgttctcatcacttttgtagaataaaaactttatctctgttctataagtaagcaagagtcaggatgtttaaattttgaaaagaatgtcccaatctaaaaatctgctcattgtttttacattccccaaatctagagaaaagtaagattttaaaatagtgatttctggttggcatgtctgtttagcaaattagagcctggaattataataatgttacatgttatacaaggaaggcaatttatggtacaaaataacatgtttataattgtttgcttatttatgacaaaagccttagaccaggagcttatccttattaattagttaattagtatttatttaaagttaacttgtttctttcctccactagattgtggactcttgaatgtagagactgtgtttcataactctttgtatctcagcttcctagtatagtctatgtctggcatgtagaggacattcaaaagtttgattaatggatgatttcaattagaaaacagtgcctaagcttaacatgggctacattgataatagtgccagctgtatttcagaggtgagatgggaagacccagtgccagtgcggaatcaggagagacgtcatgtcttcttttcctctccgttcttagagtttgtgatgttgaggaatgctgaaggagacttaatcggacaaattctaagctttctaaaattcttttcaagttttgggttatttacactgaagtttgatcctccaaatttatgataactttcatacatttgtttcttttcactgaaaccttcagaaatgtttaggtgttcttttggttagtggctcaagaggttttagtgccatggccaaggcagaagccagcagttaacaataggtaattctgactgcaaaccatcttgttttcactaagtaaatgtctcaactgggaatcaaatcaaggtggttttttagttttagctttgtgtttcacacataaacctattttttttcatcatatccctgcacatagcaagtagaaaatgtaaatttagacatcataatgaggcataaagctttttttaaaaaaactctgctttgttctagaaaggactgagactgcttgaagcaacatatatagtataagattaaaaataattaaataatttgcaggaagagagaatagggataggagaaacaaaacccatggcataaagccctctatactttaaaagaagtgggccacagggttgacatggagcttcctaccagcctgtgcaaaaaaggaatcagatacctattccatgtcaactgaccagctactgagaagtacaactgctttttagggggatggagggtattgttcaaagaggatactgtgaaacatataaattatatcctataattagtagagctgttgatgcttaacacgtttcttaaaaagtactaaatccaacttgtcaacaatccagttttctttatttttctttcttattacagtttttgactattttttaaaaataacatcgctgaaatttgaaggggaattttaaaaagtagtttgcaaatgatagttgagacttaggacttgagataatacagcttaaacattgcattttttgttttctcttggtctaggacctgcttcatgcattaattgacacctagtgtttttgaggcagagtgctaaaccctgggaatacagacctaagtaacattctctgttttagaacccttagtctaatggaaaaagaaatcattataatgcagtacagtaagtattataggaaagggtagggccaagagctataacagacacaggggatatcaaaacgtttcacaaaaaatagttgtcactatgacacttctgattctgaacagatttggaaagtttagccaatatagaaaacagaatatgttccactgggaaatgacccagttaattcatctatataagcatgtgttataaacacaagatactcaaatcaagtttttaaaacaagttagctattctgaatagctattcagaactaggtactagactatgaagagactagagaggtactagaatatgaaggagtaaccctattattttaaataagatataaaccgtatcttctactaatttagagtaaggataacaaatgaggtacccccaaaagaaagtacccaggggcagctgggaaatggctggttcttggcctcacatgtagccaggtcagatttcagaaaaggaaaaaaataatgccagaggtagggagatctggtagaaagcagttctgccagtccagggcctgacctgggttagtagtggaaagaaaggaaaagtatgaagacattgtgaaagaacaacttttaagtggctgtgtggggttgggaaatgggatcaaaccttaggtaactggaagagttcttttaacagaatcaagaaatctggggagaaatctgattcagggagtataaaaatcatttttggaatttttagaagcctattcaatgtgtggtgctatgtcccatggaaatgttgagcaggcgattcgactgaggtcctggggagggaatacaactgtagaactagaatggcaggcatcttcacagagatactaattgaagatgtgggcatgagtaagagctagggagtgaaggatatggcaagaaaatcaaaggaccggggctggaacattgggacatatccatatttttgaattggaataaaggaggggaaaggaaaaaaacattagacaaatagagaaccatttatgatgtatgcgtacaggcaaagaagtgaaggaaggggttttaaccagatgacatagtccataagggctgtgagtagacagaggtcaaggttattggacagaaaagactttgttgatcggggtgggggctgccctttcaatagcaagaagccagatggaagaaggggaaagggaggatgattaatgaagaagtagaagtagtagtcatagcagtcaaaaactcccttggagtttaaggaaggaaggaggaaaactagaatatttagtgggtagatccatcaagtagaattttgtttatgttgttaggaaacagtcttgtggcataggaaggttcaagattctaggacaagagattagttgagagataattaaagagtatgatttgtagggctcaggattttggggatagaaaatactctgacacttgatgtcactccttcatgcccaaagcagttgtccttaattggccatggcaagtagatatggcctcccaatcctctgcagaatcatttggtctgagttaccataccaggttgggctttttctagatatacaaccacagtgatatacagtttgctgatttgcttaacgaacatgaagtttgaaagtacatgagttctaggaggaaatatattgtgtaatgtattgaggagccagagtgaaagaaacttaagttatagataaagtttttcataatagagaaaattttaggagtcagaagcaaacatattttgatttagatttgacttttacttaaagcccaaaatttgtgtgactgtcctagggttatttaacaatatatatgcaaatcttagaacccaaaaattttcaagatgcttagagtcccaaaaaatgagacctagactagcttttgactcttcaattcttctaatttcactctgtattttactctccataagcaactagttgttgtagcctatatctaatatgagttttttctggtaaatgaaactattttcttactatttaaaaatattaattttaggttttggatacaaaggaccttacaatagaaaaagtagtgatcaatggacaagaagtcaaatatgctcttggagaaagacaaagttacaagggatcgccaatggaaatctctcttcctatcgctttgagcaagtatgaatgttatgatctttctcttttacagctaaataatggggaaacatattcttaactaatttaaatattttttctttttaaattttagtttgtaaatatgtaatgattggtacactacttatcctgatcttctgttcagattaaagttgatacagcagttaaaattatatatacttaagatactaaaaatgttgtttgtatataatacaacaaggactttgggaactgttagtttctaaacgattcatccttttactaatatctagagtgatggtgggggcatgccatcataagaaggcatttcaagataacctgggcagctttacaagttgcaccctccttgcccttgccccagaggccagctgcatttattaatgggacaatgataatgccaaagatagaactgttacagtgcagcaatcttgggataagtgctttaaatgcattcttgtatctaatccttacagtaaccctgctggtataatctacacttaaagatgaggaaagggaaccttagagaaataacttattcaagaaagtggcaaccagaattgtcacactgggagtatatgccacctcttgaggggaaagagggtgaaaactattggcctagaacaagggtgatctaccccagttgttcagaggccagtgttttcatgccttctctttccctttaagagaagggaaacacttaagtctagcttgtgaggtagatggtattcaccccattctacaaggaaactgtggcatagggaggtcaaataatttccccaagtttacagtaccagtaagtgatagagtcaggattcgaacaccagcagggctgctggtctctaaacctctgctgtttccttattatcagtgcttctcaaactctctggggtaaaggaccaatttctatcctcttcaatctgtcatagactgatacttttgtacaatgcaataaaaatgaaatatgaggaagaagagatgaaatacaagcacacattttttattattagattcaacagacaaaaatgactctaaaagttttgcaatgctgactctcaacttctggtcttgtcttgtcctgggccggtaacagtttgcagactagcactgctctgtgtcatgctgtggcacctgctgctgtggtagttgaagccccaaaaatgatttcttttactttttcactctaataaaatattaaatgatatcacagatgcaaagtacgtgacacacaacggggtagtcaaccactgttagttgccattaagccttcgctagcagttagcatgggagaggtaaaaggacccacaggctggcaattaggtaggaaaactgagaggagacttacccactgaggatgtggcatacctagagcttactgccaatcagtgatgagaatgcatactatgttatttatattattcagtgtatgtattatgagtttaaattttcactagatggaatcatactctactaatatatttatgtgtttcatacagaaatcaagaaattgttatagaaatttcttttgagacctctccaaaatcttctgctctccagtggctcactcctgaacagacttctgggaaggaacacccatatctctttagtcagtgccaggtaaaaaggattccagaatgatttctgatgcagaaaatttcagcacctatggttgaatgaagcaaaatgaacagtggttttatggattatgtaggttttacctaataaaatgtattaattgatcttatagaaacatataagatgaattatatattttcattttatctttcactattaatacactcatgccttactttaaataagaagcttctttcagtttggaaatatgtccacctagattggactctctaggcctgacttagaacttagcagagagtaggtactcagtaaatagtcataaaatgaaaggaaaaattaataaataatatgtactggttatgaaaaatgctaatagtaaagaaatggaaagtgaaagatttaatttccaaaccttttccagacaccattgcccagaggtaaccaccattgagtttggaatgtagcttttccatatttttcttacacatttacaaaagtatgtattatatcaatatattaactgtacctttaaaattgcatgacttaaactacttttgttttctgttttaaaactaagggtaaagagccatacaattagagataacctgtcacaaggataatacatttcaaactgtcttctgaaagaaaaaatacctacttttcatagtaatcaaataatttacaattaagggaactgacttcattaaacgtttgctctatttccaggcattgtgctagattctttacatgtttcatccctcccaatattcctgtgtgttaggttcaaatttcaatacaagtccatttaaaaaaggaattagcatatgaatcagacctgtttactttctatggccacttgaaacatctttttaatctaagaaaccctcagtttaataatctagaagagatgaaatgttctacgcaagagtgtacaaattgcacaatctgtatctcataaatatctgattttcaggcagtatgtcttaatagaatgtctattaaccaaagttggcaagaaatgcaagatttatgagtcatgaaaatgttaattttgaatatattattccatttcttattggcagcaatggtgggaatatgggaaacagatttcagctaaattaataaatgattgaggtgataggaatcatgtagacatgattttgtttgatgaatttgcttacggttgttctgtatgcatatttgcctgggtttggccttatccaatgaaatacatttaaaaacccctttggtgttgccatgtcacctaactagaaaccattaaggaactatagaggcatggtcttggaaatctattttgggagagagaaccaggtggctctgctagtcctacttaatccatctagaggtcatttgggagcctatatctttggagaattttctagaactgaaatgaaaagacctggagtttgggggttttaagaaagcttgtggtggaatgaagtatgtttaggatttgtaatagcttcagagaagggtgttaatatcagaattcctttgagtttagtagactgtctcaatgaggctgggttttcatttcattgttcaccagcagtagacagacttatttgtaaacagaccgggtataagattgtaggtgctcttttttttttttttttggagacagggtcttgctgtgttgcccaggctgtagtgcaatggtgcgaacttgggtcactgcagcctagaactcctgggctcaagcgatccttttacctcagcctcctgagtagctgggactacaggtgtgcaccaccatgcccagctaattttttttgtgtagaggtaaggtctcactatgttgcccaggctggtctcaaattctagagctcaagcaatcctctcatctgagcctcccaaagtgctgggattgcaggagtgagccacggcacctggcctgtggtcatactggatggaaccaatgttaataacgattggtgtggcagtacagaaacactttgcatatgatatgaatgaatatgtctagatggtattgaaagagactgttctttctcccttctttgcttctttgttttacttacaaggtttgctgcaagattgaagtgtcaggattacagcaacatttctcaggctgtgttcattagaatactgacatcccattaggtgttaaaccagagagaaatgggttttgtgttaacataaatgtaagaaatcaaacaggtttctttattgtaggtctgttcagagccttcaggcggctaatattctagtggctctgcaagacagtggtgcagtatgccatacttctcaggtctgttttgctacagagcccttttttctcaggtttctaaaagcttctcactgggcactactgtcacccagaccatagagtaggaaacactgcttaagagtttctccatgcttcaactgaaatgtgagggttaaccatagattaaaatggaaaatctgatttttaaaagtccaagaatctatttttggactttaaaagatcccaaaaggccaggcgtggtggctcacgcctgtaatccctgcactttgggaggccgaggtgggcagatcacctgaagttgggagttcgagaccagcctgatcaacatggagaaaccccatctctactcaaaatacaaaattagctgggcgtggtggtacatgcctgtaatcccagctactcgggaggttgaggcaggagaattgcttgaacccgggaggtggaggttgcagtgagccaagatcatgccattgaactccagcctgggcaacaagagtgaaactccgtctcaaaaaaaaaaaaaaaatcccaagaaatgaggactgtttttattttaatgtctaagaacaatgctgcaatttttaatgatttcttaatgacttatgcgaaagataaatagctatttcttcttgtttctccctttttcaggccatccactgcagagcaatccttccttgtcaggacactccttctgtgaaattaacctatactgcagaggtaaatattacgaattattaactcaattaaatgatgcatatcagtaaatatggtataaatgataagcagagatgataattgaattcctagagctagaattatttttcttaatgaaattctacctgaaatatgtaaacaaagaggctgtggcactcattctgaatctctactttaaaggcagttttaaacattttaactgtgaaaaaaaggaaatggaaaccaatctgacttttaaaaaggaattcagggctaggtgtggtggctcacacctgtaatcccagcactttgggaggccgagatgggtggatcacgaggtcaggagatcgagaccatcctggctaacatggtgaaaccccatctgtactaaaaaaaacacaaaaaattagccgggcatggtggcgggcacctgtagtcccagctactcggcaggctgaggcaggagaatggcatgaacccaggaggcagagcttggagtgagctgagatggcaccactgcactccagcctgggcgacagagccagactccgtctcaaaaaaaaaacccaaaaaacaaaaaaacaaacaaacaaaaagaagaaattcagaatcctggatctagaaataagaacttaggaacaatttttacttaacttttaaaaattgacatttgcatgatttaagtttctataaatgcattctgtagccatataagcctagtgggcatatattccagacttgtctgtatgcaattccaacttattcccttggtaggtactgctaatcctttttggaaaaggcggactgtaattactaaataatcactatcccggaggctagacctacttagaccaagcaaatagaatgaggaccaacccatatttatggggccttcttgcttcccaaatcatcccacaaccaaattacatctaggatagtgcagtgatatattatacttggaggcaaagaatcccagggctctggctcttctccaccacttaataactgcgtgaagtcccaactacttgggaggctgaggtgggaagatcacttgaactcagaagttcaaggccagcctgggcgacatagcgagaccccatttctaaaaaaataaataaataatgatgtgacacttgaacaagttttatgacctcgcaacctcagctggcacatatatataacgtatcaccacctaaatgaagggaggtggctgaaccgaattatttcctgaatagttttgtgctttagaatctacaattgttgtagcactggttcaggaacttctaattctgtgcctgcctcagtcacagctttgggtcctgagccatgcaagaagaacatgaaagtctagcccctactggaatatattcttgtttgatcattaatacttgggggagtcctttattctggcattcatcagaaatcaaactttcagaatcatggagctaggatacacagttaaatgactatatggtttgccgcataagggtcttttccgtatggatttccagagaaaattatttgacagtttttagcaataaattttagtttttcacagttactacttttaaaatgttcctctatttgtaactccaagtgtgtgttttcaaaacaaaattgttcaaaaccattctgtcctacagtgagtatataacgtccttttgaatctgttttgtgagtgtagcgggagcagggatggtggctgccattgccagggatggtgctgggctcttcacttatattatttattccttgcagcaagcctttgaagttttacacttacttgatggggaaactgaggctcgggggttatatttatttgcccaagtttgtgcagttagttattaggtggcagagctgggattttaatccagtttctaccaaaactctgctcttaatgtgcatgggtgaatggatagaaatttcacattcacttttaaagaagccagtttcccatattgctaattttatttacaaaactgatatgtatatgtgtatatatatactttttgtatatgtgttttatatatatacacatatatatgtgtgcatatatatacacatctatacacgttgtgttcatatatatgtgtgtgtatatatatactttttgtatatgtatatactttttgtgttcatagtctgtttattagatagtcaagaatgggaagaaaaggttattttacatatatggtttaagacacatagaagcttttatttatgactagaaatgatttttctccttgattaggtgtctgtccctaaagaactggtggcacttatgagtgctattcgtgatggagaaacacctgacccagaagacccaagcaggaaaatatacaaattcatccaaaaagtaagatcctagggtctagatttttgttttcattggcggtaaactacagttagcttgtacacatccagagggcaaaattacttttgaaatatttcagaattttgagaacagcttttggtttttgttttcttcatttttttttcttttgtgcttttaaagggttttgttctacttacagagtgttgtattgaagagagggtttgctgtagagacagaatagggagcatacctgttttcattttccctcactccagttcaggggctggcttcctgttcttttgagttcttacgcattcacctgccctggtactacagtgtgggcaagtggctgttgagagtgtttacaaatggaggagtcaagaccaaaaaagcactcagttacagtcctggtcattagacatgtatctttgaccttcagtgaacagaatgtgtatgcatgcgtgagtgtgtgtgtgtgtgtgtgtgtgtgtgtgtgtgtgtgttttcttaattgacctcacaatggataatttgacttccactgcagcttctgtggttccaagctcccataactttggcatctacttattgccgggtaactctgtgtgcctctacaacatgccaatagtgctttgaaacataaaggaataaaaaaagaaaaccaaaaccttttaaaagtcaggaggaaaaaggcaaacatatgggaaatgcgcttcctgtaggttactttttgagaaatgctcaaaatgcaccttttaatagtatgtgtgatcttgtttttcatgtgtgagaagcttttgttcctagcagaataaaaggcaaatagatgttttgaacaatgttttatatcacaattttaagctatatgttaaagatgagaactatttgagaagtataaaagcaaagttatccctactaatattaggagatttgaaagggaatttacttacttttaaatatgaattgtcttactgtgtaacatttgtgaacactaatgcaagcacgtggtgtgcgtttgtttgccctctttaggttccaataccctgctacctgattgctttagttgttggagctttagaaagcaggtgagcttttggaaaaattttcaggtttgtggaaagatcaaaacttaggcatcttgaacttctctcaaggttaattggtcaatcatttgcatatttctcaagatatcaagctgacagctctagaaaaattcaaatctaaaatgtaggcaacaaattaattttacatttaaaaatcttgaccagttaccccttattttttcaagtattgtaaaatgagcatgctcttacctttagagatctggattctcatgtaagcttgaacaagtcactctcaatctctgtttccttatccttgaaattataatgtctgactttctacctcatagggtggttatgtgaaacaaatgagataaaatatattaaagaacttggaagcctacaaatattacagaaatgtaagatattttatcaatattttacaaataaagtgcccttccttcttaattttttgttcattcttagttttaagcacacttaactgtttttaagtgtgcggttcagtagtgttaagtatatccacattgttgtgaaacagatcttcagaaatttttcattttgcagaactgaaactctgcaccaattaaacaatagctcctctttcccccaccgcccagtccttggtaacacccattctattttctgttcctatgaatttgattactttagatacctcacataagtagaatcatacagtatgattttatctctttgtgtctggcttatttcattcaaggtgtcataatgcccttaaggtttatccacgttatagcatctgacaggatttccttcattttctatttgtttcttcttatataagagtattcaacctttaagtgcatgacaaagtttatacccattcctgttctagaatagtcttacaggctgggctctgtggctcatgcctgtaatcccgtcactttgggaggccaaagtgggaggatcgcttgagcccaggagttcaagaccaggccgggcaacataagtgagatcatgtctctacaaaaaaataaaaaattaatcgggcatggtagtgtatgcctgtagtcccagctactcagaaggctgaggtgggagtattgcttgagcccaggaggtggaggctgcagtgagctgtgatggcccctctgtactcagcctgggcaacagaatgagaccctgtatatttaaaaaaaaaaaaaaaaaaaacgctgggcgtggtggctcacgcctgtaatcccagcaatttgggtggccgaggcaggcggatcatgaggtcagggaattgagaccatcctggctaacacagtgaaaccctgtctctactaaaaatacaaaaaaaagaaaaaattagctgggcgtggtggcgggcacctgtagtcccagctactagggaggctgaggcaggagaatggtgtgaacctgggaggtggagcttgcagtgagccaagatcgtgccactgcactccagcctgggtgacagagcgagactccgtctcaaaaaaaaaaaaaaaaaaaaaaaatagtttcttatgagttgtgactgggtttctatagttgtgaaattgagggatgaaatgagaccctcaagaggtcttacaagaggcaataaactaattggggacaccttatgtcttggtttttttcctttggcccagcctgtacctccttagagagctgcatatctattgctgcatatacaacagcaggtttgcagctcacgccatgtaacctcatccctttcccataggcacatggtaaatgcactctcactgtaaaggtttgtctacaagacattaactactttttagaaccagatgaatcatttgccatgaatttcttttttattaagctttttaatcttgcaggcaaattggcccaagaactttggtgtggtctgagaaagagcaggtggaaaagtctgcttatgagttttctgaggttggtcatttagttatcctttgtaatcattgtgatagacagtagattgaagattttgagtgtgaaatgtgatggttttaagtgatacggggaaagaaccagattgtcttttatgtagatgtgtagttgctacattctttttatcattttcatttaacataaaaatcattaacttgtaaccttcatagaaagcaatatacaattttaagaaatgtacaatggtgataattaaggcatacagacatatatatgttgatttttcagactgaatctatgcttaaaatagcagaagatctgggaggaccgtatgtatggggacagtatgacctattggtcctgccaccatccttcccttatggtggcatggagaatccttgccttacttttgtaactcctactctactggtaagtgtaaatgtttcttcatttgaaattgacgtttcaaaaataaacttaagaaccttaggagtcctaataatatgtatatatatgtaaagaaccttagagtcctaataatgtatatatgtataaaaatcttttctcttgttcgtgtaacctttgtttctaattttattgtttattgtggttatcacaatctcattttttttttgttgttttttgagacacaggcttgctctgttgcccaggttggagtgcagtggcacaatctcagctcactgcaacctctgcccccgggttcaagcgattctcctgcctcagcctcttgagtagctgggactataggtgcacaccaccatgcccagctaatttttgtaattttagtagagatggggtttcactatattggccagggtagtctcgatcctctgacctcgtgatccacctgccttggcctcccaaagtgctgggattacaggcatgaaccaccccaccaggcctccatcttgtttttgaaaggaaaataatcaggccatttggagaaggagaatattatgttcacggtatttggggagttgggcatgggggtgctgtgtaacaacaattcattgataaattatgtatccagacaatcagactataccaattacacttggtgtgtaggtacaattaaaaaaaaaatcagtacaccatgtacaggaaaggattagggccatagaacgctgctatgtttaatatgcctgtgagctactttaaattcttcttagaaccaaaatgagtgatggattagcaataaaataaataaaatacagcacaggacacataggacactctaaagttttattaaatatattttgggtaataggagagaaagaaagtgatgggtaaataagagcagatataaaaatggaagtagaagaaatgtttcatggaagttagacacaaatagactggctttcattgtattgcaaaaattccctagaattagggcaagaaagaatgatgctaatttttagttctgtattttttttgttttttcaattaaggtctcttttaccttctttgaagtgctgtagtagaaatacagtggatcaccagtgccagtatgctaagtatttaggtaggcagtcttttagatagtctgtaattcgattactaaaatactaaggtaattttctttttttgtaggcaggcgacaagtcactctccaatgtaagttaaactttttcattatggccttaccttcaagaagtattacgtcaactgattttaaaatatcccttgtatttttatgttaaagatatggttataatggacaatttggggactcttctcacattattaacaattagatgtaatagatttaaggaaattttatggtttgatctcttcatatatttatgaaatatttttaatgcagtgatatatctatttaatattttctaagtaatttttgttttctaattactttatgccatatttgtgtgtgtgtgtatgtctttggttaaattaaagattttgctgaactgagtaactccctgaatatctcagctaatattttttaaaaattgaataacatggagtgtttacagtagaatgggttattttaggttaagataatcagtcttactattaatcacactgttttctttaggtcattgcacatgaaatatctcatagctggacagggaatctagtgaccaacaaaacttgggatcacttttggtaagatttttgttattatttctttattggttcatgttgctgatttttttttccctgcctcctaccactctgaattgttttgtgtgtatctcttgtttttctttgttatcatctcttaggtaggcaaggattttttttttttttgacatggagtctcactctgtcactcaggctagagtgcagtggtgcgatctagctcactgcaagctctgcctcccaggttcaagtgattcttctgtctcagcctcccgagtagctgggattacaggcatgcgccaccacgcccagctaattttttgtattttagtagagatggggtttcaccgtgttgcccaggctggtctcgaactcctgagctcaggcaatccacccaccttggcctcccaaagtgctaggattacaggtgtgagccaccatgcccagctattttttttttttaattggagacaaggtctcactctgtggcccaggctgtagtgcagtggtgcaatctctgctaactgcaactccagggttgcaatcctccctcctcagcctccaaagtggctgagactaaaggcgcatgccactatgcctggctaatttttgtattttttatagagatgggatttcaccatgtcgcccagactggtctcaaactcctgagctcaagtgatccgcccacctcggcctcccaaagtgctgagattataggcataagccgccacgcccagccaacaaggattttttttttttttttttttttgagatggagtctcactctgtcgcccaggctggtgtgcagtagtgtgatctctctgcctctcagttcaagcaattcttgtgccttagcctcccgagtatctgggactacaggtgcacgccaccatgctcagctcatttttgtatttttagtagagacggggtttcaccatgttggccaggctggtcttgaactcctgacctcagataattctcccgcctcggcctcccaaagtgctaggattacaggcgtgggccaccatgcccggccaacaaggatagttcttaaaaattctgtaacacttattacagcgttaggagtgttaggttcagtctaggtgttaagtttaattccctgatatactcccacttttaacatagggacatgcaagagcagaagcagggcttaactttcccctgctgccatctgctgggctgggcttcccattgctctggattgactgcctgggagccagagtcggcttagactgtagtggtcatgccttacaactgctttcctctgtagaaaagccaaaaagaaaatatcttgattgaaatgtcttttcttctcagctgtgtccgtgtttttattaaaatatttttttttcaggttaaatgagggacatactgtgtacttggaacgccacatttgcggacgattgtttggtgaaaagttcagacattttaatgctctgggaggatggggagaactacagaattcggtaaaggagtcaaagttttaaaaaccttcatccaaagttgtataggtgttaaaaactgagtttttataaaagcgtctttactgtgtagcaaccaaaaagtcatttttacaagtgtggaaagtgaagtcaatgctggtataacactgtgttgatccacactgttcactgttctatgtaaggtagttttgatgacctggtctaaatagggagctgtgggacctcactgggtctttgctattaatatagctgtttactatgtttgcatcttatttggtatgtcatttttaagtgttgtctcctgaaagccaaatttgctgaccaggcattaaatcatttttctagtctttttataagaataaagcctgtattattgagcaagaaacaacagagaatattacttaagtaagcattctattaatagacttccagaagtttatgccaacatatcctagtgttccagtctccaagttttagattcccctaaagttacaccactgagtgaagtaatacctccttattagcttatttgcgtggtgatagcagtctttctatatgtttctccatgttatttcatgtcttgcaggtaaagacatttggggagacacatcctttcaccaaacttgtggttgatctgacagatatagaccctgatgtagcttattcttcagttccctatgagaagggctttgctttacttttttaccttgaacaactgcttggaggaccaggtaagtagttggtattttatgattttttttttctttttgagggtaatgtgagaattaggaagaattgtaaactattgttttgttccatttaatacttccaattcattctggatgtagctgctgaagaaatctgtattgttttctgagttacctctcaacttaaaaccattaataacccctaaggtttaaattatgctgcttcattttttaaaaaatctcatcagtttttgaaattaggataatagtgtgtattccctgaaaacatttctatggtacagaagtttataagagtaacaagtgagagtccatcaacccctttccactccccaggggtaaccactgttagcagtttggtgtaaatggctccagatcattttctaggtgtaaattaacaagcagacaaataaatacatgtaattattttaattacaaaaaatgggtcatgctatatattggctctgcatttgtgttttgttttgctcgatatttcacatacacccttctgtgtcagtacatataaatctgtttcatactttttaatgccatcatactagttcatgataaagctatgctgagttatgtacccatcccccactgatggacattgaggtgttctccttggttgattgacttggaaggctgtctgtcacctggatccattctgcctgtccagtcttatttttctcctttctagtcatgtgaaggttattgcttttagaacttgggttatgcattccttttctgtgtcttcatgtgttatccccttacctataattagaatttctcttctcccttccactgaattacatatattcttcaaggcccaacttaagtcccacctccttttttgaacattctttcactctgaaagtcctcgtagatttccctattctctgaatgttctctgttctctgtggttaatagtacaatgccaaacacgcacacaaaatgtcaaataattacctttctatgaattgatttcttttcttttttactcttagagattttcctaggattcttaaaagcttatgttgagaagttttcctataagagcataactactgatgactggaaggatttcctgtattcctattttaaagataaggttggatttaaaaaccttttctatttttcatgctcgatatatctctatttattgactgattaggttaacttgtattatctaatagtagtattggttcagaactttaggactcaacctctcattgcatattttttctattttaaatgtgatcttaaccacatgaactacctgtagaattttcctatttcagagaagtcatcaatagtatggtgatgaatataaattttagaagatagagttagatgaggtaatggatatattagcttgacttagtccacattgagtacatatatcaaaacatcgcattgtgtcacataagtatacacaattatgatctatcaatttaaaatattaatttttaaaaaagatttagaaattatcttgatatagcagattagacaaaattatatatctaaggacttacaagtttaaatttttttttgacaggaaagggcattctattgtaaactgtgaattcttactattcataggttgatgttctcaatcaagttgattggaatgcctggctctactctcctggactgcctcccataaagcccaagtaagtacttgcctgctaatgctttccttctcattctcctaactcctagagagcctcaaaatatctgaaagaatagtatgccttcctgaaactgttactagtaaatgatgaaagcagagttcttaggtgttttggccttaaccctgaggccaaaagaataatttctgcagtttacaaatatggtttttcacttcaagtaattgagtgcctcctttctgcacaaggatggtgagggatttagacaataagctattgtatcttccttcaaacttctgcaataaaaatattttataagtattatgttaattacaacactgttataagttattatccccatttcccaaggaggtaagttaggtttagctaggtaaagtgtcttgccctaggttgcacagctagtgagtagtaaaagttgagattcaaaccctggcagtcttattgcctccaatatactgctttcttccttctttttttttagaaacagggtctcactctgtggctcagcctggcgtgcagtgatgtgatcttagctcactgcaccctctgccttccaggctcaagtgatcctcctacctcagccttacaagtagctgggaccacagatgcgcactaccacacccggctgtttttgtacttttgctagaggcagggtttcaccatattgcccaggctggtctcgaactcctgagctcaaacaatccacctgcctttgtctcccagagtgttgggattacaggcgtgagccaccgtgcccggcctcaatatactgctttttatactgaaccccctccttcaatcggacctgaaccctggtctttcacgagttgtgtgaggacactgaccatggcatgttccatggcatgttctcttgttgcctttcttttggatcaccaaaattgcctaccagcttctcttacactaaacaggccagtttaattgatgttcagggagcagcaggagagaagctaagaaacaagatgaggcctggtcatgtttgtttgtaaagcactttaaacagccaggccgagaagtgtttggttgagaagttactgggagttctgagtatggaacaaatgtggtcagagcgccccactaactgggcagtcctggttatcataggctgtggtgggaaacaggagctcaggtagggaggggtgattacgatagaatgtttcgaattttgtgttggaaacaggtggcacaaatcatcagtaaacccttttaacgtctaaaaaaggtatcagcaaaaataatactttagatttttttcctagcacttcattaagaagtgccatacattatctcgttaatttttacaacagccttgctagagattatgaggacctgaagtcatacaaaggcagtggaaaagaaaggagtaactgagagaagagacgtttgggggctagaatctattggcaactgattggctgtggtgagaaaagaagaaattaaaaatgactgagcagagatgtaataaagattcagctcaatccagcacacatttattgtcaggcactaatatgatgaataaggaactcacagagcaaatatgtatgtatcaagtaattataatacaatgaaaagtattttttttaaaatattaagtgttgtgggtgaggaaactattaattttaatggtgatggatttggacatcgtcttggagatgacttacaaaggagaatacaagaagtaaactgtagaaccttagaggatcttcattttagagctaggacagaggaaaggtagcaaaataaatggaaaactaaaaagatttcaaaggttcattgttaagaaagctgtgggaagaaataatttaaaagtggtacggagagtggtcagcagtctggtgtgctgtagaattatgaggagcctgagaataaaagcatagaatttggagtttggagtctttcaaagactctaacttcaggggcctgatatagccaaaagacagttccaggaagtttaggagtggagaaggctttgcccattgcttttaaaattggggaaatctgggtggaaaattagttcttcaaaagtgtttctttgatatcaccgctgctaagggatcctttttgggcgttggttcattctagatcccttaagattgctttcaagtaataccaaagtgctggaggaaccctggaatcattcgtgtgcccgggaattctgtaaagagagagtatcttagaaaatctcaaaccacagaaaatactttgatccattgcagcacagaatcttggcttccacgatcctctttttataatgctctcatcatttgtatatgtatttaaatatctgagtctatccacatctctccatttctactaccactgtccaagttcagtatcacatcttcacatcctggaagactgttctggcacccaaactgtgcacttgtatctgttctgacttctcccagccactctccacactaaagctagagtaaacctttaaaagcacaaatgtgtcatgttgtcctcctgcttagcagtctccactggtatctctttgctcttgggctaagacaaaatcctttagtggggattataagctcctaacactctagctccctttgcttcagtcacactggcagttttggagtttctcgaactccccatatgtcctccaacatagtacctgagcatgctgttttctctacccggagccctttgcccagttaattccaatctcagctcaagaaccacttcctcttggaagcatttcttgacatccctggccaggtcaaatctcccattctagggctttttagtgctatatcctctcttcgtagcagttgcacagttctaactttacatttatttattcgtatgattaaagtatttcctcttcgctatactgtcagcaccatgagaacaaggcacatatctggttttgctctttacttttctgaagactttgccataagtagggtcctttcccaggctaattcttaacttagtacttttaattacactaataaggaagtttcaggacacgaagaaacagaccagctaaaggttttctactttgctattattttttaagaaatcaatgctaataatgttttggttgaaagcagtgtattctgatcagtcaaggacctctgatcccacctgttcttgaagacaaaatggcatgcctgcagtccacagcctgacacttcatgtaataaactggcagctgcttcgaggtgggagctgtgttgacctttttattgtctcccctagggaacaaacggagtcccagtcacaactctctttaagggagattcagtggtaacttctaatcaaaacttacttcatttaggctctaaggggcaggtgcctctctgttccctaatacaagcatttcagtacaagcaagcatgatttacggagaaagagggatgttttgcaagaattttgcacacactacatgttctttcccattgttgcaaaatatgatttctaagttgagaacacacaaatattggtataatttgcttaacaattaccatgtgttaatttcattttcttctaaaaaggaatgaaatcatcaggcaatggtatcgggctctctcaagggtctagcatctagaacggtgccaattatgtagcaggtgcttgcaggtttgttagatgattagatgtttggaacaaccaagtaaaatccatgacagcaaggacttgatgttgttcatcttgttgtcttgagtgcctagaactgttcctgccatgtactaaatatgctcaactgattccaactactttagcatatactactcgagcacatgacagtcttttgctgaggtgctttggcattctttctaaaagatagatgggtgtttcattaatgtggtatccatttgggtttgtgagttcttggatgatgccagtagtatgtaagttaggtaaaatatttcctattttcctcactttggagtttgttttccttatttaaaagggactttgaaatttaagtatgtactgtagctttaaaactgcatttctgcaaaagcacgtgcatttttaaacaatgtaatctttatctttgcagttatgatatgactctgacaaatgcttgtattgccttaagtcaaagatggattactgtaagtaataatgtgtgatttttgattcctttttgaattgtgcaaatatgtctttactcatgaagcagggagggtactttaaatcacaaacagttatatttggaaaggctatttgaaagtcaggtttatctaaggtgatattatatctactctcaatatagaaaattaagggtttgagacagggtcttgctctgttgcccaggctggactacagtggcgtgatcatggctcattgcagcctcaacctcctgggctcagtcagttgtcccacctcagcctcccgagtaactgggactacaggcatgtgcctccatgcctggctaatttaaaactttttatacaaacagggtctgtgttgtacaggctggtctcaaactcctggtctccagtgatcctcccaccttagcctcccaaagtgctggaattacaggcatcaggcatgagccactgtgcccagcctagaaaattaagttttatggggggaaaaattgatgttgaaggcattaatcctgatttttcttgcttcttaactcttaaaaaaaaaaagtatgcaaaaatatttgcatcttacctttcttcttttccttttaaatcatttataagatactgcttccaatatggcaatttcacataccaggtaaatctaaaatgatcttgggtgaccagctgctgactattagtggtgcaaagaatcgaagcacttttgctctttgttcactttctatgaagcttcttaaagaggagcttcttcatatatgtactaaaatagaaccctttactgaagccaaagtaaggatgagcccttgataattctttaatgaaaaataacagaagatttaggaatacttttattcctattaatttgcaacagatttatcatttttttacgtaatttcaacttttaagttcaggggacacatgtgcaggtttgttacacgtgcatattgtgtgatgctaaggtttggggtatgattgatcccatcacccaggtactgagcacagtacccagtagtttttcaacccttgccccactcctagtagtgcccagtatctattgttgccacttttatgtccatgaatatacagtcgtttagctctcacttgtgagaacatgctgtatttggttttctgttcctgtgttaattcacttaggataatggcctccagctgtgcaatcagttcagctattgccttttaaaacctgttttgtgtagttgacaaacttgtcatgaagaaaagtataagagatttctatgggaaacaggattttttaacagtgtgagtgtattaaaattctctgttttagtttgaaaaatgtattccagcttatttggtgctagttaaaactgctactaatttctgctcaaatattcctttgggcccagcagttaaggtggataatgatcaactcttcaatattagtagaaacaggcattgttaggaacagattcaggacactgtattcactaatgcactcttttccttatgtattttatttctcaatgatttgtcttaaatagtaaataaatgcaaaagaatatttataacatattcatatggtgtataaaacaattgtgtgacccaccactagcataagaagtaaaatcttagcggtacctctgtagcatccctccccatcttatgcccctctccaccctccttgctgacccatccaggttaccattgtcctgaattttggtttatcattctcttgctttttatgtttttaccacataaatatatccttaattaatatatagtttagatttgcaggtttttgcacagaaaatgagctggagctgtaagttctcatattaaggataagttgtaaagggaaaagaagtattgctattaaagagagttctgaagagggggaagatgcaaaatatttatttaaaagggtatatacctatgcattaaatttagtggaaggatatacagaaactactaatattagttactgaggagtagtacttggagacagggagcagatccaaaagaatt

SEQ ID NO: 15874 - DNA, 60141 bp, Human
  misc_feature (1)...(60141): n = A,T,C or G
ttcggttcatgaaaatagatgctgaggtggagaatttcactagagaactggcatctgcaggaaggagtcaaatggaaattctagagctgaaaaatatagtaactaaaactaagagcacaacagatgggtttaactgcagattagacacagctgaaaagaggatttgtgaactggaggatacgttagtagaaaacattaggcataaactcgactttaaactgagctaaggaatagaaacttttcaatatctcaccaaagtatgtctcttattttagagcatgtgggtgaaaagagtccttattaaagtgcagtcgcaactcttgctattttaatgtgtatttagtattttttggtatttttattttagtggatttttaaaaaattattaaaaaacattatttaagagagcatcttattctgtcactcaggctggagtgcagtggcacatttgtagctcactgcagcctcaaattcatgggctcaaagtgatcctcccaccccagtctcctgagtagctgggcatacaggcagatgccaccatgcctggctaattttctttgtttttttcagtagagacaaattctcgctgttttccaggctggtcttaacctcctgaccccaagagatcctcctgccttggcctcccaatatgccaggattacaagcatgagctactatgcccagctggtttctattttaaaatataatatgaaagtagtaaaatataaaattattacttatgtttatttgtgatacctccccccccagcttttaagcaaaaataaattattctataactaatatgcatagattacctgttcagtaaactcagttacttagaataaatccttagaatgagaaaataagcaaaacatttacagctataaaatagatatctggagctggatggtaaaacccctgtactttaatatagaggagttgtacggcccttactcttggttggttgggataatggttatagtgtgcatggcaatctggtaagccagctcatcatagaaataccaagttagaaaggaaattgtgggtcaagaatttgggtttggcataagtaccttgtttcatcatatccaagactctactatgaattataccattaatttatgtacctgtaagaaaaaatactgtcagttacattttgacatcacattaattgtgagatacattctgatttcaaagatgttaaagtgtgaaggaaaaagtaaatggtaattctggttttaaatctcagttctgtcatttatttgtttgacatgagtcagggaacttctttgagcacgtttcctcatgtgtgaaaatgggatagtatactttacctttcagaattaggaagacacaattagagatatgaaagtgtctgctgtgtggcaggcattcagtacccgctaatttggctttcgtttcttccttctaaagcttggttctcttaggatgaaagagacacttgaaagcctaacaagtaaaaacaaaaccaaactctaatgtactggctgtgtaagagcgtaaaaaggaaaatttcttgttggagctgtttaattgtcaaacattgttctttgtcttcctccattacctcacccgcctccctgttatatctgaagatatcactggctggttccaatataatgattgatatttatgttatggaacctaagcatcaaaataatattgatattttactataatggtttttaaaatacacattttaagaaaatttccaatccttctaaacttatttgtgatgcttaaagtcccactctttagttacatggaattcctgctcttctgatgatgccaaataaatacagcattattcggagtaggtgaatctttttaaaaaaggggttggatttggtgatgtttggcagaagtgagaattcctcattatattcctattttaaagatttccagtaaacccaggcggtatttttcttcagtggtaaaatatttatagctttagttttgtgtttattcttttctttcaggatttttcaagccacattcaattgataggatgaaaaaatttaagagaaggctatccctcacactccgaggaagtcagactattgatgaatcattgtctgaattggctgaacaaatgactattgaagaaaacagcagcaaggataatggtaaatatttggcatagggggagatgcttcctccttttaattactttatgaatagaatgtaaatttactttttagataagttcataatagcttccctttgtttatttctgtctcattccatggtttcttaggaaattgaagactatataacttttgtttggttactaactggaatatttccctctcactccaacattacgatacctggtctcaaaccctgatgaattgttctattccacatatccttccatttttcactagttcttaaagaagaatgcattttataatattatcttgattgttaaataactattaattttttttattcttataacccaagttaatacagcttaaaagtgcataggaagtctgtgaaatttctgtttgtggcttcatcagtttcataatgtttcatgcatttgacagtgctttttacaacataaagtagtagtatccagatgttaaaataaaaagagcttgttaagtgtgttaaatacaaaatcctggtgaaatttctagaggaaggctacatattcaaatctgaaatagccctagggatgtcatagtagtaactgggaaggaacttacgtgactggctttcagtgtgtcatgatgtgcagagtatctggcagatcttccttacctgtgcctgaaattctgctgttagagatttgtggcagtggctggaaagcatggacacccttaccccttccactagaatgcacatacttatgttttgagagaggaaaaggtatagtggagtgggctctggactttttaaagtcataggtttggattttggatacacttaaacacttcctagttgatgactggctaagccgtttattctacccaggcttcagttttcttatttcctttactcagaagggtcattatttgctcaaggttacccagctccagaaccagtactttagaacccaggtttcttcacttcagagtctataacaatgctactgttctgcaaggaccctttcattcatttgttaaggttttccttgataacatctaccttttttttttttttttgagacagtctcgctctgctgcccaggctggagtgcagtggcacaatgttggctcactgcaacctccacctcctgggttcaagtgattctcctgcctcagcctcctgagcagctgggattacaggcatgggccaccatgcccagctaagttttttattatttttagtagggatggggttggggtttcaccatgttgaccaggctagtcttgaactcctgacctcaagtgatctgcctgcctcgacctcccaaagtgctgggattacaggtgtgagccaccacgcctggccttgttttgtttttgtcatggtggggaggagagagggatgggctcagtaggaaatttaatataataatttggatataattatatgtaggaggggaaaattgtacatttgggtcaaatctcaaacatcatgattttactgttgttcctcttgccagaggacctattctagatacacagagcaaaatccttaattctcttttagaccccctcattgaatttttggtgggacccccccccattgaatttttggtgggaagcgcagtgtgcctactcttaggatagaagggtcttgccaatgtgtttgccaatgatgatcaggaataaaataaacacagtatatatcttagtggttggtttctgggacatatttttagtatttgactacaagacaatcctcttttcctaaagaaaagatatgagtcaaagaaaatgaacgtatgttttagctaatattttagaccaattgcatattttctagaatattttggtattaactatcataaaacatgctttgtttttaacaaatggtgaaagattaaaaatatttgttttctcaagttgtatatgttttttaaaacttattttattacagtagtaacttttaataggtagtaaataagggcaaataggcgatctattgagtttctccttgaccttgaagtaatacttcaagacgtcataagagacattgattcctcttgggttacaaagattgctagtagcataggctaccataatctactatgcttattttctctctgtaatagcacatggatttcaccaacagctttcacagagattctacacctttttggtcacctgtcagtgcctgatagctgattccaacacattcttttcttgtggaacatattttagagtataaaagctgttagacaggtcacatacacagacacagtccatgccagaatacagagaatatagcataatgaatgacacgtatatacttttaaagttatcttctcacatacaatgtaagcagtttatgaagcaaaagtgagctttaatgccaaatagtagcataatgctagctgaaggagtaggaggaatatacagtcatgcattgcttaacagtggggatgcattctgagagatacgttattaggccatttcatcattgtgcaaacatcagagtatatcaaaactaggtagtatagcttactacacacctagcctacatggtacaacctgttacttataggctacaaacctgtacagtgtattatggtactgaatactgtaggtagttgtaacacaatggtgtttgtgtatctaagtgtatctaaacatagaaaaggaaatgcattgtgctactatgttacagcgggtgtggcatcactggcatcactaggctataggagtttttcaggtccattataatcttatgagaccactgttgtatatgatgtctgtcattgtctgaaacgtcacatggcacataacagtagtttataatttccctgaataaactgcctttggaccaatttttgatcacttgtctcttgattagtcacaggcatgatcacagtcctattactcttgcatatctaggcacatggctctcatgcatactctagatccagaacacattaattgggggtaatactataaacatgttggagaaattatgggtatgatgcgtttggttatacttatacccataatctcactcatgcatgctctacctctatccaaatacaatagaatatcccaaatgagatattatctctcttattttgataactgagtcatatatgaaggtttttaactcagttataaatctataaatcaaattactttgtctatttatagaaactagtatgtttgcacattgacaggtgggttgaacccaaggaatgatgaatcctgaatttgtattcagtatgctaaaaaaaaaaaagttgaaagtttgcaaatttggttcatttaaggattctggccttaactcaatacacctttccctaaatatgaaataaaatttttgcagaaaaatttccaaactgaaatgtacaaaatatttttttctgtagtgcctggaagaaaaagaattttgagcccatcagttttctttttactaactgagaagtgtttaatgttcagtttttaaaaacctgtcaaggccaagcatggtaccaggcttatgcctgtaatcccagcactttggggaggccgaggtgggcagatcactggaggtaaggagttctagactagcctggccaacacggtgaaaccccgtctctactaaaaatacaaaaattaatggaatgtggtggcgcacgcctgtagtcccccacctgctcaggaggcaggagaattgcttgaacccaggaggcggaggttgcagtgagccgagatggcacccctgcattccagcctgggtaacagagctagactgcatctcaaaaacaaacaaacaaacacacctgtcaaaaattaatttacctcagttcttcaaaaagttaaacatagacttactatatgacccaacaattctgttcctaggaatataccccaaataattgaaacaggtaatcaaagtcttgtacacaaatatttatatttgtagcagcactattcacaacagctaaggtgtaaacaacccagatgcccatcaacagatgaatggataaacagaatgtggtctgtccatagaatggaatattattcaatacataaatgaatgaagagctatgtgctgtagcatagatgaactttgaaaactgaaaggagccagacccaaaatactctatgattccatttatatgaagtatccagaataggtaaatccatagagacaaaaagtagatgagtggttcccagaggctgatagggagaaaagactgaggagtgactggttattgtgtatgggatctcctttagcaatatgaaaatgttttggaacacagggaggtgatggttgtaccacattgtaagtatatgaaatgccactgaattgtatactttaaaatggttaatgttataagaatttcatctcaataaaaaattcagttcatctgagcttcagctttccctcataaacactcaatgtatttgatgtcttttttttttttgctgtcactgcagcagaacagatgtttgataagtcttaattctattttaagacttatcacagaaagttatatttcagaatcttgtgtttacatagccttgaacttattttttcttgtaatgggacgatatattgagattattgaatttgatgagaataggtgacaatttaaatgtgaggaagagaataaatcacagttgtagaaaggtaaaattatgttttattgcacatatactacttgagacttcttgaccaactgaaattcttcagctaatgtacatgttcccaagaagtgtagtcagataaacctaacagaatgtcacttatcatgattatttagcattagaagtaacaccaaaaagcaaagattaaaatgacctggttttcctgatattccaaattctcattcttaacagctccgtttgtacactggagcaatttgtcaagtttggagtcaacaaattccagttttatggatattgtgagcctctgtctttcacctaggtctctttatcttgctgatctcttacatgttagctgtgacagtttgtcttcgacagtttgtggttacatcataacagtaattgttttttacaacagtggataacatagggagtttaaggaggactaactccaacaaatagcacaagttccttgaaaggttgacgctgaaggcataaactccattggatatatgtaggatctagaatgggatcaggctagtaataatgtttgaaagagcaggtttgggaggagggaatggcttaggctacaagttgggctatgaaattgcatgttcctgatcatagttcacgtaatgaaaagatctagataaataagatgccaaataacgtttcttagtggaatcataatgattatcatgttgtggtggtaaaaatcattggaaatccttacttggaactaattatagagtataaaagatctgcaatttttcatatagatttctattactttttaaaagttatggtaaaatatatataatacaaagtttaacattttatagtatacagttcagcagcattaaatacgtgtctatttacattgcgtaaccatcactgctacccatgtctataactttttcatcatcccaaactgaaactctgtacccattaaacaatacctccacattccctcctctccccagcccctggtaaccaccattctactgtctatgaatttgcctattctaggtacctcatatgagtggaaccatataatatttgtccttttgtgtctgacttatttcccttagcatattgtcgccaaggtttccattactttttaaaatacagagtgttattatcttattgaattggccagctaattagtttcaagttctggaagtgttagaatattttattgtattttattgtggctctctcatgggccgcaatctcttctctgtctataccctctccttgggtgacctcctccaaccctacaatttcaactaccatatatatgttgactactcctaagtctgaatctccagttaggatcttcatctggatctctagattcatatttaaatgccttcttgtcttctccacatggatgtgtaatgggaatcttagacttcacatgaccaaatcagaattcttgatttcctttctccaaaatctgcctctactcaaactttgctcacttaaccagttactaaaactaaaaatctaggcattgtccccaattcttttctctcctttactttactgttgtctcctccctgcccccaacccccaccattgtagcttcctattttttaccacataaataacttacaaactcatgattatgatagtcatctgtatcagtggtccccaacctttctggcatcagggaccagttttgtggaagacagttttttcacagactgaggttgggggaatggtttcaggatgattcaagcatattatatttattttgccttttatttctattattattatattgtaatatataatgaaataattacataactcaccataatgtacaatcagtaagagccctgcccttgtcttcctacaactagatggtcccatctgaaggtgatgggagacagtgacagattatcaggcgttagattatcataaggagcatgcaacctagatccctcgcatgcacagttcacaacagcgttagtactcctatgagaatcagtgccaccactgatctgacaggaggtggagctcaagcagtaatgtgagcaatggggagtggctgtaaatacagatgaagctttgctcacttgccaactgctcacctcttggcctggttcctaacaggccatggaccagtactggtctgtgacccaggagttggggacccctgatcaatgtgactgatacacaattccagttatagtccattaacacatcatatttcatatatgtttaacagttgatctggtaaagatttaaaaatattttggggctaggcatggtggctcattgtaatcccagtgctttgggaggctgaggtgaggaggatcacttgagcccaggagtttgagactagctgggaaacatagcaaaaccccatctctaccaaaaagacacaaattagccaggtgtgatggtgtgtgcctgtagtcccagctatggtggggaggatgaagtgggaggaccacatgagcccaggtggttgaggctgcagtgagctgtgactgcaccactgcacttcagcctgtgcaacagagcaagaccctgcctggaaaaaaagaaaaaaaaaatatttgaatagatgtttttactataaatgctgactaaaagctgggtggtaggagtgtgtgtgaaactaatttagcagtcgtgtctgctggcctgttgcttctgcctttgtaatatgtcctaaatctgcctgcttccctccatcttcagtacagccaccctagtctaagccaccaacatttgttacttagggtactgtagtaatctcctccttttgctgttgattccctattgcctgtttttcaaacagcaaccaagatgatatcttaaaaaattattttcagtaattacaaatataaaggaagttacaaagattatatagaaaggacccatacttgtacccttctcccaatccccccaccattggttccatcttatgtaactatagaacccaggaaatagatactggaataaagtctaaatatagttctgtgtcatgtcctcacctgtgttgattcgtataaccactgcaatcaagattaagaactgtttcatcatgacaatagatctctcgtgttaccttttgtagtcttccctacccccttacctcctactatctttaacccttcacagtgatatttttgaaacatgaatcagatcatatcactctcctgcttcaaagctaccgtaactgcttccaatctgagaataaaattcaaacttttatggtgaagtataaagtgttgaatgacttgttccctccttacctctgtggtctcacctggtaccactgttgcccgcacggttaggtactatagctacacttgccttctttctagtcctctaacacagtggttctcaaagtgtgatccctggaccagcaatgtcagcaggacctgggaatttgttagaaacacatatttttagattccacaccagacctactgaaccaggaagtctgtgggtgagaccgagcaatctcatgttttacagatccttgatgattctgaagcatgttaaagtttgaggaccactgttctaacaagtcgaactctgccatatgtcggcttttcattagcttttttctctatctggaatatcctgttatccacaacttaaccatcttccctgactggctctttcttgcatttaaatttctgttaaaaatatctcagcagagagaactttcctcaatatacagtgtaaaataactagctactcatttccacatccctctattttagtcttttgcatatcgcctgtcattacctgacttcgtgtgtgtgtcttttccctgttaggttttatgcactctgagatcagtactttgttttgttcaccagttgatgcccagtgcctagaatagtgtttatcaaatagtatgtccttatgatccccattttttttctatattctccagaacaatcaagctgtattctccaggacagctttacagagcaactaaaatgttgtctgtaggcaaaagatttgcataatttgtttttaatatttgaatgttgtgatatttcacatgtgaaataacctagaaagagaaaaaaatcttcatttttcttttctctttcttgagacagggtattactttgccacccaggctggaatgcagtggcattatcttagctcactgcagccgcaaactcctgggcacaagtgatcctcccactctagcctcctgagtagctgggactacaggtgcatgccatcatgcttggctgagaaaaatcttattgtatgctgtagcctgtattatcccacattgtttgtaattatttatgcatttatatcagatagcccctcttcattcattattaaatcattgattattttgcttcacttaagatccccaaattctttatcagttaggtactgccagggaatgtacagatcacaggaaactttagacacatgttctgtattactaggtaggcatttgcccctacctccagtctgtctttgacccagattagatagcttggaccttgggtgagcctttgggcccttatgccccatccttcttatacccttttaggcaaccagtattcgtagaggctcaggccacatggccttcttggcccatttctctggagcccataccctggtcctgttctgcggatcctaagattttcttgtgagagaagcctttcactttaaggcttgtagccaactcctgtcaacctgtccttagttgagaaaccttagttgagaaacaggtagaggaatcccctgatcaggaggtatccttatgcctgattgttaactgcagaagaatagttggcttcattttaaaaaggaatcccctgatcaggaggtatccttatgcctgattgttagctacagaagaatagttggcttcattttaaaaagaaggtattcagagcagcccagttctttttaaaactccttggctgctatcagtaaaaacaaaattctaatatagaagactaattgtgtatcacaagacttgtatctttaacctgtatcagagctcttctttggaggtggaaaggagtcaagagattcctgataaacattacaaaacagtttctcccccatgcataattaaatagcttttaagtattatatttttttaatgtttctgcttggttatgggtctgtgattgtttaaaaactctttatattaatcccaaattcaggggaataaacttggagcctctgtattgatatgtatttaggtacttcggttttattcactaattgacataccattttgaatgtccagcaaacagggatgtaaattcctttaggccgggaccatgtcttttatattctaaagcatgcttaatttctttttttttttctttttgagacggagtcttgctctgtcgcttaggatggagtgcagtggcgtgatcttggctcactgcaacctctgcaacccgggttcaagcagttctcctgtctcagcctcttgagtagctgggactacaggcgcatgccaccatgcccagctagtttttgtgtttttagtagagatggagtttcaccatattgatcagactggtctcaaactcctgacctcaggtgatccgcctgcctcggcctcccaaagtgctgggattacaggtgtgagccatgcacccagccaagcatgcttaaaataaggcacacaggtagtcaataaatggaggagtggtatggaaacaatcttgagatacactaaaataaacaaatggatgaaaatttggttgggtatattagtagttttgtggttcttagccacttttgattatataagaaatagatggttattagaccaacttaaaatattcaagtattttcttaagtattttttcagagaaactattttaattttaatactgtgtatagttaagcaaagcaatgaggctaaatgtactaatctctgttacaactttttgttttgctttctgaatccttctcatgtgatcctggatcttggactgatgatggaatgattttcgaattctatgaaccacagagcctattgtgaagaatggcaggcctccaacgtctcacagtatgcattccttcctccaccagtacacaggatctttcaagaagcccccattgcggagaccacacagtgttattggagggagccttggctccttcatggcaatgcccagaaatggaagcagattaggtaatttgattacttgtctgttgtgtttacctttctgattatacgtcatgcacatagttaagttttaattaagcaacttttattatctcgtttcttctgtcagataaaaatcaagttgagatcaagaggaatagcagaaggatggaaagttctagagaggtagtagtgctgacaatacagggaagtaatatttgaaaaacctgtccatcaggagggaaatgaaacccataataaatggatgcagtatttcaagatgaatggcagtttgggatggtgtttattttagggtaatgcctcagtaacttttcagatcatcaccatataaagcctattgtaatgaatagtatatgtggttatcacctgaattgtttcttcttctgtcattatgtctttaaatatccaagaaaaaagaattgcaagtttctgtttattcctctggccttttttgatgatgccttatgtttttatttttatttttattttttttgagacagtgtctcactctgtcacccaggctggaggggaatgcagtggtgctattgaagctcactgcagccctgacctcccaggctcaaatgatcctcccacctcagcctcctgagtagctggaactacctgtgcatgccgctacgcctggctaatttgtttgtttgtttgtttttgttttttttttttttttagaagacggggtctcactgtgttgcccaggctggtcttgaactcctggactcaagtgatccacttgcctcagcctcccagagggctgggattacaggcatgagccaccacacctggcctattatgttttgatttttaaaatcacttcaagtacaactattttatagtcttcttagataattatatttactgaagctcctaggggttttattctactgctcgttttatgtgcttactcttggaatagtatattatttccaaatgtgtttctttaattttgggagtatgagcttatctacagtgagattttttctgtgagaactgcatatagcctttatctctgtaggtgtgtctctacagaatggtatgctggagttggctcacactagttcataagagatgattgttaaagtttcaggaactttgcaaactggttgttaaacatagctattaaattttaaattatataagtttacaaataggtaaactaaattaaaaacaaaggtaatgaatatgcaaaagtcattgcttcctaattttttaccacttttaactattatctatgccaccggcgttatttttttctgttctagttatagtcaaaaacactatataatggtatgctactgcacatttcttcccaaccatatgttcagtgttgtcatgttggtagcctgaagttgtccatggagagagaagtcagaaaacactacagatcaggccctggcttattgttttcttgtttgtctagaccagggtttgttttttttttttttgtaagggggcagttagtaataaatattttaggttttatgggcatacagtctccattgcatattcttctctgtttaataatcctttaaaaatacaaaaaacatttttagctcatgggccatataaaaagaagccacacttgttctagacccttgttctagaactaagacagtgtattgaaaatgttagtaacgcagattaaatttaaagggtattgtgctggaggagaaaagtatgttgtatctgccgctgttacattacctgatcagcagagagatatccctcttccccccttgacagatgagtaaagttctgacaagccatcattgtttcacgtttgtcttgatggaaatgaaaataccgactggtagtcatgtcagaactacacttgtttgttaatgacgtgagtaatttcttgtttgggtcagatggtactcaagtatttattcatagtctgagattagtaagctttctttgtcgtccaattccttgtgcaacaggacagatttttttttaagtgtgaattttttttttttattatactttaagttttagggtacatgtgcacattgtgcaggttagttacatatgtatacatgtgccatgctggtgcgctgcacccactaactcgtcatctagccttaggtatatctcccaatgctatccctcccccctcaccccacccaccacagtccccagagtgtgatattccccttcatgtgtccatgtgatctcattgttcaattcccacctatgagtgagaatatgcggtgtttggttttttgttcttgcgatagtttactgagaatgatgatttccaatttcatccatgtccctacaaaggacatgaactcatcaatttttatggctgcatagtattccatggtgtatatgtgccacattttcttaatccagtctatcattgttggacattctgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatgggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctccatatggctagccagttttcccagcaccatttattaaatagggaatcctttccccattgcttgtttttctcaggtttgtcaaagatcagatagttgtaggtatgcggtgttatttctgaaggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagtttttcccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtacaatgtataagatttttgtacattgattttgtatcctgagactttgctgaagttgcttatcagcttaaggagattttgggctgagacgatggggttttctagataatcatgtcgtctgcaaacagggacaatttgacttcctcttttcctaattgaataccctttatttccttctcctgcctgattgccctggccagaacttccaacactatgttgaataggagcggtgagagaaggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttgttgatttgcgtatattgaaccagccttgcatcccagggatgaagcccacttgatcatggtggataagctttttgatgtgctgctggattccgtttgccagtattttattgaggatttttgcatcaatgttcatcaaggatattggtctaaaattctcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggcaggcctccttgagctgtggtgggctccacccagttcgagcttcccggctgctttgtttacctaagcaagcctgggcaatggcgggcgcccctcccccagcctcgctgccgccttgcggtttgatctcagactgctgtgctagcaatcagcaagactccgtgggcgtaggaccctccgagccaggtgtggtatatagtctcgtggtgcgccgttttttaagccggtctgacaagcgcaatattcgggtgggagtgacccgattttccaggtgcgtccgtcacccctttctttgactcggaaagagaactccctgaccccttgcgcttcccaggtgaggcaatgcctcgccctgcttcggctagtgcacggtgcgcacacacactggcctgcgcccactgtctggcactccctaatgagatgaacccggtacctcagatggaaatgcagaaatcacccgtcttctgcgtcgctcacgctgggagctgtagaccggagctgttcctattcggccatcttggctcctccctctgattttttttttaaatgtaccctgtaagtctcaaaagtgtagcactttgggagttgagcctttctgtgggaaggtctcacttgtaactcagaaacccagggcttcattttttatcccaatgtggaaggtaaacccagggaccttctcatcaacatcagcagcctctcctaagacactgatagagtcaatttatgtataacagctttgggttttcagtcctctctttgtttttgcttcctaggtattaccaatacattcttgcacatttagctgtgcattttaaaatattgtattttagtcaacattttcttgaggaaagggagattttcatatctcactagaaatggaagccatgattaaattatttttaacattttgaaggtgtgacagaaatgaatacaggaccttagatgtgttatataccaaattttaagaggttaggaatcaatcaccaatacattacttttgctgccaaattaattttttgttcacatatcaccataaaatttctatggaaatctcaacataactgaagtgtattcttagattacatattgagctattaaaaatccattaccatttgcaactgcttatgaatattaattggagttttcttaatattgagttaaccaagacaaaaatacagacataaagtgagttttaagatagagttgatataagacccttgagttcaaatttctccttaatctaagcagtcctcatgattttatatgtaaatattattaaaagttaacatttatacttataaaatacaattgtctcacacattgatattttatataactttatttgaaaaagagatctagttatctaggccattccttgattgttagttaatatgcagttcccttgaatacttgttaagcaccttctgagtgccagacagttggttaagttctggaaatagaaaagtgaacaagctaaatcccatccccaaggatcttataaaatcacatgcaccaaaaaatgttcttcagtgcagtgggtgggggcacagtagtcaactgtgtctgagattagaaaagacttcactgagtgatgacacatgagcatagtttgaagactaagcctgatctcacaaagttgataaaataggaaaaggcatcttttaaaaacgagaaaaaaagtgtgttaaagcactgcagcatgaaacaacatgcttctttctggaaaatgaatacgtgtatagaaagtaatagtggcaagagaggagttctagagatccagcatttgtttcctagtacactcttcttgctgggttattagataatgactgacaaatgcaggtatatgagtatacaacttggccagatgtggtggctcatgcctgtaatcccatcactttgagaggccaaggtgggtggattcctgaagttgcagttttttgaatttttgcaatcagaccttggtgatgaccttgagcagtaggatataagtagctcccacatgcttagcttccaataatggaacactaggcataaatggctacaagttcaagatgagcctgaacaacaaggcaaaaccttgtctctacaaaaaaaataaaataaaataaaacaaaacaaaacaccagatgtgatgggtgcctgtactcccagctacttgggaggcaggaggattgcttgagcctgggaagtagaggctgcagtgagccatggttgtgtcactgcactccagcttggccaacagagcaagaccttgtctcaaaaacaaaacagtatatgtctgtttttaatattttcaaatggaatttatcttcctccccctacttccatttaacttttatctctattaagcatgccataacccaccttttttgtagtatgtttttgctctgaacagatttttgagtatttgaagatcataaacttgtttttgtagttctggtacaaaatagatattcagtgaataattttttattgttttatttttaacattgggggtgcagggaggagaaactgcattagaagcttttaagaggtgttttaaagaatattccaagaattagctccatttaaccatagacccagtgacacattatttaattgaaagaatactaaataagaggcagatgaccaggtgtctattccagctctgcatctaagctttgtgaacttttgaaagtcatttaacctttcaagtctcagttcccagatctagaaaatgaaagaactggctcattctcagagatattatttccagtttataattttattactcaacccttgataataacttgaatgttaatttttttcataatttgaaagtgtaaaaagatttcatactattttaagacatttgagtcatgttttcatctattaactgcatacctgtggcacccagaatgtaaatgactttttatgctgtgatttttactcgttggccttctatattttacccatagtgataataaattatatattagaatataatgtatctcttttaatgtctcattttttgatatagatattgttcatgaaaatctaaaaatgggatcagatggtgagagtgaccaagcttctgggacatcatctgatgaagtccagtcacctacaggtgtttgtctcagaaatcgtatacatagacggatctcaatggaggtaatcatttaaaaaatacaaatatacttgtgaatatgtgtgttggtatatgttaatacacatacatatcaagtggagtaaatgcccatttaaaaattttcatgaagacacgtgacacttgtaagaaagttacttctttgcattcataaattgcagtctgtgaatatttcctcttttttaatttttatcccaatgtagatatgtaatatagttgttcgcattctgtgaaacattttattttaattttttgcgaaacgttattttaggttatccattaaggagaagtgaattttcaaaaattctggaaatacagaatgatacattagcaatgtcttctttttagaaaatacgattttaatgatatttttgagattcatctggataattagcattttattttctctgtttcaaattttaagaggtataaataaacagcttttttttcttgcattatattataaaagtgggtgtcctttcctttgtggttcactgtacctactgatctctgaagcacatttatttctccgtgtaaaaggatgaagaattcattttcttttctttgtaagtgttgtggtataaccttgaggacataagttgatcgtgactgttatttcagtacgtactgtaaactaaaataggtttctgcaaaaaaaaattgaacatgttttgaaatgaaagtattgttgcttttttggtgctgttgagatgatgattaaggtatctctcctattggttgattatattttcattataaaaggattcttcttaatcagttaaggaaatcttatcagttttctaaatgataaattaacattttcacttgttgaaatcaacgatatatttatgtgacacaatactaatgaaaatatttcttatttttcttcaccttatagatgattttttaaaatcatttgttttatttagtattagggtctgtatctggagtttctcattcttcgttgagctataatttgtttccccaccaccaaggaggcatgctctagattatattctttttatagtatatatttttttctggtttatgagacagggcctcactctgtcacccagactggagtacagtggtgggatctcagctcaccacagcctcaacctcctgggctcaagtgatcctcctgccttagccccaagtagctgggactacaggcacacaccaccatgcccggctaatttttttgtattttttgtagagacagggtttcaccatattggcttcccaaagtgctaggattacaggcttgagccactgcgcctgacctgtagtatattttaatatctggaaagactcctttctgtatccctcccccatatacacatatactctttcttattttagaatgtttttggattttttctgtttattctattgatacattttaggcattttattttgttctaagaataagcttattgtgatttcttagtggttatataacttataaaattaatatagggaggaccagtatcttctccttacttattcttaccatttggtggcattgtatgtttttatacttaagtcttatatttctcagtaaatatttatgcagttcctatacctctccattccgtttcatggtttggctgctgttatgaatgggaggaatttctttttatagggcttaaatttcttgatacaatgatataggcaagattcttttcaagtttatcccagctcacattgtataattaaataaagtagaaatgccattaacatggcagtaataaatacaattctctttccccatgttgcatacaagatcatataatgtctacttggttagttatttaaactgatcacagagtttgtggtagtgtttgcctaatgttactatatggtataataaatttaaagtaaatttcaagttgaatttaccagtgaaaggactcaaaaattactgaggttgcaaaatttcatttctgtaacacttcgctgtatacttttgcttacagtaaatgtttttgccatgagtatattacatataatcaatgtaggtaactttgcaactgcaataaaactttacaattacttatcactaagaaataatatgttagagcctgtgaatacaaaagccaaatgccttgcctttactattttggattacctttttttttttttaaggatttaaataagcggttatcactgcctgcagacatcagaatacctgatggatatcttgaaaagttgcagataaacagtccaccatttgaccaaccaatgagtcgaaggtctcgtagagcttccttagtaagtttttggtctcctatacctccaccatcaatcagatctgcttgtttgctgcttctgggtgtaaacattttaaattaatttttatacttgactttagaatagctaaattttattatattgccttctcgatttttattattttccattcttaaaggtttattggagtccttaagatgcattcaataggatgcatattggaataggatttaaggtatattttatttttggtaaatgttattaatacatgctaggtagataaatacatactagatatatagatacactagatatgtgctggataaataaacatgtattaatatatactagatatacagagaagtacacaaaccataattgtacagctcaacgaacttttgaaatgttaatatacctgtgtaaccagtacctggatcagtaaaagaaaatttcagaaatcccagaaacccccttctgttccctttctctttacttagtattcctcacttcctcaactgtagccatactctctgccttctgatgctaaagattagttttacccatatgtgtgacattgttctgatcatactgtttttatagtatgttttggtatctggatcttctaaaatcccattcacatatattcttatttgttttttaaatgtgtaatattctctttctgattatccttattaaaacgtctgagctttgtgtaattatgaatatgtaattatattaaaatatattttatgtagatatacagaattatatacttatacaaagtttgtatatatatattgcacaatatgtatcccagtatgtatggaagttatacagtatgtattatttttgttgttagcttcttttgttcagtgttatgtttgtgagtttcagccctatttttgcatgtaattatagataattcgttttcattgttgcatggtattccatttatgagtgtactgtacttcatccattctcctatcgatgggcattctggttgttttcggtttttggctattaccaaataatgcttctatcaccattcctgtgcatgttttttggttaacatgtaagcatttctgttgagtgcttacctaggagtggaattgttgcattatattctgcttccctagatactgtcaacagctttccagagtggttgtaccaacttatacgtatatcactagcatataatagttctggttgttctccttgccaacttttgataatgtcttttaaaaattattattttaagttttctagcaagttgatagtggtctcttggttttattttgcatttctctgatgactaagttgaacacctttctgtgtgtttattattcatcgtatgtttattgtatgtttatatttagatactctcttttgtgaattaactacccaagtctgtttttcttcttttttctattgggttttctgtcttttttattggtttatacgaatttttaagtatactttatatacaggacctttgtcagttacatgtcttacaaatatattttcttaatatttagtaattaacccagcaccatttattcaaaggataacttttcttattgcagtatcactttaatgtaaattcaggtgattgtttatgtgagaatctcttttggatgactatagtcctgtagtagagatacatataaagtgctttgggacaacaaaagaggcagcaagtaaaatgccttggcaaatcacaagcttacagagatagcacttgagctggtcctagaaggatgggcagaaatttgtcagttaaaaacggcctatgaatgaagggtgttgtaagaagaggaaacttcatgtactaaaactaaaacccagaggtttgggtgtagatgtcatgtttgggaaatcagaactgatatgaagggtaatatggaataatataaaagctatggcttgaacggacaggacagatccagaatgaaaagccttagaggtcaggccaagaagtctggacttcttcccatgtaatgagaagacatcaaaggtatttatttaaacaaaggctgacatggtcacatttttgtttcatagcaatagctttaggaaaagtacaaacaatgaattagagagaaagactagaggcagggagaattaggaatgtattcaaaattaaggatgatgtggcaatcagatggaaatagaaagcagaacataaatcctagggaccaggaagggataaaataccacctaatacccacttggactttgcacctgaaggaagagaaattgatgatgactcttggattgctagcagttgttgtatctccttttttacattattattattattattattattattattattatttttggagacggagtcctgctctgtcacccaagctggagtgtagtggtgcaattttggctcactgcagtctgcctccccgggttcaagcgattctctggcctcagcctcccgagtagctgggattataggtatgcgccaccatgtcctgctaatttttgtatttttagtagagatgtgatttcaccatgttggccaggctggtcttgaatgcctgacctcaggtgatccacccgcctcggcctcccaacgtgctgggattacaggggtgagccactgcatccagcctttacatattattatataatggaactattttctttagagacaaggtctcactctgtcacctaggctggaatgcagtagcacgatcatagctcactgtaatcttgaactcctgggcccaagcaatcctcacatgtcaggctcctgagtagctaagactgcaggtgtacaccatcacacccagctaattaaaaaactttttttttttttttttttttttagagatggcatctcactgtgttgcccatgctggtttcaaatgcctgggctcaagcggtccttctgcattggtttcccgaagtgctaggattataggtgtgagccgcccatagcatctggcccctgtgggccagattagatattctagttagatagtctacaaaatattttggtgacatactctaaaaaataaaatcactttatgctgtatataccatgagcacattgttatttgacattcaccagtatataaatatggtaaaaagtataacacaaacttgattttggtataagcatatgattatcataatttagcatcactgcttaagacattttttgtgtgtgtgtgtgtctgtgtgtgtgagacagagtgtcactttgtcgtccaggcaggagtacaatggcgcgatctcggctcgttgcaacctctgcctctggttcaagtgattctcatgcctcagcctccttagtagctgagattacaggcatgtgccaccatgcctggctaatttttgcatttttagtagagatggggttttgccgtgttggccaagctggtcttgaattcctgacctcaagtgatccacctgcctcagcctcccacagtgttgggattacaggcataagccactgtgcctggccaagacatttttattgggatgattttgccatttgattgtcaagtcaaaagttttcttcggctatcagtttttatcaaagattggtacttaggataaattttgaggttgtatttgttccaattgggagtaaaaatgtgatttaatcaccatgtaatttttttaagctatcatttaggagctatcttttacagtctacatgatattaagaaaaacagtgccctctaatgaatgctaagtgattaaagtttttatttatggttaagtgttcctacctacctcccccgctttttttttgagacagagtttcacttttgttgcccaggctggagtgcaatggcatgatctcgggtcaccgcaaccttcgcctcccgggttcaagcgattctcctgcttcagcctcccgagtagctgggattacaggcatgcgccaccacacccggctaattttgtatttttagtagagatggggtttctccatgttggtcaggctggtcttgaactccccatctcaggtgatcctcctgccacagcctcccaaagtgctgggattacaggcgtgagcccctgcgcctggcctgcctacttcccttttcagaaaattctgaaatggcttatagatttcagataaatcatgccagctatgttttggattttactgatgcatccatttcattattcatctaccttagtaaagcatactttttggaaatacattaaaaattattcttcaaaatgaaaatctctaccctaggtttatatttgaacatagtcagtgaagggagggcatgtgaaagttagggatggatggaaaaggagtgggaaaaagaaactcatttttttatatgtattagaatttgtgtatctgtggataatatattctttatatacctaaaaagtaaaagttttttcaaagagatcagttcttcagcatagaagtctggacccttggtttatgtgtaaaggagatgggtaaagattagggatggatagaaaggaggtaggaaaagaaaaatattcttcacatgtactagacttcatttttccatggataatatacccttaatctaaaaaataaaatattttttaaggtaaaatgtaaaatttagccttgtcttctaaaagttttaaactttcaatgtgttgttctcatatatatatataatttttttttttgtacaaattatttgtagagacagggtcatactatattatccaggcttgtcttgaactcctggcctcaagcagtcctcccgctttggcctccaaaatcactgacattacaggtgtaagctacctctcctggcctattttcatattttctaatggcaatatataatgagtagtaaaaataacataaaacctttgcttgagtaggaattaagaaacaattcatttttcctggagaaagttatacagtagggctgaatgggtctaatataaatttatggtcatcaatctcgcatagatccccagtgttgtctggctatcccactgtctttctctgattaactcttcctctcttactgtaagcagatgatctctcttcctatatcataaaaaagagagagggccagatgttgtggctcatgcctgtaatcccaccactttgagaggctgaggcaggaggtttgcttgagcccaggagtccaagaccagcctgggcaacatagtgagacctccatctttacaaaaaattaacaaaactagccaggcgtggtggcacacctttgtagtcccagctactcagtaggtaggaggtgagaagatcacttgagcccaagaggatgaggttgtggtgagccatgattgcaccactgcactccagccttgtcgacagagcaagagaccctgtctcaaaaaaaaagggggtggccattaaccgaaaactccctccttttctgtataacaaacttgcaaatctacctatgcatatacccattctgttcttttttgtttttaatcttgagaagttgtcccccttactatcccatcttttcaggatgcttaagactatctgttatccctataaactgatgtgtgttcagtctcccatttcttaccttaatcctttccagtgactttttatttacataaacataattttagttttagatttacagaaaaaattacaaaaattatatagttcttctataccacatacccagttaccatattattaacattttatattactttaatacatttgtcacaactaaggaaccaacattggtacattactagtaacaaaactccatactttattcagatttcactaattttttgtcagtgttgtttttctgtcccgatactccctccaggataccacattacatttagtgatcatatgtcatgttaaaaatattggctattggatggtgacgtgctatttagtagtcctttatgattgataagaaataaaacattgtcaacatatttagttaaatattagaatagtggcaaagcctatatgtagatagtcaggattcatcagagcttccttgcccttacgataatggtatacccagtggaagttttgtgagactgagtgcagcttcaattataatggaggtcatccatatataaaaatttgtcttattgtattcaaattataggtttatacattttaagagcatatgccttcctaaacaatgaatgtttggattcttcattcctggttttaccaatagactatatagacctttcttaattctcagagcaggtgagaaaatacaatcaagtccttacatctctcagcaattagaaatataagatggaatgtgggagtgaggttcaaagtcccacagaatttacctttagcatattatgtacaggagtacaggattaaggtggtattgtggtgatgataatagcaatttttgtaagacaaagtgactgagtagaatagagattctcagtctttccccctgcccaccaagtctaagggataaaacacatttctttcgttaacagtaactcggtaattcccacagagagggaaatgaatgtttgaaaaagcctccctcttcccctgctgtttcttttttgttgttgttttttgagacagagtcttgctctgtcgccaggctggagtgcagtggcacgatcttggctcactgcaatctccgcctcctgggttcaagcgattcttctgcctcagcctcccgagtagctgggattataggtatgcaccaccacacccagctaatttttgtatttttagtagagacagggtttcactatgttggccaggatggtcttgatctcctgacctcatgatccgcccttctcggcctccgaaagtgctgggattacaggcatgagccaccgtgcccggccccgtttcttatgtattaatatatactcactcttaaaatgtcatctatggatcctctgtacatacagaagcttccccctttatctgtggtttcattttccacaatttcagttatgtgaggtcaaacatagtctgaggataggtgaatacaatgccagtatgattattttgagagcaagagatagagactgcattcacgtaacttttattacagtgtattattatggttatttgttttattagttgatctcttactctgcaaaatttataaattaaactttatcttaggagtgtatttaatatgtatagggaaaaacctagtacatacaggtttcagtgctgtctgctgtttcaggcatccactggtgttcttagaagtatcccctgtggataagggggacctctggtgcttcatttgttttgaagctcagctagcacagcatctccagcctgtgatagagtaattatgttgctagatccaaagtaaacaaaaagtttcccataaggcttggtattgcttacaagttacagtgaattctaggaagactattataaattataatttaatttatatatatatttagaattttcatgtgtttatactctaagagccatctgaataggaatttgcttggggctgtcaaaaagtgaagtattttcttggaacagtgaaatatcagaaaaaattatcttcatttgtctggaaagcagcattaagggggctcttatattacatgaaaatataagctttgagcagtgatagtatcatacccgaggtttatccaaggcacagttattgctaattgaaaatttttcccaaatacccccaccatgacaacttgtgattatagttggcattggcaatttttgagtttctgcagagactggaacaacaacatacacattataaagcttattgtgctatttctttagctattatttctgtttctgtgaaacttttaaaatattctaaaataatctaggatggaactcaggctagattgtgaactcatgaaagtgggaatcatgtctgtcttctctagcacctaacattgtgctgggtaaatgttgaataaatgagctttgtcctctgtcctctgaataatttctgtaggagagcacgtcaacaagctagtcattatatctattgttaatcttgttgtgttcagcaaataaaaatgcaagcaaaattttctaaaaattttatttaaagattcagtaagtactgttttgatgtaatcattaaatcctaagttggaaattactaaattgggggctaagcttttactttttgaattaggatctgacagacaattcactagtgtaattgtgcctttgtctgaattctctgcctgcctgcctgcctgcatgggtggaattcagtagtgttgtttattttatagactgattattcaaatttaaacttaacctcttacatatttgtctttacagtctaatttgtagtccatttacatagtctttaaagcaaacctcgacattttgtcatagtaaccattggaccctagtgtatttgatgttttaagaacatagtagtattcattcatttaagataaaaggattaataagaaaatttctctactcctgagaagaaaaaatgcctagcttacagtcttatttcccgtgtgcttctcattgttataatgacattttaaatatttttttcaggaacattcattcttttgttcatactagtttgcatttattctcaatatagtgttttttcccccataaaagatgacacaaaacttaaaattcatggcaaaaatgcggtagttccatattcatgaatttaagcacctaaattccagagataagtatcagaataaagatattttattagtttctgtgatcttggcaagtagccttttttatggagtaaagtatttaagatcatatataaataggctatataaaacatatataaattaaaagattattcgtaatcagactgtcatgtaccagatagtgggctatttgccatgtttttcatactgattttaaaaacttcacttgtattttaacaatgttatctattgtagttttacttctttattttgcatagttattgatactagaaagcgaaggacttaatactgagtcatgttcaagacaatacatggatgaatagtgtatgatggtcgtaaaacttcatttttaaaatttaatgttttatgaaaaacgtcataggaaaatgtcatagaatgcaaaaataatttttcattcattcaataatacctgtgaccaaagttttaattagtttactaaaattgaattaagtactattggacgtgcagttttccacatggcttttaatatgatacatatcattgtaacaaaaagataaaaacagttattttgaggggcctctgctacttttggccattcagctttggataatttatcctattgtctgaaatggtaagtgatgcaagtctaattaccaaggattattttaattttattccacagttccaaggaaaattgcgtatttagacctctagagtttgactaaatcacaacgtttaatcatctggcataatttatacacctttgagaactgagattatgtattaaaaaacattatttcctttaactggctttttatttaagggcattagcaccattctaagcaagtggatctttctttagattatcattaccttttccattatctataaaggggtactagaaagcaactttaagaaaattcttttcccattctgttttactttttaaaatatttctgctctctcagtccctagttttcaatctatctaaaaacaaattttcctaaattttgtgttaaggttttttctttttcattttaaatattgtgtttgtattacatatttaggtatatttcatgtaccctgtttatcatctccatacacaatagtcaggcgagctcaagttttaaaagcaaggcttttaagaactcacttttaaagcattttctcttgttgttgtgggtttgtttgttttttttttttttttttttggccgagtgttgagggggggtgtagccagaattagacttacattgctgcttctatgtttgccacttcctgatccatagaagagcatgattttcagttgtctttttcattgtattttgattggaaagcctgaaacaaatagtattttgttgtttgcaggacttccttgggaattcagattggtgagggagaaaatacataggaaaattatttattttgcaattttgttaaaaagaaaatcccaagtagttatccttgataagattctttagtatcttaaaatgcctgtggtatcttagaataaaaccaaatatttttcatgacagaatgttaactgtgtatatataaaggttgggttgacaattttgattgtgaactttgatatttttgaacctttgaatgttccaacattgggtttattttaaaacttgatagatattcaaccatttgattataatcagatttttctattcttagtcattctttagagtgggaaagtttcagaagttgaggaagagatgaattgaaactttaagaatatatacaaggctgggcgcggtggcttacgcctgtaatcccagcactttggaaggccaaggcaggcagatcacttgaggtcaggagttcgagaacagcctggccaatgtgttgaaaccctgtctctgctaaaaatgcaaaaatttgccgggcttggtgctgcgtgcctgtaatcccagctgctccggaggctgaggcaggagaatcacttgaacccgcgaggtggaggttgcagtaagccaagattgtgccgctgcactccagcctgggcaacagagtgagacgatgctgtctcaaaaaaaaaaaaaaaaagtaaatactaaatttttcattgtttacttttcagtcagaaattggctttggaaaaatggaaacctacatcaaattggaaaagcttggagaggtaagtaaatatctcaaaaatgtaagacacatttttttcttattcgtcattcaaactctgttactccacggtttttgttaacctggaaaaaacgtaagtactgatgtctacaagattatatacttgttctggaaaggtaacagagtttctaggagttagagtcttcaattcttgaaattatcccatcagtttgagaggaaatgaattttttttatagctttgaaatttttattgaagcagaaagtattatgttttcttaataacaaagtaggcatttgtcacttagtctactgccagtctactgtctgtgccaccatgggaaattgcatgagttcagacctgtgaaaaatcagaataaagataaaaacacattttttgaaggttacggaaattcttaagatcttggttttcttgaacttactactagtactactgatttagaaatggcctacctcctatagtaggaaagggcaaagaaaacaatagttaatagggaaggcttaaaggagcttgagggctgtcctggcaataatagaagagatccttgttttttaaaggagagttaatgtacaaagattctgaaaagtctagaaacatgggtaaaatttttatgattgccgggcgcggtggctcacgcctgtaatcccagcattttgggaggccaaggcgggtgaatcacgaggtcaggagttcgagaccagcctggccaacatggtgaaaccccgtctgtactgaaaacacaaaaattagctgggcgtggtggcgggcgcctgtaatcccagctactcgggaggctgagtcaggagaatcgcttggaaccggaaggtggaggttacagcaagccaagattgtgccactgcactctagcctgggcgaaagaatgaaactccatctcaaaaaaaaaaaaaaaaaatttatcatttaacaatatgtacattatgttttcatttttcaattaatatgttcaattagtgtccatcagtctccatataccattgcaggtaaagcacctttgattttaaagctattgatctaattgttaatctaaaataaggtacaaaaagtaaatattctgtctatgtttttatactcttgaggcactctgtagtgttacagaagtatggaagctgtgcatatgaactgaaagtcctgtttactgtaagaaaagccatggctgatcattgtgtgtttttctttgcaagatggaacttaacaatgcttagaaactagaaattcaggtagagctctttattataagatggtattaaatagactcttatgatacttttgatgcgtcctttaaaaatatattttatagggtacatatgcaacagtatataaaggaagaagtaaattgacagagaatttggtggcattaaaagagatccgattggaacatgaagaaggtgcaccctgcacagctataagagaaggtataataattatacagaacattttaaaatcaaagtggtggaataagtgtctattttttataagtaaaaagagctcagatatacaagtaataaatgactggaagatgtaattaaacctttaaaaagcaaatttctaaaacaaatactcaaagggattaattatattagtgtataacttataatgaaatctgaattcattaaaaatcactatcatagacaactatttgtcatagggaaatgttatacattggtacatgaggaacatggtaactataaattaaccagataaactaaataaattaaaaaacagtgtgtaaacatatttatatcatagtaccattttataaagaagattattcagaaaatggcttgaggcaactgattagtaatgtggaggggaaaaatggttccttgtaatttatatctaaattaatgccagaagtttcaaaagttaacatttaggaaaaatacagaagatgatatggagaatgttataatattggggacaattttaagtattataatatcaaacccagtagtataaaagaaaaaattgatttccatgaacttttttttttttttgagagggagtctggctctgttgcccaggctggagtgcagtggcgagatcttggctcactgcaagctccgcctcctgggttcacgccattctcctgccttagcctcccgagtagctggaactacaggcgtccgccatcacgcccggctaacttttttttgtattttttagtagagacggggtttcaccatgttagccaggcgatctcctgacctcacgatccgcccgccttggccttccaaagtgctgggattacaggcatgagccaccgtgcccagcctccatgaacatttttacaaccaatccccttggtaaattattgctttaaacttaagagaatcttttttttttttttttaaatagcattgttgcccaggctggtcttgaactcctgggctcaagtgatccgcctgcctcggtctctcaaaagtgctgggattataggggtgagccaccgcccaagacctaaacttaagagaatcttttaatcagttcgtatgttcaacttacttcaggtttttataaagactgccacagactaaacaattttctttttctgttttgcagtttcactattaaaggatttaaaacatgcaaatatagtaaccttacatgacattgttcacacagataaatccttgactttggtgtttgagtatctggtaagcatctcataaaaattcagtatttaactttactttagaaaaacatagtaaattggacttttagtttgttttttatttttctttaaactgcagctgtgcttagctaaattggactttttaacagcccaagagactttattatttagttatcagtttttcattaaattatgtgtatggtgcatccagtatcttttcttgaaaaacaactaattttgaaaaacactattaagtgaaccagtcacaacattctgaaaatggtgtatcacatagcagagtgctgtgtttttccaggataaagacctgaaacagtacatggatgactgtggaaacatcatgagtatgcacaacgtaaaggtatgttttcttgcgtgtgtaatttttaaattttgtttaaagcataggtgaaccattatataatgaaatgtaccagcctcataactcttcttcagggttttctgtttggccttttaaataggttattgtcctctgaacgtgcaatatttacccagaacttctgtttactacactatagctttcttaggatcagacctttttgtagaaccacttcattcttttgacatttcacattacaactgattgtcctaatatagaatatatgtacaggtgtattctgctttaaaaaaaaaattcaaaataaacacgaatgatgggtgcattctgtgaaaggccttctttaaatagtgaactccccaaataaatggtatttaattgtaaaacaacaacttttcagaactaatgaataaggccagaacatgcaggttttatgaacactatgctggaaataccaatctgtactgtcaggaagaagagtaagataattggtgtgttttcttacaacaacatatttaaaaatttaatgctaaaaatgtttgccataaaatcagtgccagatgatacccaaaagttattaactgagtaacagcatccagcatagtttgtattcttacagtaggtttctttgacctgagtagtgtatccaaatttagcaaagatttatttatccaaacttagtcaacaatatgtaagaacctattctgaaaataggctgtcgcagctgtgtgcttcagacatttctaattctgtaggtagtaattttaaacttacattttaaaaaaatattaagtttggtggttataaaggagagccagtttctgttactaaaagacagctcagaacatatggataacacattgctaaggatttttaaaaagggctttaaatgtacttccatatatattctgtcagggttgttttcatcttattttacatcttttgtttgcaaagtgttataactgtcattttgtatttttttggttttaattttgtttttcctgctttttttattggcaataatttgaaaataaaacaaggtccttgatgataatttcacaaatgttgagacgtttatttctttaatgccaggtttacatgattagcttaagttggaaagcgttttattatttatttgtttaaatggcctttatactttcaaaatacaaagtgtaacaagaattcatttaaatagtaattttagagttttaaaaacataattatgtagactggagagactctggcacagagaattcattcaggcataccgttgacctgctgccttggctgcctcagtgttcggatgccctgtttttcacctacagatgaactgaggggaaactcttgaatcctctgtacttgaggttctttttgttaaccccagagaatcaaaggtcttatgtgttccgtaaccctctttctaccaaaatgtacagcaaaaactctaccattagccttataggaattacttttttcagagtcattcagaacactacggtgctaatgcccctttgtgaatcacagtagattttgaaggctaagtaggaggtgctgaaagtaaagtacccaagagatgggtgatagaagctggtttaggttagttttatagtaagtaatttgccagagctatgcagcagctttctctttgatacctcagacttttcataaaatcgccaattccagtgccttattttaaagacactgccccagatcagagtttttgtttttgttttttttcaaggagagatgggtgggaggggggttggttggttgttttgccagaattttataattaaactatgtaaaccttagtaggcctgtaagtttatgaggatatgttttttttttttaagtcattttccacagtaaatcaactgttactgctaggaggaagttactttttaaaaaatatttccatagatactgttagactaaaagaaataggtagatgcttcaaatagaataataaactattaaattcagaaagccactatatataaaaggaaaaagacattgtacttaaggatgcaattactttctttttcctgttacaatgttctaggccagctgcttttctgcttaccatcatttatgcttatactaaagcatgtctcatctttaagactaatttttatttatttgtttctgtagctgtttctgtaccaaattctacgtggtttggcatattgccatagaagaaaggtattgcatcgagacttgaaaccacagaacctcctcattaatgagaaaggagaattaaagctagcagattttggtatggaatgtatgagatatttattagtacttccaggttctaaaatgtaatggttaaaagatcaaccactgtcataatgtgccattgcttttatgtgggtttggaaattttctcggtagcccacagaataagatatttgacagaactttggttggtgatttatgttggttattagcagcaaattctaaaatgcacaggctgttcttgggtgtggacaaagacccctagggctcctgagacccttgtaggaggcctctaaatgtaaatatattaccaaaattgtaccatctgttatttgcctatttcactgtgttaatatttgcaatgatggtcccaaaataataatgcataaaactatacatcaaagtagtggcaccaaaatatatcttttttttttttttttttttttttttgaagacagcattttgctgttaaagcccaggctggagtgcagtggtgtgatcttgactcactgcaacctctgcctcccaggttcaagtgactctcctgcctcagcctcccaagtagctgggattacaggcatgcgccaccatgcctggctaattttgtatttttagcgtgaccaccatgttggtcaggctgatctcgaactcctgacctcaggtggtccactcgcctcggcctcccaaagtgctgagattacaggcatgagccaccatgcccaggccgtcattgtattctttaccactacacttacgtaaagggaaaactgtcagttacacttacatgatgaagcaataaaatttattaattatatttaatttccatccttgactacatttctttttaatattttatgtgataaaatgggaagtgtacataaaactcatttgctgcacacagaaataatgtggttacttctcagggaaaagtgctcatgtgattatttgagtgcacattgaactagccctgttatttgaggggacaccatttttacttaaatgactgacagacaaactgtggttattcagacttaggtgtttggcagacattttcctgaaagtgaatgaaggaagcctatcatttcaaggaaaagaactgtcagtatttcttgccaataataaaattcaagttttcaagcaaaaattagagtttggaaatttggatctgctttgagtttgatggcttttcaatacttagagacttttctgatgagatcgatgttgatgttaacaaacacgatttttcaatatgctgaaaaagtgtataaacatttggaatgtataacccagggatccactgttttccaaatggctaatgcatgatattacagaatcatgcatggataaaagacccatttaaagtacaaggtcaatgaattttagtgcaacaaaagcatgagaagttcatcgttatagtttttgttaacacatagcttttaagagaccacttactttctagttctgatgtagtgtcaaataagactattcacatttatcagaaaaggctattaaaatgcccctcctctttcaacctcatatctgtgtgagatttgatttccttcatatatgtatgttgtgatatgtatatttgatctattttgatacatattgtgatatgtatcaaagcaacatatcacgacacacagaatgcaaaaacagatgtggaatccagttgtcttctattgaaatagactttaggccagacacagtggctcaggggtgtaatcccagcacttatgaggctgaggtgagaggatcacttgaagccgggagtttaagaccagcctgggcaacatagcaagaccccatctctacaaaaacaagacttaaaagagatttacaaaaatgtgaaagaaggccattcttcttactgttttgtttttataaaaaaaatgtttttcataaaaatgtcatacatgctgcatataaagggtggtgtttttaaagagaaaataatattttaaaatttgctaagttttaatttctagtgtggcaaatatcagtaaatatatccacaaaaataaaagctctttaggtctttgataattttcaagagtataaaatgggtcttgagaacaatgagtttagaagcaactactgaaaggcgttcccttaatatacctgccaccattactctgtatttattatatgctcagtaatttaattgtagctatttatctattttttttttagctaatctggttttaagggaattgaaagtaaaattaaatgctctttttgcttctagaaagtaaactttttcatattgaaggaactttgtagagcagctttgaattttttgtattccgcattctgagagtttgaatactcttagagaacttagtttttaaaaacccatgcagttttccataactaaattcataattttttttcataaatgattatggtagttttttggttgtttgttttgagacagggtcttgctctgtcaccctggctgaagtctagtggtgcaatctcagctcactacaaccttcgccttctgggttcaagcgattctggtgcctcagcctcccaaatagctgcaattacaggggtgcccaccacgcccagctaatttttgtatttttagtagagatggggtttcaccatgttgttcaggctggtctcgaactcctggcctcaagcaatctgcctgccttggcctcccaaaatgctgggattacaggtgtgagccatcacacctggctttgattatggtagttttatgtttggagtatttcattaaatttaataaatatgagtgtttcaagtattactcttcactgtcattaaatggtgagtttattctggaaattcctatacttttgctcgtttaatactttgccatttgaagagtaaattactttttgcatttccttccttaaaaaggaaatgtgtgggttacctgtgtttgaataacaaattatatgctatttacatatgctttcataaagtctcttcttgggcatagtttatgttgttatttcccttataataattgttactctctctctcttttttctttctctttccttcccccagccactatttccttttcactctttttccttctccttctctttgtttgctaacctgcatgtaatgctctttattcccaatcccaaaatgaatggcagtgaagagaaatacttcaggatgctaaggcgggtggatcagatgaggtcaggagttcaaaaccagcctgaccaacatggtgaaaccctgtctctactcaaaatagaaaagttagctgggcattgtggcggacacctgtaatcccagctatttgggaagtttaggcaggagaattgcttgaacccgggaggcggaggttgcagtgagcccaagatcatgccactgcatgacagagcgagacttcatctcaaaaaaaaaaaaaaaaaaaagcaaaaggaatgtcaaggactataaaaaatttacctttggctgggtgcggttgctgacacctgtaatcccagcactttggaaggcccagcaggcagattgcttgagctcaggagttcaagaccagtctgggcaatatggcaaaaacctgcctctataaaaaatttcaaaattagccaggtgtggtggtgtgcacctctagtcccagccagttgggaggctgagatggtaggatcagttgtgcccgggaggttgaggcttcagcgagtcatgatcaagccatttcattctagcctggttgacagaacaagaccctgtctcaaaaagaggaagaaaaaaacaacaactacttttatcagggaatactctgagtgctttaaattttgcttccaacctctacaatgcaagccaggcaaattttacccacaaggcaacaagaaattctgattattccatgagatagtatattcaattctgtctctatttcttcctttttttttttttttttggttgcatagtaaatatgacttcttgtgaaggagggtcatataactttgagtatttatactataagttgttctctgtccctctgaaaattctacccttttcccacgatcagtgaaaatcagaagtctaggaactagtgatatagacagatattttcactaatgatagaaaatggcttatataataataccatatcacatttaattaattttgtttaggagagattgtttcatttcattccaaccagtattgaaattctaattgtgaactagaaggccatgtacacaaacaccatagttcggaatcctctcaggagtgggagagtaggatactgaggaaactataactggtaatttgccttgatatggtatgttacaggataagcacgtttgcaaccctgtcctttgccttcctataacccacttttaatatcaagaagagaggtcagaaagctacctccatcttgttaattaattaccaaaattggtatgaaaataatttgttggacttacttcaccaagttgagatgctggagtaaaacttgtaattaaatgaaggaatgtcaacattgttccagttataacctttcaccattatactgaactgaaatagtatatgagtcctgcctaattaaatttctgacattgtttctgtaaccttattcagtaaaattgattttttcttttgtgacatttttctttaatattttaatcagatataccaagttatatataacagcaatctcagcctaaaaaataaattcttccttgttttggcaaaataaatttgtaattttccagatattttttaaagttgcttcttcagatcataatttagaggcttcgaggtaatagcgactctctcacactagtgactcaagagataaagttgtaaactctagcctttatttctggattatcaatagattccatattaaattagcaaaggaatggcaaatgttttatatcacttacagcaagcttgtccaacccatggcccatgggccatatatggcccaggatggctttgaatgcagcccaacacaaattcgtaaactttcttaaaacattatgagatttttttgcgatttttttttttaaaggtcatggctgttgttagtgttagtgtattttatgtgtggcttaagacagttcttccattgtagcccagggaagctaaaagattggacacccctgacgtaaacagcaattaataatatccaaggacaatgaagtctgtcttactccagaatgatccatgtaacttacaacctaaaaagggagtacagaacagcactgtaattttattccaaggaaattgtctctaagtcgatttgtcagtaaatctcaatgagattatggaccaataactttacagtttttgataaaaaatggtatagcaaatgaaagttggaatcaggttaaaaggtgacaaaagctcatagccgttagaagtaaaattgtgtatctcaatgtcattggcctattatggattaatttaattgcagctgagaaataattttgtcatcatgattcatggacagaaggaaaacatcttaagtttagattcacccagaatacttcaccaggtgtattcaaacataaaagtaagcacagtctctggttgtggaattcttgtttagttcaactatgtaaggatttgcttacttagggccacatgcactcaacgaattcataaagttaatagtggtgaagcctcaagaagctacgaattaaccatttcaggcatccctttgaatggagtcatggtgagaatagggtctgagagatccattaaagctttttcttaaccctttgttttattttccctatgaaggactagcccgagccaagtcagttcccacaaagacctactcaaatgaagttgtcacactatggtaccggccacctgatgtgcttcttggttcctcggagtactcaacacagattgacatgtggtaaatatatacagatgtcactgacatttataattttgaaagaatgtaactgttaatgcaagatgtattgataagtatatacttttaaggagatattattttaaagagccataatgtaacagtgattaatgagttctggcatgggaattagattacctaggtttaaataccaattctgccatttagaactatgtgttaactttattcaaattactggcctttgcctcagtttcctcatttaaggaaatgggaatagtaacaataactactttgaagtgttgtaggtgatgttaagattaaatgaacactcagaagagtgctttatgagacactcaagagtatctgatacatagtaatttaaaacaaaattatcattttatcatcatttaatattcaccaaaatctttctgctttaacttgaactaaaagtaataatcaaaatattgtagtcatctttctcacacaccgcttcgatcctgacactcttctactcagacaccgttattgccacccccttcattacctatagaataaggtacaattaattcctcaatctgatacttaaggatttccataagatgtactctaaactaccttttccaacttatttcagactgtttctcaacacaaatgttcccttttagcaaaatggcatactcactatatctcaggaataatgtggactttcctacctttgctcttggtgttcataccagtccacccatctggaatgcccactccggtgctctaacttgggctcattcctagtaacgttcaaaatacagcttttcataaatcctttcctgaatatactctagcctctgttggcagttccttcctctgaactgtggttgcatttattttctatgttcttcatgtggtaataagtcatataccgatttctgttgctgtcttgaacagtttatgtaaaatgtctcgtataactttttaaaattaatttttaatattgtaaaatactcataaaatttatcattttaaccaatttaagtgtacagttgtgagacattaagtacatttatattgttatgcaaccatcaccactatctatctacctccagaatctttttcatcttgcaaaaccaaaactctgtacccacttaacaatttcttcctattcccctcccccaccatcagtttctggtaaccactgttctataatactttctgtctccataaatttgactgttctaagtaccacttatgagtagaatcatgcagtgtgtgtcttttcatgactggcttacttcatttggcataatgtctttaaggttcattcacgttgtagtgtatgccagaatttccttcctttttaaggctaaaaatactccattaaatatatattccacattctgttacccatttatccattgatggacatttggtttgcttccaccttttgactattgtaaataatgctgttgtgcacatgggtatacaaataccttttcaggaccctgctttcaattatctctctctccttctctttttctttttaagagacattgtctcaccatgttgtccaggctggtcttagactcctgggctcaagcagtcctcctgcattggcctgatttcagttcttttagatatatacctaggaagtagaattgctggatcatatagtaattctacttttaattttttgaggaaccaccatactattttccatagcaactatatcattttactttctatataacacttaatatgtaaaattaacttttatatatagttgctagattacgagccctttaatggaaggattatgtcttaaactgtgtgtgtacatacagttcctagatgactgttctaagaaccaccattctattctctgaaccaccatccttttcttttccttcacttacacacaccgccttgtaccaacatgttctacctctgcttcctgcatcaaaacgtcttgaatcatttgtttctctccatttctcctgcctagcttcactcactgtcatctcctagattaccataatatctcttcagttgtttttccccactcctgtctttgctgttcaatccatggtctacactattgctaatacaaggattcagtgagataattggtgcacttaaaaaacatttctaacacatagtaaatcttcagtcactgttagctgttgttagtgttactcttcaaggattatgcaaaggagagttggacattttaagtgggaaaaatgggatatagcaatatagaaattgagacaaatagggtaaatgcgaacaaattagttagatctaaaatatcccttcaagaggttttccgacaggctagtgcaaaattctgcagagaggcaaccttaaggaaaagattcttgtgcttcataatatgtaaatgaattgctaaattattttcatgatctattttaaaggggtgttggttgcattttctttgaaatggcttctggaagacctttatttccaggatcaaccgtggaagatgaactgcacttaattttccgactgctaggtaacagaagaaatcttttcccagtgattttgcacccataattgactagctggataagactgtatctctaaaatacatattttaaaattagatactgagactaacataaacagctgttagttagaataattagaatggacactatgaagatagatccttctaggtaacttcatctgctaagttttatctttgcaataaagattttatggaaaaacagaacataattagtatggaaaattggatgtcaccatattattaaggaatattgctaacttttttggtatcaactggatagaaaaaggaccaggcatcctttttacagtatcattgcaaagtccaaacaaaaagtccatgtacgtttatttctgtcatttcaattgcagttgaaatagttaagtcatctggtaaatgtaaattattctctaagacactttgttatatatatgtgtatataatttttatatataaattttatatatatttataaatatatttaatttttttttttaattcaggaactccatctcaggaaacttggccaggtatttcttcaaatgaggagttcaagaactacaactttccaaaatataaaccacagcctctaattaaccacgcacccaggtatttttttttcttatgtgaaaggggggaaaacacatgattcttttcaatcttttgaaggattagccacagtaaggattcaggaaaaaatacataatacacataacccttacgtattttaggatcttatttaattttgaactgtatatgttttagaattctagagtttatgtagttacttttcccagaaagaagacattgattaatgccttattccgtaccacagagattatgatgaaattcctgttttgctttctacagaattattctgtatttacttaacaaaaacctaagaaagggttatgtaagtaaaatcttgactctataacacaaggtaacctatcagtattttgaccagtgttaatgatgtaattcatatttgaagaatataaactctgtccaattccttagcaaaatgtaacatctaaatgtcagccattcatttaagtttcttcttagacctaccccaagatcaatccaaggctcccaataaaatttgagtcagaacatttttacttgtagaatgtattacattttcaggagataacatagaataacccctttgactgcattttccatctccctgcccccaacccccccaaattttgaaagtcaccaagataccaaataaggacatcatttattttaacccaaagccattcacattgctcacaacataacacacttgttatgcttccttttattttcaagctaaggaaggaagagcaaaacagttatgacaccaaaaatatttttaaagtatttatgtgagttggtactcttattgttactatagcaactaataccattctaactagattttcttaggaagaataataatacttgctgggctttttttgcatgtctctcccaagtagcataaattctatttttgtcctttaattattttttggtaatgttcagtgtagaaggttgaagcttttctttgaagcagagtctccatgacttagtgcctagtttgtgcccagggaactctggatatgtgctagaatggcaaactacatagaatgtctagactgcagcatccacaggacccacttgagagcacttggaaaaaaacgttaccttattcataattgtacttctaccagtgaaaggcagtgtaagatagaacctgttatttctgatcaagagattattccattaagataatcccaggccgggcacggtgattcacgcctgtaatcccagcactttaggggggtcaaggcaggcggatcacctgaggttgggagtttgagaccagcctgaccaacatggagaaaccctgtctactaaaaatacaaaaaattagccggacgtggtggtgcatgcctgtaatcctagctactcgggaggctgaggcaggagaatcacgtgaacccaggaggtagagaggttgcagtgagccgggatcgcacctttgcactccagcctaggcaacaagagcgaaacaccatctcaaaaaaaaaaaaaagataatccctaaccctactacccctagttatactaatttcatctttattatgtcattagttttatatcccttattgatgaaatttttttttttttttttttttgggagacagagtctcgctcttccgcccaggccagactgcagtggtgnnnnnnnnnnnnnnnnnnnntctcctgcctcagcctcccgagtagctgggactacaggtgcctgcccctgcgcctggctaatttttagtagagacggggtttcactatgttagccaggatggtctcgatctcctgacctcgtgatccacccgcctcggcctcccaaagtgctgggattacaggcgtgagccactgcacctggccaccattgatgaagttttatgaagttattgtagcatatttaaattgaactcaataccttctagtacccggtgctaagcagacaactctaaaaatttgctgaatagctcatttctgtgtttgtcttgaacaacagtgatacattttggggtcacttgtctctgttttcacctatataataggaaaatgatgctcttatatacttgcgtttagtgaaagactgcgaaaagtgatacaatatgtaagctttcttaatattgaagtttctttgttttgagacagcatggtgatttttaaaattctttaatttgttcttggatattgaaaattcaaattgaagccaagttatttatggcttatccttaaacaaatagcaaggccagtcttttaagactaaaacagatttgtgtctatttgaagacaacaagagtgactattttagggcatttaaatttagcagattaaaacacttagaaaatagttttatctgaaaagttttatcagctaagagagcataaatttttacttgttctttgttgtttctaggttagactctgaaggaattgagttgataacaaaatttcttcaggtaagtcagttcttacagtaattgttaaataggttgttaagcctcagcttcttcatgtgtagaatgggctcagtagtacttcctcggtattgttaatgacaaataaaattatctatgcttaaggcacatgtttaagttaaaaaaaaaaaaaaacatggtttctcctaatgtgtctgggtctcttgtcacctacaacagtctgaggtagttggttactggcattgatcagctgtgtcaaggccacattctctgcaattgatgctctctatgctctcttatgttctcttttccttatacgtacagcctttggaggatgctctgcctccaaatgccattcatatttccctccaaagcaggaataaggggggacgataagggtagtaccagccacattagtcctcttgaaacttggaagcaaaagctttacagaaacccctacaaggtttctttccaagtcttattggccagaacattaattgtaggaaagactgggaattggggagcagaattgtcataattagccaaaatttaaaacagttatgattcatgattcatctatcagagttgatggacaccttgaacaaacctaggttgtatcatcaaaaaaaaaagggaaatgagtattggataggtcgttaagaatgactgccataaaaatactgggtatatgtccaccagtcctttggtgttcatgaagagaagtaactacacaggtcaaatattttaatttttctttgcttcagaaaatacaagcaatgtaaattcttgtttaagatccagccttatcttagaaatgtggaactgagatgttattacacaatctcagcagcgactcaaattagagtataactggagtattccaaattgttgattgaaaaatagtcatcatattaaataatcaagattttttttaagtagctctaaatgctaatttgcccatctcctactttttgcagtaattagagaaaaagctaatgaagcagttctttgctttttcacagtatgaatctaagaaaagggtttcagctgaagaggccatgaaacatgtgtactttcgaagtctgggaccaagaatacatgctttaccagaaagtaagagaaatcctaaagtgttttccctgctttatttttatttgtccaaggttagggtctggggtgattggggagatggctattgatttttaagcctaagattctagtcttctctatagttagattagaatttcttgaagggaggtgtgtgtcttatttccctatgattcagttatttcttgtaacactgagcacattgtcactcctctgtaggaaaccaatagtacttaggcaaggatcattaatcttattggactttagttgaaacatgccatctgatgacaggcattgtccctaggcccaatctagcttcgatttagcgttgttaaaagtgaatttcaaacaaaaactaatgaagcataaccgaaacataaattgttttcttgtgaaaatacattttttcttaagatacaaagatgattttcctttattgtggtcacactgactttactatccccatgacagcagtgagcatattgtcaaagtcactgtaatagcagatttcccatgcctgaataacattgattttactcttaacattctatttttagattaccacagtattttactttaaaatagagtaaggtgagtggggaattagaagaatgtttgggaactaagctgccaaaagctttcattaatttcctattctcatttattagacaatattgattcatcaaagcttgtgtagcagtcagtgacaaagctaattggaataaaaaatccttaatacttttcacttcaactttactggatatatttaaatgaaagaatacctctctgacagagattggaaatgaaaaagataaattacaagttttcttttaaagatatttgtatttcactgggcgcgatggctcatgcctgtaatcccagcactttgggaggccaaggcgggcggatcacgaggtcaggagttcgagaccaggctgaccaacatggggaaaccccgtctctactaaaaatacaaaaattagctgggcgtggtggcgcgtacctgtaatcccagctactcaggagactgaggcaggagaactgcttgaacctgggaggcggaggttgcagtgagccaagatcatgccactgcactctagcctgggtgagagagtgagactccgtctcaaaaagaaaaaggtatttgtgtttcattattaataccaagttttactttgaggtaggcagttatggttatacaaaccttttccttgtttttcgctaaaattccaaagatagcttgagggcctggtaccttcatgtcattgtaaggagacagagaaaggacagagagaattaacacctagtataataatatattttgactgggtctcccaaccccagaaagtcctggaacagacagtgtatattctcctcagagaaacacttgcccacagcctgctctgacacagagttggaagaagaaaggttctaaaggtggattgcttcattcatttagttttctcctcaacacactgggacaaaaaggaaaaatttcagcagggctatcaccttgtaaaatggtttcatattgaatcagtatatgctttataaacatttgttgatagtagggttgtgtttgttttaatgttagaccttcacctaataatttttgtctatgcattttaggtgtatcaatattcagtttgaaagagattcagttgcaaaaggacccgggttttcgaaattcttcttatccagagacaggtgtgtttgtcataaaccatttcacgtgtcgatcatgaatttttgcgtggaaccaagcttttggtttataaattgatcagtaaaattattgatgtaaaaaccaatgtacagtgcattccacaactgtttatgtttagcattgcacgtactcacttttctgtatgatgtgggcagctcagtaaatcttcagagaaaaatctgactcagtcaagtcagggatcctgaaagctgcagatggcacaaagaccttttacaagtgacctggcttgatcactgcacacgccatccctggtacctgaggcagaagacacatcttgtgcttccctagtcatcaggttcatcacttcgaagcatagaagctgtagactgaccccgtcaacagaagggtcatttaagacagtgctgatcactcttaccatggaatattagcttttgctggtgggaacattagcttcctagtcaccaaataactgtatgtgggataaaactgaaccttgaactgcctcataaaatgactttatattttaggacatgggaagaacagaagacagagcatgctcttttaagtctgataacatggtttcaagcccagcccccagcctttcttaccaatcaaggactcagaactgaaggcaattatttcttttggtggacttggaatctccgtttgtctacactgtcctcttcacagtggagtctttttatttcagacctacagattgtttttatatttgttgtcacagtgtgacaattttttgtacagtcggttttaaggtcttctctgccattagagccagtaggttacagctattgatgtaactatagctgcaatttttgtgcaggactgagaaacacagtgcattatttattgcggaatcattgctgctaaataactactgtctgtttatttaacacaacaattgaatgcctgaagaagttgcagtggctttattatatgtgaatgcatctgtttctcctcacgaattgttttactgctgcattttttgtttttaaaattaaactgcagtgtttcctggaatgtaaatttagctttgcttaatagtaaaataagtgagccatcttgaacactttaagtttatactatataatttcttaatgaacattggcaaatagagtagctaagagattgacaagcacattacgtttagataagcatgtgatgcagaagttgattcaagcaagtgaatccctgacattttgaggatctcacattagacaccaacaaattaaagctccaaaattatttattttttatgtgttcctcactttagaaacgtctactgcatattactggatatttgtatactaatacacttacctattttacattgtgttttaaatttagttaaaacttaaccgtagaagtctgttcaaacgcgaaaggtcttgctttgtttgttttaaatacatttattttattagaaaggatgatatttcattggggaatagtttctttcatttgggggctatgtgtttcaataacattcacttggaatcagctgaaagctgtaatatgtctttgaaatgagccatgataaattacaaacaagagaaatgagaacttacaggattgcttgaaattattgtgggtattatctgtttaccagagatactaaatattagttttaattatgcatctctttgaacatcataaacacactttggtgttggtaacagtattttaagcatttttgttcacttttaaggactatttgtttagtgcatcttacaaactataaatcttaattggtatattttgaaatggtcgtgtaaatttttgccttatatatcatgaaaatagtcataacttaatttcttttcctgaaattcactgtaaaacattcaggggtcctaccatttctgttcaggaaatcttgtagtttattgttgttatttaacagtattaagtggatttttgtatatttcattttaactttatttgtgaatagtgattgtggcatgtttggggtgttattttaatatttcacgatactaaaattttaattttaaaaaattctggaagaaacagattcatgtgtaatggtgaatattggaccactactgcttttcacatttgtaaattggttttatgttaaaccttgtagcctaacaaactgctgttctttctaactgacagacatgtattaatattgtactttgaaggttataaatatgtggaaattccttcattttgttttgaaatttataataacaaaatctccatgttgttaaaatgtggttttattgagtcacagttctttcttggggatgaaggctgtgccgagtggggtccttttcttttatgggtcgttcttaagataatgaagtctcactgtgctagaggtgttattgttttctgtttgtgccaatcatttgcttagtaatttctgctgggttttttttatagcactctcaattataaagtatcaaatttgtcacttcatagaatgtatatttgatttgttgcaaatttgacattatagcttttcataggcttaattcttgcgtataaaagatgaaaatatatatccatttgttacataaagtgtttcttcctaggaattcctaggggtatttcttcattttattaaggaatttgacaagcaaacaagtgtttgtttttttgttttatttttgatactcgagcaccattcagatcctgaaaacactgcagtgaagggaattgaaactccgaaacttggaactttgaatacctgtgattcctcttaaactggtaagattcttaaaggtaagagaagatgccttttatatttttctttccaagtggtactgtgaacacacattggatgtgtcattctaggtgtatagagtggctgcattctgtctgaggctttatcaactttcatttgaaaggctatttgttaacatgttataatctgtcttttggactcgggacaatttatgtaggttctttttatcttttaaaaattgtgttgagacatatatatatatatatatatatatatatatatatatatatatatatcataaaatttggcattgtaattatttgtatgtgtacagttcagtggcataattatagccacaaagttgtataacagttaccactgtctacttctaaaatgtttcattactccaaacagaaactctgaaccattttacccttccccgcagcccctggtaaccgctaatctactttctgtctctgtgaatttgcccattctaggtatttcaaataagtggagtcataccatatttgtcgttttgggtctggcttatttcattcagcataatgttcacagttcatccatgtttagcatgtatcagaacttcatttcttatcatgactgaataatattctattatgattatacacattttgtttatcgatttatctgttgatggacactaggatatcccatcttttggcttttgtgaataatgctgtgtgaacattggggtataagcatctgtttgagtccttgtttttaattatttggggaatacatacacctaggagtggaattgctgggtcatataattctgtgtttgactgtttgaggaactgccaaaatgttttccacagtggctgtactatttgatatttgcagtagtaatgcatgagagttccagtttctcctcatccttgctaattctttttttcctcctttttattacatttattctaataagttgaagtggtatttcattgtagtttttatt

SEQ ID NO: 15875 - DNA, 29569 bp, Human
  misc_feature (1)...(29569): n = A,T,C or G
agaatatatccctgtcattaagcaatgcatggctgcatttaaatcacccatcttctccagagtaggagttgagcaaatgagtgaggtcaaacatttccctaatggaagttcctccactgggaaacactgcatggggaggtggggagaggaccaatcatccattctaagaatattcaggagctggtgttgctggctttcattctctcttccctttctgaaacctggaagtatcctttttcacttttcagctaaaccatgtatttacaactattttcaacacgttttaaccaacatttccatgtttgaagccaggagctttagttgccattttgccagaagttgtttcagagagttttttttcacaaaggaaacaggctattaaggcaacttctcaagaacaggccttcctggatccctttcctagctgtttttagactttagagataccataaaatatttcctaacattattctttcattaactgtaataaaataactgagtgtaaatctcagcatattcaaggatatatttatttttctcctgagtttattaggcaacacacttttaaacacatacaataaatacaatttgaagtgcgtgctttatatcttgcatgatgtcgtttgtgttcttatgcttgtctccattagtctattgccatatagtaataaagctttatcaaatcaaacctttataatggattccttgaagatacttgaaaatacttcatagccaatagtttttacacaattggtttttcaagcaatgaatttccatttaaataaaatatggatttacaatacatagaaaatttacaaggagttataaaacagtgggaaagtatgtctagcctaaacttttgtgcatttagtctaggaaaatttcacatccctctttccacacctataaaaccaaacagaaccaggactgacttgaggaaagcaattatttatctctgctgtgtctaactaagcaagctgccaaatgtgatcatttgcctgattggaaaatcacataaattaagactttgccatcaactttctttcaagtaaggaaagaaaagcatttcaatatagtaatgcaaaacaagtggaaattgttattgaacatttacttggacgggcactgtggaaaattattccttgtccaaccacctcctcagctgtaactggtagcacaattcttgacccattttacagattaggaaacatgagtttccagagtttattggcactcacgtggctgttacatcgttttgatgttcaaacgacctactttattcaaagtcaggtagtacagtctgctggtgggaaatacagtattactcaagggacttcaaaggaacaagaagatgtttgagttgcacagtgagctaaattatgcaagttgcagaaatcctaggtggatagtacgacacctttcagatcagtttctaccctcaagggtggcaacaaccttgtagatccattatggattaggtttctaaactgttttggtgttatgaacccctagagtcttctggggaatccaatggacctcgtctcagaataatgttttacaatgtatagcagaaagaagagaaattatattgaaatacacttctggcatttgaccccttaggatttttccagcatttctactctgcccacctctcctctcatgtctaccaaagagactttctctactttattcagaaaggtaaatgagagacactcaaacaggtctgtaggttatgggagtagcagggagtatgggatgggctactgaggagctgtttttgaggtgacatcactgtctcccttcctttttcccttccctctggaagcctccttacttctccagctcttccttccttccccacatcaagtccaatttttctccttttacttcttgtctatcctcctcactccttgctcagccccgcccgcttttctaggcccgcccctccagggccccaccctcaggccgctcctccagtctaggccccgccttctcctcagtttcctgccaatgacgctggggcagccggggcagccggggcagcccggtcaccccgcccccaggcccacactaagggtgtccgcggcctgccctccaggcggaggagcccggactgcggaaggatggagctggccgccggaagcttctcggaggagcagttctgggaggcctgcgccgagctccagcagcccgctctggccggggccgactggcagctcctagtggagacctcgggcatcagcatctaccggctgctggacaaggtagcggccaacccgctggaggaccgcggggcctagaatgcgccggggtcgacctccccgcagggagtgcggggcggcagtcgcggaagggacaggggcgggtcttctccggctcaggaaggagctccgcccggaccctgtctcaagctctggagctagcgcaggggcggtgcctccaagtgactgccgtgcagatccaggggagttggaaggtcacaggagttcagcctcaggtcaggcccgacggggcatgtagttagaagttaatgacagttgaaacgtgggtcagctggttcctaggcccgtgcacacgtctgcaagggacgttgatcctcactctccaatgcgtgtcagtggcatatgggggctggggtgggggaggggcggtatcttagggcttggatataggaggaaaagaaacagaacttttcaaggactggatgtgcagggtggtgtcaggggttgccgagaagggccctactgttttagtgactcgtttcttttggttgttgccccttccttccaagttgctcttaataagttgagtccgaatcttcaggcaggagtaaagatgtaggaggaatgggattggttgttgaagtctttggaatcaggtagccatccaggtggaaggcattgcccctgaggcctgtcatccaaggcttgtcatcagttgctttgtgtaatagtcgcagcatggcaagtaggttaaaagtcgcctgcaggtaatgtgggtgaaactgaagtttcctaatacaggaccaggatattatagtgttagagttaggaggatacctcatgctcacctggttaaaccccaggtttcataggtgaaagcaacaggcctcaagggtgaagtcactcctgaaatggcccagataagtgaatagcagaggtgggattggagggttcatgatcttgtgaatgtcaaacatgtggttgcctttttaggcacttgcatttttgtttacatcaaatatagtgtttttatattttaaaacagaaaacaaacgtttgcaatatttagaagttgctcacctgttaaacaggaatgaaaactctgcctgtctcattgcaggaatgaaaactctgcctgtctcattgcagggttgttagggggttcaaatccaatctgtcagatatgtgtgaaaatttgatagctgtaaataactctacaatgcacaggacagtgaccccatacctctcccggggaagaattatccagtcccaaattgtaatattgccaaggtcaagaaaccctactctaaataaatggagaatataggtattatgaagaaatttcctgtctaaatacatatatatttgctttggatgcagtccgtccctctccagttagtgggactgtaaaacatgctatttggaatacttacaaattagtagggctggcctttacataatccagaacacagcagatactgcaagtggctaagctgccatatttactttttttctgtatacagatgttatatcttgatggattactcactcaacaaactctgaatgcttgctgtgtactaggaccattgggtttaacaagatgatcaagaagttcacagtctagaacaggcagaattaatttcttagggtaactttaaaaggtaccttagtttgaaaattgatacattttcagaaaaagtctttcttttaatttttattttttagagatgaggccttgctatgttgcccaggttggtcttggaactcctgggctcaagcagtcctcctgcctcagccctcagcctcccaaagtgctgggattacagggatgagccaccacacccagccaggcaaaattcttttatcttctctgctattccatttttcttaccagccacatcaaggctttggccaagttttgttgattcaactgctcagacgtgtctagcatctggcttatttcctcccattttctttcctttatctttgctactttgggtactcagcacccctcacttagaattgcagtgacctcttaactagtttttggcctaccagctctctgctcctgtctatcctacaccttccagtgcagtcaaacatctgagaagcagtgatcttatcactaccttttcagtggcctatttattgcagaaataataataatcatcactgtaatagctaacatttattgcatgatttcttataattcaggtgctaagtgttttggaagtattgatttactcaatccttgcatcaaccctatgataaggtactatgatgatcacctttttacctatatataaatgaatgcatagaaaggttaagttggtttctcaagattccagctaggatccaaacccagctgtctgcctccagtcctgtgtcttcaacatgctcctgcattgcctctccaaacagaaggcaaatgctgcctggtgggtacactgaactaatttggtctcaactcacatttccatcattctctcccattaccatagacctgacatcttctcctctagcgagcccagaccgctgtgccatcttccctgtatacagacaaggcagttgaggtccagggaaagtcagtggcatatacaaagcacacggctaagaagtggtgaataaaactgggatttagatccaagtccatctgcccatgaagcccctactctttccccaagccacacacactctttttctaataaagcttccagcatgtgggatggaccgtcttaggagggtgagtcctcattattggaagtacagtactgtgttggagaaaaaactcaaactgtttttttcattatctcaacatcaccaacaacacagaagcacagaagactcctgtgaccaaatgtctgaggatttctctccaaacaccaagtaagcagtcagttttgcggtggacgtcagctaggtgtcctcctgttcagtgttgacactacctacctggaaatagtgtcagatcccgtaggttgaggtcccagtcccacaagattaaccccctcttccctgccacttgtaatgccagttgaaagccccaggttgttttacctgtgcttctgaccaactggctgtaaataggggatcccatgaccccctccttggattcaattaatttactagagaggctgacagaactcagggaaacacttgctttcatttactggtttattataaaggatactacaaagtatacagatgcataagatgagatatgggggaaggatcttggaacttccatgccctccttggatgcatcaccctccaggaacctctatgagttcagctatccagaaactctctgaaccccctcctcttgggtcctttatggaaacttcattggctaggcatgattgaagcatggacaacagtgttgaaatatgactggacagaaagggtctgatctcatattaatagactgattggggaaacccaagaaggcctgtccagattcttctggcctctccatgcgacattccttcttccagggtatgaggcaggaccctccctggaatgaagttcttgcaactcttggctcaactcctgaggcctaaagtgcaccaacgtacaaaagactgtaacgagggctatgagagttatgaaccaggaacagtggatagaaacctgtgtgcgcgcgtgtgtgtattggatgtacagtactggagtatgtatgtgggtgtgtgtgtgtactctatgggcaatacacacacgccggcgcacatatgtttacacacatgtgtgaatgatatataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatacacaagcatgtgtgtgtgtgcatatatattctaatgcacactcaatgcatgctcaagtttgagattctaatacacactgaagtttgagaaccattctgccatgtatcatttcattcaatcgtctcaacaactctgaaaggtaagtagtatcctggttttgcaaatgaggaaactgagacacacacacacacacacacacacacgtatgtatatatatatgtggaaaatactatatgtgtatatatatacacacacatatagtatatatgaatatatacacatgtatatgtgtgtgtgtatatactaatcacactcatcaatgaatgtgatccacgttctcatcaatgaataagttctatgttcatgtatgtatgtgtatagatagatagatagatactcttcttttttatgcattatatttctaaccagctgctgaatgatgctgaggctactggtccgggaatcacactttgagaaccactggtggatggggagcatctagcatggtgctgaggcagttctgacattgagagctaaagtcagaggcaggagaataccctagagatgagatgcaatggaaattgaaagatgaaagtgagaccaaaaaatgtcttaagacaaaagcaacatccattttagggctccctctccctgatgtttaagttagtggtcacttgggagtaaatgtggtcccctgagcagtgctgagaagtttccctgagagaagggccatgggtcactgagaaaagctcttccagtgatctgcaagtcaggcccttgcaggaacttcaggcttcgttaccatgccattaaccactgcccatagagtgtggaaccagtgcgcagaggctcacagcttcaatttagagaaaataaatgttggactgaaaagctctggctgatggcttgacttattaagtttttaaatctaaatatctggcactgtgagaaggggcagcctaaattgtgtttttgtccttgaatagggcttctaatcaaagagtttggtgaggagcagacagtactttcccagggactgttcttccctgtgctcttgacctactaaaattctcaaagaccagcatgactggaaaaactgcatttgggcaggctgggctgagagaaagtttggcctttagagagaaacacagatccatctcacaggagaagagatttcactctatagatgtgaaatccctactcctatttccccagatgggataataagccaattagcatcatgagccccattacttcaggattgtaaaactgttctgctcctttctgtcatccttctgattaccagcgtgattgatagaatcattcttgagccctggtcacttatggagctgaaatttacttgtgggcagagccaccatgtctccaggacacccgtctgcggcattctacttcccaccatagaccaaggccagctccttcttttctgtctcccttgagtgtgcaactgggtagataagttagagtctcagtttttccctctcctcgcatctgtcttaggataagcctgtgggtatgaggccatgcgagaatgctggtctcaaggttcagatttggtggaaggaggggagaggaaggagtaagatgcctcccttctgtctccaggtataagccaagctttatgctctcactctgtctttcaccagattgctgtatggcgattacaggaggtggctattaataaaacaaaacactgatatttcattcagccttgggaatcccttgagaagagagatgacttgtagggaagggtataggcattctgaatgcttggacataataccataccaacatctggagtgaaccagcaggtgaatctggggcaatgctgaatagaggttcttgtctctatacatgtgccttttctggacattttgcagaacatctttaagcctcagttttcctgtttgaaaagtgggtttactgatggtccatacctcgtatcattatttggattaagtgggataatccatgtaaaagcacttggatcagtgcctgctgttcagttaatactcagtaaacatcagctatgagtattgttttacccagctgtgtgcaaccctgaaggattagacctatcacattttcttagagaggtcttaaatattaaatcagatttagtcaactatctgtctttgtagagtcttggcacatacttcccagcagcagctgcacctttgacttctgccattagaactgctttactttgatgaaaaatacttatttttcataccatctgagtctattacttgccccaaagtggatggacttggacagcttttagataaatagattgggggtgtttcctgtccctctgaggaatggaaatgagcgcttctgtgagaggcaaagagaactcaatgcacactcatgagtgcattcacaggatttgagaatatgtgatttatcaagaccaccttgtagttagtggtgtaaattcagataaacaccataaattggaggtaatgagtggtgcctttctccaggcctggatgggtgatgggacatctacaggagattactcctgtgtggggattgcaagtgtcatttgcaaacattacgacattttgacacatctcatatgtaaatgcatagcatctctttcagagtttattctgtttgggacaaataagtgtactgttgacaataatatttctcagaatactttaaccttgtaaatataattgaaaacaaattgcacagctgttttttttcacgcatttgaatcaccattgctgagaaatataccagtttaatgtttcgacaagttagccagcacgatagcatctcaaaaattagtgataacagtaacagatttcctggccatgcattcccctgtctccagcctccatttcttcacttataaagtggagttaatgatgcttacatcacaggattattgcaagtattcatgattaagcccagcctggcttagagcaggttcactgtagatattggttttcctgaaaatgtacattacagttctgaatcccagttctttaatctggaaaaaggagattatcgtacctaccttgttaatgaaatagtaacctaccttattaatgggaatgatatctaatatttactaagtacttattatgtgcaccacataatagaactttagatggattatctagtttaatcctcataatcattccatgaagtagaaacttattagacccattttgcaggttagtagtggaagaggttagattctacccagacggtgaatctgagcccatgctattaccaccacactgtcttttctgactagcttttctgatttatgagacagcactttggaatagtatatggaaaaacttggcacagtacctcatctgttgaaagtgataatattcatctttctctatacctgcctttctcctggttcctttctgaacccttcagaagcagcatctaaaaaaaaatacttcttctggccctttggaggcctgttgggcaaacacaccaggcttagggactcaggggagcatctcagtgggaggtccgttctgggtggcctggagcaggagtactggcttagggaaggaaagggttcccatccaggctttgccaccaacagcgtcatcagctgactcttggcaagtcactcacattacacagctaagctaagaccccttcctgctctaagatcctgtgtgatgggtcttctttatctttatcattagtttgtggtctggaacaatgatttgggaatgacatgcagagaaaatacagctaaataaggagacattgtagggaatagaaggggccagtgtgcaaagacacaccatttctttctgtctgtcctgttactagctgtaggacttaggcaagtaagttggcctctctaagcatcatttccttctgtaaaggtagagataacaccaacttccctatctacatcacagggctatcttagctgttacatgagagaatgaatataaaacgttggaaagtggaccatgcttagaaaaacaatgactagtattattgaaagaatttgtagcaggtcaaagggattagaaaactccttcaaatacaaaatacatgacttttgttgtattgttaataaatcatcaagggaaacagaatccagtctgcagtcaagtagaagcctctgcttggtttcttcttgggatcaagatatagtgaataccagctggtattcactatatgtactatagcaggtatatataaaaatatatatacctactggcattatatatacacatatatatctgctggtattatatataaaatatataatatataaatatatgtaatatatattctatatataacattatatttatgtagaataatatttctatatatatttatatatattttttctgagttagttattcaaaggagacagtactttttataacatggcatgtagggtcttgtacgcatttgtgcaaaactaaatgttgtatctcaatttaatatccattaaagtgtccattatctcttccttgacagtacattttagcaacatttatgtacttctgtactgttttaatgaatttatgtataattatatttcttgtaaatattcataagtcttaccagcactattctgtcagtctacttttttaccttgatgtcagatttttaaaaataaatctggacttggtaaggagagacttgtattcaaatggattatttcaaggagttagggaaagaagtattacagtaggaaaagtgctttgccgataagctctgcaggcatcttgggagttgcagagccgttcttttataaagaggagcaaagaacgttagaaagaaccatatgcggggatgtgggatgaaaggatggcatgatcggatagcagatcagagaatacttttccctgagcccagcctgttttcaggagggactgtatgctggctcaggtttaggatgggccaaagttcaggggcctggaggaaggagaaaagttcaaccagttgggttaacaagcattttgttctggttgatcagtgggggtgggcagcttagctaatcatttataagacaaagaaagggaaatctggagggtctgtgtctggccttgtcataggtaaacgggggcatccgtgagtcttatctaagtcatatggggaagggtagtggatcttcacagtaaactttatgaaacacaaaaggtaggggatttcttaaccttcactgtaatctaggatgacagggttcaaataaaattcagcattgttgataaggaccactatgtcaattaggattgtttttagctacaagtaatagaaaattggacaatcaatgacaaacagaggcatgtttatctcacctaataaataggtcagagttctacctattggtagagtttgctgtcattgatttagcattcagtgatgccagcaaccctctgagtctttctactctgtttctcatgttgattgcctcttggtcataggatagttgcagcagttccaaccatcatgtccacatttaaaacagggataagtcacacggctacctctccctgcagaggagaccagggaagttattggctgtttacattgccacggggttctcttaataaggagaaggagtgtttaccacatcaagtcttatgtttcttctggcagttgcattctgtacatgatactggctaattctctacttccaacataatccttttactatttgaattgtaggaaactaaatgtcttataactggagcattagaaaagtatccattatattttagtctagataaggaaattgagccactgttagaggtggttttctggaggagcttcaggaaaagccaagaatctcttgagtaagcttctttggagtcatttattcaaatgttagtaagcttggaaaaataaaaccgatattgcaaaagatttatatctctaattttaagagatcttacacatcagatcttattatagtagcaataaaagttttgccaaataagttttgctttttcatatcaaattgtttgtataaacaatggtgcccaacgctggtgagatgctcctttggaactggtgagaggaactggtgagagtacacacttggtgcacacgttctgcaaggtttgtaaaaagtataaagagccttaaaatgttaatctacttatcctaaaatttatctgtaagaaaacatttgtagtaaaaaaaaaaatagaattatggaccaagtattctatacaaacataaatattctggaaattttttttcataaaaatatttggaaacaaatttttttggagaataattgagttaggtatggagtcttcataacctcagtataatatttagttaaaaataagaatacaaactatttataccatgtgattcccgtttgataatgtacagatgtatttatttacttaaaggaaatatgtcaaatattatcagtagatatttttggattatggggttacatgtcaccttttaaaaattctttttgtcatttttataaactttttaattataaaaaactattttttaaaatatgaagtaaaaatgagtgtggttgctgagatcctttttaaaaagaaataatgggtgagaaaatgctttgattcaagaatgtggaccaggctgttcagcgcttggacattgtattgatgaagtaggaaaggtgttgccgtgttatggagcatttggttcctctggagctctggcattgctcagttctgcctcgaagggaatgtttaaaggaagttgtcgcaatcgttcattcttctgtactcacgcaaattatggttgttctatttttctcttccttgagaacttcctgttctcattgtctgtgccatataacaggatggaagtcactatgggttgtaactacattcaggagaagaagagaaccagtgtaagggaacagtgtgttttaatttatgcagatatccaatgctaacttatttaaaggttggggaggtcattatcttaacacataagaattcttgttgcttagaatgtgtggaaaacaaggcctcagtattcttgaataattgctatttgtctcccttccaaagcctatgatgaaaacaagtgtgtatgagtgtaaatgtgtgggtatgtataaatccttactaagttcaattgtgtgtgtgaggggagggggcaagagagagaagatgtttatcttcctgacatctctcatcagaccctgaggtctgcccttctactggggcatccatggcatggcacataaggggttcagatagactagtttgatatttgctggttggaaattcttggtataaaatcacatgcttttagagctggaagattcttatggattcattttcaattttacattcattttttgccaggtactttcacatacatctgagattcctaaaccgggatgtatttatccctaggttataccacccaagctagaagacccttaaagcttcaggatctctagaaagattcagcatgtttattccttgacttcccctcaggccatggcacagtgtttacagagagggcttcattcatgcatgattaaccagtaacacggccttagcgcatggatgcaagagttcatccaaaagtttatgttcgttcatttgtttctttgcctttgtgttgaaattaatctaatagccattgctttaattttaataatagagcctttaggcaaagctgagggtcaggaattgtaaattgtcaccgtacagagagtgaaatgtgtgatggggcaactctaggccaggaccctcatggacaagaatatggcttaccaaggaaacaagggaactctcttgtactttggaatctagaaaggccttttcccaaatcaaaggaacttatatgatttgaagcagatttcttttgtttttcattttcagtcttttatacagaatcaaaaagaagcagttgttgaaaaattctgtcttggaattgataaaacaatgtgttgggtttcactatgccacatggctatttaaaatataacctctctcgagaactgtagctgcctatgtgacacccttacttggatgcttaataaacatcttaaactcaacttgttcaaaagagaactcttaattaccccaaaagcccaccaatcacctcttctccaagttttttttctgtcttagaagatggcattcccatctgcccaacttgggttatgaaagttatccttgattctttgctttccctttccccaggatctatcaggaattcctttttactttacctccaaaatatatccttaaatcactgactcctcgccatcactgttgttacttccctgttcaaatcaccatcatttcttatctgaactattgcactggtcttctcacccatctccttgttctctgatgatctattttctaccaagcagcaagaatcacctttaaaaaattaatttgattgcgtcattcttaaactgaattacgaatcagatctggtcatccctctgtttaaagccatccattagttttccatagcaatgagaataaaatctttacctcttaccctggtttacaaagtccttggggtccagccctgacaaactctctaacctcagctcctgccactctctcttttgtccagagttctccagaccccaggttctttaaagatgccagcccaccaatctgaggaccttccttctaccaggaacgggcttttcctatcttcctatggctggcttcttccaacatttggaacaagatgctctgataaatgttaactctcatagaggcctttcctgatcacctgattacatagatgtcctccccatccctgcccttgcaaggcatcatttatcacacaactcttcttaccctatttaaattacctagatggcacttatagctatctctagcactgctgcctacctgaatttaagatctctgagagcagggcctgcacctgcttttttatcattgtgtcaccaagaccacagaggaggtcagtgtttggtgtggcatgaacgtcgtcatcagctgcttttctttttttttttttttattatactttaagttttagggtacatgtgcacaatgtgcaggttagttacatatgtatacatgtgccatgctggtgtgctgcacccattaactcgtcatttagcattagatatatctcctaatgctatctctcccccctccccccaccccacaacagtccccagagtgtaatgttccccttcctgtgtccatgtgttctcattgttcaattcccacctatgagtgagaatatgtggtgtttggttttttgttcttgtgatagtttactgagaatgatgatttccaatttcatccatgtccctacaaaggacatgaactcgtcattttttatggctgcatagtattccatggtgtatatgtgtcacattttcttaatccagtctatcattgttggacatttgggttggttccaagtctttgctattgtgaatagagccgcagtaaacatatgtgtgcatgtgtctttatagcagcatgatttatagtcctttgggtatatacccagtaatgggatggctgggtcaaatggtatttctagttctagatccctgaggaatcaccacactgacttccacaatggttgaactagtttacaatcccaccaacagtgtaaaagtgttcttatttctccacatcctctccagcacctgttttttcctgactttttaatgattgccattctaactggtgtgagatggtatctcattgtggttttgatttgcatttctctgatggccagtgatggtgagcattttttcatgtgttttttggctgcataaatgtcttcttttgagaagtatctgttcttgtccttcacccactttttgatggggttgtttgtttttttcttgtaaatttgttggagttcattgtagattctggatattagctctttgtcagatgagtaggttgtgaaaattttctcccattttgtaggttgcctgttcactctgatggtagtttcttttgctgtgcagaagctctttagtttaattatgtggaatgcagctttctctcaacttgggaaccaatagacatttctacctgttctgtttttatagaagactggactttatgagtataaagtctttggtgttctggaggactgctcaccaactctactggcagacatctatatggactcagattacagaaaacaatgggaccagtatgttaaaggtgagtgatgcttgcttttctttttttttagacgtactttcacttttgtagcccagggtgaagtgcaaaggtaggatctcagctcaccgcaatctccgcctcctgggttcaagcgattctcctgcctcagcctcctgagtagctgggactacaggcgcccgccaccacacctggctaatttttgtatctttagtagagacagggtttctccatgttagtcaggctggtcttgaacttctgacctcaggtgatccgcttgccttggcctcccaaagtgctaggattacaggcatgagccgctgcacccagtgcttttttttttttttttttttttggatcattaaaaagtagatctattctgaccagatgcagtgactcacgcctgtaatcccagcacgtggggaggctgaggcggacagatcacttgaggccaggagtttgagaccagcctggccaacatggtgaaatcccgtctctactaaaaatacaaaacttagctgggcatggtggcgcatgcctatagtcccaactacttaggaggctgaggcactaagaattgcttgaacccaagaagcagaggttgcagtgagccaagactgtacttcagcagggacaacagagggagaccctgtctcaaaaaaaaaaaaaaagtgtaatctatttttatttattcttgccagtagaaaaaaataaaattaacttctactacatagtgcttcctattaaattttggcacaaaagcattttaaatgttggactgaaatgcacttttgctattgctaggacttgctccttacctagttttagatcctctccacagtttgctcttggggctcctttgctgccacttttaagttgtgtgatcctcccatgtatctaggttgtcatgaaaggggaggaggtgcggtccaagttttggtttgagagttgaatcaaaattttccaaacagagaagaatacatgtatgtgaggaggtaagagagggacaggatgactggttaagagcattctaggctcagggatcagcattagtaaggtcaggaaagcgtgaagcaatatgttcaatagccgccagcagtttggtgttgttgggttggttggagtaagagaacctatcctaggtcttcgactactgttagtactagttctactactactattgttagtactgctagtactagtagaactagctaatagaactagtactagtagtagtcgaagagctagggtaggttcttctactactaggcgaactagggcagctgttgggtccagatcctccagggcctagcatggcgaccaggctatcggtcttagatttttccctgtaagttatgtgttatgaaagacatcacacagggacttctcctgccacttagagctggagtagcctctgccaacccagtcatagtggaatggaactatgaaactagccaaaggcacataaagcctttagtcaagactcttggttgcaagtaacagaaagccaactaaagacagtgtaagaagagaaaaaggagtttattagttcatggcattgaaaaaagtccaggggtttctaactttgaggacagctgcaacagggaacttaaataatttcatcaggattgtttctttctccatctgtagactctgttttcttctgtgttgacctaattcctaggcagattcttatgtcatggccaagatgtctgccagaagatccagatttatattctaaccatatgaataaccccagaggaaggagaattctacttttctagggatgacagccagatgccaggattggctcttgtcagctcagcttggagtttgtgcttattttctgtggacattcatcatggttttgggcaacttagtgttctcaaatactcttcctatttagggggcagtgggatgcttacctatccaagggaacagccagacactgtctgtccaggcctcccttgcagccaagatacagtcatgtgacatagactctgccaataagacccacatgtggcttcaatttggaaaagagccatgtgaggaagcaggcagcatggaagatccatttttcagtgaccagtgatggcatctgactttagggaaaacaactgctgagtctctgatgtttgctccccaacatcaacagctttcactctgggttctcatccagtggaagcagcagttaggctttgctggaacaatcttgaggttggaaatctcactctggtccatccgagagctttactaaatcactttttgctctcaacttgctagagtgactaactacgactctggacagatctgccatccctgaattcgtcaccatggccgtgtcttgctcattttcccagccctgaaattactgcagagtcagtcttgcgaaaccatgcagctgagaagtaggggaagggtgatgccctgaaggaaaattgagatgctcaaggggcgatcaatgctgagcatgtaaaagcaacagatgtccacctctccctttcttttaaggactctcatcagcctcctgtgaccttaatgggctggcacactccttaatctacagtgtgcttctaatagattttctttcaaaacctaaattatccctccttaccatctcctccagggactttgggctcctttaactggaggtagaaagaagtttactgcacagcacagtctggggacagagggtgtgcatgccattaaatttctttgctatctccctccaagagttggctgctgtttgcacataatagtaagacggaaggattattagggaaatttggtcaccctagctgtggcatagtgcaaagaaacatgggagagaagaaagaaacttggggtaagccatagttctgctgatctctaactattcaagaaggacgttgctcattctggaaccttcatatccgacctatgaatgtgctagactgggtgactccgttccaggttagctgtaatggatcaaggaatcctaaaggggaattaaagggctcagaagcaaaactattggtactctagtgacatctggtggttatcctgaatttaaaacctctgactatttttttgatgtctgattttgtttcattgcattctatcaagaatattgattatgctatagaatggccaagatttgttggcttcttttatttgtgctgtgtttttctatccactagactctgtccctgggcaataagctttcagtggaaattaatcggtttgacttttttctagaattttataccttatgagttagtggtttatcataacctaagaggtcatctttttttttttttttcttgagacatggtgtcattctgtcacccaggctggagtgcagtggtgcaatcatggcttggctcactgcagccttgacctgctaggcttggatgatcctcctacctcagcctccagagtagctgggactacagacatgcaccaccatacctggctgatttttttgcttttttttttttttatatatagagatggggtttcaccatatttcccaggctggtcttgaactcctggacttgagcaattgactcaccttggcctcaaaaagtgctgggattacaggcatgagccaccatgcttggcctaagaggtcatacccttattagttgtagctaaaaaggcttccagatgcattaacttcttttgctttcctttagaactctatgaacaagaatgcaacggagagactgtggtctactgggaagtgaagtacccttttcccatgtccaacagagacgtatcctttccacaaggtactcattccctggccctctaagtgtttctgtgttcctcagctgcagtctattgcagagaggtagagctggtttctcagcaggcacagataacattgtctctgattcttgcagcagcatttgctaaagatattgcttcttgtatggtgtttggagagctcagagtgtgatttctgggcccaaccacatgaagtgtctgtaattttggtcactggagagcagctcttactttcctaagaagtttcctaggccttgaaattgtcaggccacagaattggggatctggaaggaacttcttataaaaagtgcttgttacagctccctcagtctacagaaggaaaaagggctcccaaagaggtgataggacagaggcacataggtggttagtggcagagcaggtgctggaactcaggcctctgcatttccagctctctccgcctcccccatctcagtagaccccacagcaatccctccttgattgttggctctggacactgactgtaagcttcttcccctcaatgtccttgtttatgaaatgaagcagttgaatgaaatgtagggaggcttggctggcactgtaaggtcttcagaagcccccttaggactaagctggggggctaggatggaattttgggggtgggtaggatggaagtaggatgactcctaggtaagattttgactccttcaccatgctcttcaatcccagcagcggagtgttttacaggttcaatttccatgtaagatccttttagcaaagggtctcttggagtcaaaaaaaagtttggaagccactgaattagatgaactgccaacacttcaaaggtgttctgccaaattttaatcactatatcaagataattcttcctccgtggagtatcagatgatatctatcacatgagctgagaaagttgggggagagagtggaacaatatttgctaaaaggaaaaagtaaaaggtgtaggagaaaggaacccagtgacaaatcaacatctctttcctgaaacatttaagaactttacttattagtgtataagagcatggagcaatagactgtccaatgtgagggtggggcaacagggggcgctgtcaagacactgaggtgggactgaacgcgggtggctcacgcctgtaatcccaacactttgggagtccaaagtgggcagatcacttgatgtcagagttcgagatcagcctggccaacatggagaaaccctgtctctattaaaaatacaaaaaaatttagctgggtgtggtgggcgcctgcaatcccagctactccggaggctgaggtgggaggatcacttgaacccaggaggtggaggttgcagtgagccgagatcgtgacactctactccagtctgggtgagactctgtctcaaaaaaaaaaaaaaaaaagacactgaggtgggtggaggctgagacggctgccatgttatagtaagtgtaattgtgttgtgcgtagtgactttttgattattttaggtttttgattcctttgagtgggaaacccaaaattctgttttatgaaagtgtaactaacaaactaaatatctgagctccatccaactatgaaattctaagtaggttttggagccagatctgggataaaaattcaggtttcatcacttcagctgggatgtgggatttttggcaaggttcttttcctctctgagcctcacttttgtcatctgtagtatggggatactcataccaaactcacagggtctttgtaaggatccaaatttaagctgtatgtcaagtgcatgatgttacatgataaaggctcgataagtagtgattcctgttgtttcatagactttcattatcctccctagaatagtgccgtaaacttaagggttcttctgtcaaggctgatggacatgaaatggttttgttattcttggtaaactagtgttagcccagagaggacatctgcctacgaaatattcatgtagtcccatgtcttcctatggtcatcagctgtaacattgcttgaccatttactatgcataaaggtcagtaattagagcattgggtgaggccagaacaaagaggaatgacaccattgtctgtcgagtgcttactctgcccaggtctttctctaatgcccccaccaagcctgtctgcaaggcagtgttactccctttcctacatagggaatctgagtctcagcaaggctgagtagcttacctaggaccacacagctgttaagtgaccattcctctgtcatctcccagtgccttcttggagaaaggaaatgtggtttcctcacataattaaaagcatgaagggatcactcacaggtaagtaatacatgctctttggtgagaatactaggtggtgtgaggcacagtcttgcagtgcaggtatggagacagggcacgtcagtgaactagtggtagaaaggagcaaatgccaagtgggaggcacagaatcacctccctttgcttccagcttgtggcgctttccttctgtctgtctacaatgctggcgttggtgtcttgccttgactggccatgcagtatgtctaccttcggcagcggcgagacctggacatggaagggaggaagatccatgtgatcctggcccggagcacctccatgcctcagcttggcgagaggtctggggtgatccgggtgaagcaatacaagcagagcctggcgattgagagtgacggcaagaaggggagcaaaggtaaaacccatggtgcctgtcagtgcacccagccaggggtcccccacgggagggccaggctgatggggggacatgtcgagtacatgaagcgtatccctgaaggtcagaggacaggcaaagctgcagagcaaaccaggatcagcacctagagagagcctcattccaccccaacaaacttgagtagagtatgaggttgatgtttaactctgacccagtctattttctccagactcatggattgtccagatgaaaccagaccattataagtaagccagagagtttagaaagtcacttccagctggtcctgtggatacatacgctgggcctaagggtaggcaagaaagctggcaggtttgtcttggaggtctcagctctggctcagtaccaactcagagctactcaagacctgcccagcttgagtttcagcccccagggaggaaagctgcagacagagagtggggtgcgaggccacctgctctaccagaatgagtgtggccttgagtcctaggcaaaaatctgaactatagttagatggtcaccttgaatatgtcacctaatttttatgagtatctgtttcatcagttataaaatgggattaattttaccatctccttaggattgctagaataattgaatgagaggctatattcaagtgtccagcacttgccaggtatttaataaatagcagcaaaatgtgtctatggctgttttcaaaagtgcctatatttaagtatgccataagggcagtcaatggagagaagtccatctgaattatatgctacctccctctgcagtttctgagcttgaatatgaagatataaagtttgcacagttttgttgctatatttttctggtatttttcctttttctgaattgtcctttctttccctctctagttttcatgtattacttcgataacccgggtggccaaattccgtcctggctcattaactgggccgccaaggtgagatcccaggaggtggggcggggggagggatgggggagtgtgtttgacaaatgttgacttagcccgcggggctgtcaggctgaagagacacattgtctcaggcgtaatgaggctcttttatgaagagtttggttgagtgactctggttagggctggggctgccaacatccaagacggaggctgggacaagagacaaagaattgtcagcttggaatgccagcctctccctgcttgtgccccaggaccccgccagaatcactctctggaacttctggacaatagtctgctcttagtaggaacaatagtgcctttggagcctatattcctctgcttactggggaataagacagactgacctggcttggagacaaccagatgtgtccaagcctgaggaaagcttccacttttgttgttgttgcccttttttttttttctttttctctataagggagggaactgcagtggtagtttgtatcactagagactgcccaggagcctggcattatggggaccatcagcctgctttgcacaagatctactactagagagctcaacagattccttggaagagtgaaaaagcacatcaactttggagtcaaacagacgcaatttcaaatcctggctctgctgctgactgtcttgttttatttaaggaagccatgcatttcttcctttttaaaaatgaagatagttgtcttctactgcatagagggggagtaaataagacaatatttaggaaaagtcttgcccagtgctcaacattaactaaataataatatatcctgctccttgatccccaatccttaccattttctaattcaataaagcaagtgctttcatttctttggaagaatgtaacaatccagcccaagcccatttcttgtgttttcttttttccagaaacactgtttcagaaacatcttcgctttttcctagaaaaagctaacatataaggcctttttgcaacagaagttcctgttgactggtcttacttttgtcctcagtcctactttttgtcatcatctgcaacaacattctgttgaaatccagttagggagcctattcatttttgttcgtcctaaagccaacattgtttaccttctgccacatcccaaagaatcaagagtgaccactgtgaagacatagaaatgacagtctcatttcctttgcagaatggagttcctaacttcttgaaagacatggcaagagcctgtcagaactacctcaagaaaacctaagaaagagaactgggaacattgcatccatgggttgatgtctctggaagtgcaaccacccaatgtctctggaagtgccacctggaagtgccacctggaagtgtctctggaagagcacccaccactgttcagccttcccctgctgtttctgtcttcagaggcctacacactaccacatcctttctaagcatgtttgcctgacatccagctcactcgtctgcttcctttctcgctccccccatcctgggctgggctgccttcttctacagttcaatatggggcagactagggaaacctttgcttgcttactattaggaggggaagtcttcagtagggaacacgatcattccattgtgcaattttacggggatgggtgggcggagggacacaacaaaatttaagaatgactatttgggcgggctggctcttttgcagcttgtgatttcttccagcttgggaggggctgctggaagtggcatttcgttcagagctgactttcagtgcacccaaactggatgacgtgccaatgtccatttgccttatgctttgtggagctgattaggctgggatttgaggtgataatccagtaagtctttcctcgttcctacttgtggaggatcagtagctgttatgatgccagaccatttggagaagtatcagaggcctgaccggacacataatatgacaaccacatttttcctcatcatccatgaggaaatggatgatttctcttttccatatgtcactgggggaaaggctgcctgtacctctcaagctttgcattttactggaaactgaggcgtcaagatggctgtggcagctagcaaaagcaaagatgctttgtgcatagccttgtgaaaaagtatctttctatgcaataagatgaattttcctcccagaatatttagaaatgtagaagggataacagttcacagccaggtaaaatttaactggtggcttaatgactctgcacctttttctcaggaattctgcctaagttgtctgccttttctaccaccaaaaagacttttagttttctatgctttctcctgaattttggtagggtaaggtatttctatgtcaaaggcacagccttgatgatctcagggaaaaattttaatcactgtgtataatgatactgaaccttgattaataacagaaattcaggatgtaaagccacagaatgggatttattaatgtgggatacctcagactgtttgttttctttctgggaagaaaagtgtgttctataatgaataaatatagagtggtttttacttgtcctgtgtaccacttccttcctaccttcttccttttgtgagtgtgcatcagttagatctcctttatttgcaagtgatattcagcctaatttgtagacttaaacataaaacataattttgggcttacttatatgcatgatcaggtgtaggtatcttcatgtagggatcaatacaggtgctcaaactgagattagaattcagatcgtttagtattggtctgcatttcctggtagcattgtcgctaacagcaataggtaggtttgcatcttcctaggctcatgccaagcaaaacaaaaaagacaatgtttctttctagtaggacctgcactttccataacttagagcacctctaaaacatatgcttatctatgccctgctcattatggtcatctggatagaattatacaagtaagtgaatgcctcataaaattatcattaaaatatcattatcaataatgtagctgaaatctattctagataaactaaatctgaatacttcctgttaatagaagtcaagttgaaatcttatgaatagattatttgaaataaaagcactgagattatagtcactgaaagagaattggcatgaaatggtgtcatgtaaaccatttctttaaataacattaaataatttgctaagaactctgaaaatactaagaatgctgagtttctaggtaaggtacttattttaaaaggttacagtgtttgctgtaatgaatggagttaagactttttagcatttttacttgctaatttagagtagtggacagtcctcacgagctgaggttatgtaggaaactgaaaactcttgagctatagtaagtgccaaagtcaaaaaaaaaaaaaaaaaaaatagaactggtggtttaggcctttacttagagggacttgcacctgagttctcagggtatgtttttctgcagcagctggatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 15876 - DNA, 13599 bp, Human
attataaaagtaatatatgtttgttgtagaaagtacagagaagtataatttataccataccaacagagattctctaagcacaaaggcaggggttcctctaatttttgtattctgtttgttattttaaggagaatttcaacagggatggagacttaaatataatttgtttgtatatacatagagtgtctgcagaaacacaagtaagaaactggaaacattgcttctgagtagaataattgaggaaatggggaagataagtcaggtgttaaaggcactgacttttgtattatttatgtagccacatcactaaaaaaattaaaaaacagtacgtaaactttaaaaacacaataaacattttcataagaattccctaatattcataattcttatatagaaatgtgaaataaaaataaaatccactatgaaatcataagccaaacaaaaataatttaataagagcatcctagaaacattgtttctatgtaatcattcagataaaaaagaaataaaaggatgtaaagaaggcacaaataaaagagaaagaatagaacaaagaagagtgaaatgcctagatggaaagattttcaaaataagtctgctacattgaaaatatactgccagttggttgatatttaaatgtagaaattcttgaataatggtggcatcaatcatcactaggaaggcccggcacggtggctcatgcctgtgatcccagcacttttggaagccgaggtgggtggatcacttgaggtcaggggttaaaccagcctggccaacatggtgaaactcctgtctctaccaaaaatacaaaaattagccaggcattatggcgcacacctgtagtcccagctactcggaggctgaggcaggagaagtgcttgaacccgggaggtgtagactgcagtgagattgtgccactgcactccagcttgggagacagagcgagattccgtctcccccactcgtcccccaaaaaggagcatcactaagaaaaggtgaatggttgggatgcatactggaaggaaacaacggaaatctgaaaaggtgtaagaacctaaacaaatttgtttatcacagaaaataaatcacaaaacaactttgcgttctttggcaagtttctttatgttaaacaagaattgctttttgcatcacatagatcttctaaactctttgttgaagaggtccttggtagtctgtatctaagccagttccttacggaagtggcactgagcggagtagataaagataggaacttttgaagggtcataatctctgtgtgcaaaaaagaagccacagtagtctgaagagctgtgcaggttttagggtgacactgggttgggaaccttggagctaagtgtcccacacctggcaagccatgacatacatattttctgttcaggcagaaactgagctttacaaaagtgaaatgagaaaaaaaaaaaaaccaaaaaccaggcacgtatattgagaaccattcagtccttcttagaattgcctcatacctttctcatgcatctttattaaattcagatgcaaattaattttagaaaagtctaaataggtgtgtgttttatttttctgtttcctaattaaatagtggtataagcctggaaatgctctatatctattttcggaaatctatagctcttgtttaggtaaatatcaggtacttagctaattaaatgtctcttgtttataggaaagtgtcagctttcaggatgttatgtgtatggctcaataaaattacgtacaaagtgacagcgtactctcttttcatgggctgaccttgtcgtcaccatcacctgaaaatggctccaaacaaaaatgacctaagggttgaaacaagataagatcaaattgacgtcatggtaaaaattgacgtcatggtaattacaccaagtacccttcaatcattggatggaatttcctgttgatcccagggcttagatgcaggtggaaacactctgctggtataaaagcaggtgaggacttcattaactgcagttactgagaactcataagacgaagctaaaatccctcttcggatccacagtcaaccgccctgaacacatcctgcaaaaagcccagagaaaggtaatatgaatgaaataattttgggggactttaattgaggagtaagatatttgagaatatgaggaagattccaaagtctctgcatataccttaataagaactgagacaggcttttactcattctcttttcagcacttatgattgaattagaaggaagtctgtaaaatttggctgtgatcatagggtaagatgttatctaacagaagccagaaacccaatgtctcctgctgagatgcttgagtgcctgtcaggatctaaaaattttcctcaagaattactgtatgtcattggaaagacgttcttttgagtggcttccaggagccagacagagggcaagtagacattatgatattgttttattatccatttttaagtgatgtatagctatatcttcaagctggcccatgataaagtggttcacttgttcagctgaatgactatagcttctgattatcttttgaatagatgttctcatgcagacttgaatagtagcatggaatttcttgaatgtcgttgttttcatttttcttctttaataaaatgctacaaaaatcaaagttggtagtatttctctagctattattcatgaatttgcaatgataagtcacttgcccaagtctaattgattagttccaatgagtttctggaaacttttttgcagctaaccttggttatcttagcattagcattaattggtggctgattgggaaatagacactagaaaataaaagaccttttttgtccctccttattagcgttgaagaataggctatgggcacgtgtgaagaactatgggctgacactatatgggtcccttaggaatgcagaagctccctttcatctctgtagatattttgtttcttaagctcttcaatctttttcccagtcaaaagtcagatattttgctttagaaaaggaatcttttaaagtttctgaaaatatcttttaaataattacttgacttaataccaattcaattattcataatattggtcaaccaaattgcatgtaatacattgctatattcttgaattatttaaaaaagacaagagtggtcatcatttataaaaggttcgtggtttttcatgttaatttcaactttggttttcttaagtttattattttttttgcagtaagagtcattgaaattttaagtgagtcatattccttaccatttcctgctgaaaagggtagtgtgtgagaaaaatgttagaaaagcaattaattatgttccagagcagattttcagttgcagtgtacatttctttttaatgtgagacccaaatttacatgaaaactcaaagtaagagctgggtaacagaaatggctaacttagaaggtaatgtacgtcttgcttaaaagcacatcaaagtaatctactttctcaaagagaaaatttacaggagtgaacttacatttcttttgagaacagcatggttcatagcaccaaacttcatttttacaggttgtgaatcctagagtagtttgctatcaacttctgatctttgcacattctggatttggcatataatgttacagcagtgccattgtaatgttgcacaaagtagtctagcaatttcttggttcaccaggcttagagataacattgtagaaatgatccagcatctttaacactctgtggtttaaggtggggcacttaggggtagaatcaataacaatgttagaaatcaaattagacaagataactgaaacagcatgatccatgtgtgactccaagttataaaggaggacatggattaatggtatacttctaggctataggggtagtacaagtggaaggacaccatcttagcatcagatcactttctgagcaactttggcaaatcttttaaattctctaatgtgtagttttttaatatatgacacaggtgtaaagaaaataaagcaagtgaatgtatgtgaaagccaatgctgactgggcacgggggctcacgcctgaaattctagcactttgggaggcagagccggggatatcacttgagcccaggagttgaagatcagcctgggcaacatagagaaaccctgtctctacaaacaaaacaaaacaaaaaaacaaacacaaaaaaccactcccaaattagccgggcttgctggcacactcctgttgtcccagttacccgggaggctaagatgggaggatcacctgagcttgggaagttgagactgtaatgagccgtgatagtggcactacactccagcctgatccacagagtgagaccatgtctcaaaaaaaaaaaaaaaaaaaaaagaaagctaatgctttttcccctttccctgttcccctgctgttccccactgcagacagtccttatagcttgatcagtttaaaatacctgaacttgctctcttttcttttcttttttcttttctctctctctttctttcttttcctctcctctcccctcttcccctctcctctcctctcctcttcttttctttttctttctttctctctctctctcttttttgttttcaagacagggtttctcactgtctcccaggctggagtacagtggctcgatcccagttcactgcagcctcattcactcaggctccagtgatcctcccacctcggcttctaagagatgggaagcaggaactgccaggtcagttaagggatatacctactacttgcccagtgtcactactgctatattcctgatctaagcagtcaagggcctatgtagatgaaatggggtacaaagataaaaatacaaagacagacataccactgtttgacgtgggagtgacaaggtcacactgcaaataaatgtaggctgaggggtatttttgtggccatttttggaaagtacaatctgccatagcagtaaacacaggggcaatgaacaaggggcttcactttgcagctcctctgctctgtttttattaccaaaaaaaaaaatccttttaaagtaagatgcctagacaacatagtgagatgcccacttcttttcttttctttctttctttctttttgagacggagtctctctgttgcccagggtagagtgcagtggcgcaatctcggctcactgccgcttccacctctcgagatcccatttctaatttaaataaaaagaaagaaagtttctttgtggatgaagagatagacgtgtacataactggttagactgtggggcatcatctaagaattataagccaagtgataggtgagtgcagtggagaaagatatttattttgtctttggggttgggtgaaaacttcacagtgaatctggctgttgaacagctccttaaaagactctgaagtagatgaactgaaaagggagagaaagaaggccaagttgagaaaactcatgttttcttggacacatattatcttgatgtggtgggtgatgggatataagggtatgttggtgtgtattgcaggttagtctgaggttgtgtgtacagggcctttgaagttcggaaaatactcatgtgaaataccaaaagaagctgagattagtaaatctgactttagattgagcatatttttgcaaaatagcataaatcctagcagaatttaatttctccccctgattcttaatattttcttttgaattttaaaacagaaaaacctgagggtgattaggatgataaaaatatttattaaaatgctttcaaaatcacctagaatttgaaggctattctgtttttacttggttaatgtcatctcttttcaaaatacaggcaaagaaaggtaatagttctgctacagcaatagtgatttttgtttcactttttcaatcttcttttcactttattataaaggcaattctaaaatgcgcattgacttcatgctttcacattctcaaatcttattataaatgtttctctctgaattaattctgatatagttgttcactgcataatggctgaattttcataatatatgagctgcaatattaaggcacaaacatgatactagtttaaaaaggaaactagttttaattctgaacatttccttatggctttgtgtattctcaaacttactgatctcagaacctgtttacactcttaaaaattattgaagagcccaggctggtcatggtggctcacgcctgtaatcccagcactttgggaggccgaggcaggtggatcacgaggtcaggagtttgagaccagcctggccaatatgctgaaaccccgtctctactaaaaatacaaaaaaaaaaaaaaaattagccaagcgtggtggcgtgtgcctgtagtcccagctattcgggaggctgaggcaggagaattgcttgaacccaggaggtggaggttgcagtgagccaagactgcatgactgcattccatcctggacaatagagggagactcaatctcaaaaaaaaaaaaaaaaaaaaaattattgaagagcccaaagagcttctattcatgagtttatatccattaatatttaatggcttagtgattatgctaaagtttaaaaatatttattcatttagaaaaatccatcatatgttaacacatataacatatatttattttttaaaaatgacaattttcaaaaaaaaattagtgatgagtggcattgttttacccttttgcaaaactcttcatcgtctggcctaacagaacatagctaaattctcatgtgctttttcattcaatctgttgtaaaattacatgtcatgtagcctctagaaaatttctctgaacacccaagaggatgaagaggaaaaaaagacaaacaacattttagtattattatgaaaatcattttaaccccacagatccactgaaaatctttggggttcccagatcacactttgagaaccactgacttagaacaatatttattcagtgttaattatgtgtgaagataaatagaactcaaaattacttacatataaatatatatattaggtagaaataatgacataggtttgttttagccttcatacttacacaatctgaatttctatacaggttgagtatcctttatctgaaatgctgaggatgaaaggtgttttagattttaattttttttggatattggaatatttgcatacacatagtgagatatcttggggatgagacccatgtctaaacataaaattcatttgtttcatatacacatagcctgaaggtaattttatatactattttaaatattttgtgcataaacaaagtttctgttaagtacttatatgtggaaatttccacttgtgtaatcatgttggtgctcaaaatgtttcagattgtgggccatttcagatttcagatgttcagaatagatatactcaacatgtgttataaacttagttctgctgtctgataaattattcctaagaagtattatgggttaatataaacatctagcagaaactcagccctattatgtcagtctacatgaaaaataaccataagttttgactcatatgtacctttaaacctcattctgaatttttttaaaaaaacttttattttgaataattgcagatttagaggaagttgcaaaaaatgtacagagaagtcctgtatatccttcagcttgttccctcattgaaaattatcttgtataactatagtacaaggtgaatactagagaactgacattgctgccgcctatacagcttattcagatttaagacacacacacacacataatactagtgctctgttatgcagttttatcccatgtgtagattagtgtgactaacatccctatcaacatgcggctgtcccatcaccacagctcccttgtgctatccctttagagccatactcaccctcatacacttctttcccagtgctaactctttgaaaccattaatctattctctatctctataattttgttatttccacagtgttatataaatggaatcatatagtattcagcctgcattcagcacaattctcttgagatccattcaagctgctgtgtgtatcaatagtgtgttcatttttttgttgctggacagtattccatggtatggctataccatcatttgtatgaccattcaccttctgatggacatttgaaatgtttccaatttttggctactctaaacaaagtttctatgaatatttatatataagttttgtgtgaacatagtcttcatttctctgagataaatgcccaaaagtgcaactgttggggcatatggtaagtacatgtttagttttatcagaaactgccaaagtatttcccagagtggctgtaccattttgtattcccaccagaccagcaatgcctgagttatctggattctctgcatccatgccagtatttggtgttattttttattttagccattctgatagatatgtaatatgtcattgtagttttaatttgcatttccttaatggctgataatgttgaatactttgtgtttatcctccatcaaatgattgtatattttatatctcatatataagtttatatatattttcttaggtattatctagtttaagttccatgttttacaaataaggacattgaggcttcttaacaggatgacagataatttaaaatttaaattttaaagaatttaaaaagagaattttttgtaattattattaaaccaatttctacagttaatgtgagaaatgggaagattcagttatctatctctttcctaaggagaactttttttaaaaaaaattacatggttttagtatatgttgggagctaaaagcagggaggtcaagacactgatgactattattaatagtaatgttgaaactactggttgttgttatgactggtaagccaattttagattaactgttttttttttttttttttgccatgtctgtctgcaggagcgccatggattactacagaaaatatgcagctatctttctggtcacattgtcggtgtttctgcatgttctccattccgctcctgatgtgcagggtgcgtgaccaaatttgtggttcaagtaataaggacaacacacatttctagatgtacatcaataactccattaattacatttctaccaccttttcaaaagtaataagtctttgctgctggattcatatctaggcacttgtagattgtgaacataaaattaaattaggttcagaaaatgtgcagtgaaaatgatatcttacacaaccatttatgcagcagcctatacattttcatcggaaatagattcctttttattcttgagtcttacaagaagaaaatgctccttattcagttagctcagttattttttacatttctcccggcagatttgagattttaacattgcctttgtagatgaattttcacatcagttaacaagtgagaaaaacaaaaccattttatacagtaaatttgttttgctgtattgtctgaaaaatctcatatagtagctggtataattccttctgctttgaaattgtgagctactattggttatggtttttctctatataagtggtaatattttaatccaggtcccaagtgcaggcgcctgatctaatatcaggctctctacactcaccaagctttcttaattctgacatatttctctctgtcaatatttggagttactgtgggaaaaacaatagcagattctaaagggaaaaatatttttcctctgtgcaaaattctcttttcagatgaacatgatgttttcatctgtcaagttttgtgtttcctctaggcatactgttagcattgggatagagaatccatgcttgaagagagactacaactgagattttctatgcatatctgtaaaaaatgtttgtttttaagttttatttcccatgaacattaatcagtataaatattaaatagatattatagatgaagattaacatataaccaaaaagcacttacttagtttcctttcatttttgatggaaaaataatattcactatcccataataaggaagcattcacagtttcttttctttgttgccttgccttgtcttgccttgccttttcttttgagacagagtctcgttctatcacccaggctggagtgcaatcgtgtgatctcagcttactgcaacctccgccttccgggttctagtgattcttctgcctcagccttctgagtagctggtattacaggcacctgccaccatgcccagcgaaatttttgtatttttagtagagatggggtttcaccatgttggccaggctggtctcgaattcctaacctctggtgatccacctgcctcagcctcccaaagtgctcggattacaggcgtgagccaccacattttttcttatttttttgagtcagggtctcactttgtcacccaggctggagtgcagtggcatgatctcggctcactgtagcctcgacctcccagcttcaagcgattcttctgccccagaccctcaagcagctgggactacaggtgtgcaccatcacgtctggctaatttttgttgttgttgtattttttgtagagacagggtttcaccatgttgcccaggctgctctcaaactcctgagctcaagcaatccacccactaaggcctcccaaagtgctaggattacaggcgtgagctactgtgctggcctcatagattctttttgagtcttttttggatattttactctgcctttttttttccctgatagattgcccagaatgcacgctacaggaaaacccattcttctcccagccgggtgccccaatacttcagtgcatgggctgctgcttctctagagcatatcccactccactaaggtccaagaagacgatgttggtccaaaagaacgtcacctcagagtccacttgctgtgtagctaaatcatataacagggtaagaacctcaagatccccagaagctttctaacagcccaatcagagaaatgttcatagagcccacccatggaatttaatgccaaaggtgtctaatgacccagcatctgtcgagcatttgtacaggtggggaatacatttctacccattaattaaaagagtcaattgtcttgtgggtatagactggatttattcagaatgaggagaataggggtagaggtgacaaggggcaggttgggagaaagtacagcttacttgtgctaaaaatatttcctaaaaaggagactgtgcaaatgtagtatgcatctacttatttcagcagaatgcaaacaattttatgtaatattcttcaattttgtctctatctatctatctatcatctaatctataatatgtttttttttccttcccctttaggtcacagtaatggggggtttcaaagtggagaaccacacggcgtgccactgcagtacttgttattatcacaaatcttaaatgttttaccaagtgctgtcttgatgactgctgattttctggaatggaaaattaagttgtttagtgtttatggctttgtgagataaaactctccttttccttaccataccactttgacacgcttcaaggatatactgcagctttactgccttcctccttatcccacagtacaatcagcagtctagttcttttcatttggaatgaatacagcatttagcttgttccactgcaaataaagccttttaaatcatcattcaatcactgaattatcatttttcttcaaagtaaagccagttgctttggacagcattaatggaagagagtgggccattgggtgagttggggccaaatgtgtttggtgacctgacattggagagccttgctgttaccacacctagcagcgtgtgagtcctttcagccagtgggctacttataagacatttattagggcaagagaagaaaatataagaacttctatttatattaatttttatataactttttaagtttccattttgatggattttataaaagcacagatacattagtatggtaatacatgtatacaatttataaatcaataattatccatatattgggaacatttgatcagaaactttttactgttagaaggggacaataaaaaacaaacaaacaaaagaaaaagaaaagggagaacacttctctaggatttgggaaagacaaaattattcccagactgaagtttctatttacttgctttatgcctggctgaaaaacgctcatcttattagtccctggcagccaggctataattgaatagaggccaaggaaagggcatcattgcaccaattgaaactgggcattactctgaaataccagaggcatcagattttgttcttcacattcagatccggctcagaactatggtctaggtcagatgcctggcatattcactttgttttttaaaatgtttaagatggccgggcatggtggctcacacctgtaatcccagcactttgggaggccaaggcgggcagatcacttgaggtcaagagttcgagaccagcctggccaacatggtgaaaccccatctctactaaaaatacaaaaattgccaggcatggtggtgggcgcctgtaatcccaagctactcaggaggctgaggcaggagaatcacttgaacctgggaggtggaggttgcagtgagctgagatcgtgctactgcactccagcctgggcgatagagagcgagactcagtctcaaaaaaacaaacaaatgaaaaatgcctaagagtagtgccatgcttcaacaccacatctgttgagcatttatactgagaggtggtccttaccttgaggacaatggtattataaatattaaattatattagccatggtggagatcatagctactcaaaaaagttctactcctaatggagcctgtaatttaaaaaagataatcacactggtaaccggtaaggttttcagaaagaaattttgatcatcacccatttgtcgaaattttatttctgagtggcaacccagttctttgttccttagcaggctggtaaacatatcaggtgttagggtagtaagttaaaataggaagtgcatgtacttttttttttttttttttttgagacagagtcttgctctgttgcacaggctggagtgcagtggtgagatcttggctcactgcaacctctgcctcccaggttcaagtgattctcctgtctcagcctctcaaatacctgggattacaggcacatgccactgtgcccggctaatttttgtattttcagtagagacggggtttcaccatgttggccaggctggtatcgaactcctgacctcaaatgatccgcccgcctcagcctcccaaagtgctgggattacagttgtgagccacggaggctggcttttttttttttttttttttagtagagatgggagttttgccctgttggccaggctggtctcaaactcctggcctcaagtgatcccccatctcagcctcccaaagtgctgggattataggcttgagccaccatgccctgtttgtgcatatacattttaagaaacatgaaaggacacatgaagatattagtgcatttctttatttacttattatacttttattgaatgtatagtaaatgttgatattttgttagatcgctgggatttagacatcaggaatctctgaaagataagactaagaaaatataatactgcttaatcagagaaacaattgtggtgatcattggttcatta

SEQ ID NO: 15877 - DNA, 9443 bp, Human
ggggcataatgatttaggtttggagattatttaggtttggatactgaacctgcatccctactgctcttttgaattctggtcacttaggagaactgagtcccatcaaggatttagggtttggctgatattttgagctccttcaccctgtcttggcacagccctttacagtccctgcttgattctcctctctccattgtttttgtggcaattacacaaacatgaaacaggggtgggagcagagaaagagagcccaggattaggagccagaaattgtagcttctggtgaggaactggcttctaaaccttgaattttactctctggacagcccctgacttgtggcaatgccaatctgtgcctcagttttctctttggaaaacctctgccttctttcccgactttttggaaagatgagaatttgaaggggtctgtgcctctacctacctagaaacaagtgagtaaaagccaatttagctactgaacttaataagtagactctggattccaaactctttgtaattctttgtttcactggtgctagtctcttttctccagttgctctgtaatgtgttggagagcaaagactttacccttttctgtttactgccttcatcctgaacaaccagcaatgtgctcatgcttaatatcttattcagcatacaactgcagatgaattaactaagcccagatggcacgcttattataagaaagttctgtgcataagctgttccttggggtgatctccagcactaccagggttccaggcatgaaaggaggcatcttcaactcccattgattactaatgaaagtagaagaggtatggtggcctgtgggacctgtgtcccttgctgctcagagactcgcttgggctcatgacggtttctatgttgctcagcggacagtcttctcctgcttctcattcccttcaatatgcctttgataaatgttagttgaatgaatgagtgtctgataccagaaacatcgtctctgaaattgaagcttcactgtgagatctagaactcttcagagaatgaacagaatgaacaatctcagcaggttagagatgctaagagatgcgtctcctaggagaagccggctcttcaggcgtgttcatctctatgcccagtgtgtaggaccagagcctcaatgcctggtgggttagagctgagtcccagtttccctagagcttcctggagagtataaaaaaacaggagcaagcctttctgaagtgcagcatttgggtggcagtttggagagcccaaccgaggactgcctaatagtgaaggtggacccctgaacttgaggaccccagaatctctggctcgggtgtgtcttccagggctgagaaggcttaggagcagctggagacaacagctgtccatttggaaaggggaaagcttgagcatttgaaagcattatccctttctacctccccaaacttttctaatgaatgtgtaggaaaggagaaccctctcaatcctcccagccccttatcaggacttcaagaaagatccagtcctcagccaacctgcagtgttttagtttttatcacacaaaggtttaaataaaaggaattagaattttctgattttagccaacccactggcaaattttaggaacctgaccctctatcacaaaacactacctcccaggaccatttcaagcaaaagacctcacccaaataaccccccattattgcagagccagcccccaagctggaaaaggagctcctagaaggaacttcccttcccagccttcccagctggagtctcatccttctgaggagggtcagcctggagcatgcatcaggacggtgaggagcctgggggaagtgggaagacagggaggacaacagagacaggggaagacctcagggctttgcttccatcaactgtttcatctgctattggccaatgttctggggaagctttttccagtccctcccttcctgccctgtcctgcttcccttagatcaggagagttggcgcgtatgggcaaggaacaaagactcacccgtgagccagctctcaaagaaagcagcttgcgttgacagcctgggggcagcaaggatgcagtctcccaggagaggatgcactcggtggtgggaagccaggctggaggggcctgagtgaccctctccacaggcgggcagggcagtgggagaggtggtgtgtggatacctctgtctcacgcccagggatcagcagcatgaaccagcttggggggctctttgtgaatggccggcccctgcctctggatacccggcagcagattgtgcggctagcagtcagtggaatgcggccctgtgacatctcacggatccttaaggtaatgggccagcacctttacccagtgatggggacaggaagcagggagaaagggctcctctgaaggcaagagcctggggctgttgcaggctctgagggcttctgggacttgggtcacttcctgggagatcctctcggaggttgaaaaggggagcctcaggccctcaaagctgaggctggactcccgacttcatggcctggtccagtaagtcttggctttgtcttatagcctcctcctgtcccagggacactctccttccttctgcccatcatgcctcacctgtccctgcttctcacctgactcaggtatctaatggctgtgtgagcaagatcctagggcgttactaccgcacaggtgtcttggagccaaagggcattgggggaagcaagccacggctggctacaccccctgtggtggctcgaattgcccagctgaagggtgagtgtccagccctctttgcctgggaaatccaacgccagctttgtgctgaagggctttgcacccaggacaagactcccagtgtaagtacccttccctccccacactggggctggaaaagaggctttctgggggagacaaagaacctttcttatttggcaatgtgggcatcccaagctggtgacagggctcctgggcaattctgacccataagtttttcttttgaaaagtggtggtaataagaggattgggaaggagaaagcatagagagagagagaggaggctgcccttgggaacaatgtgtaggtggagacagatgggaaaaaggatattaagggcaacatcctcagggtatagccctgagtctgagcaccatctctccactcaacaccctgacactcccaggtctcctccatcaaccgagtcctgcgggcattacaggaggaccagggactaccgtgcacacggctcaggtcaccaggtgggtcttggagttgtccccagggctaatcacagccaaatctctagcattttatagttctcaaagccctttctcgttctttcttggatcaccctcacaacaacccaataaggaggactgggcagggagtctcattctctcccagcagaagaaaattgaggtccagaaaagtgaagtgacttacccaaggtcaccacctagttgatggcaggccctggaacagaacacaggtcccctagcccctgggttcacaggatctattgaagaagaggcaggactgcatctcataccctccctctgccccatgcatagcttcttagagcatcattcatgttctttgggataacacacccctggaccaagcctactgcttgtccctccaaactcttgcacattaagcatgcaccccaccatggtattgagcaccctttccaccaagtgaccctgcagtgacctctaataactatgaatgccccaccagcttggctctgctcttctacccatggtgtctcccggctgcagccccagagactcagggaccccatctgaccagaggaatcaccatcacaaaccaccacaaactgttatcttccttttcagctgttttggctccagctgtcctcactccccatagtggctctgagactccccggggtacccacccagggaccggccaccggaatcggactatcttctccccaagccaagcagaggcactggagaaaggtgctgggctgggacagatggagggtcagagagtcctcagtgtgacacagggacagtggccctgaggcctgtgggcaaaggctgagaggtgcaggctgtgagtggccctgccttgaggaggaaggtagtttggggttgtagcaggtggggagtgttgcctaaggggagacccatgccttgctcctctcccggtgcccttactttgtgagactcgatctccgcagagttccagcgtgggcagtatcctgattcagtggcccgtggaaagctggctactgccacctctctgcctgaggacacggtgagggtgagtgagctctgcaacactgtacaaaccacaaggaggaagagtctgggccggccagggctttgggttccaatgaggtggagaggggaggtgagaaattggaagcaaatttgtttggagcaacaatcagagatgagatcctccttgttcaccttctgctgactgctctcctctcttccccaacccaaacctttgagttgaggaaggggccagagagcaaaagctagagcagggagggaggatgtcaggcccaaggaagggtcaacattctgagttcaggctaggaacatgtggtgagatcagcaggtgacaggcagcataaagtacagccagctgcattgtccctgtcctcgctcaggtctggttttccaacagaagagccaaatggcgtcggcaagagaagctcaagtgggaaatgcagctgccaggtgatttctctgcaccatcatccatctgcccgctcagtcatctatccatccatccatccatccatccatccatccatccatccatcctccattcgtccatccatttatccatccacccatgtatccatccatccattcatccattcatctatccatccatccattcatccatgcatcatccacccaccacacccacccatccacccagctacccatttatccacccatctatccatgcatcaatccatccatcctccattcatccatccatttatccatccacccatgtatccatccatccattcatccattcatctatccatccatccattcatccatgcatcatccacccaccacacccacccatccacccagctacccatttatccacccatctatccatgcatccatctctccatccatccatttatccatccacccatctatccatccatccagccagccagtcacccacccatctgctcacccacctatctacctatccatttatccatccatccatccatccatccatccatccatccatccatccacccattcattcatgcatccatccatgcatctgctcatgcattcatccatccatccacccatgcatccgcccatgcatccatccagccacccatgcacccatgcatccatccatccatccatctttccattaatctgtgcatccatccacccatccatccaatatttactcagcatctccccagtgccagaccctgtgctagatgctgggcacacacagtcccggatcttaaggctgcactgtccccagtaccatcactggaatttaatcattcttctccagtttcccaaggacctgtcttggggaagaggacagttttgggttaaaatatccatctcttcacacccctgcaagaagtggctgactttcctagaacctctttgtatccaaccttcctgcctctcaccacactcctcccgtccctaaccccaattcctccttctgagtggattcactctcattttataggtgcttcccaggggctgactgtaccaagggttgccccaggaatcatctctgcacaggtactcgggaggagaggggagtctgtgccctgggaagactgaagggctcatgggctcttccatttctggcctgagccaggatctccggctctccagggccccacagtgttcatgtcaagaaagtactaacccaaagtctactatgtgaatggtgccctctggagttgtgcaggatactacttgggtggcaggcagctctggggtcccggcgttctctacaggaggcatcactggaagctaaggttcttctcttgctttttttttttagcagtcccctggcagtgtgcccacagcagccctgcctgccctggaaccactgggtccctcctgctatcagctgtgctgggcaacagcaccagaaaggtgtctgagtgacaccccacctaaagcctgtctcaagccctgctggggtaagaattcaggccaggcctcagtcctgcaggatgtagggagggtcgactgactcaacctccaggagggcatggatctccattgggggtcatcaaaggaatctcaatacagctttcctcattctttgcatggtccacaaaattacggagactagtaacccctgagtctatggtatcactgacagccatagcaggtaaaggatgtgagactgggattcaagtgtgtatatgcagggtgggaaactgatgtctcagcctctctcccatagtgactttgagaggtggggtgggagcaataaccccaagctctctctatttgtccccacaggccacttgcccccacagccgaattccctggactcaggactgctttgccttccttgcccttcctcccactgtcccctggccagtcttagtggctctcaggccctgctctggcctggctgcccactactgtatggcttggaatgaggcaggagtgggaaggagatggcatagagaagatctaataccatcctgcccattgtccttaccgtcctgcccatacagactgtggctccttcctccttcctgtgattgctccctcctgtgtggacgttgcctggccctgcctcgatgcctctctggcgcatcacctgattggaggggctggtaaagcaacacccacccacttctcacactggccttaagaggcctccactcagcagtaataaaagctgtttttattagcagtagttctgttgtccatcatgttttccctatgagcacccctatgcccactctaatattcaacaattatagacaatttgccctatcatttatttacatctatgtatctaccatctaatctatgcatgtatgtaggcaatacatgtatctaaacaatgtatttgtcaatgcatcaatttacctactctatgtatgcatctatatgtgtattatgtatgtatgcgtgcatgcgtgcgcgcacacacacacacacacacacacacactgatattatatcatggcattttattcctaaatcttccagcatgcatccccaaaaaacaagaaacttgtcttacataatcacaataatatatccacatctaagaaaatttactgtaacttcttaatctaagaaaattatgtatttttgtcatatgtattttgtcatatgtattttgtatttgcatatgtattttgtatttgcatatgtatttttgtcatagcagcaaacagagtgaaatgccatttttcatattctgctttccatttatatgtgctttatttatacatgctccaggggcatgtttgcttggtccttttggcagtaagttccaaaccttctcaattctgtcccttcaaataaaggtctaggcccttcctgagaagtctcaggatgtggagaaagggaggaatatgggggaaaggcggtgaagaatcggatattcagcaaggaggataggctcatccttccaaattctttcccttttgaaagtcaggcgatggataatgatggtgcaatgctggtcggcgggcggggaggtgggggcattgtttactcctatctgggataggtactgatccagaagacgtcattcaagaggcctcttcattatcaaatactgtgctgtgctgaactgtgctgttaaataagtagccaccaaccacatgtgactatttaaatgtaattcacattaaaaaaaaaagaagaatgcagttcttcactcacattagccacatttcaaatgctcagtagttacatgtggcttgtaaggactatcgagcatttcagtcattgcagaaagttctatgggactgcacagctctagaatgaaatttcaagggtaatagagcacatcttgcccctgccttgccttctatactttcaagctggaggtcctgctaggcagaacagaaaggagctgtctcagctgaggcctcatggttgtggtggtagtggcaacccatcttgagctgctgctgtgaagatgctggctgcagatggggaggcatggctggggttgtgtgctctgcaaggacagcgggaacccggaacaggcaggagccacgcccccaacagagttggcagggtgggagcgcggtgctcctggacacagctgcagctgcctagctgtggctccagacccaggcatccctgcactctcaggggcacaggaagcccctgccccacaggcttagaagtgcctgctcccactccctggcttctccttgcccccagagtccactcggttgtggaataaagttgtggctgcacctgggcactgtcatgacctggctgggtgtgtgcatgctctgggtggcactgacacaccagcccccctaccaccttggccccctccagactttgggtgccaacaagtgcaggagaaaggccagagggaggggactgagggcatcttagtgtgggcctgcaggcacccctcagcacaaacagcctgggtgtcatggatagcatgttgatagtgggaggcagacaggttcctgggcagaaaggggcaattctgcagagaaaccccacctttaagccaagaatggcctgaagcctgggggccaggctgccagttctgggtgaagtaggaggcccagagtgaggacttcattgttgaccctttggccaatcggatggtgctttttccagacctacccatggccacttatggaccagttagcacacactcctcccttctgagcccataaaaaccccaggactcagccagagtcacacagacattgggactaccagctaagggaaggagctacccacctcaggtgtcctcgactagttgaaatgacctgccggcagaaaggacctacctacttccggtcttctgagagctgttctgttgctcaatgaagctcctctctgccttgctcaccctgcagttgtccacatacctcattcttcctggacatgggacaaaaactccagatccaccaaatggtgggactgaaagagctgtaacaccaacagaactgaaacactcgcacacacacactcaccatgttgtgggtgatgagaaagagagaagagctgtggccgttcagggaccccagacataggggttccccgagccagggctgtgataccctctttggggccctgtggttcctggcatctccaaatttccaggcaccacttcattccccagcacctgcagtggaagcttcttgcggtcctgctgaagccttgcacagagccggcatctgtaccagcacctggagctgcctgccccccacagcc

SEQ ID NO: 15878 - DNA, 23803 bp, Human
cttcctgatcttccttccttccctccctccctctctcctccctccctccctcttccttcctccctcccttttttccctccctccttcttctttcctccctccttccctccctccttccttttttccttccctccctccctccctccccttcccttcctttctcctccctccctcccttccttctttcctttactccttccctccctccctccctcccttccctccctccctcccctccctccctcccctccctctcttcccttccctcccttccttcccttccttctccctccctcccttcctccctccttcctcccttcccttccctttcctcctccctctctccctcccttcccttcccttccttttccctccctccctcccttcctccctccgttccctcccaccccacccactctctagaacgcatatcagggagaagggtggctgaaaagggacccagaatggcccacacagtctcagcacccaccccactccccatcacaagcagctgtgtcctggtgcctcccattccaatggccacaggggcagctgggaaaggaactgtctagggtcaaggtcaggccaaggggagacgtggccaccacagttctggctcccagcatctctggattttctttagaaaagcccatgacacccactggattagcagaaactccgcgaggggtgaggctgatctacttgacaaggagagactgacctgggtgctggaaggggccatgggcagccctctgtgggtgacccccattcagacaggctgccgggattcccagccccagggcctggctccctgcccagagcacttccagctcatggctcgccagcaagaagactccttatcagccttaagggtggggcggctccgacgacagggccgtgggggctcgccagggaggcccctgcttccagcttgaacctccagtaccaccccgggtgagcttgggcaactcatttctcttctctgagcttggtttcctcatcttcaaaacgaggggtggggctggggaggcctccagctctgaggagccaacgtgggaccctctgcccaccccaaacccctgtgttcagggcccgagctgggggtgggaagggaaggcagggactgcagaggtgctgtgccccagactcaatggtggcctccagttctctgtcccgtgttgctgagacccatcccctgtgagcctcgacctagaaggaacagcccttattaccccaatttacagatgaggaagcaggctcggagaggcaaggtgacacccagcccccacagccaagaagtggcagagccagggatctccgaggtcaggctctctcggctggtcttgggccccccatggcaccggtgacggatgtggtgctggtcttggctgggcacctgccacctctctccctctgatggtggccccggcaggacagacagtgggagaggagaggtgggggatagagatgccagctcagcaccgaggttgaccgggcacaggccaggctggaactcagagcctccttcctctctgccttgctcgctgcagacccccagggacgaagcagccaaccctggtgggggagggtggagggtggtggatggggctggggatggaggtctcattttggcagtggaggggagtcgcggggagtcccctaatctgaggagactccagcttcccccaggccccggccagagctccatcttgccaggttttggggggaggataacttgaggagtcgactgagagctttatctttgcccctgtgacgggtggcctgtggtttcctgccaacaactcctgtttccggaggcccaacaaggcccacgcagagccaggaggggcagtggggctgggcctgggtggccccaccagccccgccccatctatctttgggaatttatttgtccatgggcgaggctggcctgcagtctgttgccttccaggggccaagagctgctctgatcacccagggattctctctccaacccaagtgcctccagctgacctctggctcctgtcctctggctccacctgcaccgccctgctcttcctaaggggccaggaagcccccagaagctctaccatcgacgtgggtggtggcacccggctcaccctgagagcagaggccgtgcagggggctcagttctgagccccagccggcccaccatggcacggcggttccaggaggagctggccgccttcctcttcgagtatgacaccccccgcatggtgctggtgcgtaataagaaggtgggcgttatcttccgactgatccagctggtggtcctggtctacgtcatcgggtgagtccgggcgcctcccgctgcctgcaccagcccctaccccgggcctgtcctccagactctgacatcccttgcgtgacaccagcgagcccctcttcctctccatccaggggaaggccttcctggcaagccactgtgcgagaatagaaaatcctgccaactcgctgttgagatggggacgaggccggaggggaagccctgcccgggggccttcggtgaacaggaggcagagtctctgggttctgaggagccggctcagtgttatggttcctttgagtggttagtggtgttcagggccagggcaccaccaaccacagccactgagtcctcgacctctgaccgcctgccaaaccaggccgccactgacacacagaggccatgccccacacccgtcaccccatatgacaagttagagagagacagactctgctgccagcttccctgcctgagcaagggacatccagggacgtttgaggcccccggagcagagaaactctcacattctgaatacctggtgccttcatgttggcatgtcaggcggaggacagagatcggttctggtcccagggatgatagttcctttctgggcatctctggacctgtcccaccgggctgggagtgcagaatcagaggcagcgtgggacgctcctgcagtatggttgtctcgggagccaagacaggcctggcagaggctggcacacttgtgagtgtgcatatggagctctgtgcctatatgtgtctgggtgtgtgtccctggtgctgggtgcccacatgtgggtacccttatgtgtacatatggctgtgcccatgtctgccctgtggccaagtgtctgggtggccagtgtgtgtcccctgtgtgtggtgcatcttgtccactcacagtgactctgcagaggtctcctggaggccccagggccactggagggggctcagcccctgttggggtcctaggggtgcccagtagcccctgcctgcctttgccgtgtgattctgagagctctaccctccccatttttaccatggttccgaaccagaactgctaaatggagtccagggcaggctgacccagggcccaaacaaggaccacgaagtcctagtcccccggaaacttctggcgtccaaaagagccctccttctgtcccaccagtccccagaacctcagagccggccaggtggacccagggccagaccccagccttgacctctcctctctcttgttcagaaactaatttgacatctgtgatgtctgagcttgtgagggaaactgaggcccagagaggggcagtggggtttccaggtccacagcaagtcagcagcaaacccagggttgcagctgagccctcctgacccccaggcctctgctgtgccttctccttcctcaccatcacaaggggctgtggatcctttctactgggcactgatggtgggatgccaggtacaggacgggccggaagtccacccttagtatcactcctgaccgtccctgggagaggctgtctgcgcaggcccagcctacccttgctggaagaggctgggggaaggctgtcctctctctgcccctgcggctccctagttctgctttcagatctgcaggtgtgaggggcaccaggtccctcctctgtgtgtgtcacaggctgtcagcgttggagggacccacccattcccagccgtagcctatgccccaagctgctgcccagccgggaacctatacctccagtgacggggacctcactaccgtcctcctgcctgtcttccctcccaagactgtctaatcagtttccaaatggatgtggcccttctcggtgtctgtggggctcaggaccacagggattagccaggatctcacagcttagtaagagactaaccaggatttgaacccacctgcatggctccaaagtcagccttgatattctggaaaggcaacctcctcagagagagggcactggcctgcccacgtcacacagcagagggtggaaggaaggcagagtccgtcatcaccagcaacccccagggctgcaggcccaggcttccagctcctgctcaggctgtggtgcctgctgtctcttgcgccctcgtctggccactgctcagtactgcactgacctctcagccaggaacccacagcggcaaaccgaacccctgacccagcctggacttggtcttggcatctccggactcagcttcctaaccggcccgtggggcacgggttgcaggggaccaccccccgccaagagtgcactcagctcagcactttgctgtttcctgaggagggctttgctttcatgtctgatcctgtgggcactgccaggggatggaaaggagcatgagagaagagccaggcccccgtgtcccagacacagggcaaagcctgggtgggggatgggtggacacagagacagacctggacagagggacaaacgccggagcacaattcagacgaagggtgggaggtcccgagactcagagttactgaggctgagcagggaggctgagaagccaagaacacagactcaggaggaaaaccgaggccatggtctccgccagtcatgctcctccaggagatcctgggcaagtgcaggcagtgagtgggcctgagaccagaaggctgagctgagctgaccctctcagatccagttaagatggtctcagttaaggctgggcacagtggctcatgcctgtcatcccaacactttgggaggctgaggtgggaggatcacctgaggtcaggagtttgagatcagcctggccaacatggtgaaaccccgtctctactaaaaatagaaaaaattagctgggtgtggtggtgcacgcctgtaatcccagctacttgggaggctgaggcagcagaatcacttgaaccctggaggcagagtggagctgagattgccccattgcactccagcctgagtgacagagtgagactccatctcaaaaaaaaaaaaaaaaagatggtctcagttagagctctccccgaagagctgatgagctctctgtccctggtggtgtacaggcagtggggaggaagccagggaggccttcctggaggaggtgacacactgatggaaccagccataagcaaagacctgggggctgtgggctgggctggcctgctctcagctttctctccagtccctctgggtctcttctcaactaagtcctcactcatcccctgcgcctccacacagacctcttgaaatcacatgttctgagatctccaagtggagatcagagtgcaccaatcagggagaaggatggatagaaattattggggggagaaacacatccagggaccgtttctgcagcatcttctccatgcctggtgctgtgccggggaacagaggtgggacatggaatggagagagggagagggaggaactgagggtgaattagccagactcctttggttcctgtgagaaaagtctaatcaaacagatttaaaaggaagggtgggccgggtgcgttggctcacgcctgtaatcccagcactctgggaggctaaggcgggtggatcacttgaggtcaggagtttgagaccagcctagccaacatggtgaaaacccatctctactaaaaatacaaaaattagctgggtgtggtggcgcacgcctgtaatcccagctactcgggaggctgaagcaggagaatcgattgaacttggggggcggagatggcagtgagccgagatcgcaccactgcactccagcctgggcaacagggtgagactccgtctcaaaaaaaaaaataaaaaaacaaacaaataaatgaatatataaataaaaggaaaggtgggggtatccggtggtttatgtaactgaaaaatcagtgtgggtttcaggcccggctggatcctccaggatgaagacacaggaggagtaaggtttagaggggagaggggatgaggaattcctgcgggtccagtcttggttctcaaaagaagctgcccatgacctatctccctttcctggctcttctttcctctgtggaggcttcattctcaggcaagttctctgtcttcacagtggtgaaacggccaccagcagctccaagctaacatctcaccagtttagccactcccgaggcacaagagtggctccttctccagagctccagcaaaagtctcaggttcaattcttattggccggggtcgggtcccgtgcccaccccagaaccaatcaatcattgcagtcaaggaaacggaatgccctgattggaggagcctggttgcgtgcccacccttccaggctctcctgtcgggacacagtgtgaaccaaggtcttggggccggagaggaatagagaaggtgtcactgggactaggctgaaggggccataaaaggagcccaggggagaggctgtgaaagggagagcaggggcgatggcgaaggcctttgaacaccaggctgaggcgcccggatttcttctgcaggcagaagggagccaagacaggatgtctagcaggggagggcctggagcaggcaggggtgggcgtggggaccggaggcaggacagctgtgaagaggccgcagggatgggaaggggggacggggcgggacccaaggcagaggcagtgagcacgggtgacagatgtcgtcaccccggcaggcctcacgcctggggcggcccctgctcagcttctgcccattgttgccgcagcacgtaacacctggcacagccagagcttccgacgtctcaagagaagtgggaagtgagatttatgcatgaaagaaaccgcttggtttttagagattggtgacgtattcaaaaaaaaagaaagaaagaaagaaagaaaaacagaccgggtgccatggtgcacgcctgtaaacccagcactttgggaggccaaagtgagcggatcacttcagctcaggggtccaagaccagcctggccaacacagtgaggccctgtatctaaaaaaaaaaaaaaaaattacccaggtgtggtggcgcgtgcctgtagtcagtcccagctactcaggaggctgaggtgggaggatcacctgagcctggaaagttgaggctgcagtgagccacgactgcaccagtgcactccagcctggaggacagagtgacaccctgtctcaaaaataaataaagaacaataaaaataaaataattaaaaacacaaatggttggcctgagattcaattccacattcagttagtcattcaacacacagtgtttgttgagttcctattatgtgccaagcactattctagacactaaaaatacagaagtgaacaaaacaaaccaagatcctgcactcaaggaacttaacccagatgcccctcgacttgtctgcgggttgcatgggggcctcagggtgggccccagttctgagcacattccctcccaggcctggagtctgctcatgcccctccccaaggctgctgctccctgacagcacacgccccatctggtcaactcctgcctgtggcccatggccataccctgtgtcccaccagccacctggccggtcctcccaacccatgccagagctgcccccgcacctgtcccagctcctccagtgtctcagccttcccaaaaccagcccttctgggtccttagatgaaagccgagggaggaccagaaggactgggggatccaatgaatgtgggggcatgatggggagggtggctgtgaggatgctgcctgggtgttgagcctgggtgatagggtgaggacagcaccattctccatgacgaggacacaggggaacaagttctaaagggagatgaagagttcaggttgatccaattgaatttctgtctgtatagtggttagtgcttggcacgaaatagatttcgtaggccgggcacagtggctcatgcctgtaatcccagcactttgggaggcagaggtgggtggatcacctgaggtcaggagttcaagaccagcctggccaacatggtgaagccccgtctatactaaaaatacaaaaattagccaggcgtgttggtgtgcgcctgtaatcccagctcctcaggaggctgaggcaggaaaatcgcttgaatccgggaggcagaggttgcagtgagcctagatcgcctcattgcactccagtctgggggacagagcgagactccgtctcaaaaaaaaaaaaaaaaaaaaaagaatttatcaggacatcaccacattgtaaattgaggagcatctggacttagcgtggtttgacttaggattttttgactttatggtgggtttattgggggtattaagagccttttgactcaggatgggtttatcaggttatagccccatcgtcatttgaggagcatctgtgtaagacccttgggtgcgagatttttgtttgttttgttcacttttgtgtttgttttgttcaacagtgtttggcgcatgaataggggctggataaatacgtgtttgtttttgttttttagtagagacagcgtgttactatgttgcccaggctggtctctaactcctggcctcaggtgatcctcccctctcagcctcccaaagtgctagaattgcaggcctgagccaccacacccggctcatgtttgttgaatgattgaatgtgtggaattgaatctcaggggagagtgcagtctggagatagaattctggggacacagcgtgtctgaggcagctcactcagggaatgggggcggatcaacattgaaagaggaatttgtgaaggaggaacggagaacagtgaaaatgggaggttttcattatatgtgcccactgagtgccaggcactgtgctaatttccttaagaactcatagaggccgggcgcggtggctcccgcctgtaatcccagcaccttgggaggccgaggcgggcggatcacgaggtcaggagttccagaccagcctgaccaacatggcgaaaccctctctctactaaaaataaaaaaaattagccgggcgtggtggggcgcgcccgtagtcccagctactcgggaggttgaggtgggagaattgcttgaacccgggaggtggaggttgcagtgagccaagatcgtgccaccgcactccagcctgggcaacagactgagactccatctcaaaaaaaaaagaactcatagaagcttcccccaaacacttacctagatgcttctgtctcctggggcccaggctgagtttgtagcagagcctcactaaacacttaatgaataagcagcgcctttgaggtaggtggcgtcacctctgttttattgagaaaaccagggctcagagaggtgtagtctctagcctgaagccacacagctggggagcagcagggctggcacctgaccctcagccactccaccctgtggcctcttccttgagaaggccattggagagccccaggatgggggattgctgatgacgaggtagaaagcatggtgagggttatttctggaaggggagaggcttctgaagatgcctgtgtctgacatcaggccctcttggttgtcttcccagggtggtgacaataaggccagatcaaggcatggctttggaggagcaggcctggcaccatagtcattctattattattttttgtttttttgagacggagtctcactcttgtcgcctaggctggggtgcagagtgcaatcttggctcactgcaacctccgcctctgaggttcaagtgagtctctgcctcagcctcccaagtagcgggattacaggtgcccgccaccaccatgcccggctagtttttgtatttttagtagagttggggtttcaccatgttggccaagctggtcttgaactcctgacctcaggtgatccacctgccttggcctcccaaagtgctgagattacaggcatgagccaccgcgcccagcccatagtcattctattatcaccagagttgaggtcatgaatgccagatctgaccgacctttcccttcgacctcaagaccggcagctccaaggtgcatcagccccggcttgtgggctccaggtggctctgtttcccctctgtgctctgcctcctgggagacacgtcgaagccagtgttgctcagtggaggtgggctgagtcctgggctgggtgcctcaagcatggggacacttgagaccgccactcctgcaggcctcagcttccctgtctcttgggaaaaggtagaaagttcgttttgggcaaagatagaaacgttgctaagctgttggggctgaaggtgccgagagggaggtcagtggcctgtcctgcagaggggcccaggacaaggagaaactcctcctcccccctgcatcagctccttctggcttggacacagaaccagaggccctcctggaggaaggggcccaaggaggccagtggggggatgggcaatgctcttgctctccctgatggggctggaggcagcgtgacagactcaggacactgaggatcagaggcctttgtcatgcctccacctgttgctatctgggacctgcaggggacagcagtgaccaagcttaggcttcgggagcatgtgacttggccccagtgccaaggtgagagggggcttagagaagaggtgggtgggccatgagaagaaagaagaggacattggtgggtggcctccctggggcctgcagcagggagagaggtgactctgggactaagaggcctggagagttctgttaccagatctgagccctgggggaaggagcagggagtccattgctttgagctccccttggacaggtgagctcggggtagggtaaggagtggagggggatgatacatctggccacaggtgcactcacagatttgccctgcaggtatacagccacacaccccataccccaacacacacacacacacacacacacacacacacacacacacgttaccctgaatctccaaaaagagtctttcctcgaggaaggggccacagcctggagaggagtgttatccaggactatttcatttgcaagcaacagaaaccaaatccgaactggcttaaacaaaggaaggacatttattggtttacgtaactgaaaagtccagaagtagatttttcaactgtgcttcaggtatggctgaatccaggtgctcaaacaacattgtcaggattctgcccctctctatctcctggcctggctttcctctaggagagcttcattgtcaggattgctctctccagaaggtggcaaagatgactaccatagttttcgtcttgcagccaccctgcttagccactcaatagacaggatgtttctttcctggcaattcccagaaaagtcctggcctcattgctgaaactcctcaggtcatgtgcgtgtccttagacccgtcactgttactagggggatggaacattgattggcaagccttggttatctgcccaactcctggggctaagagggaggttagcctcatggaaccttccagactgaaagtggagaatccaaaggaacgggacagctcaatgctgggaaggcaaggccagaatttcccaagaaaactggaagacctcccgactgagccactcccacagtgcctcgaccgaggggctggacgctgcaagccctccagaggaccacctccctgctctgttttcctcgctgtctcccagggggtcccagcatggctggatcataataacaactaatgtctatactgcatttattctgtgccatccccattctgagtgtttctacatgtatgaactcactcacttgatcactacaagaagtaccattgttggccgggtgcggtggctcatgcctataatcccagcactttgggaggccgaggcgggcggatcactaggtcaagagatcgagaacatcctggccaacacggtgaaaccccatctctactaaaaatacaaaaaattagctgggcgtggtggtgcatgcctgtaatcccagctactcaggaggctgagacaggagaatcgcttgaacccgggtgtaggaggttgcagtgagccgagatggcgccgctgtactccagtctgggtgacaaagcgagactccgtctcaaaaaaaaaagaagtaccgttattattcctattttatagatgaggaaactgaggcacaggggattgaatagcttaccccaaatcccacagtaagtatggagctgggatttagacccaggctgttaggcattgaagaccatattctcagccttcgtgctctgttgggacctctggaaggaggagcaccctggaaggaggaggcttggcctccaggccccagcaaactctgttcttggaaaaggattggaaagagtatttgaattagcagtttctttctttcctttttttttttttttttttttgagacagaattttgctcttgtcgcccaggctggagtgcaatagcgcgatctcggctcactgcaacctccggctcctgggttcaagagattctcctgcctcagcctcccaggtagctgggattacaggcacccaccaccatgccaagctaatttttgtatttttagtagagacagatttcatcatgttggccaagctggtctcaaattcctgacctcaggtgatccacccgcctcggcctcccaaaatgctgggatggcacgcccgtcctgaattagcattttcatagtgaaaagcaccgtggaacttcaggcccaggccagcagcgggaggcaggggaggctgtcctgcctctagcccaagacaggagctttaggagcagatggtggctcagaggcacatctggggagggcgtgggaaagcgtgtgacaggtccagctggtgccacaaccacaactccccctctgtccccacccgcacaggtgggtgtttctctatgagaagggctaccagacctcgagcggcctcatcagcagtgtctctgtgaaactcaagggcctggccgtgacccagctccctggcctcggcccccaggtctgggatgtggctgactacgtcttcccagcccaggtgagctggctcaggtttgcaccttcccctcacagggcctgtctcagagttgggtgggactctgtcccacgtccctgtgggaccagcccagctcctctttctctctggacctctgtgaatgccgggcagaagcagcctggtgatatcaccccatgttggtggcagggggtgtggtggctgctgcgtgtcctgtgggctctaggggcctctgctggggcagcggtggggcccttggggctcttctcccagctcccagcccaccccaccctccccctgcccctcacttctagggggacaactccttcgtggtcatgaccaatttcatcgtgaccccgaagcagactcaaggctactgcgcagaggtgaggacttctgcccgccagcccccttctgggactcacaggggaaaatgacgtgcagagaaagtctccaggggcactggaggggaagccagagaggcttcctgcaggggccatagtgatggaaatttgggcgcatattcacacacagcaactgtcaacccttgcagagctgagccttcccgcccagcacacggtgtaccaggcagggtgccgagacttcgtgcccacccccaccgcccagctgacattggcagtgggcagctgggcatgagcccggggggcgcctcggcagagcagtgtggggggaaatgggggaaggaggctgtgagcaggcgtcactccagagaggtctgagactctgccccacgctctccctagggccctggggggtggggagaggggctcttctcaggaccccacccaaggggcctgggaccagcagcttttgcctcccccagcacccagaagggggcatatgcaaggaagacagtggctgtacccctgggaaggccaagaggaaggcccaaggtaaggtcagcctcctcctgtccctccacagtcccccggctgcggtccctgacgtcctgcaggcccagcttggtgctgacctgcctctctccacacccctcccgccgaggcggcctccgggagggactccctcctgccgtctcccctcctccgccctggcttggcctgcccgtccgggacccagccacgtttctgtccttggctcctttgcttgagtggcccgtcactgggagctcctggagaaggggtctggggcggcctcctctgtttagtgcaggcacccaggggtttccctctggctccaggcatccgcacgggcaagtgtgtggccttcaacgacactgtgaagacgtgtgagatctttggctggtgccccgtggaggtggatgacgacatcccgcggtaacactctgaccttccagagagctaagaacagggtcccaggccagacagaggggggcctaggtctagaaaggatctttacccctttttctgaccccaccctcaccccatccgcgcaacctaggctgaagattcccctgggtcctggccacgctagagcacacccacccctccaccagcccagggctgcaggcgggtcccggaggctcggcccaccccctgctgtgccaagctctgtgtgggacacacagggggcctcctggggaggggcggtgagtgcgtgtggtgtcctccagccctgcccttctccgagaggccgagaacttcactcttttcatcaagaacagcatcagctttccacgcttcaaggtcaacaggtgcgtgggaaattcgggcagaaatgcaggcagctggccggggccgctccggcagctctcagctgtctctgtctccctccattcctgctggcgtggaaggaatcaaaggggcaatgtggagcctgtgaggggtccccaggctttggggcgtggtgggcaccctcccggatgacacacagcagctgtcaacaccttccacccccacaggcgcaacctggtggaggaggtgaatgctgcccacatgaagacctgcctctttcacaagaccctgcaccccctgtgcccagtcttccagcttggctacgtggtgcaagagtcaggccagaacttcagcaccctggctgagaaggtatggagcatggtgccaggcacgtggggagggctgggccgcaggatcctgataaaggctttttaggcccagttcatcttcccaagtctcctcggtgagggctgagtatatgtatgggtctgtcccctgatactggggccccctgagcgtcagatccatgtcttcagcaggtcctggcatggaactggcacgaaggaggtgcccagaatgaacggatgtgggcagaccttgtcatctggatgtttgttgatgccctgctttaaaaaaaaaaaaaaactagataaaagcagcttggtcaggtgcggagggtcgtgcctataatcccagcactttgggagtcagaggcgggtggatcacttgaggtcaggagtttgagactagtctggccaacatggtgaaatctccttctctactaaaaatacaaaaattagccaggcatggtgacgcgcacctgtaatcccagctactagggaggctgaggcaggagaatcacttgaacccgggaggcagaggttgcagtgagctaagattgcgccactgcactccagcctgggcaatggagcaagattccatctcaaaaacaaaaaaaaaacaaaaacaaaaattggccgggcacagtggttcacgcctgtaatcccagcactttgagaggccacggtgggcggatcacctgaggtcaggagttcgagaccagcctgaccagtatggtgaaaccccgtgtctactaaaaatacaaaaaaattaggcaggcatcgtggcatgcgcctgtaatcccagctacttgggaggctgagaccggagaatcgcttgaacctgggagacagaggttgcagtgagctgagatcacgccactgcactccagactcggggacagagcaagactctgtcaaaaaaaaaaaaatacaaaaattatctgggtgtggtggcgggcacctgtaatcccagctactcaggaggctgatgcaagagaattgcttgaacccgggaggcggaggttgcagtgagtcgagattgcaccactgcactagtctagcccaggcgacagaatgactccgtctcaaaaataaaaataaataaaaataaaaaggcagcttgaatcctatagcctatggccctgagaaatcctgtgccctgggatcctcgcagtcacctgggattccgaagaagcagtccctatgagcgcagaactagctgaccgggttcaaatcccagctctgccccaaacgagcagtatgaactcagacaagtctcttaacttcagtgggtgtgagtttttggacccaccgacggggggcaataatggtgccagtctcgtggggtcgccccgagggtcaagtgagttgacgcggtgtgcgtggcgtgcctcgctgcctggcacgtgggaagcctatacacctggcagagttgacgccgtgtgcctggcgtgcctcgctgcctggcgcgtgggaagcctgtacacctggcagcacgtgtcccttattagtcctgcccttgcagttgcctgttcaagaacgaaatcaatcccttttctgtgatgttatcaaaataacccactcacgacacatttgtctgtctacaagggaggtcagcaaacttttttttcaagggccagatagtaactattttcagctttgccggctatatgggctccgtgccaactacccaagtcagctgtggaagggcaagggcagccacagaccatatgtgaagagtggacctggccatgatcaggcccatgggcctcagtttcctgacccctggagggggttgatgccggagcaacacacatgctgaatgttagacctccctgttcctaaaaatctccctgtcatcagggctgggtgcggtggctcacgcctgtaatcccagcactttgggaggccaaggcgggcggatcacgaggtcaggagatcgagaccatcctggctaacacggtgaaaccccgtctctactaaaaatataaaaaattagccgggcatggtggcgggcacctgtaatctcagctactcaggaggctgaggcaggagaatcgcttgaacctgggaggcagaggttgcagtgagccgagatcgcgccactgcactccagtctgggtgacagagcaagactccgtctcacaaaaaagaaaaaaaaaatctccctgccatcttcaactgggaacttctcagtaactaggctcctggcaagtttcccagctccctgtccccttctctgaccaccttccagctcttctcctgttgctcagcctatctccacctgtcccattactcgcctcgcccagaggagcttcgctttctccaatgttttcttcccaatccaggtcttcacagattccttctttaattaatgcagtaattgtctgcttgcctcccacactgtgacctgtgccaggaactcaggagttggtgatgaatgagacagacagcttcgtcctcctggagcttacagtcttggaggagatgggttaatacataatcacactaaataaacttatgattataaagcgagaaatgctcccaaagaaaacacacgagtgaaacagaagggaataacaaggacgtatctgggttacaagagcagggcgaaaataaataaataaataaacaagaaatggtcagagagctggagtgtggagggtaatgggagggaaggccagtgagggtgacaggacctctaccccaaaacagtttctcagtatcttttcttaaataaaaaatgtccagttttttttgttgttgttgattttttgagacagaggcttgctctgttgcccaggctggagtgcagtggtgtgatctcggctcactgcaacctctgtctctcgggttcaaatgattctcctgcctcagcctcccaagcagctgggattacaggcacccgccaccatgcccagctaatttttgtattttttagtagagacggggtttcattgcgttggtctggctggtctcgaactcctgatctcaagtgatctgcccacctcagcctcccaaaatgctgggattacaggtgcgagccaccacgcccggctccaaaatggtctgttcttgagagagtgcgtgtaccagctgtgagatgggctttttttgtttgtttgtttttgagacagagtctggctctgcacccaggctagagtgcagtggtgggatctcggctcactgcaacctccgcctcccaggttcaagtgattcctctacctcagcctcccaagtagttggtattacaggcgtgcgccaccacacctggctaatttttgtatttttagtagagacgggttttcaccctgttgaccagactggtcttgaactcctggcctcaggtgatccacccgcctctgcctcccaaagtgctgggattacaggtgtgagccactgcgcccggctgagacaggggtttttgatcctgaaatcccagatcttaactacttgtgtccctggcagggtggagtggttggcatcaccatcgactggcactgtgacctggactggcacgtacggcactgcagacccatctatgagttccatgggctgtacgaagagaaaaatctctccccaggcttcaacttcaggtgtctgccaggcccccagcagcacattcttccttgtggtcctgcgggcttttctactcccagaacacttcaggtctgagaaagtgtccccagaggggagcagagggtcctgggcagctctcattctgcctgggtggccatgcaggaagccagcagggagaaagatattgaagtctcaaatcccctgtccctgggtctcagaccccttcaggcccacctggccaggactagctggggaaattgctgacattgggagctggggcaatggctgagcacagcagcccacacctgtaatcaaggcatcttggggggctgaggtgggattgctttgagaccaggaatctgaggctgcagtgagttgtgattacactactgcactccagcctggcgacagagcgagactccgtctcacaaaaaaaaaaaagaaaaaggagttggggcaagagttgagtacaactttcccagaatgaggcctgggatcctgcccggtgttggggatgaggctgtactcagagaccactaaatctcctgtatccctgatgcgctaagaactccagacccaagacagtcccctccatcaccctcctgccacctcatcccttccccaaggtttgccaggcactttgtggagaacgggaccaactaccgtcacctcttcaaggtgtttgggattcgctttgacatcctggtggacggcaaggtgagtgtccagtgtgagggtggtggcagctgagacacattctcagctcctgtgagtacctttgggcatctacagttatagacaaccggaagttgggtgggttcatccagcagttttacttctaataacagatggtcatggggcatgtccagagcagggctttgcaacctgtggccatgcctccccacagtctccttgcgctcagggaggcagagccaaggtcaaaacccaggtctactgaccagcagctggtggcccatgtagagtccgaggtggggacagttcacagccgagggtggggaagtccccttgtcccaggtccggccttttccagctgggccccttccgacggttagcccttctctccctgggtcctgccaccaggccgggaagtttgacatcatccctacaatgaccaccatcggctctggaattggcatctttggggtggtaagtgctggggtcaccggctcactgtgctggggttggcccctcctcttccacaattcagtagcagcaagacgtccctcaccctaaaacttgaccctaactgtctatcatttttgagccagcagctgcccaccccaccaactacatagatctaagaaaaccaaggcccagagctggggcaggacagagttggggtggaaccatcttggtcccctgagagtcctgcagggcctcatccaccctccaggaaactggcctccagtgaggtcagatccagccagggcctcaccaccagggactgaggtgggatgtggagggctccgtacccacccccggattcccacgctgtctccgtgcccttccctgaccccaggccacagttctctgtgacctgctgctgcttcacatcctgcctaagaggcactactacaagcagaagaagttcaaatacgctgaggacatggggccaggggcggtaagagaaccccccgagccaggcccttcgaaggcctccggcgcttgtgtctgtgttggggtggggggcgtgggcagctgcttccccagcactgacttgtatcccccaacccttgcaccacgtacacaggctgagcgtgacctcgcagctaccagctccaccctgggcctgcaggagaacatgaggacatcctgatgctcgggccccaactcctgactgggtgcagcgtgaggcttcagcctggagccctggtgggtcccagccagggcagaggggcctccccaggaagtctcctaccctctcagccaggcagagagcagtttgccagaagctcagggtgcatagtaggagagacctgtgcaaatctgagctccggctccgaccccacacaccctgagggagccctaccctagcctcagccgctcctggtggggaatggctggggctgggcaggaccctcccacacacctgcaccctagcttcgtgcttctctctccggactctcattatccaacccgctgcctccatttctctagatctgtgctctccgatgtggcagtcagtaaccataggtgactaaattaaactaaaataaaatagaatgaaacacaaaattcaattcctcggctgaactagccacatttcaactgctcagtagatacgtgtggttagtggctgccatactggacagctcggggcattttcactgtcaaagaaagttctattagacagccctgcttgagccctgtttcttcctggccttcggtttccctggggaacttatcgacaatgcaagctcctgggcccacccccagacctcctgaaccaaaagctccagggctggccgtatgatctgtgtggatggcaaactccccaggccattctgggacctaagtttaagaagtgccgtcctcgaactttctgactctaagctcctgagcgggagtcagacttagccctgagcctgcacttcctgttcaggtgcagacactgaacagggtctcaaacaccttcagcatgtgtgttgtgtgctcacgtgccacacagtgtctcatgcacacaacccagtgtacacaccacctacgtgcacacagcatccttccacactgtgtatgtgaacagcttgggccctgcaaacacaaccatctacacacatctacacccccaagcacacacacatggtccgtgccatgtcacctccatagggaaaggcttctctccaagtgtgccaggccaggacagccctcccagccatgaatccttactcagctacctcgggttggggtgggagccccagccaaatcctgggctccctgcctgtggctcagccccagctcccaaggcctgcctggctctgtctgaacagaaggtctgggggaagcgacgggtggagtacaataaagggaatgaggacaaacctctgccgtccgtgctctctttccagacctctctgaaacacagtgtgctcgtctgtgaaatgtggggctgagctgggcaatctctgagatccctctggatctgccggtggggaccagtgagccgactcatacgccctgagcccagcagggtcagtgctgggtggagaggtcagctcacctctgtccacgggttgccatcttggcacagccctgaacattggcgctcttcccaaccctccatggctgggagaggcctggcagtggcacaagtagagaaccccaggagtggcctcgtgaaacagtggggaggaaggggctggctgtgccaggagggagatctggcggaatcccaaagaggggaggagggacttgactgaggctgtgtggagggccctgctgtgggcatgacctcaggcctggatttacagccaggtaggatctctgggcagcatcccccacccagtcaccatgctctgtctagaccagtgccgtcccatagaaccttctggaatgatggaaatattctctatctatgctgtccaatagggtacccagaagccacaggtggcctcggtggaaatatgcagccaaggaaatgaaattcgtattttatttacttttaattaattaatcaatattttttttttgagacggaattttgctctgtcgcccaggctggagtgcagtggcacgatctcggctcactgcagcctccagcccctgagctcaagcaattctcctgcctcagcctcccaagtagctaggattacaggtgcccaccaccacgccttgctaatttttttttgtatttttagtagagatggggtttcaccatgttggttggccaggctggtctcaaactcctgacctcaggtgatccgcctgcctcggccttccaaagtgctgggattacaggcgggagccaccatgactgcccaatttacttttaattaatttaaatagttacatgtgactagtggctaccagactggacaacacaggccagcccctgccatctccctcagggccttggccttctgccctcttccccaaccaagacctatcatttagattttataagactggaacttcctcttctgcccccccttctttctccagacacacctgcttttgcactttctgcccccttcccttccaagtgagcagaaaagggtccctcctctgtattcagcctcaccacccagcccagaggctgcccagcagaagccacctccattctcctacccctacatctgtccccctcttctgcctcctcctggcccaggttccccagcagctctgcccctctcccctcactgcaacccttccagaaagaccagtccacacttccctctgcaattggcctccaccccaaccacttctcctaggtgcccttgccaaggtcactggcagtgtcctggttgccaagtcttaagcagacacttgggccccatatcctgcttggcctgacagcttctcacattgttgtccaagccttccttgtcgaaagatttccttccagcagctcctaggacacaccctttcctgacttcccagcctgtctggcgtgcaaggaaaagacaggtttcaattgcagctctgccacagttcactgtgtgtccttgggggaagtggcttaactctccaagcctcctctgtgagtcaaggataataacaacttctttttttttttttttttaaatagagacagagtttcactatgtggaccaggctgttctcaaactcctgggctcaaatgatacgctccacctcagccttccaaagggctgggattaccggcatgagctactgcacccggacaataatagcttttagtagggttgaggaaagacctgtaaacagcacctggcatacagtcgagctctgcccctcaatctatccaccctctcaatggtggagtccactagttgttccggatatctgttctcccggtagcaattcagtccttggttcttggttgggcatgtggctgcccagaat

SEQ ID NO: 15879 - DNA, 28823 bp, Human; identical to SEQ ID NO: 12437

SEQ ID NO: 15880 - DNA, 25375 bp, Human
agggccaggtttgtccactcattcaataatatgtctagaactattatgtggcaggcacagggacatacagagatgtccaaaggcatggtccctgctctccgggagcttctggtcttagcatgggacacagtcactaagtcaacgagatcctactggatagtgacaggtgctctaagggaataagatgagataatgggatagaaagtggctgggctgggactgggggctactttgggtgggcaataataacaggcctttttgaagaaatggcagttgagttgaaatggatgaaaagatgcaaagatccacgctttcccaaatgacagtttgagagcaaaatacaggttcccagccccatcttagatttcgtgaatgaaaatttgaggggcagggcctaggaatttgcctttttttcttccacatgattcccatgcactttgaaactggacaccttccttggggcttttactttagaatcacactgatgaatttcagggtaccttccagttccccgagtctgtggcttagggaagggagcctctttgtgtgtgaaagccaggggtagggagaggagcaggactgcttgtggtcagactgcaggatgcagaaaataagcgtgcgcagctcctcaccacaccgcgctcacccagggccctgcgtctttggctgtcaggagttctaaacctgccccccgggaggccctccctcatcccactcccactcctgttgaattccacatactgagagggttgcagtcatagctgcatggatcagttctatttcttgtgcgttgggaaccattccaaacagttggtacatgcgcactctccaggcatatttttaggatcctagggtgggttgcctgtgtctccccgcccccaccccgtctgccccccacccccgcaccatccgccctgagtgtgggagggaggtcttcatgctgccggcactcgggacctgcctgaccaccgactccgccggagtgtgggcttttaaacctgcagcagctgctgcagtagaaacgcgcgttagtcgcagcagacacaggcagcctcaggtgggacaagtcttgtctcttccagcctgtgggggagccacggcttcccccccacaaccaccccctgcccacggagcaagaatgtatctccctggcaggagacctggcgcgaggtgaatggagaaacctgttgtgtccccttccttcctcccctggcctcagttccccatctattcaataggaagaaccctttgggatttctttgcgagagaaaggggagttttgctttaaacggagctcttcccggccgtgcgcggtggctcacgcctgtaatcccagcactttgggaggccgaggtgggcggatcacctgaggtcaggagttcaagaccagcctggccaacatggtgaaaccccgtctctactaaaaatacaaaaattatcacgcctgtagtcccagctacttgggaggctgaggcaggagaatcgcttgaacccgggaggcggaggtagcagtgagctgagatcgcaccactgcactccagcctcggcgacagagcgaggctccgtctcaaaaataaatgaataaataaatttaaaataaaataaaaaggagcccttccccctttcacttcctctcctccgcgatcgctgctttcagctgggcaacagcacagggcggtcctgcgcatccggggggctgcgctcccagaccggtggctggggagtaggttgcaggggtgtcactgtgtcaggggaggaggaggaggaggaggaagaagaggtagcggcaaggtcgcggtctgaggttccggtgctcgccgccgcccagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtgtaagttctccgcggacttttgggaaggcgggggaggggcagggcgggtgccagccgccgcgtccttctccagggtcctggaattcgcaggcgtgcacgcggttttcccggtagctgggggtctgtgagcctgcttgctgtgggggtcctctttgggtccttgggtgtaggagtagggtgtagagagggggctctccactcccccactggcgctagaggtgatgagaggtgggcaggggccttctggtttcctcgatttatcaggctttccctgcagctgcttctcccagagtcgggtccccacgtgttagggccatgggaagggggcagggatgccagggggctgggtggcagctgtcgccccaggagcctccctgggccttggcctggcagctgacccaggcgccggcaggttatttataatcacagggtgtcactgcctactcagagctggagaaactcatcagcccggcatgttcctgagctcccttccggtcaacttgccccacccgcggccagcctctctggtgtccagctgggggtcctgcccagaggcctctatctctgcacccagctcggccatccccttcccccatcctcatgccacctggcaggagctggcgccacaaagccaaagaggcaacttgtggaggctgctctgccaggcgccttcagagccctgaccccggggtgggtggggggtgagcaggtggaggggagaagcagcgctggacaatggggatgcgcctcattccactcgttcagtaaatgcggtggagttcctcctgcttcctcctgggagggcagccctgacgcctggctctccctcggaggtccagcagtccgcgttctctgagctgcatccccaggcccctggccgcctcccacctgagcggcctcgtaggcgctgtgctgttgctcagccaggcctgcccgtcctcctccactcccttagcatccactcagcccccagatctgggctttccagtaactccctctcccttcctccctggccttcccacagtgtaattattgggcttatttgggggatcatttgcctgatgtcgctgtcagtccgggaatgccctgagggtggggccccagcagcacttaactgcttagggaatagatgtgaaatgaacgcgtgaatgaataaatggagttgcttttgcttgaacaatagaaatttaattctcgcagtcctggatgtggaaatctgagacgagggtggtagcatggttcggggtctcagggggggctctctccttggcttgcagatggccaccctctcgctgtgtcctcacatggcagggaaagcaggacatatttaactaagtacaagtatgaaaattaggaaattggcggccgggcgctgtggctcatgcctataatcccagccctttgggaagccgaggtgggtggatcacctgaggtcaggagttcgagaccagcctggccaacatggagaaaccctgtttctactaaaaatacaaaacaattagctgggcatgatagtggcgcctgtaatcccagctaatcgggaggctgaggcaggagaatctgtctctatggatttgcctattctgggtatttcgtataaatgaaattgtatagtatgcggcctttttttttttttttctggcttctttcacttggtgtcatgttttcaaggttcacccatgttgtggcatctatcagccctccattcctctctgtggctgatactatcctgccgtgtggggctgccacattgtggtcatgcattcatcagctgatggacatttgggtggttttcacaccgctgagtgtagtggctcatgcctgtaaccccagcactttgggagaggagaccgcggtggctggatcacttgaggtcaggagttcaaggctagcctgaccaacgtggtaaaaccccgtctctactaaaaattcaaaaattggctgggtgtggtggcgagcgcatgtaatctcagctactcgcaccagtgcactccagcagcctgggcagcagagcaagactgtctcaaaaaaaaaaaaagaagaagaatgcttctgagaacattcatgtacaagttttttgtgaacatgttttcaattttttaatttttaattattattattattatttttgagatggagtttcgctcttgttgcccaggctggagtgcaatggcatgatctcagctcactacaacctctgcctcctgggttcaagagattctcctgcctcagcctctggattaactgggattacaggcatgggccaccatgcctggctaatttttgtatttttttagtagacacggagtttcaccatgttggtcaggctggcctcgaactcctgacctcaggtgatccacctgccttggcctcccaaagtgctgggatgacaggcgggagccactgtgcctggccatgttctcaatctcttgggaattttctggcttatctggtaactcgatccttaaccttttgaggaactgctaaactgttttctaccataactacctcattttacatccctatcagtgatatacgggggttctaatttcttcacaacctcatcaacacctgttatctgtagggtttttaaaaaatgatagccatcctagtggaagtgaagtggtgttttattgtggttttgatttgtatttccctaatgaccaatggtgtttgtcatcttttcatatgcttaattgggcatttgtgtatctctctctctcttttttttttttttttttttgagaaatgtctattcaaatcctttgctcatttttaaattggattatttggctttttattgttaaattataagagttttttgtatcttctggatactaaacccttaccagctacattatttcaaatgttttctcccattctgtgggttgtcttttcactttcttgagagtgtcttttgatgcatgaacattttaaatttttatgaagtccaacttacctattttttcttttattgcttgcgtttttagtgtcaacaagtatgggatttgtactcttatttcatttttttgttgttgtttttgaggctgggtctcaccctgtcacctgggcacaatcatggctcactgcagcctcgacctcccaggctcaagggatcctcccacctcagcctcccgagtagctgggacgacaggctggtgccaccatgcctagattacttttttgtttttcatagagatggggtctcactgtgttgccccggctggtctcaaactcctgggctcaagcgatcctcctgccttggtctcccaaagtgctaggagtacaggcgcgagccaccgtgcctggcctgtactcttattttgtagaatgcccctcagtttgggtttgtttgaggtctcctcgtgattggtttcaggttaggcaccatcacaaccccagagggaggcgctgtcaccccatgttatgtatgggaaattggcttgcctggggtcaccaaaccagtatgtggcttcagcccaggcttgtccacttggggcctctgagtggacagtggtctttgcctcttttatttatttatttatttattttttgagacagaatctcactctgtcgcccaggctggagtgcagtggtgcgatctctgcttactgcaagctctgcctcccgggttcacgccattctcctgcctcagcctcctgagtagctgggactacaggcgcccaccaccatgcctggctaattttttgtatttttttttttttttttgagtagagacagggtttcactgtgttagccaggatggtctcaatctcctgaccttgcgatctgcctgcctcggattataggcgtgagccactgcgcccggctggtctttgcctcttcagggcccccatctctagggttgcttgtcgcctctgctgcttgcaggactgggtttcagtcagcagtgggagctgtggcccctgcccaggagctggtgggacaggtggagccctgagcctgctccacctcaactaggagttgctgtgactgctaccccaccccaaggcctggggaagctccccgaagccagcagagtggctgatgcccacgtaccggcccccttcccacagatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccaggtctgagtccccacctagcacacggccaaggctggcagggactgcctggttcgggtgggtcacacgggaagcttcttggatacgcagggacccccatccatcatctctcttggcccaagacagctgccagggcttgcagagagcaaccctgtccagatcctacctcccatgccaaacccctgccctctttgactgtgccgcgggtgactgctctgttctatctgagtctgctgagaacaaatgggacccagagaactttcaggtcattgtgagtcaggtgggctggcacagagaaccccccttctaagtcactgcctctgggaatagctctccagcctgttcacagttggccagggccagggcagcctgagccctgcgcccacttctcccggatcctggggcagttggggtttgtgagtctggaggagatctatcaatggacatctacctggggactgtggggtccatgagcagatgggcagagtataccaagtttgtggccccattatccccaaaacccaggcagagggaccgccctctttcaggtaacgctggaaaggtggggtggtccctaaggggcaggaggaggttcctcagtgcctctctggttccttagggagagaacgtcttttttgtggtcaccaacctgattgtgaccccaaccagcggcagaacgtctgtgctgaggtttgatttggcgaggggccctggcgtgggggtgggagagccaccggcagtggttggggtctactctcttctgaagcaagggtgtctgtccactccaagggtctcgggtggctgtgtgcacccgggtgtggttcctgcattatatgggggagaagtaggttctcagagtgtgtgtgggccaggccgaagaagaacccctattctatctcctggagtgggacccggctctgagctgggggaacccccccatccaggtgccccttctctcctggcagaatgaaggcattcctgatggcgcgtgctccaaggacagcgactgccacgctggggaagcggttacagctggaaacggtgagggcctggagcggccacgggctgaaggaggactcggagtgggaggctcctggcattgatcctgtcccacccctgcaggagtgaagaccggccgctgcctgcggagagagaacttggccaggggcacctgtgagatctttgcctggtgcccgttggagacaagctccaggccggagtgagtggctgcagcctcaggaccctgaggggtttcccagccccgtgcggtgggtcccagcctgagggtggagtcctgcccactctgggagcctcacgctgagggaggagtcaggctgtcccagcgaggcccgacggcctccccagcatgagcaaattaactgtcctgggcagaggctccaggggacccaaggaacaggcctcacactggcccaggcctgggggaggggcacaggggtggggcctcctggacaggctgttctgggttggttttcagggagccattcctgaaggaggccgaagacttcaccattttcataaagaaccacatccgtttccccaaattcaacttctccaagtacgtgggcttggctactgggggccacgggtgggccttggtcgatgaggggccttggctggccctccgtgggtctctgcctgggggtgtgtgtgcgcgcgtgtgtgcacgtgtgtgcgtgtgttcgcgtgtgtgcgtgtgtgcgcgtgcatgtgtctgtgtgcatgtgtgcgtgcgtttgtgtgtgtgcgtgtgttcgcgtgtgtgcgtgcgtgcacgcgtgtgtgcgtgtgtgtgtgatgtctgcatgtgagtgggtgatgtctgcatgtgaataaacggtgggtggcgctggggcgccccttcccctgctgtaaagtggggtgttgctgcggggagctgtcagcactcaggttggtgagggaccgagtgactcctggccaggccgggaaacatcaagtcttacttcatttctcggctgcccatggcctccacccagaagcaatgtgatggacgtcaaggacagatctttcctgaaatcatgccactttggccccaagaaccactactgccccatcttccgactgggctccgtgatccgctgggccgggagcgacttccaggatatagccctggaggtgggtggggtgcacgcagggagccctccctgagggcctgggggcactgggcctggctctgtgacgaggagggtgtggacggggactcgtggggcgagggtggccctgcaaagtcacctgcccccagggactcagtgttttcagaactggctgtggcacacaggcaggccgtggcagcgggcgagggtggccctgcaaagtcacctgcccccagggactcagtgttttcagaactggctgtggcacacaggcaggccgtggcagcgggcgagggtggccctgcaaagtcacctgcccccagggactcagtgttttcagaactggctgtggcacacaggcaggctgtggcagcgctcagaccacgggcagtcagtgagagccagacctggcacctgctgtgcggttctgagtccttggggcaccagccgaaggtgaggcagagggaccccctttggcacatgctggctggagtgtgaagtgcctgtccagagaggcctaccctgtgcggctcccttctccctgaagaacgagggaggcagccctgaggcagggacgacgcagtgttctcagccgctccatggggggactaagcctcctggagggtggtctcgaggggctgacctcgtgcctgagcacctcctcctattgtccagtgccggtgaagggctggcctgggatgctgtccgtctccggaaagctgtgtgtgctgaccctcatctctcttttatcaagggtggcgtgataggaattaatattgaatggaactgtgatcttgataaagctgcctctgagtgccaccctcactattcttttagccgtctggacaataaactttcaaagtctgtctcctccgggtacaacttcaggtaaccgctgccttgtgcccacttgtgacctgaccatgatcagtggcactcactcatctgggtgccagcactattgaggccccttcctgggggtgggtgtcagagcgggaggtgcagggacagatggcccaggagaggtgtggaccccagcagagtggccagcgactgaagctgggggtgcctctgggagaggagagcgcgtgttcttgcctgtttctctccgtgaagccgagtcttgcggcctctgccgcatcctttccatccgcgctttggcgacccaagggttgctcagagtagggtggggaagcccttgctcctcagggaatgtctggcagggatttcaaatagctggatgcctctttgtttttggctcagtgagaaggtctgcaagccactcctggggctgctgagagtcagggttccgggagtccttctaagtccccagagcagccacatcagtgctgcctaaagagggaaggccaggcaggctgaggcctcccctgggccctgtctccctcagatttgccagatattaccgagacgcagccggggtggagttccgcaccctgatgaaagcctacgggatccgctttgacgtgatggtgaacggcaaggtgcgtgtgccttctcctgttctgaggctgggcggggggcgggggctgggagggggacgttgggagggtccctgggggcccagctgtgtgttctcctgttctgaggctgggcggggggcgggggacgttgggagggtccctgggggcccagctgtgtgttctcctgttctgaggctgggcggggggcgggggacgttgggagggtccctgggggcccagctgtgtgttctcctgttctcaggctgggagggggacgttgggagggtccctgggggtcccgctgtgcgttctcctgttctgaggctgggcggggggcgggggacgttgggagggtccctgggggtcccgctgtgtgttctcctgttctgaggctgggcggggggcgggggacgttgggagggtccctgggggcccagctgtgtgttctcctgttctcaggctgggagggggacgttgggagggtccctgggggcccagctgtgtgttctcctgttctgaggctgggcggggggcgggggacgttgggagggtccctgggggcccagctgtgtgttctcctgttctgaggctgggcggggggcgggggacgttgggagggtccctgggggcccagctgtgtgttctcctgttctcaggctgggagggggacgttgggagggtccctgggggcccagctgtgcgttctcctgttctgaggctgggcggggggcgggggacgttgggagggtccctgggggcccagctgtgtgttctcctgttctgaggctgggcggggggcgggggacgttgggagggtccctgggggtcccgctgtgcgttctcctgttctgaggctgggcgggggggcgggggacgttgggagggtccctgggggccccgctgtgtgttctcctgttctcaggctgggagggggacgttgggagggtccctgggggccccgctgtgcgttctcctgttctgaggctgggcgggagggggggagagccgggggacgctgggagggtccctgggggccccgctgtccaacctgcctcgctcactggccttgtctctatcttccaggcagggaagttcagcatcattcccaccatcatcaacgtgggctctggggtggcgctcatgggtgctgggagtacctcccctccctccccgcgtcccaccctctccccggcggccgcactggcagggagggggaggctgctgttcaggaggaccgtgtcccagtgcccccagaaagaaccagagctggcaagatcagaataggcgtgggaaaagagggctttctgggatttcacgctctgccagctgtcctcaggtagcagtgacagcccgagtctctttccagagccagggaggcatgtgctggtagctctgcagctgtgcatgggtttaggtcagtccccagccgaggcgtggctgggatatccctgggatcccaggtgagtccctgaacttctaaagtctctatctctacttctgctaaaagagggcaggattaggccgggcgcagtgactcacacctgtaatcccagtgctttgggagggtgaggtggcggatcacctgaggttgtgagttcgagaccagcctgaccaacatggagaaaccctgcctctactaaaaatacaaaaattagccaggtgtggtggcacatgcttgtaatcccagctgctcaggaggctgaggcaggagaatcgcttgaacccgggaggaggaggttgcggtgagcccagatcacacaactgcaccccagcctggacaacaagagcaaaactccatctccaaaaaaaaaaaaaaaaaaaaaagggggcaggattaggctgcagacagtttcttagcctgggtgctgctgactttttgggtgggagaattctgtgttgtggtcttacacacatccttggacatgcccttaaacattccacaatgcacagagggctgtgctgggtgtcgtaggaggtttttgtttgttttctatttcatatttcacacttttctggtcgatactatattttcccagaccctgaggatgttgatttcagagacagggtttttgctctgttgcccaggctggagtgcagtggcatgatcatggctcactgcagtcttgaactcctgggctcaagcgatcctcccacctcagcctccccactagccagggctgcaggtgcaccaccacctgtggctaatttttaaattttttgtagaaatggggtctcactatgttggccaggctgatcttgaacccctgggctcaggcaatcctccggcattggcctccccaagtgctgggattaggggcgtgagccaccgcgcccagcccattgtaggatgtttaagagcattcccggtttctacccactagatgttaggggcaccctcccctgcagttgtgatggagcaaaatcccagctggctgagaaccacccgactgaaaggctgagaggcagggaaggcagccctgtgactcttccttagaggtggcccttcagtggggccgggagcggctcacaggggaggagacacagggactgagggcagggaaaggcgtcctgagtctacactgccccgtggtccttctggagtttttgagagccatgggagtggtcagtgcccatcccggcaggtccctttcccaggtttctggcagcctcttccctcattcctctccctgtgcacacaagacagccccactggaggagtccattgggacccaggggtgacttttgttaaaacctggaaaattgtgtcccataccaggaccacgttcctgggagggggtcaagaaaagtgagctccacatggatccctacctgcagacagtcactgggagggtcctggatgtttgcgcctgttactttcttacagaaggcccaccttcagctatcacttttctttttttttttttttttttgagatggagtctcactctgtcgcccaggctggagtgcaatggcatgatcttggctcactgcagcctctgcctcccaggctcaagcaattcttctgcctcagcctcctgagtagctgggattacaggcgtgcgccaccgcgcccggttaattttcgtatttttgtagagacagggtttcaccatgttggccaggctggtctccaactcctgacctcaggtgatccgcccacctcggcctcccagtgctgggatcacaggcgtgagccactgcgcccagcccattcatcactttcttgtgatgtgggtaaaatcagagcaccctctggggacagacctgtgaactggaagtaatggcgcaggaagaggtggtggtcaaggttaggtttggggttggtctctggggagcagcgaattggtaagcaacatttttggcatctaggggatggatgtgcagcacccagggtcaggggaccaagattccttgttggcccctccaccaacccttcccacctccactctcctctatcattcaggccccaaccctgccctgtgctgtgggtggagtctccctctgctggaggagaggggcaattgcatcgctctggtccgtagggcacgttttgggtgtgaggggctgagctggggtcgtccacctcatcatcttccttttttgtttgtttttgcttttgtttttgtctcttttgagatggagttttgctcttgttgcccaggctggagtgcagtggtgcgatcttggctcactgcaacctccacctcccgagttcaggcgattttcctgcctcagcgtcctgagtagctgggattacagacacccgccaccacgcccagctaatttttgtattttttagtagagacagggtttcaccatgttggccaggctggtctcgaactcctggcctcaggtgatccgcctgactcggcttcccaaagtgctgggattacaggcgtgagccactgcacctggcacccatcatctttctttgactagcaccatagcgtccttgttggttagaacccttccaacctatctcacactgactaccacagggatctttctaaatgccaaaattcgggctgtggtgcctccgcctcacctaaaggatgaggaccaatgcctcggaaacattctaagaagcctaacaggccagtccccatccccttctccagaagcgcatctccctcttcccgcacaggccctgcggcatttcccagatgtgacaggcttgttcctccctccgtaatgtccttccgcctctttgtcttgtataaactcctctttagtccttaaggactgaatagggaccctccccaggctgagtgaagtcctatgtgggtcgtcatcgacacgcctgtctcctgcaccagagggagagtccccaggaggtctctcttgtccagatcctctccgtacttcggtgcagacactggcacgtgctgggtgcccagcaaatgtgttgaaggaacgattggatggggtccgggtggtgcggggtcggggagtgcctggcctgtgggatcgggggagctccagtccagcttgagctccaccatggaccagctctgtggtgtcggacaagggtgccccttgctgagcccagtttcctcatctgttaaatggggacagtgatgccacctttaggggctgttgcaggatggaaggggcaaagtgccctaaatgaacagtgctctcagaggtctaggattctgaatcaggaacccctgttttgcagggtgctttcttctgcgacctggtactcatctacctcatcaaaaagagagagttttaccgtgacaagaagtacgaggaagtgaggtcagttccgcttccaggccggcggcccgagggcagccctgtggagcacccccgtggcttcgagcctttgccctgatgtgatattgatggctggggtgggaggcaggggctggagggcccggggaggagaagtgttctgagtacatgctctacagaaccggattcggcctcggcagcagtgggaggagagggcgctgtgggccacagggcgggagacggagttcacaggctccgcctgattctggacaagtcccaggcctccccgggcctcggtttctctatctgggagatgagagagttggtttaccaatcgagtggtgtctgcagcacttctgttttgggattcttggacttggtggtcctggtgcgccggggctgagggaagctggagtagtaaaggaaagaaaagcggatattttcttccatgcagaggctgtttccggagtttcctgggccctgggttcggtggggtgtgcgtgttcacagcggcagagcacagcgtgggtggggaaccctgatgactgtgggagggcgggaaggggaaggggctgtggcttcggcctttggggaaggccttctggagaagcagggatcagaatgggaattgggacagacaccttagtactccctcagcacccccacagcctgggacagtgggtgcagggtctgcctgggtcattcgccttactgcactccagctacggcctgaaccccagccctgggttatagccctgcgccctgaccctggccacaggctgaaccccaaccacagtcctgactgtgctgctgaaggaagcagggtagaggaagccgggtggaggacgctgggtggaggatgcagggtggaggacgctgggtggaggacgcagggtggaggatgcagggtggaggatgcagggtggaggacactgggtggaggatgcagggtggaggacgctgggtggaggacgcagggtggaggatgcagggtggaggatgcagggtggaggacgctgggtggaggatgcagggtggaggacactaggtggaggactcagggtggaggatgcagggtggaggacgctgggtggaggatgcagggtggaggatgcagggtggaggatgcagggtggaggacactgggtggaggatgcagggtggaggacgctgggtggaggacgcagggtggaggatgcagggtggaggatgcagggtggaggacccaggatggaggaagcagggtggtggcctgcagggtggaggacccaggatggaggaagcagggtagaggaagccgggtggaggaagcagggtggaggacgccgggtggaggacgctgggtggaggacgcagggtggaggatgcagggtggaggatgcagggtggaggacactgggtggaggatgcagggtggaggacactgggtggaggactcagggtggaggatgcagggtggaggatgcagggtggaggacgctgggtggaggatgcagggtggaggatgcagggtggaggacgcagggtggaggacactgggtggaggacgcagggtggaggatgcagggtggaggacactgggtggaggatgcagggtggaggacactgggtggaggatgcagggtggaggacgctgggtggaggacgcagggtggaggatgcagggtggaggatgcagggtggaggacactgggtggaggacgcagggtggaggatgcagggtggaggatgcagggtggaggacgctgggtggaggacgtaggatggaggaagccaggtggaggatgcagggtggaggatgtagggtggagggagctgggtggaggactcagggtggaggacgccacgtggaggaagcagggtggaggactcagggtggagagagcagggtggaggatgcagggtggagggagccgcatggaggaagcagggtggaggacaccggctggaggaagcagggtggcggcctgcagggcgagggattcttcaaggcccactccgcccgtctaggaggggaggcaccctgcagggccgtcccaggtgaacagcttgtatcttgtccaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggtgaggccactgctaggcagagagcccgacagctgggtcctgcagagaggggtccccagttggggcttctcatgcctggcagctccagcggacccctctgctctggtgtgagctggccacaaggcaggacatctaggaactgggagagcctctgtgggaaggggctggtgctttaccccgcaaggtcccccttagctcccgagaccctggatggccatgggtgcctgctgtgccatgccggcgctcagatgataacagcgcgctgctccacagcactgactctctgcccggaacccctctgtactctccgtatttgttaactcatgtaagcaactgaatcagatagacaccgatcttccccattttacaaatgaggaagctgaggcacagaaaggctcggtaatttgctcaagtcacacagccggtgaatggcagcgctgagatttgaatcccggcagtgtctgtaggatgaggttctcctgagttactctgcctttgccgaacgtctctgtgctcagatgaccccccctcagcccctcttctgtgtgcgattctggggctgccccggcctcaggagggtgctggccgtgctgccaggggggtccttgggccgcgattcctgggggcgctggcttctctgcagacgaggctcagcctgcgtggggagggcgtctggctgggtgggggacctgtctcgggcctgctctgcgtctgccttgcagagtacctgtgcggtgagcaggtgcctggccctttctgtgccttgttttcccttttttcccctcccagtgggggctggacacctcctgctgtcagactggggttctgtgactctcttgcaaaccacaccccaggtactcactgaccttggtggcctttctcctggcccagctttcattccttgctgactcaggaattggcagcgttcagctgggagctgggcctgggcagggaaggagcaagaaatagactgggctggataagagtgaggagagagagaggcaggggctgcagcagtggggcaaggaggctggaggctaggggtccgtatggggtaggcccagagcctggcagccctcctgtgctccctgagctgactcttacttcctgggtgctcacttgagctcccattctgagcaagcgggaagcccgacggcctggcttgtcttggctgagcctcgctgaggcttgtgggaggctgtggactcacaggcccacgctccagctgccaccgcaattgctgctgctccttgccggggcaactccagaggcttctgcctgagcatctatgcgtgctgggcttccgcaggaaccctggcaggctgtgctctctctgaatgctctgcctgcctgcagtgctgccaggagcgttgctgcctctggtgaggctggcccacccaccggctcccgacagtcctctctgccctgtgcgccccctcccgcccacacacaggtctggccatttgcagaatgcacaggtgaatttggagcagctgcagacagtggagatgtagccagggctgctggctaccagcagtgtcgctgaaaactttggggccagaacaacccgcagctctgaactgggtagaggagtctgtgcctgcatgagacaggggcttccaggcacagccatctctcctgaactttgggatcttgctgcaagctttttgctgagtgaggaggggagcctcccaatggtcagaggggctcggacctagaagaggagtccctggagcaggtgtccagggaaagggacaggccagggtgctgagcagaagtggagtgtttggattttccctcaacctggctgcaccttcactcattcatatgagctgtaaacatgtattgacgcatgctgtgtgctgggcccaccaagaggtgcttaaatgagatgctgacctaacctcagggagaggggcccgcgtgtaattcctccaaagccaacagagacatcacagccaggcccagccactccagctggccttcctctagcctctagcagggtttccgaaatccctgccgagaatgatggttgctcagagaaagctcttggacaacacccaaggggacatttgggcttgccccaaggataaaatttaaaggtggccatggaggcaaccaggaaaggactggagcagtcaggaggcagctggctcttagtggggaagccagctcctggggagtctaggtaagatggggaaggggaggcaagaggcctctgctccatctgactccaccagcctcgggacgcccggggaatatggacctgcccagatgggagatacagtcgccttgaccctgccgagctcctgccctccccacccctcctcagaggctgggcctgaagtgctaatgagatcaaggatggcgccactcagcaggtgtaaacgggctgagttagggaggccctcattcccctccctccgtccccacctgtcttatgccacggccacacccacctaccgcaccctcagctgctctctgcctccatcgctgtagggccttgctttttatttatttatttttttgaaatagagtctcgctctgtcacccaggctggagtgcagtggcgtgatcttggcttactggaacctccgcctcccaggttcaatcgattctcctgtctcagcctcctaagtagctgggattacaggtgcccaccaccatgcccggctaatttttgtagttttagcagagatggggtttcaccatgttggccaggctggtctccaactcctgacttcaggtgatccgccagccttggcctcccaaagtgctgggattacatgcgtgagccaccaaacccggccaagccttgctatttaaagtggggtccagggaccggagcctgctagaaatgcaggtcccagctcccccgccccccacccaaatcagaacctgtgtttcaacaagattccaaggtgatctgtgtgcacagtgacatttaagaagccctggttctcaggggaaaaaggccagctttggtggatggagccaatttctaggtcagacttacacgcatgctgcctagagaccaagaggcttcctcccccaccctgaaagcagcagtatgctcagctgatttaagttacaatattttgactgggtaatacttaaatgattcaaagtttagaaggtgcaaaaggatagtcagtgaaaagcaacctccgtcctcccggttccccagaggcagccagtgttactaatgcaggaggctccctgattttgccgagaactcgtgtggtttcttacacattcactcaggtaatgaacttctcctgacgctggcgcttaagacccagtctcccctgtcaaaaatggacatgaagtacgtttcgatgttgggcttgggagctgactagctctcttctcctaccccgttgtatgtgagttgtctccccgtaaacccaaggtgagaaacctggagctcagccctcgccattgcccgagccacctggcagaaaagtcctccagcgccgccctcacacaaccagtcccagtgctgtctgggcggctccctggaagcatcctctttggaggggttctctctgcacacagaaaggcgggggtggtgagagcatccctccactgaggctttggagagggatgtcaggggcccagggacatggtctccagaacaggaaccctcctagagcaaagcaacttcctcgctttgggttttctgggaagggaacctgcaacaagcctatactgctctctgattagaaagtaaagatccaggctgggcgcagtggctcacacctgtaatcccagcactttgggaggccgaggcgggtggatcacgaggtcaggagttcgagaccagcctggccaatatggcaaaaccccatctctactaaaaatacaaaaattagccgggcatggtgtccacatgcctgtagtcccagctactcgggaggcggaggcaggagaatcgcttgaacctgggaggcagaggttgcagtgagctgagatcataccactgcactctggcctgggcgacagtgagactcagtctcaaaaaaaaaaaaagaaagtgaagatccaggtgatccacttaggtgtgtcacttcttcactgacgcaaagccttgcatttttataacttggtgacttttaggtttgggaggaagcaaaaaaggcaggggtcatggctgctgattttaaccagacttcgaaatggctggcagaagccacagaacctgaggatagtcatactatttgtttcatattgcaacaaaaatgtcttcctagccgggcacggtggctcacgcctgtaatcctagcactttgggaggccgaggcgggcagattgcctgagttcaggagtttgagaacagcctgggcaacatggtgaaaccctgtctctactaaaatacaaaaaaatagctgggcgtggcggcgtgcacttgtagtcccagctactcaggaggctgaggcaggagaattgcttgaacccgggagacggaggttgcagtgatccaagatcgtgccactgcactccagcctgggcgacggagcgagactccgtctccagaaaaaggaaaatgtcttcctacagttagtcattccttcagccaggaaatatttatggagtccctgtgacatgtcaggtgttggaccagatgctgctgagacagagatgagcaacacagacacgatccctgcccccgagggtttccagtctaatggggcattgaacccttatcaaatgatcacacccgtcatcacagacggaatggggtgtcggagaggtcagcgaggagtagccagagaaggtttccccaaggaagtgacctatgagttgaaatctgaaaggttatagcagcctaactaggtgagggggaagcattccaggtaagagaagcacaggtgtgaagagacgctttgatatgggaaggagcaacggagaacctgggtgaaggcggcagacaggagccaggtttggtgaggcttttgtttaatgaagttgacggtctttagctgcaaggttgcccctttagactttgcttccttagaggatttaacctcattgtttcttcaaggccggccaagccttccagtgacctcttgactgcccatcaggggccccgtgctcagaagagccagggatcgcctgacagcttccagacagtgtcacactcttccagtttccttgctttttgcacagcccccagctcccaccatttttctgcataatcttggtgcaagagtgggagctcattactctgatggaaactggcttttttttttgtattttttttttttaattttttgagacggagtctcgctttatcgcccaggctggatgggagtgccgtggcgcgatctcggctcactgcaagctccgcctcccgggttcacgccattcccctgcctgagcctcccgagtagctgggactacaggcgctcgcctcgcccggctaattttttgtatttttagtagagacggggtttcactgtgttaatcaggatggtctcgatctcctgacctcgtgatccgcccacctcggcctcccaaagtgctgcgattacaggcatgggcatgagccaccgcgcctggccggaaactggcttttaaatggggagaagtgaagcatgaactgtagctcttttcagacttgggaaggcccttctccctgggcactggttgcctcactgggaagatgagagtgccagcctctcaagagctcctttctgttctgatattccaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaacgtgtcctgatttttttctcttcatgtttacccatctttttttttgagatggagtctcgctctgtagcccaggctggagtgcagtggcacgacctcggctcattgcagcttctgcctcccaggctcaagtgattcttctgcctcagcctcctgagtagcggggattacaggcgtgcaccaccatgcacggctaattttttttgtatttttagtagagacggggtttcaccatgttggtcaggctggtcttgaactcctgaccttgtgatccgcccacctcagcctcccaaagtactgggattacaggcaacagccaccgcacctggcccatttttacccgtattttaaaggaaaatgtaagaaggcaagatcaaaagaggcagacacaagaaacaattagtaagcaatatattcctcatcttgcaaagaaattcaaattatggaaatgctttaaatgagcaactattaaaattatagactaggaaggaactgataaaactggtacttttcattcaagtagtgtaatctaacacaactctggaagtaacttggaaccaaatttttatcctctgctgtaggaacttattaattttctcaaaacaatataaacgcagacattcattgcagtattttttatagtagtgaacatttcaaacttactgcccaacaatagggaaatggttaagtacatcagctcgcttatccctcttccttttttctcctctcccaccaggctgaggactccctctgcttctcccttacaccaggaatgaacctttccttcccactcagaggaggttctgagaggactgaggtgggcaaaccactgaggatcttcagtgggggcagagaaagggctcactgagatggggggcaacgctatggcctcagcttctccttggcgtcgtgtgcatgtgttcctgaagccgaaacggaatttaacaggtctgggtcccagatccatttccatgactggccatgggctatctatgatctgtcaaaaggggacttggattcaagctctcagatccccttccaatctaaaacagattctttttttaaaaaaaatccaaatgtgattacgtcacttcagactaaaaacttccaaaggcttcccccatttgctctgaggatcaaggccagggcaaatgggagctcactgcagcctcaacctcctgggctcaagtgatcttgatcttcccattccagcctcctgagtagctggactacaggcgcatgtccccacacccattactgccctccatgatctggtctgggtctaccctgtggcctcttctctcactctctaaatacagtcacattccttcctgcccaatggcctggaaacatgcgctttcctgaaggtaactccttccccacacttgcctatgttattcaacttttgggtttcagatgtaatgttatttcctcagagaagacttccttgacctccatataccccaacttgggctaggtctgctatgtcctcttcatagtactcaccatgatttaagtatttctgaagttaggtgatgctggtttccccagttaaccataaatccaatgagcaccatcattttcattactgtaatttcttttttttttagacagggtctcgctgttgcctaggttggagtgtagtggcaaaatcgtggcttactgtggcctcaacctcccgggcccaggtgatcctgatcctcccacctcagcctcctgagtagctgggactacaggcacatgccaccacatctggctaattaaatgtttttttgtagagatgggcatctcactatgttgcccaggctggtcttgatctcctgggctcaagccttggcctcccaaagtgctgagatcacagcaggagccactacactcaggcaattaccgtcattctaatgcaatatttattcctcaattaaacaaatgcattttattcttttttttttgagagggagtttcgctcttgttgcccaggccggagtgcaatggcatgatctcggct

SEQ ID NO: 15881 - DNA, 87470 bp, Human
  misc_feature (1)...(87470): n = A,T,C or G
ttcaggggcctcccactgtttaaggattaggttcaatttctaaacctttatccagccctgatctttcaccagatttggaaattattacaaaaaataaatcttttttttttttttttttacaaaaaataaatcttaagaaactaggaataggccgggcacagtggcccttgcctataatcctagcattttgggaggctgaggcaggcggattgcctgagttcaggagttcgagaccagcctgggcaacatggtaaaaccccatctctactaaaatacgaaagaaaattagcctggcctggaggcgtgcgcctgtagtcccagctactcaggagtctgaggcaggagaattgctttaactcgggaacctgagaggcagaggttgcagtgggccaagatcacgccactgcactccagcctgggcgacagaacaaggctgtctcaaaaaataaataaataaataaataaaataaaaaagaaagaaactaggaatagaagtaaatttccttgatttggtaaagtgaaatatcaaaatggtccctttggtctatttgatagggggcagtggttcacacttgtaatgctaacactttgggaggccgagttggaaggactgcttgaacccaggagtttgagaccagcctgggcaacacagagagacctctggcccccccctccttttttttttttttgtgagacggagtctctctctgtcggccatgctggagtgcagtggcaccatctcggctcactgcaatctctgcctcctaggttcaagcaattctcctttctcagcctccctggtagctgggagtacaggcgcctgccaccaggctgggctaatttttgtatttttagtagagaccaggtttcaccatgttggccaggatggtctcgaactcgtgacctcaggtgatctgcccacctcggcctctcaaagtgctgggattacaagcatgagccaccgcgccccgtcaaaccccccgatctctataaagcaaataaaaaaatagcagggcatggtggtgtgtacctgtaatcccagatactaaggagactcagatgggaggatcccttaagcccaggagttccaagctgcagtgagctatgatcactgcactccagcctgggcgacagagagaattgccgtccataaatgataataataacagggccggtctcggtggctcaataataatagggccggacgcggtggctttttttgtgcactcttcatgtaaagtgagttatcatcatatattgcctctattttgatgtttggttaaaatggggcacaccagtactaacttcggctttctaacaattcctacttcgcacaccatgtggcagtgttagatggcttttgggcgctcgccaaggactagacatctaccacttcttctggcctcttcgctcctatatccactgcttcaatccagaggctgtatttgaccctctgcgacctctttgtcatggcgtccgcggggcgtctaccagcggaggcttgggctggcagccgggcgtcgaccttcccaaaatggcggcggacgggacaactgcgctcaaggggcggggttccgccgccgggggcggggcgggaggccgaggggtcgggctagcgggcgggacgcttcccaagtcggcagtctcagcgcgcctgcgccgagcggccctgcgcgcagtgaggcagtggcgggggaaggcaccggtggggccgacgggcgggttgaaggagggaagcgggcgagcgaagtcccagtgcgcgccgcggcagcccgggcaccctccccttccgggcgtgagtcgctgtgaaaagagctgaagcgagcggactcgcaccggcagcgaggcgccgctcccgccgcctcagcccggccttcctcggctccggcgctccggtcgcggggcccgggttcctcggcacaccccgctccagccgcccccagagcctgtccccagcccttcggaagccccggcgccagcccgggccctcggcagggaggatgacggagctgcagtcggcactgctactgcgaagacagctggcaggtgagcaggcgggcggcggggcgccgggcccggccgcgatcgcggacagccgcagcccagtccctcttctcctcccgggccagcggccgtactgccgaaggggcccgggcctgcgagggtggggacctcgaggctccggtcccggccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttatttaatcttcacgacaatcccaccaggcaggttttactattatgtccattttacagatgatgaaactgaggctcagagaagttatgagacttgctgaagctgggatttgaatccaggaagtgtgcctccagagtctgtcttttaactctgggagcattcatttcacccactgtgtcacagaaatgatttgaattaggagaccttgggaatgaggagtgtctgttttccccttgggaagggcatctgcagattcacagagcgtctgcaggtttaaggcacttaaaacagcctgcaagtgatccctgcatgtgaggaatatgaggatatatacatatttgttgttgtttgtttgctttttgtttttttttttgagagagactctcgctctgtcacacaggctggagtgcagtggtgcgatctcagctcactgcaacctccacctcccgggttcaagcaattcttctccctcagcctccccagtagctgggattacaggcgcgcggcaccatgctcagctaattttttttttgtatttttaggggtttcaccatgttggctaggctggtcttgaactcctgacctcaggcgatccgcctgcctgggcctcccacagtgctgggattacaggtgtaagccaccgtgcccgtctgcatctttttttttttttttttttttgagacggagtcttactctgtcgcccagctggagtgcagtggcgcaatctcggctcactgcaagctccgcctcccgggttcacgccattcccctgcctgagcttcccgagtagctgggactacaggcgcccgccaccacgcccggctaattttttgtattttcagtagagacggggtttcactgtgttagccaggatggtcttgatctcctgacctcgtgatccgcccgtctcagcctcccaaagtgctgggattacagacgtgagccaccgggcccggcctctctgaattcttacataatggaaaagataaacatttaaaaggtgtgaaagaagttatgcattactaagaaagtaaaataagataacaatgtcagcagcagcaatgtgtgaaaggatttcctatccgtttgtgaaccagctctagattttgatggtcatctggttccgttttgcacttttttttgacaatgtatatagcaaatattaataaaacgtcccaaagctctttcttaatgattgactttctgatggggcatactaaaatacactttaagatagaggagagaacaatttaatttgtattttttcaggcctcattgtaaagttacttagctgcagatttaagttttcctgccttcttgatcagaaacaatgggattgtttttaatttttttttaaaatttgaagcatgttaattaacatgctcaaaatgtacaaagtagtagggcaaggcaaatgaattttaattgaaatgtaaacatatcaaatttattggaaagattcgataactacacacagtgaaataaaagccttgttttattttatttttgagacagagttttactttgttgcccaaactggggtgcagtggcgagatcttggctgatgacaacttctgcctctgggttcaagtgattctcctgcctcggcctcagagttgctgggattacagaagccctccactgtgtctggccaatttttgtatttttagtagagacagggtttcaccatgttggccaggctggtctcgaactcctgacttcaggtgatccacccacctcggcctcccaaagtgctggaattacaagtgtgagccaccaccacctttcacccagactggagcgcagtgacataatctcagttcactgcaacctccgcctcccaggttcaagcgattctgctgccccctgcggcccccagtagctgagattacaggcatgtactaccacgccaggctaatttttgtataaaatttccaaaaacttaaaacaacaatggctacatttattgaacctctagtctgtcaatccttaaggatttaaattaattacttggtagaatatatcgggtatgttttgttgataacataatgaagaatctggttactttcagaattgaacaaaatggttccttgggttgtggagtgtctcagtcttggcgctactgacgttttgggttgagtattgttgtagggcctattctgtgcattatagatagaatgttcagcagcattcgtggccttcacccactagatgccagtagcatactcccttagttgtgacaaccataaatgtctccattgccaaatgtctcctgagggacaaaatcatcccagattgaagattactgagttaaaatgtttcagagaagaccattatggctaattgttaagcaaataaagacacctaacagattcatgaaatcagataggttgtgtatttctctgtggatattattagactatgacttactcctttgcaaattgagcggtggcaattcaagttttgcagtgccttatgttaaacactaaaaaatccctcagcacaggagatacttttaaaacattttatcttttgaaaaggtattataagcattggttaaaaatgcaaagagtacaaaaaaacatagtcttttcaccctggccataagttctttttgtggaagcaacccatcattgacaaatatgtcttttttttttttttttttttttgagacagtcttgctctgtcgcccaggctggattgcagtggcccaggctggaatgcagtggcacgatctccgctaagtgcaacctccgcctcgcgggttcaagcgtttcttgtgcctcagcctcccaagtagctgggattacaggtgtgtgccacgatgcccaggcttattttttgtatttttagtagagacagggtttttgccatgttggccaggctggtcttgaactcctgatctcaggtgattcacccgcctcagcttacgaaagtgctggaattacaggcatgagccatcatgcctggctgacaaatgtgtcttttcagagaggttcttgtatgtatgtttatataggctaacgtttactgaggactaacatgtaccaggcactgtgctgagtactttatatatttattttattttatttttatttttttgagacggagtctcactctgtcacccaggctggagtgcagtggtataatctcagctcactgcaatctctccctcctggattcaagggattatcttgcctcagtctctgtagtagctgggcttacaggtgctggccaccatgcccagctaatttttgtatttttagtagagatggggtttcaccatgttggccaggctggtcttgaactcctgacctcaagtgatctgcccaccttggcctcccaaagtgctgggattactggcgtgagccaccacccctggcctctattgcattttttttttcccaacacagagtcttgttctgtcacccagtctggagtgcagtggtgcgatcttggttcactgcaacctccgcctcctgagttcaagtgattctcctgctttagcctcccaagtagctgagattacaggtgtccaccaccacgcccagctaatttttgtagttttagttgagacagggtttcgccgtggtggccaggccgatcttgaactcctgacctcaggtgatctgcccaccttggccttccaaagtggtgggatttacaggcaggagccactgcgcccagcccgtctattgcatagatgtatattttttgagacggagcttcactcttgttgcccaggctgtagtgcaatggcatgatctaggctcaccacaacctccgcctccccaggttcaagtgattctcctacctcagcctccccagtagctgggattacaggcatgtgccactacacctggctaattttgtatttttagtagagatggggtttctccatgttggtcaggctggtcttgaactcccggtcttaggcgatctgcccgcctcagcctcccaaagtgctgggattacaggcgtgagccactgcgccgggccagttttattatatagtttgttaatacacattatatgttgtgatatttccatatatagttgtgaaattaggtgcatttatcattatttaatagagtggatctagggtggaaaatctgataatccagtgactatcattatattgttgccttttgacttccttttctcaggtgaagaatgtttgattgcactgtcaagatgagtttcaatccttcgcctcttttggtcttgggtacttcagtacaatttttttgttggcaggagggtacagtgtgggcattcctttgctttaagcaagtaaagtattaattaagcactcttttaatgagatcagtttgatttaggataaataatttggcatttcttaattattgaaaccttttttttagatttaaatttttgttagaatttagatgacctctaagggtgtgtctaatgttacctttcattggtttgtaggaaataacttttcagagaaggaagtgtgggcttatggaaacaaatctggcaaggtaaacatagtgtagttttatatggttaatagcatttcaggtacagaaaagtacaaatcagaaaaagcaaacattttccaaattttggtaatgaatatgaattattggtataaacagataaatgataaagaataaaatgtagtttcaggaaataagatatttaaatgttacaataaaacattctaaactttttccccctagtgcaagatagtattgggctaatttgagttaatcagcagtttttttttttttgttttttttttttttttgagatggagccttgttctgtcgcccaggctggagtatagtggcgagatcttggctcactgcagcctctgcctcccgggttcaagtgattctcctgcctcagccttctgagtagctgggactacaggcacacgccaccacccctggatcatttttgtatttttagtagagatggagtttcaccatgttggccaggatggtctccttggcctgccttggcctcccaaagtgttgggattacaggcgtgagccatcgcgcccggtctaatcagaagtttttatcagtgctgttccattgatagattctggccctcatagaaacttctggaagaaatactgtactgtattgctgttgctgtagagatgtatacctctttttataaagttatgttctagatttgcaacaagttaatttttgtaagcggaaatattttattttaccttttatttaacctttatacccatgtccagtgacttagaaaaactgctattgctgtatctttgctttttttcctttagctattcttatttactcttctattggctagggatatgttaaaaatacaaaaaacaaagaccttaaatttttacctggcagctgtttgttgtttgtttgctttaatcttgtaaaacaagactgcttttaagtaagtttatcaaataggaatttttaaaaaagttctttatgtcaggagacacttttccttttatcaaataggaatttttaaaaaagttctttatgtcaggagacacttttcctttgcttttgaatgtacatgcattttaattacattatcatattcttatgtaaggtatatattttctagggtttctatgttaagacagagtaatgctaggcaaagagttctttttccttttttttttttaattttatttttttgagatggagtttcgctcttgttgcccaggcttaagtgcagtggcacgatctcggctcaccgcaacttcttgccacctgggttcaagcgattctcccactgcagcctcccgagtagctgagattacaggcatgggccaccacacccagctaattttgtatttttaatagagacagggtttctctatattagtcaggctggtcttgaactcctgacctcaggtgatccacctgcttcagcctcccaaagtgctgggattacaggcgtgagccacgcgcccagccaagttctttttcaacttgatgccaaaagcatgagccataaaaggaaatattagtaaactggacatcatgaaaattaagaatttttacctgattaaagactgttaagaggatgcaaagacaagctacaaactggaagaacatttgcaaatcacatatctggcaactgattgtatctagaatatttaaagaaccctcaacagtttaaaaaaaaaaagtcaattcaaaaaaatgggcaaaattagacaggtgtggtggctctcatctgtagtttcagctactagggaggcttgaataggagcatcgcttgagatggggattttgaggcggcagtgagctgtgacttcaccaccgctacactccagcctgggccacagagcaaggccctgcctaaaaaataagggcaaaagacaccaagaaacatttcactgaagaggacatacaaatagcaaacaagtgacaacatgttcaacattattagacatcagggaaatgcaaattgaaatcaccgtaagatatcactacttacctgttagaatagttaaaattaaaaaaactgtaacactaaatgctgccagggacttggagaaacttgaacttttatacattgctggtgggaatgtataattgtatatccactatagatagaaaacagcttgcttttttttttcttttttaagagacagggtctctctctctttgtgtctacatatatcttttaaaaattttttataaaaatagagatggggtcttgctgtgttgcccaggctggttttgaactcctgggctcaagcagtcctcctgtcttggcctcccagaatgttgggattacaggtgtgagccaccacatccagtctattttttttgttttttttgagacagagttccgctcttgttgcccaggctggagtgcagtggcgggatcttggctagattgtccttctttatgggtggtcttggcacctttgtataaaattcttgaaatgacagaattacagtgatggagaatagtggtgttcagggatttagggacatgagggatatgtggtatacagtaacatgagggatctttgtggtgatgaacagtcttgtatcttgatagtgattacacacatctgcaaatgtgataaaattgcatagagttatacacccacccaccccccccccccacacacacacacaaccgagtgatgacatctgaatacagtagtcctcccttatctgcatgggataaatactttccaagacctccaggggatgcctgaaaccactgatagtcctgaaccttgtgctttctcctatatatgcatacctatgataggatttaatttatgttagtctaacaacaataataacacagagcaatgataacaatatgccggcattactactcttgcactctggggccattattaagtaaaataagggttacttgaaaccaggcactgctaagtgataggcaggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcccagagtgactcacgcctgtaatcccagaactttgggaggccgaggcaggtggatcacctgaggtcaggagtttgagataagccatggccaacatggtgaaaccccatttctactaagaatacaaaaattagctggtcgtggttgcacatgcctgtagtcccagttgcttgtgaggcaaatcacatcaaatctttgttttgttttgagacagggtcttgctctgttgtccggactagagtgcagtggcaacatcaaggcccgctgcaccctccacttcctcggctcaagcaatcctcctccctccctccctatagctgggactataggcatgcaccaccacacctggctaatttttccttttgataaagtcttgctctgtcacccaggctggagtgcagggatgtgatgatggcctactgcagcctcaatctcccagacccaagtgaacctcccaccttatctgcctccgtagctgggactacaggcacgcgccaccatgctcagcaaattaaaaaaaatttttttttggtagagacagggttttgccacgttgcccaggctggtcttgaactactgggttcaagcaatcctcccaccttgaaccatgtgtcaaatctttgccccagccaaatatttgaagtaaataaagaaattgggtaatttctccaatctaaccctcctaaatgctgatggagctggctagtagaaacagttttattttctgataaaactcgagccctttccttctcagccttctcagagtttattttttttcttttgggagttcttagtttcctttgagaatctagcaagagttaaaagacctcctgagaaaagcacacatgcataatttggtatgtaatttcggagggttctttgatctgtggagtgaagctcatttatgcagatctaatgctgtctcttaaatcagcaagtttgatgcccattttgtgtactattgggatgctgttttggtgtttcaggaacttgtagtctgtagaaaaataaaagttccataatacagctgctttagggttgttattacagaaaaagtcaagagaagctggcttctaccagtctggttcatggagggctttgaggaggagttcatggcacttgtgcttgacctttaaaagatctgtcaaatttgacacacagaaaaaggaaaatatttaaggctgagggaaaagaacaagcaagacaaagtttatgctgaaagaagttgtgtagttggagtatatgataaactgaactagtgggaaaactatctggaaaggttgacgtttgtggaagaccttaaaaatgctggggtaggccaggtgcagtgactcacacctgtaatcccagcactttgggaggccaaggcaggagaatctcttgaacccagaaggcagaggttgcagtgagctgagatcacgccactgcattccagcctgggtgactgagtgagactctgtctcaaaaaaaaaaaaaaaaaaaaaaatttgaccgggcacggtggctcacgcctgtattcccagcactttgggaggccgaggcaggtggatcacgaggtcaggagatcgagaccatcctggccaacacagtgaaacccgtctctactaaaaatacaaaaattagccgggtgtggtggcacgtgcctgtagtgccagctactcgggaggctgaggcaagagaatcgcttgaacccaggtgttcaagaacctcttgaaccgaggttgcagtgagccaagatcgccactacactccagcctggtgacagaacaagactctgtctaaaaaaaaaaaaatgctggggtgtgacattatatgtgtgtgtgtgtgtgtgtgtatatatatatatatatcaacgaaactctatatatatatggggtttcgttgatcgacactagtttatattagttggtaatacaatatagctacttcaccacaatattatacacattcttcccccttcttacatatttttcttttccatttacttgtttaagcaagtgacacttgttgagacaccttcagtgtctcatcaaggtccttatttttctttcaaagtttttgttgttgttgttgttgttttcgagatggagtctcactctgtcgcccaggctggagtgcagtggcgtgatctcggctcaccgcagcctccgcctcctgggttcaagcaattctcctgcctcaacctcctgggtacgtgggactacaggcgcccgccaccacacctggctaattttttgtatttttagtagagacggggtttcactgtgttggccaggatggtctcgatctcctgacctcgtgatccgtccgtctcaccctcctaaagtgctgggattacaggcgtgagccagtgtacccggccacacccggctgatttttgtattttagtagagacggggtttctccgtgttgcccaggctgatcttgaactcctgagctcaggcagtctgcccgcctcggcctcccaaagtgctgggattacaggggtgagccaccatgcccggcctcatacaaaatatttttgaatgagctggattcaaacattttctctgtaggaatggtgaaaatgtcattatcaggaaaatgatctagctgtattatctataatacagccaccacgcccacccctgaagtattttctttaatgaacaactctgtcatgactatagcttttctgtataatttaaaaaattactacaaaaattaacattgttttcttcttggcttttcctcccacatctctgaagttcctgtctggtcctctgccctagcagccttaaatttcctacccagctttctgaccgtagtttccaaaagagaatactaagtttcacttatttgcaatagcagaaccaagacagctagacttcattaatcttcaaacttgtcatttaacaaagtttaggcctggtgcagtggctcacgcctgtaatcccagcactttgggagactaagacaggaggatcgcttgagcccgggagttggaggctgcagtgagccatgagtgcatcactgccctccagcctggttgacacagcaagaccccctcttagaaaaacaatgtttaaattagatctacatagagaatgaatataaaattaatgttgatacgatgatcccttttctacttaggtcctggggagcctgtggggtcatatgatcctttgattttgtcactttttttgaggatgtgtcaaatatatttaaaagacggagtttcaccatgttggccaggctggtctctaactcctcacctcacccgcctcagcctttcgaagtgctgggattgcaggcgtgagccactgcacctggccaagaccaccgcattttataccactgcacactgtctgttaaactctgaagtctttgtaacttttggaaggggaactaataactattggtgatggccgcatctggtattttgagtctgtttgccatcttttgggctttaggattctaaaactaaattacttatttaaggtttatatagagagaggagtgttattccgaggtcttccttgatactctttcaccctaggtaaacagaggattgtatttccctatttttttgtatttagcagtgcgtaaggtttatattatcctcattagtactttaggctgtgctaatttcttttttctgttcattcttttttcttcttttacttggcactgacaaagctcagaataatttctgattttcagactgctgtgaacatttatggtatgatagttcccctaggaaaatactgtatttttgctatcttctctggttatttctacatctctcccttaggatgacacctttgctcttcttctgccctgagcatttgccaaatggatacaacaaaattctcgttatccagtttggtttatatttaactcttgcaggtgcagcagtggcacagatgagggtattgtgttgcctgctaccctcttcagcctctaagccatatggcatggctattggggaagcaatatgactgtgataggatttttgtttttaaataaacctttttagaagagtttcagatacacagaagaactgtgagaatagtacagtgagttcttacataccctgcattcagtttctcttatttttaacctttcccccaccccccagcccccgtgagacagtctccctctgtcagccaggctcactgcaacctctgcctcctgggcagaggtgattctcctgtctcagagtcccgagtagctgggattacaggcacgcaccactacacctggctaaattttttttttttttttttgacgaagtcttgctctgtcgcccaggctggagtgcagtggtgagatctcgggtcactgcaagctctgcctcccgagttcacgccattctcctgcctcagcctcccgagtagctgggactacaggcgcctgccaccatgcccggctagtttttttgtatttttagtagaggcggggtttcaccatgttagccaggatggtctcgacctcctgacctcgtgatctgccctcctcggcctcccaaagtgctgggattacagacgtgagccaacacgtccagcctcatactatttttaaatgagctggattcaaacattttctctgttggaatggcgaagacatcattatcaggaaaatgatatagctgcatcatctaagagtgatttaaatagataaattataacctaaataattacgtctaagttgctgggtgcacatttttacaattagtttaatttggagactgacactgttcagagccagatgttctctgaattctttattatttattttgaaatgttcaaggtgatacttagttttaactgccttgacagtgttcttttttgttttttttgagacagggtcttgctctgttgcccaggctggagtgcagtggcacaatctcagcttactgcagcctctgcctcccaggttcaagcaattctcccacctcagccacctgagtagctgggattacaggcgcaccaccatgctcagctaatttttgtatttttggtagagacgaggtttcaccatgttggccaggctggtcctaaactcctgacctcaggtgatccacccttctcagcctcccaaagtgctgggaatacaggtgtgagttaccacgcctggccaacaatgttctaagttagttacattagccataatatgtaagatagaaatttgctcatttgtatataagaagattctgaaaaagttttaagcgctgggtgcagtgacttaacttctgtaatcccaacattttgggaggccgaggcaggaggattgcttgagtccaggagttttgagaccagcctgagcaagatggtgaggtcccctctctcccactttgaataggtatgctataagtaacaggcctttgaaactcattttgggtattgtgaagatgttatattacagtgtccttttatttatttaatttgaggttaaatgtaatttttttttttttttgagacggaatctcgctctgtcgccgagactggagtgtagtggcgcaatctcggctcactgcaagctccgcctcccgggttcatgccattcttctgcctcagcctcccgagtagctgggactactggtgcatgccaccacgcccggctaattttttgtatttttagtagagacggggtttcaccgtgttagccaggatggtctcaatctcctgacctcgtgatccgcccacctcggcctcccaagctgctgggattacaggcgtgagccacagcgcctggccaattaaatgtattttatttttagacaactatgtgacgtgtttttttttaaaaacaatgcctccattccaaatcaaaataaatgaagagttcaagatgacatcagttccatttgttttaagttctggtgttgtgtgaatgacaagcagcagccagttatgacggcaggtgatccaaagtaattgccaaatttgttaacatttttccatctctaaaccatccttaaagaaaaacatatatggtgtcacaccattctcatggtagtcctaggctggagtgcagtggtgcaaatttggctcactgcaacctctgcctcccgggttcaagcaattctcctgcctcagcatcctgagtagctgggactacacgcatgcgccacgacatctggctaatttttgtattttagtagagacagggtttcaccatgttggtcaggctgttttcaaactcctgacctcgtgatctgcccacctcggcctcccaaagtgctgagattacaggcgtgagccacctcgcccagcctaatttttgtattcttagtagagactgggtttcaccatgttggccaggctggtcttgaactcttgacctcgtgatctgcctgccttggcctcccaaagtgctgggattacaggtgtgagcgaccgtgcccggccctattattattaattaattaatttttatttttatttttatttttttgagacggagtcttgttgtgtctcccaggctggagtgcagtggcataatctcagctgactgcaacctctgcctcccaggttcaagtgattcttgtgcctcagcctcctgagtacctggaattataggcacatgccaccatgcctagttaatttttgtattttagtagtggtggggtgtcaccatgttggccaggctggtcttgaactgctgatctcatgatctacccacttcagcctcccaaagtgctgggattacaggcatgagccattgcccccggcccgttctttaatttttttttttttttttttgagacggagtctcgctctgtcgcccaggctggagtgcagtggcgggatctcggctcactgcaagctctgcctcccggattcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctatttttttctttacagacagggtcttgctctgtcacctagactggagtgcagtggtgtggttatagctcactgcagcctcagcctcctgggcttaggtgatcctcctgcctcagcctcccaagtagttgggactacaggtgcacgccattgcgcctggctaacttttaaaatttcttggccaggtgtccactaatcttaatcgtttctagcgtttgatttagagtgagaccacttgaacatttagaggccattctagggttattatttgacttaatttcagtattgttgtgtctcaggataattgggagtcctgagaatcagggagacagacaggaactggcagttggtggagcagtcagaacacacacaacgtttattaagcttgctttctcatatgggcacaattcgtggtgccccaaaacaattataatagaaaaaccaaagatcactgatcacagatcaccataacaaatatagtaataatgaaaaaaactggccaggcgcggtggctcacgcctttatcctgtcactttgggaggctgagatgggtggatcacttgaggtcaggagtttgagaccagcctggtccacgtggtgaaaacctgtatctactaaaagaatacaaaaattagccagacatggtggcatttgcctgtagttgcagctatttgggaggctgaggcatgagaatctctcaaacctaggaggtggaggttgcagtgagctgagattgtgccactgcactccagtctgggtgacagagcgagactctatgtccaaaaaaaaaaaaaaaaaaaaaagaagaaatactgtgagaattaccgaaatatgacacagagacatcaagtgagcacatgatgttggaaaaatggcactgatagacttgcttgatgaaccttcaatttgttaaaaacacagtaactgaagtgcattaaaacaagatgtgcctgtgaatgaaacataaataaattttgtgtttaatagacttgggttacatttccaggatgtctcattatgtgtatgcaaatattccaaaatctgaaatccagaatgtttttggtcccaagcattttagataagggatactcaacctgtggtacatttattattatttttttgagctggagtaacttctgttgcccagggctaagccatgttattggcaatgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagaatgaggcgggcggatcatgaggtcaggagatcgagaccatcctggcaaacaagtgaaaccctgtgtctaattaaagtacaaaaaattagccgggcgtggtggtgggcgccagtagtcccagctactcagaaggctgaggcaggagaatggcgtgaacccaggaggcggagcttgcagtgagccgagattgcgccaccacactccagcctgggcgacagagcgagactccgtctcaaaaaaaaaaagaaaaaaggtttgaagaagagtatagtgaaatgccacccaaaccaaccttcatatatatgaaaagagggcttggacataaaatttttttttgagatggagtctcactcttttcatccaggctggagtccagtgtcatgattttggctcactgcaacctccgcctcctgggttaaagcaattcttctgcctcagcctcccttgtagctgggactacacctcaggtgacccacccacctgggcctcccaaagtgctgggattacaggcgtgagctaccgcgcctggcctggacttgttattaatataaacttttagagcctttaagccataggatcatgtaaaaattaccttatgttggtactttgaatttaaagtgctggcagatcacacataatcttcaaattgaattctacatttaacaaatatttgagtgcctacttttgtaaacatagcagtacattaaagaacaggacatgaaagttttgctggtacaaagttttgcagttattgtgggaagacagatggtaaactagataattaaattaaaaatgtggtgtattaggtagtgataagtgccctggagagaaaataaagcggggaaagggaatgaaaagttgagggtggagtactgatgtcttgaagagctttccaggccaagagaagaacagtacaggggcgctgcagtgggagagaggcctggcaatgtcagaggagcagcaaagggtgtggaggggaggctgtgtgattttttacaggtaaggatttaggcttttactcagagtgaggtacccgtgaggtttttcagcactggagtgatatgacctgatttacattttaatgagatcattcttggcttgctatgctgagaatatagactgcacggagagtcagatgagacatgatgctagcttggacctgtattggagccgagaacaaagtggtttaattcttgggtgtatttcctaaatagagctgttggaatttgctggtggaatagaattcttttctttttctttgaggcaggatctcgatttgttgcccagcaggagttcagtggcacaaacatggctcaccacagcctcgaacccctgggctcaagcctcagcttccccagtagctgggaccataggcatgcaccactgcgcctgactaatgtttaacattttttgtagaaatggggtctcactttgttgtccagcctggcctcctaaaatgctgggattacaggtatgagctactgcgcctggcctagaaggaacacaatatttgaagggtagagtgtgtgagagaatgtgtcaaggatgatttcagggtttttggcctgaacatctgaaaggatggagttgacattaactgaaatggaaaagaaagacgcaggacaaggagagataatcaggggcttggttttgaatatgctacttttgatttgtctattagacactgaagtagagaagtcacataggcagcttactatatttgatctggaattcagtgaggaggtttagcttagagatataaagtgggaaattgttagcatatggattgcatataaactatgaagttggatgggctcaataagggagtaaatgtagataggtgaagaagattgaggactaagtcttgggacacactggcattaagaagccagataagtaaccagaagctagtgaaggagtgtgagcggcgtcagtgaggtgtcagaggaggcaaaccagaatgctgtggcctttaagccaagtgaagaaagcttcaagggaagagagatcagctgtgtcaaaaaagagtttgggtaagataaggactgatgagtgaccactagaggtgaatggtactttgagaaaggcagttgcactggacggattggtatgagcctgagagaatggaaggagagcagcaagtggagataaggaatgaagacaactcttaaagttgtaccgtgaaggggtgttgagaaatggtgcagtaactggagggcttgtgggcttcatttgtgtatgtgtctgcatgcgtgtgtgtgtaaagttggagaattgctagtggcatgcttgatgctgatgggattgaatttagtagagagaagaaccgatgacacaggagagggtaggaatttctggagcagtgtctttgaggacatctgagtgggaagaatgagatcagatctaattactggccagtttggaagccttattaggagcaagggcagttgatccagagtaacatgagagaaggtagagaagtaaatacatcggcagagattcaggttagacgatatgtctgggtaaaatggggaacattttcatacttatctcatgatttttgtgagtattaagtttaatactttataaagggatgattacagaacatagtacccagtaagcgttgactgaaattgttaagtttgtaatatttataaagttacaatgtgatttgcatgaccagcttctttcagtgtgtgactaatactctgaaaatactggcttttcatttgagccagatggctcagtcagtaatttctagttatgccatctttttttttttttttttttgtaaagacactgggcaccaaaggtgctactcacacagaatatcaacttaaaactcaccctggaaagacaagattttcatagttctaatcagaaacattgtaattttgttatattcatgttatggttttgaaggttttgttttttttttttttttttaaatacgtgaattaaggggccgggtgtggaaggccgaaatgggagggtcacttgagaccaggagttcaagaccagcctggtcaacattgtgagaccccatctctatttaagaaaaaataaaaaaaaatagtatgttgggtattagtttgttctcatgctactataaagaactgcccgagactggataatttataaaggaaagaggtttaattcacagttctgcatggctggggaggcctctggaaacttacaatcatggcagaaagggaagcaaacatccttcttcaacatggcggcaggagagagaagtgcagtgcgaagcggggaaaagcaccttataaaaccatcagatctcgtgagaactcactatcacgagaacagcatgggtgaatgcccccatgatctaatcacagcccatgaggtccctccctcaacatgtaattgtagttttaggaccagttgtaaagttagtgcagataaagtgggaacattagaaggagagttggaaccgggagatgcttggaaaatctactcaaactctcactggatttaagtatattcctattttgaaaattcagtagctatgttctctaagaacatcagaacctcagtatcagtttagggcaagacggaggatgcaaggatgaaagaggggatataaataagttttattaggttgggcatggtagctcatgcctgttaccccaacattttgggaggccaaggtaggaggatcacttgagcccaggaatttgagaccagcctgggcaacataggggagaccctgtctctacaaacagttaaaaaaagccatatgcacctgtgttcccagctaatcaggaagctgaggtgagaggatagcttgagcccacagccagggctgcagtgagctatgactgcaccactgcactccagcccgtgcagccccaggctgagagaagtgagactccatcaaaagaaggaaaagaaaagaaaaaggaaaagagagaaggaatacgttttattgttattttaggaaaatttggctttgactttttttttttttgagatgcagttttgctcttgttgcccaggctggagcgcaatggcatgatctcggctcaccgcaacctccacctcccgggttcaagtgattctgtggcctcagcctcccgagtagctggcattacaggcatgtgccaccacctgcctaattttgtatttttaatagaggcatggtttttccatgttggtcaggctggtctcgaactcccaacctcaggtgatccgcccaaaagagttaagagcttgagccaggcgcggtggctcacgcctgtaatcccagcactttgggaggccaaggcaggtggatcatctgagggtaaggagtttaagaccagcctggtcaacatgctgaaaccccgtctctactaaatacaaaaaattagccgatcgtggtcgtgggtgcctgtaatcccagctacttgggaggctgaggcaggagaattgcttgaagccgggagtcgaaggttgcagggagccaagatcgcaccactgcactccagcctgggcaacaagagtgaaattccgtctcaaaaaaaaaaaatagagaagcgcttgggtctgaacccacacattgaggctccagcaattaggcacttaacctctatgctatgtggcctttctaaaataaaataatagtaaatataacccaagaagaaacttaaaaggtgtcaatcttccacaaactcaggtttaatctcttgatctaacatgatgttaatgtcgaaaagaaaaagcgttcgttgttactgttgttgaaaaattttcataaaatgtaatatacattcctgatattaaaaggaaagaatacctgtaaaatagaggtggataataccattactatggtatnnnnnnnnnnnnnnnnnnnnnnnnnnnnnnnnnnnnnnnnnnnnnnnnnnnnnnnnnnnnnnntaataccattactatggtattgtgactgactgagtactactcccgagcggtaccagtcccagacatttcccctgagcagggagtagtgctcggtcagtaggcactagcaccgtcattgtacaggtcgttaagatacttgccccttccttggttatctagccgctgaagggataattatgtttggcacaaagaggatggtgctgcagcagagcctagctctggcattttttctgattgatcggcatctattctatacctgctgttaaatattttgactctcactccagatcatcaaattgttttgagagtaaatgagttgaagcatgcatactgcctagctagaccagtgtctgagataaatataatacagagtttgctattataatttagaatttttattgagtatactctgctgtctatacacagttggcttaggaaatgaattgggaagcttttctgtttcataggatagtttaataaaagaattacctttgaaattacctttacttactatgaaaatgtctgggactggtatttggagttgaggggggagctaactgtgtaacttatgcgaatcttcggaagttattggagtgttttctaattctgttagatgcttttgacaatttatattttcccagaaaatcatccattgtatctgtgtttaaaatttagcagcttaggatttactggaaacatattttatacttatttttatttcttctctattatcttacttccttttcagtccctaatttcatataattgtttttttagtccagctaatagtttgtctgttttttttcccctcccatcaaaatatagcgcctaagttgttttcgtttttttttttttgagatggagtctcgctctgtcgcctaggctgcagtgcagtagcgcgatctgagctcactgcaacctctgcctcccaggttcaagcagttctcctgcctcagcctccccagtagctgggactacaggcacgtgccagcatgcctggctaattttttgtatttttagtagagatgggttttcaccatgttagccaggatggtcttgatctcctgacctcgtgatccaaccgcctcagcctcccaaagtgctggaattacaggcatgagccaccgttcctggctgctcctaggttttagaattaattctgcaggcttctgttatcttacttgagtaactttgaattcccttgttcttatttttaaatgtttattttctaaccttgagttgaatgctcatttaattcttgctcagttgaaggtgtttaggctgtggctctcttcctctgagtatagctttattagtgtaccaaagatttttttctcttctttttattttttcttttctttttttttttttgagaccgagtttcgctcttgttgcccaggctggagtgcagtggcgtgatttcagctcattgcaacctccacctcccgggttcaagtgatcctcctgcctcagccttccgagtagctgggattacaggcatgcgccaccgcacctggctaacatttgtatttttagtagagtcagggtttcaccgtgttggccaggctggtttcgaacccctgacctcaggtgatccacctgcctcgacctcccaaagtgctgggattacaggcgtgagccactgcccccagccttctttttccttttctttctttctttcttttctttttttttttttttttttacacagattagagtgtagtggcatgaacacgactcattgcatccttgacctcctgggctcaagggatcctcccacctcaacctctcaaatagctaggacttcaggcacgcgccaggatgcccggctaactttttttattgtgtgagccgctaggcccagtcgtaccagagatttttatatgggcagtttttatcattgttattttctaggtaatctctattgattttgatttacattactccattcaattacttgaagtaatttaaggagagagagtacataaatgtcaagtctactgcattaaggggagtagcttaattgtttcattgtcagattgtatagactatttctactttcctgaaatttttgaggtgttaatggcctaaattgatgatcagtttttataactgttgcatagagacttgatctcattctttcatatgttcagccattttgtcgtttatgtatttgatctttcaggaaatgatactcttatattcttacttctgcctaaaagtttttcttagatttctttgaaatttttgttctggctgggtgcggtggctcacatgtaatcccagcctggccaaaatgatgaaacctcccctctactaaaaatacaaaaattagctgggtgtggtggtgcatgcctgtaatcccagctactttggaggctgaggcaggagaatcacttgaacctgggaggtggaggttgcagtgagccttgcaccattgtacttgagcctgggcaacagagcaagaccctgtctcaaaaaaaaaagtttttgttgtaactatatattatgaaaattttggtatatatagttttataacatatctttatagattgtaatcttgatcattataaaaaatgacccttttctgcctcctttaatattctttcagtttgaattcagctggttttgaaagggtgttgatgcttgctatgtatgcttttatctaaccttttactttaacttctcaaagtctctattttagatttgtctcttgtagacccttgtagttggataaaggttagtcttgactcaatttgagatgcttttaatcatttacattaatgttatatattttgctttgcttatataatattagtgtatttgttttgttgtcatctatatgtttgcttttggttttctttcttttcttttctttttgagacagtctagctctgtcgcccaggctggagtgcagtggcatgatctcgggctcactgcaacctccacctcccgggttcaagcgattctcctgcctcagcctcccgagtagctggaattacaggcgcctgccaccatgcccggctaatttttgtatttttagtagagatgggatttcaccatgttggccaggctggtctcgaactcctgacctcaagtgatcctcccgccttggcctcccaaagtgctgggattataggtgagagctacagtgtctggcttggttttcttcctttaaactacatggtttgttttctttatttgctatcccttctgtctcattttgtaagttatatactgtatttcgttatgtctaagataccgttggtggttgtgtgcttcgttattttgtataccattaatacagttaaatgctgtcaaagaaactatgacgtaccattgattgaaatatgcatgctgatttcagatagacaaaaatgtgaaaaaggtacatcttagaatagattaaacatggtagtttgtagttctatgggtattataaagctatagctttaatatatttaaatctattatgtttatcaaatagttttttcaggagtggttgtttgagtgctcttatgttcaaaaatgtctgttagtggctttcacaagcaacgtgatgttttggctggttacagaatttttgggttacgtttccctttctcttaatacccagcagacactattccattatcttctggcatctagggttactctagagaagtctggggccagcctgactgtttttttccctttgtaggtgacctacttctgcctgagtattgctagaattctttctttatccttgaagttcagtaacttcatcaggatataactcggtcttggtgtgattctcttacattttcctgttaaatggtaagccattcaaactgcagattcaggaatattttcttatacaccttttaatatgcattcatttttatttttctttactcaagaaacatcagttttatgattgtttatcttcatttcctgtcttccatttcattacttttctaaatgcttcctttgttcttttctgctgtgctcgatgtgattttcttgagattttgtttgatatcatgtttgttttcatcagtatcaggttgactacttcctatatatgatggggttttcattttgccagtggcttcagtacttcattcaattttatatatttatgtctgtgagttgctctttcaacttgtctcatttatttcctcttttaaaaaaaacttttacttaacagtaaaaacaggtaaaaccacctgtaatcccagcactttgggatgctgaggcgggtggatcagttgaggtcaggagtttgagaccagcctggccaacatggtgaaagctgtctctactaaaaatacaaaaattagcccggcgtgttggtgggcgcctgtaatcctagctactcgggaggctgaggcaggagaatccgtttgaactggggaggcagaagttgcagtgagctgagattgtgccactgcactccagcttgggcgacagagactccctctcaaaaacaaacaaacaaacaggtaaaaccacattgtttttgagaagatgggttaaaaccagttacaagtgactaatattaaaatttactctctaagaagtgatgagtaaaatggttttatcaagtcttgtgttttattaatggcatgaaatatagaaaagcaggcttagagatactattttttacagttggataaacttttgtacacagtagaaatctgattttgccatgtgtttttttgtttatgagggagaagtgttcaatgactttttcccaaagatttttttttttcattcagtgaattacaaaatgtgctagaaaaatataatggaaatgtaccttgcatggtggcttatgcctgtaatcccagcactttagaaggccaaagcaggtggatggcttgagcctaggagcctaggctgcagtgagccatgatcatgccattgcactccagcctgggcaacagagtgagaccctgtcaaaaaaaaaaaaccatggaaattataactgacatgttctgccattcacgtgccacaattcaagacctgctatgtgattttctcctgaatgccagtctttgttttcttctgaggaaatgaaggtgatcagtgataagccccctggtcttcattcagggttgaagggaatagtgaaaactgtgaacgtgtacaacttgtggttactaagagtgagactttgactgcgaattaggcaaaaggtgtaagtcttttactttttttttttgagacggagtctcactgtgtcacccaggctggagtgcagtggtgcaatctcggctcactgcaacctctgcctcctgggttcgagattcccctgcctcagcctccccagtagctgggactacaggtgcgtgccaccacacccatctaattttttgtatttttagtagagacggggtttcactgtgttagacaggatggtctcgatctcctgaccctgtgatccacccgcctcagcctcccaaagtgctgggattacaggtgtgagccaccacacctggccagcgcccagctaatttttgtatttttagtagagatggggtttctccatgttggccaggctggtgtcgaatttctgacctcaggtgatctgcctgcctcgacctcccaagtgctgggatcacagacagagccaccgtgcccggcccgtcttttacattttacatattttagctgtttagggaacagcttcgcccgtaagtttttttcttctcttcttttaaaatgatggctgagatacacacattctttacattacttttgatgtgaacgaaggtcatttcagtagacttgcacatttagagtatgccagcaacttactcaatattgcgataggtggaatttacggtctggcgtctgaattgtagcttatcctcaaccatcaaaattcctacccaaatttcttgtgttccaaacttaagaattgttgtgtttcattgccaataacatggctttttcctaaagtgatacatatttttaagtaattcatttcttgggcaaatatttactgccagagactgtcacaggtcctggggctatatcagtaaataaacaaaaacccttgttcttatagagcttgctttgtagttagggtaggggagagaagaattaatagaaagtgtagagtgctgtgtggaaactagaacagggaaagaggataaaataaggagtgtgtaagggggtggggtttcattaaaaatagggtgacagtggaccgaggaactcaggtgaatgagtgaatcatgcagaggttaggtgaggcaagcacaagggccctgaaatggggctgacctgaacgctggagggaggtggcagagcggttagctgaaggttggagagagatgctggttaaagcccctgaacgctggagggaggtggcacagcacttagctgaaggttggagagagatgctggttaaagcccctgcggtggcagagcggttagctgaaggttggagagagatgctggttaattctgaaggaccctataggccatcacacaggccattgctctgagtgagaatgggaagctgttggtatagtgacatgatgtgactcacatttttccaggattacttctgcctgctgggttgagagtagatacaatagggaaggtattttccatagtaccccagcacatgcatttttattaaacatttgtggctgaaatgaaagcttcaccaacaataaccctattttattttttgtttctgttaggaaaaatgagtgctggttatgttccactagatctatttcatgactgtgtgacttacggttgaaaaacactgccaaatagaatatagcctctgacttagtggacaagaagtaaaattgaggtttgtgtatgaaagcaaagtgaacacaatgtaaaataaaaaaagaataaaaacttaaaaatcaacattatgtatatgtatatatacttagctttaaaaaacccaaataatcaaataccagtgattcaagaggcctaatagtgaacaatgcattcagtgaaggataatgaagaattccccagaggcaactgctttttaaaaccttttaggttcagatctcctgggggcttaactccatgcttctaaataatatatttatagtgtttatgttttggtttatcaactttagacattctctgttgacttcttgctatgacagatgttttcagtcccacttctcactactgatctccctcgtacgacggtcactgaactggcgcctctctggggttctgcccagaagattagccttcctccttcgctgcagctcctctgtgagtattctgctctctgctccctccactctgcttactcagttcacgttcttccatccgttttcatctttcagagccatgggcaatccacctggtctttttaatatactttaaattaaaaagttattttttaatttctttagaaaaatttatttaacttcttaggagggaagaggagataagcacatgtgcccgcactgacaccttgaactagaagacacgattaggccaaagctttttgttgtcaaaagtgtgtagtgtatgtgttttaagagttagatatattcagaatatcttatcttttaaaaattgtaaatatttccccatgtcctgaaatattcttgtaaagtattttaaatagatgcatagcattccttcatatgctgctactatcatattccccacatcttgacttctgggttttcaaattatagttgtaaaccacttaaattataattagtgcttctgtggattttccttatgaaaacatttatacataatccttgattatttctcttcggataaatttctggtcatttcttagttaaggaaaataaatatttttgaggttcttcataaatattactgattgccttctagaaaggctttgctaatttgtatttccactattaactgtatcaaagtgccactttttattgtgttcttcataccaccaggaactttaaaaaatgtttgattctgctaggtaaaaagaaaattattttaaaaattcccaagaaaggtgaacaccttgacagtttggaatgtgtgtgtgtgtgtgtgtgtgtgtgtgtgtggttttaaaggtttataagagtaattatttgccttttaattttttatggctattttggcatttagaaattttatttttctggccagggcacagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccgcctcctgggttcaagcaattctcctgcctcagcctcccagcagctgggattacaggcatgtgccaccatgcctggctaattttgtatttttactagagacagggtttctccatgttggtcaggttagcctcgaactcctgacctcaggtgatccgcccaccttggcctcccaaagtgctgggattacaggcatgagccaccgcgactggctgaaattttatttttttaaaatcatccagctaagtaggctttcccatttatttattttttgacacttagagtaatgtttcccattcctaaaatcaaataagagtatgcaaaatgtgaagatagctttgaatttggagtggcgtatggaaaagtgcctgggagaaacttggcggcagttgatttagaaacaattaggctttggcttgtgttaaaaatctgtggatcatttagattttcgattgttgctgtccccatgtctcctgttgccccatactatagatggtgttaaattgttagacacttccatgaatgtacttcatacatgtaaaacttcgtagatgcatgactcatggctctgggtggtctagctaaactagtcttttacgtcatacgtgtaaaactttgtagatgcaataactcatggctctgggtagtctagctaagctagtctttccactcaaagagcacgatacttaagctttctcctggtgagtcatgaattgtcatcagggaatttctcactgtttggcttaattcgattaggaactgctactggtgatagtttagtccttatttagttttagtctaagagaaccttactgacgttactataaatctaaaaaaaaaaaagcatacctttaaaaaagcctaatggcaatggactagtcaggatagtaagaaaaagttatactggaaagagagagatggtttatgaattggttacaaaaaatacatcagtattattttgaagacaaccctgatttcagtcatggttgaaatccttaaccaaccacaaaaatgtcttacattttaaatatattaaagtccttaaattatggaaatagtgtcttctaagaagttgtttaatagtggaaagaagagtctcagtctcttttttttttttgagacagagtctcattcacccaggctggagtgcagtggtgccatctcagctcactgcaacctctacctcctgggatcaagcgatcctcctgcctcagcctccccagtagttgagaccacagacacatgccaccatgcccggctaattttttttttgagacagaatctcgctctgtcacccaggctggagtgcaatggtgcgatctctgctcactgcaacctccgcctcccaggttcaagcagttctcctgcctcagcctctggagtagctgagactacaggcacactccaccacgcctgactcattttttgtatttttgtagagacggggtttcaccatgttgcccaggctggtcttgaactcctgagctcaggcaatccgcctgcctcggccttccaaagtgctaggattacagaagtgtctttttttttttttttttctttttgagacggagtctctctctgtcacccaggctggagtgcatggcgcgatctctgctcactgaagctccacctcccgggttcacgccattctcctgcctcagcctcctgagtagctgggactacaggcgtccgccaccacgcctggctaattttttgtatccttggctaattctttgtatttttagtagagacggagtttcaccatgttagccaggatggtcttgatctcctgacctcgtgatctgcccgccccggcctcccaaagtgcggggattacaggcgtgagccaccgcgccccgcccaccattgtcatgttgttagtgcagcacagaagcccatcaagtggcagtcaataatttcctaatttgtttttgaaaaaaacttagctacattccaattttctacgtgcttaggtttcttttataagtttgaataaatgtataaataacttcagggttgttttatgggttcttggtacctcacacagataaacttgtaaatggaataagatgtagaggaatgcaaaagaagctaaggagcaagcatgacagcatcctcttattttatcgccttctcctctgcagtagtcagggtacagggcactgaattcagatcaaaatcatagactttactgtatctcttgctggcgaaaatatttaagttatctgacatttactaggtctattaaatcacccaagggaagaactttttttgtatgcatacggtagtaaagggcttttgcaaaaccagtatgttgatattttggacaacataaaacaatatacaccttgtacatttactttaaaaattaacttgtgaaaagcatttctcattttgtttacttagtttttaaataaagccagactagtttagcttaatatatgggttctcagctgggagaaccagattaaccatcattctagtcaaggctttgagtttccattctctgaaatgatgacttgcaacttggtggaatttgatattctttccaaaactaagaaattttggtgatccattcggagttatttctgctctctttctttaacagtgagactgagagtatcggtctacttgcactgcacatgggccaaaatgggcctttcacaggagaagctctacacaaaggaaaggagaaagggttcctgcagaaggaagagaagggcagatttgttctcagaggtcacttatgttaaggcaaggatggcagatgtctcatcatggatttatttggcgggtgtggctgctgagtactgtattgggaggaatcctaagtacgtgataggttattaatggtgctgtctttgggtgtgggccacgtcgaaggcttgagggtgattcagagtaatgacacagtccgtctgtattttaggacctgccacacaaggaggtaggaatatgcttggcttccatttgatgtgtcccacacttctgatatgtatattggactttttaactactccattctactcttcccccttctcactactgtacttaactaagtcttaataaacaaacacacaaaccggtaactcctcatccctctttatcctgagcccctggcaacccccattctattttctctctctgagtttgacttctcaaggtattttcttttctttttctgtttcttttatttgtgacagtctcgctctgttgcccaggctggggtgcagtggtgtgatcttggctcagtacaacctctgcttcccggttccaagcgaatctcctgcctcggcctcccaagtagctggattaggggtgcccgccactacgccactacggctatttttgtatttttgtattttttttgagacagagtcttgctctgtcacccaggctggagtgcagtggcgcgatctcggctcactgcaacctctgcctcccaggttgaagcgattcttcctgcctcagcctcccgagtagctgggattaacaggcatgagccaccatgcctggctaattttgtatttttggtagagacggggttttgccatgttggtcaggctggcctcgaacttctgaactcaggtgatccacctgcctcggcctcccaaagtactgggattacaggcgtgagccaccgtgcctggccaatttttgtattttagtagagacgtggttttgccatgttggcctggctggtttcaaactcctgacctcaggtgatctgcccaccttggcctcccaagtgctgggattacaggtgtgagccactgcacctggctgcaaggtattttcatgtaagtggactcatacaatatttatccttttgtatctggcttattgcacttggcataatattttcaagttcattcatgttgtagaatgtatcataatttcattcctttttaaagctgagtaacatcctgttgtatgtatatactgcacattttgtttatccattcatctgttggttgacaattgggttgtttccacgttttgactgttgtgaataatgctgctttgaacattggtgtacaaacatctgtttgaccccctgctttaattcttttgcatatataaccagaagtgaaattgctggatcatatggtaattctaagtttaatattttgaggacatgccatgccgcctttcacaatggttgcatcctcttacattcccattagcaatgcatggggttctaatttctctacattcttgtcaacacttgtcattttctgtgtgtgtgtttaatagcaattctaattggtgtgaagtggtatctcattgtggttttgaatttcttctattattagtgatattgagcatctttgcattgtgcttgttgaccagacatctttttatctttggagaaatgcctattcaagtcatttgcccatttttgcattggttttcttgttgttattgagttgtatgagttctttttgtattctggatattaatcctttatcagataggtgatttacaatatttttcccatttttttgggggttgcttttgatgaactaaagttttaaattttgatccagatcatttattttttcttttgtctctattgctcttggtgtcatgtccaagagtttgttgctaaatccaatgtcttgaagattttctcttattttttcgcctgagagttttaaagttttagctcttacgtttaagttttcagttcatttagagttattttttgcatatcatgtaaggaaagaatccaccttcattcttttgcttatggatacccagtttccctagtgttgtttattgaaagattttctttcctcattgagcggtctagtcaaccttgttgaaaatcagttggccatatatgcaagggttttatttctaggctcttattttgtttcattggtgtatattatgtctgtctttttgccaataccacagtgttttgattattgtcgttttgtagtaagccttggaatcaggacatgtgagttctccaactttgttcttgttttcaagaatgtttcggcaatttggggtgtgaattttaggatgggttttccaaaagttgttgggattttgatacagggattacattgtatttgtaaattgctttgggtggatttttttgtgtttgaggaaaagattcagttgtttagaagtctcttaagctctctttattttacttttgtctttccagcatatgtctctttcatatattcacttatacagaatagtgtacatatgtgtgatacatgcaatgtaaatatgtacaattttaagagttatttaaaaacaaaaaccatgtaactgctagcaggtgaagaaatagttggttgaagttttaaaactactgaaatagagttatgactgatggactacattgacacgtcatcacccacaatcccatcatttatatcagggttcacttttggtattgtacattctatgggtttagagaaatatttgacgtgtatcttaccattatagtatcatacagaatactttgatggccctaagaatcctcttcagattgaatttttgaagattttaaactactttttttttttgttttttgttttttttgtttgtttggttggtttttttgagacggagtctcgctctgtcccccaggctggagtgcagtggcgcgatcttggctcactgcaagctttgcctcctgggttcacgccgttctcctgcctcagcctcccgagtagctgggactacagaagcctgccaccacgcccggctaattttttgtattttcagtagagacgtggtttcactgtgttagccaggatggtctcgatctcctgacctcgtgatccgcccatcttggcctcccaaaatgctgggattacgggcgtgagccaccgcgcccggccttaaactagttgttaaatagagtatcctattcaacattgtggatttttctaattattttctcaagaaatcatttaactggctggacatggtggctcatgcctgtgatcccagcattttgggaggctgagttgggaggatcacttgaatccagcagtttgagaccagcctggacaatatagtgagacccctatctcactttataaataaagcaattgtttcacttatttccacatcccctagatttcctgcaaactgtagcagtactatctaatagaaacatgggaaccacacatgaaagcctaatgtgtgattttaaaattgtaaccacatttagaaatgtaaaaagataggtaaaattcattttaataattcatttaactcaatatacccaaaatataatttcaagatggaatcagcataacttttttctcacaaagtcttcaaaaatccagtttatattttacatttgcagcacatgttaagtaagactagccacttcttaggtgctcagtagccacatgcgactagtggctattatattagaaagtgcaggtctaacctaagaagcttgatttgattcagtgtaaacattttgggggaggggcaagagtatgtcatagatgaagcttgtgtataccattttgcatcaaataagaagatacacattcttgggttaatggttctaaattcgaacaattatttggtgattgccagatttctccgttgcgaagatgcattatctctttttactggtgagtaatctgtggggtgatgcttgggcatcatattctgttctccagtgaccttttcacttaatggttttagcatccattgatcatccttgcctggattattacattaagggttgcaaatgaaatgctctaaatatatctatgtaacaaatttccacccctttcttccattatataaagcattaaaaatactagttactggccaggtgcagtggctcacacctgtaatcccaggactttgggaggccgaggtgggcagattgcttgagcccacttcgagaccatgatgcccatggtgaaaccctgcctctacaaaaaatataaaaatgaattgggcatggtgccatgtacctatagacccagctactcaggaggctcgggaggattgcctgagtccaggaggtcaaggctttagtgaactgtgattgtgccactgcactccagcctgggcgacaaagctgttctctcagcccagtctccttagtaagatctaataatttttcctttgggagatgactttctctaaactttggaggtcagcaataaattgaaagggactagtttcttatctgattaattcattttcattttgatgaattcgtatgccttcttaggttcttccttaaaatccttaattaaaggagttttgtcttcatcatcatcctgcatcagaaacggcatcagtaattgatatttaatctcataggttgtgatgagtccttacttttgttttacaggttgctcttaagtattgttgggttttcagagtatatcagcaaaggctttagcttaacatcgctcaattttttaaatataaaagcaatgttagcctgacacgttttctttttaaatttcttaccaaagcacaagatggcattctttaagaaaggtctatttttgtcagttataaatttgctttccaatatttctcctttattaatagttttctgcaattcattgggggaaagtttgttgcagtctcgctatcagcagaagctaatttatttatcagtgatatttaatgttatgcatttatgtactgttcttaaacctctcaaacaattcagggcttgctttgcaactgagctgctcaccaaattctcctgtttctctcctttcacctccatcacttcggagatatgaaatgcacattgctgttgccacagtgctcggtggttccatgctgctggtggttatacatttttgtatgaagtattaccgtaactgttagacatcaacattgccttccatttgtatttctgttgcatagaaacagtcttatgtgtgatacaggggatatacttaaagtcaggggctcagcttttggttcccttgcctttaaataaatgcattacttccaattttttctttcagtgtttgtactttcctaggcctcttacataggttcacctgtattttcccaggacaccccattttcttagaagccatttttacttaatgtggagaagatcatgtacaagatgcctttcagtagaagttatatttcatgcacaacatttctgatcatgcagcagggctctcttcttttgctaatgtgattataaggagaagaagcacatacaaataaatagttatttgaattagagaaatataatctcctaatgccatcttagggaagagtttgaggaggagttcaaggcatgataggaagatacaacagagggtgagttagtgtcagcagatcacagctactttgacataatcacacctgttgttcccctttggaagaaatcttggattggacctggcatggtctgctgcttacattattctttctttcttatgtcaagaagtgggtggagactacttagaggaatgaggaatcaacaccatcttaatatgtgtttgtgagtagaacatcttgtatttgtattacctgttccagtttttaactttgtgcattttatgtgaatccacttcttatacttccattaaaagtagtttaatacttggtcatatgttagaaacctgtcattcagattgttgcatttcaaaatgtagacaaagctgtcactctgacttgtttggcttttgagtttcataccacacttagtccaatcaaaatataaaaaagaaaaattatgttgctaattttcaaatttcaaacttttgctttaattataataaactttatagacacacatttgaatcgcacactaatagcctaggaaaattaggggtttaaatgtaaatattgccttcatcccttagactctaagtaatagcaacaaacattgggcaaattggctgggttcacctgtaatcccggcacttgggtgggcagggttggggggcgagctcaggagttcaagaccagtctgggcaacgtaggaagaccttgtctctaccaaaaatacaaaaaaaagacagacatggtggtttgtgcctgtggtcccagctactcaggaggctgaggtgggaggattgcttgagcccaggaggcggaggttgcagtgagccatgaacacactactgcgctccagcctgggccacagagtgaaactctgtctccaaaaaaagaaagaaggccacaatgcttaaaaagcccatccaaataatcagaaaaaagagaatcactcaatgtaaaaaaaacggggtgggggaataaaaatatgtaaatgcaccaaagataaattgccagtggcagaaggatgcccagtgttagcaaggctgtagggaaatagttgcctacagtgtttctgggataatacattgaagtaaacattttgtggcttgatatatatgttcctttgacttacagttcagtttatagtttatattctagatatacttccacagatgtacaaggagagtgcaaagtattctttttaaattaatttttttttaagatggggtcttcctctattgttcaggctggagtgccatggtgcgatcatagctcactgcagcctcagactctcctgggctcaagagattttccctcttcatcccccagaacagttggggctacaggttcacaccgcctggcaatggcagcattgttttttctttttatttatttttaaaaagacttttaaatattcataatttcttttttttactttttgtttttttcactcctctcagctcatacctaggcagcattatttatatttgagggggaaaacgaaaagaggtatggtggtgggaacgagttatctagtgttcagactatgctaagtggccatcagttatacaaggatgattccatttctgtatagtatatggtggtgtagcctaagtctgaaagaatacacagcaaattgttagcagtggttgtctttggagagcaagaaggtagtgtctaatgccttctattttattttcctatgttactttaggatacatggccttttttcataatttaaaaaatcaaagtacataaaagaaagttgaaaatattctactacttagtaataacaaccaccacctacagatgtctcccaacgttgggcatccttgcatccacctttcagtgcatgcatgcgggctgaaatctgaggttgtaatagatgtgccatttatatactttaagttgcaagttgcatatgaatgacaacccagctaaggtaatattgaagaaattattgacctatagatagacatttatcgcaagaagagattaatttctaaaagagtcctaaagttgagagaagaaaatctataaaaacctctaaatagttttgagactcttgatagaacccactgacttcctgatgtccaggatgagggaataaacacatatgtattccttagtacctctctccctttccctccattcccttcccattttctaatcataaatatagatatatttagtaattggttattcttttttaacatagaaatcctgataatgtaaaattacgacaatacagaaaataacaatgtaaaatcctgacaatgtaaatttatatataaatcctgataatgtaaaaataggaccaatggcaacaagaaaataatacacacacacacacacgtgtgccacttggcaatgacagcatatattattaaatatatatatataaaagcttatagcattcatggtggtttggttttatttatgcatttacatggggttggtaactacactggtccctttcacctgcgtttttctgttactgaattctttattttgattgatttcgcagcatttaattcaaaaagtaccatttcttaagtccttaaagtttacaatacatgtaaatgtgtattaccatcttatttggacttcctgtttgggcttctctctctctcttttttttttttcgacacaggtgcctaggctggagtgcagcagcatgcttacagctcactgcagcctcgacctcctgggctcaagtgatctgcccaccttagcctcctgagtggctggcaccacaggcgcttgccgccatgtccagctaatttttgtattttttgtagaggtggtgtctccctgtgttgtccaggctggtcttgaactcctgggttcaagcatctacttgcctgggcctcccaaagtgctgagattacaggcatgagccaccatgcctggctgcatttctcattctttttatcacattcttcttcaggattccgtatttcttcacgtcactgttacttacctacaatgagtattgtggagaaatctgaggctaacctggttggttccacccacccacctatactggacttgttttttcccttcctgaatatccttgatattatttaactttaaagttcagtgcctcatttgacagatgttttattgtttattctgtaccagttttttctgagttgtgggatatgttttcaatctgtatatttattattatagaaagctttatagatttatgacattttaatattctgatctcttcaggaatgccagtttaacttatgtaaatctcctttgtttattatctttactctttaaaaataactatttatcttttcattagaagtatgatttctgaaagttatgaccatgatttgtttttagtctgtttttcactttcctttaaggtctcctgttgctttataatgttttctttctggtcttctttaaaaatatgtttctgtaatttctttgagactgtttttctgaagtctttctggttttttatatgtattatttggtggttgaaatgaacttaaagtgaattggaaattcaagaatctcatgactgtgcttgcttccttcagcagcagcatgcttacgactcactgcagcctgagaatcacttttttgccccgtataatgtggggaaggtaaaaggacagttgagaaccactggtgtattcgaggggaaactgattagggaccaactgggatgtgaacttaaaaatagggctttacacatgaagaaggtggcattcttagttggaagtgacaggaattcaactaaaataaatttagacaaaaaggaaaactgacttctaactaagtttatagaagggcaggagtagtaccaggtgtaagaaatcaaagatctgtttggatttcttgttgcttattcttcgttttggcttcattctccttgagacttgaattgcggctattggcagctctcaggcctttatggcacagcttcccaactctgaaaaaccactccctcctgtggccttggggtaccgggggccttgtttggcagtcctactagaaacatagttgggcgtgaggtttgaagctgggtagtattttccaaaagaaataattcaggtatgggcttgttctcaggattctgaagaatacagacgtattccttttatgtcctgtagcctaattaatgagcaattttaaaggaagaaaatggacaactaacatttattgtaccttaagctgggtcagactttcgcatatacaatatcttctccgtgttgcaacgttaccaagggctttaccatcctttactgataaggaaaatgagactcaaaaaatagaaatgatctgtttaagttgcccaggctagtaatacataatatcatatgctgtgcccaaattttccattgtgaagtgacattcagaaatcctcaggaatcatctttatcaaatttatttctataaaataggcgagatcaaagtaagctgtttgtgtgacactataaactagtgttagggcataatttcggtattgtgaggagttcctgctgcgacaaatcttggcagagatgcatgcttatgctattgtgtataatttatgcacaagcaacaacgtacttaggacttaatattgaagaaccctgacgcctgtgattgaagaagctgtgataagcagggtgaaatattacaggtagcagaatgtcagtaagtgttattttaggaatgtggtccagaattctgccaagcaaatccctttgggaagcatattgacaaattctttttaagggatcatctctgatctgtttggcttgtctgtttcattttccttatgtttttgaagcacagtaaaataaattgggtggaatattttttgttttgttgttttttgagacagggtctcactctgtatttcccaggctggagtgcattggtgtggttttggctcactgcactttctacttcccaggctcaagcagtcctcccacctcagccttccgagtaactgggactatataggcacatgccaccatgtccggctaatttttttttttctttttgagacgaagtctcgctcttgtcgcctaggctgtagtgcagtgacacgatctcagctcattgcaacctccttctcccaggttcaagcgattctcctgcctcagcctcctgaatagctgggattagaggcacccgctaccacgcctggctaatttttgtatttttagtggagatggggtttcaccattctggccaggcttgtcttaaactcctgacctcaggttatctccctgcctcagccttccaaagtactgggattacaggcgtgagccaccacacctggacagggtatcactatagtgccaagcctggtctcaaatttctaggttcaagcgatcctcctgcctcggcctcccaaagtgttcggattagaggccaccgagcctggccttgattttttttttttttttttattcaagagacatggtcttgctccaagctggagtgcattggcaccttcttaggttactgcagcctcaaacttccgggcccaaacagtcctcctgactcagcgtccccagtagctaggactgggtctctctatgttgctgttgcctaggctggtcttgaactcctgcccttaagcgatcctcccaccttgacctcccaaagcactgagattacaggtatgagccactgtgcctggccaaaaatgtttttgattaggaaatcagctagccggtagcccgtgtcgtggtacaaataaaaaattctaattttaagcaaatttttaaagtttaccagaaatttgtaaaatttattaacttgatgcatcttgaaatctaaagaggaaatacacctttgtgattgctatgcttgacttttttcagtattaattaatggaaggttgaaggacgggaacgtttttgcagttacttttggtgacttggtttgtggcatttttatgttttaaggtaacagcagtttattcctctgataataaggtcaaaattattttgacaaattatctcaatagttaggagtaattatgtactgtttgggtaaaggggtctgtctatctatgatctcagaagttcaaagtgaagctgcagtaaaaatagttactttacagacatacaccttgcagccaactgtgttgtataaataaacttgacaggaactcacattcccggagcaggagaccacagtcacccagacacaaaggaaaatcgttactaggctgtaaacctcagtttgtatttggctttgtagaagttagacttagccaacaattggtcttggcaaagtacacttaggcggtggctcacgcttgtaatcccagcactttgagaggccgaggtgggcggatcacgagatcaggagatcgagaccacggtgaaaccccgtctctactaaaaacatatatatataaaaaattagccgggcgtggtggtgggcgcctgtagtcccagctactcggagaggctgaggcaggagaatggcgtgaacccaggaggtggagcttgtagtgagctgagatcgcgccactgcactccagcctgggctacagagcgagactccgtctcagggaggaaaaaaaaaaaaaaaaaggagcctcttttcttctgtttttttgtttgtttgtttttgttttttgttttttgtttttttgagatggagtctcgctctttcgcccagnnnnnnnnnnnnnnnnnnnnagtctcgctctttcgcccaggctggagtgcagtggcgcgatctcggctcactgcaagctccgcctcccgggttcacgccattctcctgcctcagcctcccgagtagctgggactacaggcgcccgccaccacgcccgggctatttttttgtatttttggtagagacggggtttcacggtgttagccaagatggtctccatctcctgacctcatgatccgcccgtctcagcctccgaaagtgctgggattacaggcgcgagccacagcgcccggccaaaagtagcttattttcttagtagtcaagtacaaaatgacgtctagttgggtcttggaatgttattctgagaatttgtattttgctgaggtgcagtgaagttttacttttacataatgatcgacaatactgaaaacattattttaggctatattaaacttatttttagattaaaaaaatcttttgaggaaaattttaaatgcccaataataccaaagtagacagataggtataatgggcctccatgtactcccccagcccctgaagtgattaggtcatggatcagcctcgtttcacctatcttagccctctccctaatgactgtgaagtacattctaaacatgatcatttgtctgtaaatatttcagtatgtatctctaaaaatggtaagaaaacccccagcacaacaccactgccaaactcaaaaaggaaacaacaatttctggatattgtctaatgtctcattactcttcacattttcatttgtgtcataatcgtcataaatttaaaaaaagtttgaattcatttctctcttttgtgctccttgcagtatatttgctgaagattctaggtcttgttctttagaatatcctgcagagtagatcttgctaattgtgtcccagggatgtccttgaacatgtttctctgtttctgttctttgtgaattagttattgtacttaggggctcaaacaggttaggtttgtgaggtgagattacttcatatgtggtggtttgttcatttttcaggagactgtaatatctggttgtcttttaaaatgcctggattaaatgataaaatggccaatgtttcagttatttttcattttttagctggagtatttttatagagagaaacctcatttgatcaaatagtaattactattttgattacttggcaatataatttgtgtaataaaaaaggatcacactaaatgttgattcttttgctttttaaaattggttttcagaataacaaaatggtttcccagcatcctgtagtggtgataaatttgtttcttgtttttgatttcacagttataaactcatggatttaaacttgcatatttcaagcattcgttgttactaactttattgacactcaaattgtcccatatttgaccagtggaggcctcttcaagctggctcttgagtcctttccacaataccatagtattactcgatagcttcctttttgtctgctatgtgtgagatgaacctaacatttcttgctctagacctggagtcagccatttgtctgaagagccctggtccgttttagtgataaattcatatttagaaaccatattctgggcactactgggctgttcattttttctagaccttttcagtggatagatctgagaactatatatttgaaagcaatgtcattttatattcatctaattccgattcagaaatgcagcgtttttacttttcatatgctctttctgttcttttttagtcttattcttggtaatgactctatcttagcaagtctgctcatgcattattttccatgacttaacacatagaagtcattactctcaaggacactaccttgtccctgggtttcctttttattcatggcttgtagaccactctggcccacagtgatttccagattcatagcatgcaagcataactcccatttaacagtcactggatactccaggatttactgagttttaaaaattgaagtataacattgacaggaaagtacgcacatattacggacggcatgcctctaccagtacaccagaagtccgttccatgcctcttcccagatactactctcacttcctgctccaaaagacagagagagagagagagagaaatactatcgtcctgatttgtaatactgttggttagttttgcctcctttagaactataaacttttgtgttttagcagtcatgacttttgtgagaaagagaggtctttctagccctttccaactcttaattttatctctagatagcattcagaaaagatgttatcttcatctttggcattctcaaaactcctaataccttaggaatataagtagaaggtcaagcatggtcacttttgggttttagtttcccttttgatttacagaagctctgtttgtattaggaattttaaacttctccctattttgcaaatattctttcccagtcatttgtatttagactttattgctgtactaaccttaaagtattttgtgtagcattatttgactgttgagttttgtgtcctgcataggaggaccacctccactcaaattgatgtgaaaaaacactattctatgttttcttttagttaggttttatacctctttgtttatatctgtaatctgtctggatttggatgtagtgtgaggtatccgtatcaacatttaaacacagataggatgttttaacatctttcagccttttccattaaaataaaacttgcttgaatttcatttacccgtgactactacacttttccatctaccgtcaaacttttagaaaaaatttccacttgggtttttccacttcatcttctctttgtccactcagcgttgcctgcatggattccaccttaccttcacactgacactgcttatgccgagggcaactgtggccttttttttttaattgaatccagtggactgaatatagaccccttcttccctgagctgtatgtgtttatcatcattggatagtttctcctttaaatgcatctcctttagctttaataaaatgttttcttggcttttgtttttttttttttttttttgagatggagtcttgctctatcgcccaggctggagtgcagtggcgcgatctcggctcattgcaagctccgcctcccaggttcacgccattttcctgcctcagcctcccgagtagctgggactacaggtgcccgccaccacgcccggctaattttttgcatttttagtagagacggggtttcaccgtgttagccaggatggtctcgatctcttgacctcgtgatccgcctgcctcggcctccctatttcactggcttacctttctcagtttaccttgtgccgcctcctgttttttgtttctcagttgttaatattttctagaattcattcggttacatcccctgcagtttatattaatgcttatccttgggtgatgcatcaacttacaacctcagtgatcagccatattctgataaccctgaagtctctatcgtcagctcagatttttttttctttcttttttttgagtcggagtttcactctattgcccaggctggagtgcagtggcatgatctcggtgacctccgcctcctgggttcaagcgattctcctgcctcccaagtagctgggactacaggcgcccaccaccacccggctaatttttgtatttttagtggagatgaggtttcactgtgttagccaggctggtctcgaactcctcacctcagatgatccacccgccttggcatcccaaagtgtcgggattacaggcgggagccaccgtgcccagtagatttctttttaaagcaatgtattttttgtccctaacaaaaggcatttaataccaagcccatcaccatttcctcccctctcttgacaaacctcctcctatgtttctcatttcagtgaatgaacagatttctacccttgcacagaaatctggtgtcagaaaaacagggagggaggaattgacattataggtaatggtgttaaagtgtaccactcagtggtgtttcgtgtattcacgatgttgtgcagccagccaccagctcgatctagctttcagacgttctcatcacaccattaaatcgccatccctataccccttaagtaattacgccccctttctcccttccctcattgtctaatctactttctgtctctggatttgcctcttctggatatatcatatagaataagtcatataacatgtgactttatatgtctgcttctttaacttagcctgatgttactgagcttcatatattagtacttcatttctttctgtggctgaatagtatttcattgtatgtatatactgcagtttattcatttgtcgatggacatttgagtttctgccttttgattattacagcaaatgctactacagacattcatgtacaacttgctgtgtggacagatgttagggtatatacctagaagtggaattgctgggtcatatggtaactctgctcaactttttaatcatatgtcattttactttttttaaaaaaaattattttttaaactgagacaaggtctggctctgttgcccaggctggagtgccctggtgtcatctgaggtcactgcaacctccgcctcctgggctcaagtcatcttcccacctcagcctccccgagtagctgggactgtaggtgcacatcactgtgcctggctaatttttgtacttttttgtttcttttttttggtagagacaggggtttgccatgttgcccaggctggcatcaaactcctgggctcaaacgatctgcccacctcagcctcccaaagttttgggattacagcggtgagccaccatgcccagctcatgtcatttttgacttactactttaagccccacttctttaacatcaccaggttaggttgattgattctcttctaaatagccttgttttcttcattgtttcgactactatatactcgaggtacacttttcaagattacttgaattgcttgctttttgtttctttgttctcatcatgcctttttaaacaatcttctacatactacaagattggtttttgcaaatgtaaatctcatgaggtcactccattgtttaaaagaaaaagaaaaaaagaaccacccttcaaaggcttatcattgccctctggataaagtccaagcatgcagggcttacaaaggccctttgctgtccagcttttgacattctgtttagtttcagctgctcccctgccccccgccgttccagtcacatactgattgccctatttcaagtttttgtacatgctcctctacctaaagtagggttcagattctaaaccttgaattccctcacccaaatcctttatttcttttctttttagaagccttttcttattcttcatgattatgttatgtgcccttcttttttgtgtgccctcaaattcttgtactgttgttggagcacattgtaattgcctgtttacttctctggggatcaggagccgatgttggtcaagtgccagaagatgtagatagactgaaagtacaattaataggaatttagcagaagccaaaagattatttgataaattatttagggaagacttcatggagggggctagtattgatagagaccttgaaggaagcattcatgaaggcatggtaaggttctatcactttaaatggattaagcctgttaaatattcatgcatctagacctaggaagattcatgctgggggctgaagccatgacaaaagtgagacattggacatttttcaacattgcttttgtattacttacatggaacaagcaaaggacacaattatgcctgtagaagaaatacatggaaagaatgggcaaaagatttcaagaacttgggggttttgacaagagtaagaagcaatgatatgctttatggaaagtgtaaggaaattttcaagggtaattttgaccatgtatactaatttcagagcttactcacctatgtttataaaccctggacttctggtggaaaatgcaacaactaggtgatttctggatatattatagaatctttcacaagactcttgtgtacagtgttgtagaaaatggtccgagtaatgtaatggtgtttctctagaaaaaggttggaaatgagatcagtcatgtagaaaataactcctcacagtgcatttgtgtgtgctgcactctgtccctcagttgacaggaaagtgggactttctgttttttaatagaatgtctgcaacatagttggcgctcagtacacatatgcgtgcataaacaaaataacagtgaaaatgctgttcccttcttaatgtgtttgcactttcaatatctttaaaaagtattttagattagccactttaaagtaaaagtacatttcttgtgttttgaaatacagagctgattttaactatttgtaaaagtctagtttgcctgttatgcaaaaatgttagacttataaaaatctcccctcacatttcaagaaaagaagcacttcatgtttaaacataaattttttatttttatttttgagacggagtctcgcattgtcacccaggctggaatacagtggcatggtcttggctcactgcagcctctgccttccagttcaagtgatcctcctgtctcagccttctgagtagctgggattacagatgtccgcctccatgcccggccaatttttgtatttttactaaagacagggtttcaccatgttggccaggctggtcttgaactcctgacctcaagtgatccacccatcttggcttcctgaaagcgttgagattacaggtgtgagccaccacgccctgcctaaatataaattttcactattggctttctcctattttgctggcatgttgttaaatcgtagttgttgaaataataccatctcttgatttccccaaaaattaatatctcctcagttacctaaacattggttcagtcctttgtagcactctgagttatattatactacctttcatcattagacaaagctgcctgagaatgatggcaggtagtatacgagaattacacacctgttgagactcccagcaagtccttttcaaaccactctactcctgtgtgttctttgtccacactttccaatttgagccaatgagtactcagttccactggccggtaaaatgtgataattgtgtgggtgattgatacatgcattcactattgtgattgttgttgtgttggttcctctggtgtatatcagtacttattaaattgtgtgtgtgtgttttttttctttttgagatggagtcttgctctgttacccaggctggagtgcaatggcgtgatcttggcttgatgcaacatttgcctcccgggttcaagcagttctcctgccttagccttctgagtaactgggattacaggcacacaccaccatgcccagctaatttatttatttatatattttttgagacagagttttgcccttgttgcccgggctggagtgcaatggcgcgatcttggctcaccacaacctctgcctcctgggttcaatcagtttttctgcctcagcctcccaagtaactgggattacaggcatgtgccactacgcccagctaattttgtatttttaatagagacggcgtttctccatgttggtcaggctggtctcaaactctcgacctcaggtggtccacctgcctcggcctcccaaagtgctgggattacaggtgtgagccaccacgcccggccaaattgtataatttaagtatgtgcagttcactgaatgtcagttatacctcattaaagttgtttaaaaatttctcacatgatctgctcaccatcaggaggccagtactttattaagtctggtgtctctggaaacattctgggctctgtaccgctgctcacctgctccttaaggtccctgtcttggcctgtgtgcccccaccttgccagttcctcgcctctcttgtttcccaccctgtcatcctttctccatgccacagcactctctttagaggaggagaacctcacgatgctgcagccattctgtatgctccaggtgttactcttaagctgctcctctgtcccagaagctgtggctctcagagggtcgacatatacagacaagacatatggggcccctgctctccttgtgctcagagatggatgggcacacaggagcacccactgtagaagcaggtccccaagactacagggacaagtcaaataggtgtacaaatgttagtataaatgaaagttattaagcgcagtacattccaatgaaaaggtatgattagacactctgaaagtataccctgaagacagcagcataagaattgccaacatgatttgatttccagggctccctctcaatgagaatctctgggggacgggcctggatatctgcattttaacaagcttccttaaaagaccactgtagggccacttagaatgacaagagcctggctggataccagtagaagttgatcttctggatagtttgctttacccagggctttcttacagtataggcatgaaaatgttttggccatcaagtagcattttgcctggcaaggtatatctatttaatggtttaaaacttacataaaacatgtacgctcaagttctgtaatttatctactggatgcaaattatgtgcttaaatgtattgattaaacttttctttttccacagaactcaacaaaaatccagtggaaggcttttctgcaggtttaatagatgacaatgatctctaccgatgggaagtccttattattggccctccagatacactttagtaagtataatggaactgacatcttcaaaatggagctcttttaatacactgaattaaaaactattttggcaggctgggcacggtggctcacacctgtaatcccagcactttgggaggccaaggcgggccgatcatgaggtcaggagttcgagaccagcctggccaatgtagtgaaaccccatctctactaaaaatacaaaaattagctgggtgtggtggcatgcacctgtagtcccagctactcaggaggctgaggcaggagaatcacttgaactcaggaggcagagattgcagtgagctgagaccacgccattgcactccagcctgggtgacagagtgagactccatctcaaaacaaaacaaagcaaaaccacaaatattttggcaaactgacatgaaattattttttaaggagcaggagaaatggctgtattcaatatcctttgtactgaatttgatcatggaagagtttttgtgttttgcttgaagctctaatgtctaagacctattgctattaaaaataatagtttcaggccgggcgcggtggctcatgcctgcaatcccagcactttaggaggctgaggtgggtggatcacctgagaggtcaggagtttgataccagcttggccaacatggtgaaaccccatctctactaagaatacgaaaattagctgggcatggtggcatgcctgtaatcccagctacccgggaggctgaggcaggagaatcacttgaactcaggaggcagaagagttatataatttttggacattttaattgagaatgtattacacacatcagtgttttaagaaggctaaggagaactttcaagatcgtctcttttcatggttctctacttgagtccccaccgaatactggttagaatctaggtgttcttatcccaaactaaactaatggtcactttctcctagtttattgaaagttattgttatgctctatgataatctattaactgactattaattgttaaaccaatggcttaaggatagacaacaatgtagtggtgtgaaagagcagtagaagaagagaaatagagtttaaaaatatttcatgtcgtacatttctagatgcaaagaccacagtcttcttttctgctctgagtgtttgcagactaacttaaatttactagtatgtattgttttgtaagatgcatctgctggcttggtgcgttggctcacgcctgtaatcccagcactttgggaggctgaggcgtgtggatcacctgtggtcaggagttcaagaccagcctggccaacatggtgaaaccctgtctctactaaaaatacaaaaattagctgggcatggtggcgggcgcctgtagtcccagctgctcaggaggctgaggcaggagaatcgcttgaatccgggaggtggaggttgcagtgagccaaaattacgctactgcactccagcctggtgacagagcgagactccgtctcaaaaaagaaaacaaaaccgtctctggtctttggtgtacatttttaaaagtgttggctgttgaattgagatgtgaatcacagcaatatttctggcagctctgctggagtgtgtatatgctgctgagaatactggtggtcacttctggactgtgccttcctgagatcactagcctttgctcaggaaagagagagcatattcctagggcaggacctgagaaaggcaaaggaaggtacaggggaatgaagaaaggtttgttagaagtaagccttttagaatgctaccaagaaccatgtacttcatagaatgcttaaaaaatatttgttgtcggccgggcgtagtggctcacgaggccgaggtgggcaggatcacctgaggtcgagagttggagaccagcctgaccaacatggagaaaccctgtctctactaaaaatacaaaaaatttagccaggtgaggtggcatatgcctgtaatcccagctactcgggaggctgaggcaggagaatcgcttgaatccaggaggcagaggttgcagtgagccgggatcgtgtcacccactccagcctgggcaacaagagcagaactctatctaaaaaaaaaaaaaaaaaagttcttaaaaaacttcttagcagaaagtagtgaggttcttgtaattatttcagtggaatggagagagtagaggccatcttggaattgtttgaagagcactattggaagtgaatatatacaccttacgtttaaataactgcctgtgaagggaagtagaggcttgtgctggggggaggggtgttataggattgaaaataaattagtataggctcagatggtacccagacctaagtgattaattcaccactttataattagataatagaaatactgtaccaaaattctgtaaaagctgctgtgattatctctctgtgccatcattagccctcatgtagtcactagagggcgctccactctcttttcagtctatgtgattgataactggtaccgaccgttcaaggattactttgagactcctatagttgccacaagtcttaattcagtcatactcatatttatatagcattacatttttatttttattaatgagtctttccagtgcagtagtccctaaggcctttctatgaaatgtacattctgaaactggtgtggtataccaactgttttcagactgattatcaaacagtatggataaccactcatatccacagaaattaaaatttcaggtagaagtggcaataggtttgtagtacggaagtttagggtggatacagtggctcacgtctataatccctacactttgggaggccaagggtggatcgcttgagctcagacgttggagaccagcttcggctacatggcaaaaccctgtctctacaaaaaaaaatacaaaaataagtcaagcatggtgatgcatgcctgcagtcaggaggctgagcccaggaggtggaggctgcagtgagccaagattacgctactgcactctagcttgggcaacagagctagaccctgtcttaaacaaacaaacaaaaccagaaagtctaagaaacctggatatcactgtatcattataacattttataaattattaatgaatgatgactgtataacttttatctctcttttcctttcatcaccagtggctggtctgttcaaggagtatgtcttatttatttattttgtttttaagcactggcaatgatatgaaaaatctggagaatcttaagattatgtgttttgtagtattgccttgggtagatatagaaaatgaagaatcagttaaccaaaactctgaattacattcttttacagttgcaaaattctattccagttataaattattttccagtcctgtgtgagacatagaggcagaagccatctcttctgtaatgaagttctggagggaatgaacctagtgcctacattgcttggaaatggaatgatcagtggtaatgccatgcggtttatcacgtagtgttcaagaacatggactttggggactgcctttggttagctctctaactctaccactcttcttagttgagtgactttgaacaattacttaaatttggtcttagcagtttcatttctagggtaaaaactctatgcttaggaaatgtttcaaacgttccatgttctattgcttataatagcaaaaaaaaaattattttttccccttttgcggttttattatttatttttgtaaatgtcaattataattcgaaggacactttgtagttactaattagactatatgaaaaactgtacagactgtttgtactataatttgtgtccctaagagattaggggactcagtaacagaaaaatcaactcagaagggtcactgctcagcagtccacataaccacatagtagagcccaagctactggttgtgagtagaaagagacttcatacaaatatcttcacatgtcttctagcattatgcccctaccaggaaagggaatgtctgtcacaattttttttttttctgctgtaagataaagaaaaggctgtatcccttagacacatacttaatgaagacaatctcaaaagaagctcccgtgtttttctgttttcactgttcttttctgaagttcacctggatgttccagagcagttttctaaacctttcattgttggttggccttttgtagaattcttcagcaacacacaatacagaagacacaggctaaaatagttctcacaaatacactttgaaataggtgtatttggatataaatacaacttgccattccattattttttttctcatgactaaactctaaatttttaaaaatggagattttcaaaccagtgatgtgcaaaagcccattctcatgacacagtcatttaaacttattaagtatgggaaaattttatttcttccctttgtcttgtggaataatttaggttctcaccctgggcatgattcacaaaatagagtaagaccacagataaaagtcacatagaatcacaggcaatgaagaaaacttctaaaaacaaatatcccccagtgtccagtatcatccatcccagcagtgatggaaatgatggccaccccaagattctgaatggagtgcgtgaagccatatgcagttcccagttgatgttcaggaactacagatgccactgttggccaaaatgcacaggcaagcgatgaataggagattcccagaagacacagcaacccaagggctccacatcataaaggccagcatcatgtgggacacaagagtggctgcaaccacacgcagaacccagatgctgttcttccccgtgtcatccactgggagcccaaatactggggtgtgggagctgataacgacatatacaacactgttcattgcacttgctgcctggaaagaaaatccaaatttgtctgtaaagaaaactttcccaagtccaataaaagggaacatggcaacacaatagcagacacagatgataaatatgagccacaggggtaaggagaaatcctttacatcagttaatgtaaaaacttcccccccctttttttgttgttgttgttctttatgaaggattctctctgctctcacatctaagtaagcaagagccaaggaaggcacagattagtgaaagaatacattttatacccccaatcttaagtgtgaccccaggggttgtgtgaccagcagaaccccacgaagcttcaatcttagaatacagccaactcacgaagttcatgtttaccgtacttccaattctagccatgctaaattgttggagtccagacaccaggtttaattctttgtctttaaaccagctgacagcatatgtcctgggcaactgctgagcactccccaccaatccaaacacaagtctttcaaattccatcagccaaaaaacattaaatattccacccagaacaaaacaacctgtccagtgcaaataaaacagctaaaagtaattgtgccccatcatattccaaatactcggtcttttaaaaagccaccaaagaaacacaaaactacattgggccaagaataccaggcatatagcagcatgaatttcatggtgttcacctgcctgttccgtttatcctgagtctgaagggcagcaggattattatagcaaaaatagctgctgaagccaaggaaacacatcaataacagcatcaaaagtcatagccaggtgactggaggccacagaagggccagcagcacccatgctttctcatccttctcctccattgcgcccgtgggaggctgagaggcaaaaggggtgacaactccaggacctggcagaaaagcagtgcccacggagcacagccaagtcagtgatcacatgactatgtgattctgactatcgtagaataatagtgaactgtggcggatagaatgaatggacaagagacagctacaacaggactatagattaatagaacaatgttgagcaaattgcagacggcagcatacagcacattatttacataaaataaatatggcagtatggtaggatttgatccttgtaagatttttataatttaactcaaaaacagtaatggaggcctcatggaaaaaaattgaactaggcctgggtttttaaacactttcaaatgtgaaactgctggttacatatctctctctctcttttttttttttttgaaaacagagtctgactctgttgctcactgcaacctccgccgcctgggttcaagtgattctcctacctcagcttcctgagtagctgggattatgggcacctgtcaccatgcctggctaatttttgtagtttttagtagagatgggatttcaccatctcggccatgctggtcttgaactcctgacctcatgatctacccgcctcagcctcccaaagtgctgggattacaggtgtgagccaccgtgcccggcctacatacctctttttaatatcatgatagtacttatactatagtatctgtgatgaagataatatgtaatgaaagatattttgaattaattggtgcctttttaaattttattttatttatttatttattattattatttttggagacagagtcttgctttgtggcccaggctggagtgcagtggcacaatcttggctcattgcaacctctgcctcccaggctcaagccattctcctgcttcagcctcctgagtagatgggattacaggcacctgccaccacgcctggctaatttttgcatttttagtagagacggcgtttcaccatattggtcaggttgttttcgaactcctgacctcaagtgatccgcccgcctcagcctcccaaagtgctgggattacaggcgtgagccaccttgcctggccacagtcacatctttctatatttgaaaaatagtggatatgtgacatgttaatgtgtagtctacagtgttattctactctatgggttttgggctttctctttgctaacttggctgctcggtagaagtttgcacgcacaagttgggtactagttagttaagcatcaaaaaaaaaaaagcaggtaggccaggtgcggtggctcagaaggtcaggagttcaagaccagcctggccaacatagtgaaaccccgtctctactaaagatacaaaaattagtgggacgtggtggtgtgcgcttgtaatcctaggtacttgggaggctgaggcaggagaatctcttcaacccgggaggcagagcttgcagtgagccgagatcacgccactgcactccagcctgggcgacagagcaagactccatctccaaaaaaaaaaaaaaactaaaaaaaggaaaagaggggaggggcaggtagaatttccacaggtaaaatagaagaagaggggtccacagataggagaaaaactcagaaatgctatggttgcttcagagtgggcaaggccattttcagatagagtgaaaattgtgtgctttaaatttttagggctactcttttagttgaatttggttgacattttagagattgaaaacaatttagagggtctaagtcagtttttcatgatgaggattccagtcagctattatgaagctttttagtgaatgtaaccaatcaaaagtaagtgacgtgggaaagctgacttaatgttgtcaaggaatcaagtggcaagtggctgccagtagaatcaagtgcaggggctttgtggcagtggctttgatgtccttttacattgactctttttttgttgttgttgagacagagtctcactctggcacccacgctggagtgcagtggcacaatcttggctcactgcaccctccacctcccaggttccaacaattctcctacctcagcctcccaagtagctgggattacaggtgcacgccaccatgtttggctgttttctgtaattgtggctttcaaacccataattagaaatactttacatcatgacgcagtgcatacatatgtatatatagattagtgaataaaacacatacatagattatataactgaaactacttgtgataaactctgttttctatttttgttaacaaaaaaactttgatagtgactcattaaattgcttttgcagccctgtttgaaaaactagtccatgtaatcagtatatcctaagacccattttggcactaacttacacagagcaacaggatcagtagataaagacttaactctttttggtgtaatgcactcttcacaacagctattccagtctctattccctcaagccctcatgcttcttcctttcaatagataacctcatcagttgtgaaaagtaaggcgctatggtgggccttacttcatttctacatttcttcgaatatctcttttaaagcgcttgttttgtacagtttccccatctagttactatcttcaactgttaaattttttgtataaattgtcctgtttattatgcttaagtactttactaccctgttctttaaccctttacagctttttttcctattgctttttactaaaaaaattgtattatcaaggtcactgactttatactctgagtcctgtggcatttcctaattattcagaaatgtttggtgttaatgatctgtctctttttttaaacttaatctgcaccttccccatgtcttatgatcagaaaaagcaataaaaattcatacttgcttgtgaacagttcaagctatattaaaaagagcagagagtaaaagatctcgtaacactaactattgttagttaactattgttatgtattgatgtcctgtttctggacatttttctatgtgtatacaaacacacccccaatttttcacttgttctttcctttcttttcttttttcttttcccaggctggagtgcagtgcagtggtgcaatcacagctctctgaagcctcaacttcttgggctgaagggatccttcccccctcagcctctcaagtagctagaattacaggcatgagccactgtgtccggcctcccactttttctttaaagacaaattagcttgttttagaaatacctgcttttaaaaatgtaacaatagattcctcatatcattccatgacaacacttactactgatatttttcttggtagatattttccttctgccactaaaatgataagctccacagtgctctttaatgctttgttctctgttgtatccttttacgtagaccaatggttagagtaactgggtaatcaatgtatatttgttcagtgaatgaaaaccatttaatgagctgagaatttcatttctcactgatctgaaacaaccacaatcatgattctaatggttggacacattgaacaacagaagaatcagatgtgcaaatggtactgcaataaagaaatttaaagaggtcaatgtactagaagggacctggtggctagtttagattttagtcaaataaaatctttctagaggtaacgtttaagctgagtaccgaatgataatcagaagacaaagggagaaaagtatttccaacagaggaaatatttagtaccaaggccgcaagacaggaatttagtatttttgccctttaaggctgacttgatctctgtggttttagttaatgtatacaactcattgtattgttcttttgatgattccttaagaatgactgctgattaagtgtcagtgatctggaggtgtattgtctaaaatagcagtcacagggcatatttcaagtggttggtggctacattattggacagcacaaatacagaacatctccagcattacagtttggttttacagtgctgttctggaaagtcactcttgagattttttttgctgctatacccctggagtttgacacataaatgccgagtaaatacttgttaaatgatgaaatgaataaatggatagatggaggcaatatatctattcctagataaggaaaaagaaaatgtccataagttttgagatgagaaagggtttgatgtgtttgaggaatagaaagacgactggctagtttcaaatcaacatagagaaattggtgatgttaaaccttctgaattttgttttaagtgcactgggaagtgatggaagggtttgtagcatagcagtaatatgatctgatctgatctggtgtgaatgtctttttagcagatgatttcattttaccagctctcttgaaagtttaatcaatgtgatagccatgacagtttattaaactacttatttgagaaagtaactgcctgtgggaatccagattatttgtttacttcatttttgatgttagtgctagcacccttgttttatatttgttttaacacttctatacttaaaagcaggaacttataggcaagaacttctttttgttcttttttccagtgaaggtggtgtttttaaggctcatcttactttcccaaaagattatcccctccgacctcctaaaatgaaattcattacagaaatctggcacccaaatggtaagtttatctagttttacttttacatttgcagatttgatggcctgttattgaagtgttcaaggtcaataagaaagatctgtttctcagtgaaattgctttggcatttttgtactgttcattgtgcacatggctgtgtactaaaacctttaaaaggaggagaggccaggtgcagtggctcacacctgtaatcccagcaggccaggcaggcggatcacttgaggtcaagagttggagaccagcctggcaaacatggtgaaaccccatctctactcaaaatacaaaaattagttaggcatggtggcacacacctgtaatcccagctacttcggaggctgaggcacaagaatcgcttgaacccgggaggtgcaggttgcagtgagccaagatcacaccactgcactccagcctgggcagcagagtgagaccgtgtcccaaaaaagagaaggagaaacagagatcatgtggaaaaagttattttttatttatttacttagttttcagtttggtttgagactcgtgttttaaaccagagggcatggttactgagggataacatcaatagaactcctataattgaggggataattatcaaggtattagatgattcactggctattacaaagaacacagaaattatgaaacctggttctgtaacttatagtttttcatattatttttataccatggataactcttctatgtgtattcataggtgtaagattactggcagtgtcatatgaaacaacatattacattttttaagcctggaaagcatctagtatggctgtgcacgtagtgatgacattgactttttttacttaaagaagagctaccacttcaaatccacacggtggcagttctcctgcctagccagctgccactggactctctcccctgtatataagcccccaataactacgtcttatttaaaaattaaaaaaaaaattctctataaagtaaaataaagtccccaaagtttaggccagataagctatatttataaaacagtctctctgaacttttggctttgttttgtatgatagaacttgcagagatttcttttctaattattttgactatgtaatcagagttgtctctttaggctattatactaatttgcatttggcttcgcatcatcaagacttctgggtgcagggaatagaaacatatagattagtttaagctggaatcagcgagacaggaatgaatgattgaatgaagttaaacaaggatttatcggaaggatatggaatacgtaatagaagccaaggcttgaaaaccagatgggcattaggagagactggaactggcaaatggagaactactgggagccaagggacttagcgtattttattgcatctaaggcagcagtgatcgtaaaagatagtgatttttcctaccagtaagaagaggaaaatatctctaacagttgatggcagaatgcattaaccgtattcctgcatgatgcgggcatgcatgaatgggtgacacttgcctcttgtgctttggcttttcttttatctcttcctaggctttcgacagtttcttctaccttcacttgcattacttgattataataggcaatcgttttgcacctatttcgaagatgtaacagattctgaatgttggcttcaccacagactagctgtgtaactctaggcaaaccctgttggagccttaagctagctagcttgccttcctccctccctccgtctctccttcccccactctgcccctccttttccccttctctccctctctcgctccctccctccctcacttacgtttctcccattccgtcctttttttctaagacagggtctcactctgccacccaggctgcagtgcaatggcatgatcacagctcactgcagccttgacctcctgggctcaagtgatcctcccaagtagctgggatgacagggacacgccaccacacccagctaatttttgtttttttttgtaaagacggggcttcaccatgttgttggccaggcaggtcctgaactcctgggcacaagtgatctgcccactttgtcctcccaaagtactgggattacaggcattagctaccacgccaggcctatgttttctatctgtgaaaattagatgaaaacatacatgtaagcaaatacatgggagacttcccttctggtaaaaagaaagagagcaatcacctaggtagtttaagaggacagctgataaaatggtggtgtgttttgttttaaggttgaagagacttttttttcttttcttttcttttcgtttctttcttttttttttgagacggagtctcactgtctcgcccaggctggaatgcagtgggacaatcttggctcactgcaacctctgcctcctgggttcaaacgattctcttgcctcagcctcctgagtagctgggattacaggtgtccactaccacgcctggctaatttttgtatttttagtagagtcggggtttcaccatgttggacaggctggtcttgaactcctgacctcatgtgatctgtctgcctcagcctcccaaagtgctgggattataggcgtgagccacgcgcctggtcttagatggaattttgaatgaagatgatgcttggcttgaacttcattctttaggctgtgaggactcgtttaattcatgacatttaaagctgtacatattgtcatgacaaaaagagaaaatgacaaaaaataaaaaagctatgtaataggtttctcttatattttccttcttgaaagattacactcatagaagattggaaggggaagtcagagagatagcagggaggtagagcattttagcaataatttgagtaaaaaacaataaaaacttgaactaagaatagtgttgcaggaagggtaatttagtttctttgacttgactgccagaggtgaatggtaaaggagaagtaagagtttaggattgactggccatttacaaaaataattatagagtgaaaaccataatgaaataccactttttacccactaggattcctataatcaaaaagataataacaaatgtcaatgaggaagtagagaaattagaactcccatgcactactggcaagaaggtaaatggtgcgggtgtttggagaagagcctggcagtcctcaaaaggttaagcatagttaccataggaccctgcacttccatcctaggaacctaaccaagaaaactgaaacacatgtccagaaaaactcgaacacgagtgttcacagcagcatttattattcataacagccaaaaagtagaaacagcccaaatgtctatcagctgataaatagaaaaacaaaatgtggacccatataacggaatattatttggcaataaaaagaaatgaattacatgatattgttttctaaagaaaagaaagaaatgaagtagtgatacttgctacaacatagatgaaccttggaaacattatattaagtgaacaaagtcagtcgaaaaaggtgacatagtgtacgattccctttatatgaaatgtcaagaatagacaaatccatagagaccgaaagtaggttagtggttccctactgctggaggggaggtgggggggattgaggaatggttgctaactggtactgcgtttcattgtagggtgaaaaaatactctaaaattgattgtggtattgattgtacaactctgtagacatactagacagaaaccattaaatcgtgcttttcaaataggtgaattgtatagtaggtgagttatagagatgttataaaattattataggggaatagttttatgtgactgaccttacatatattcagcttttcttgaggtatacttgctacacccagttagataattagttaaaccagtccagggttcagcaatgagcttaagggccttggaagttactgtatcaggatgatagataacatgataatgaatgggttagttttcctacggaaaatatagttaatgttggagattaggataacatcaaaagtcaaattaaggaaaatgaaaactagaaagtgactgagagaatgttcaagaaccaggggaaaacaagagtaccacagatgccaggggaggaaaatgtatccagcaaagtgttgtcacagtattagttgtcttggcccagaggggtgacttcaggtagctgaaagtacccaggagaataaatatgctatccagaccacttgtggacacagttgtagcatcctgctagggagaagccagtttctaggagaataaaggaatacctgagtagtaagtaaatagagaagatgagggtaaatcagtttttcagaattttaggtgcatggcctcaagaaaaaggaggtagctagaagtatatgcattgtttaggcagcttagttttgtttgtttggttttggtttgggttttttttttttttttttgagacagagtctcactctgtcgcccaggctggagtgcagtggctcactgcaacctccgcctcccaggttcaagcaattcacctgcctcagcctcccgagtagctgggattacaggtgcgtgccaccaagcccggctaattcttgtatttttattagagatgggttcaccatgttggccaggctggtctcgacctcaggtgatccgcccgcctcagcctcccaaagtgctgggattacaggccagccatacattacagtgggccgagccactgtgcccggcccaggtagcttagtttcatctctaatgaacactgaaatgaaagaaaaaagtaacaagcaaaaattatatggggaaaactaagaaacaccgtggcaagaggaaagtaaacattaagtacataactggctaaaggataagaacagacatttcacaaaagaggaaggacatacaggttatatccatggaaagttgtcaccccaaaagcatttagaaaagtgaattaaaccagatgttatatatgaaatttaaacagcatcaataaaggaaaatgttcatcctgaggaggcaatgaaatggccatctcagattgctgatggcagtataaattgatacaatcctttaaaatatggtttgataataggtattaagcctaaaaatcttctcattctaaaataaatggtatgtttaaaatgacatgagaaggttaaaaatgtaaagatcctggattagtgataacttgattttttttaaaaaggaaaatggatcttatatagtggtggtagaattctgtacacatatttaatagcatgtttttaaagaaaaatgacttggaaaaaatccttattacacagtaagtacagaaaacattgtaaaatagtaatactctatgaaatttttatgctgaattttgtagtgttacaagttttgatgttattcctttttttttttttttttttgagatggagtttcgcccgttgcccaggctagactgcagtggtgtgatgttggctcatggcaacctctgcctcccggcttcaagcaattctcctgccccagcctcccaagtagctgggattacaggcatgtgccacaacagccagctaattttgtatttttagtagagatgggatttctccatgttggccaggctggcctcaaactcctgaccgcaggtgatctgccctcctcggcctcccaaactgttgggattacaggcgtgagccaccacgcccggccctcggtgttattctggccctgattctattttagtaaatagattttactagcagatagggatgggttgggaagaggaaccttaattatagaaaacctcatacataaaacattgaaggcacgggccttgcctgtcatatattcactgctgtacttctctgtcagatgtgtgcctggcatgcagtaggcattgaaaaagtatttgtcggccagcgcaggggctgtttcctgtaatcccagtttgggaccagcctgggcaatatagtaagactatatctctaccaaaaaaaaaaaaaaaaagccaggaatggtgccatgtgcctatggtcccaactacttgggaggctgaggtgggaggatcactagagcccaggagtttgagaccagcctgggcaacatagtgagacccccatctctaccaaaaaaaaaaaaaaagtcaggttagccaggcatcatgccatgtgcccatggtcccagctacttggagggctgaggcaggaggatcgtttgagcctgggaggtcaaggctgcatagagctgtgatcataccactacactccagcctgggtgacaaagtgaggccctgtctcaaaaaaccaaaacagcaacaacagacaacaccaaaaaataagaatttgttgaattaagagagcaatgatattgattggtagatacaaactttgattctgattacccagagttcataacagcagaaatactgatgttatgaaacgaaaaataagatttagcattatatttattcacaaatttgttagactatataggataagttaggaatgaaatatacataaacattgtcactactcaaattcctttctaaaatttcttcctcaaagtatgatttttaaaaaaatttacggtgggtaaatgttaccataaaagattagtttcacaatagggattatttatatgatgtataaatgaattagtggattaggacctttttttaatgaataagtaatattttacttttttgctaaactgcttaaacagttatgtcaatacatgtctcctaaaaataaggatgttttcttattaaatgtgtttatagaaaggaggcctcttgagtgtcgtatatgttgatgagttttcattggcagtatggcatgtttgttttgtgaatttgaatatactcctttctcagaaaatacaattttgcctttatatgattgtaaaaatatatttcttaggaatagtctctgggcctttgactattaccaatttaagtcggtaagttagtggggaaactaggaggccattacatagaaactcagttgctagtttttggaaaaatatgctttctgcaaatgaagaacacatccaatagttgctatttattcatttattatattatacttaagacatgtaaatgttaggcaccatctacgtgctagatatcttcatgttttacataaatgaaaaagatagcttgtattcctattgggtttgtcagatggatcctgtgtatgtagtacaatctatactatagtcttcttaaaaagtcaacacattgcattttggacattaacttctgcgtatgtgtcatgtttgataaaggtactgtgtgaatcaggatcacatttgtaattgatatttcatgtataaccaaattagtaatatatgaaacaagcctcttcttgaattttgcagttgataaaaatggtgatgtgtgcatttctattcttcatgagcctggggaagataagtatggttatgaaaagccagaggaacgctggctccctatccacactgtggaaaccatcatgattagtgtcatttctatgctggcagaccctaatggagactcacctgctaatgttgatgctgcggtaaggtggtcacacgtcttcccttcccttcactttcccttgtaataaaacctgaactatagttagtatgtatgtaagtatgcatgaatgtatgcatgcgtgtgtgtgtgtgtgtgtgtgtgtatctcttcccatagttcttatttttgacaaaataaatatatttatttacgtatttattttattttttttgagacagggtctctctgtcacctaggctggagtgcagtggcacaatcataggtcactgcaacctcaaactcctgggcccaagtggtcctccagccttggcttcccaaattgttccgattacatgtgtgagccaccatgcctgaccaaaagtgcatatttattgtatacaacatgttgttttgaaatatggatatgttgtggaatggctaatttgagctaattcacatatgcattacctcacatacttactaattttattgtgagaacacttaaattctcctctcagcagttttcaagaatactatacgtcgttattaggatgtaaactgtgacaccaaatttagaattgggggtggaatgggcagagcagaagtgtagtttttcaatgcaatcagatttttatcagcttaaaatggcttgtcgtaactgtgaaatttttttgtaagcctcattttaaccacggagcaaagtcctacagtagttaacacaaaagataaaaagtaaggaatcggggctgggcacggtggctcacaactgtaatcccagcactttgggaggccgaggcgggtggatcacgaggtcaggagattgagaccatcctggctaacacggtgaaaccccgtctccattaaaaatacgaaaaattagccgggcgtggtggcgggcgcctatagtcccagctactcgggaggctgaggcaggagaatcacttcaacctgggaggcagaggttgcagtgagccgagatctggactctaaaaacaaaagcgattgtcatacctaagacaatttaatgcctggtctgaagttcatattattatccccaagttttcaattttcaaaagtttcacatctatagaaaaaaatgtattagttaaatgaacaccagcatacctttcacctaggttcaccagttgtagaaattttgcaactttttttcctaaacagtttgagagtagtttatagataccataacccttcaccccaaaatgtttcaggatctgttccctaagaacaaggctgtctttccatatacacagtacaagtctgtcgttaatgtagtactattattgtttatgcatatataatctatattcacattggattggattgtccagtattctttatagctgccacgcccctatcctgcagttttttttttctttttaaatccagaggctagtctaggaacctctgttttatttgtattcaagttttattagtcggctttaatctagaatagttcctagttccttagccttctctccttctttgaaaagcctttttttcttattcttagaacctttgttagtactatataccaaagccagggcataaaatttaccttttttcttaggttaataacaacttgggtggaatcttatatacagactgagacactatagataactccctttgaaagctatgactgaaattaataatagaattgaactaaaaactggcagaaaactatctatttaatcaagtattagtctaaacaatgtaagacatgataagggagaaggggtgatagctgcattaaaagaaatcctaggaaatcattttgagagagacctgatgaatgtttatatggttcatgctcaactatcagcaattttaataataagatcagagttggccaggcgtggtggctcacacctgtaatcccagccgtttgggaggccgaggcgggcagatcacaaggtcaggagttcgagaccagcctggccatagtgaaaccccgtcttaactaaaaatacaaaaaaattagccaggcgtggtggcaggcgcctgtaatccccagctgcttgggagactgaggcacggagaattgtttgaacctgggaggcagtgcttgcagtgagcccagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgacaagttgccctttttattttatgtatgtatttatttatttttgagacagagtcttgctctgatgcccaggctggagtgcagtggcgtgatctcacctcactgcaaccacaacctctgccctctgtgttcaatcgattctcctgccttagcctcccaagtagctggtattacagacgtgcggaaccacgcccagcaatttttttgtgtgtttttagtagagatggggtttcaccatgttggccaggctggtctcaaactcctgacctcaaatgatctgcccgccttggcctcctgaggtgctgggattacaggcatgagctactgcacctggcccttttatcttaaagaagagtaaattaatagccaataaccaagaccatgaatatgcaaaaattactttattaacccttcaaaatagctgaatctaaaaagagccaaatgtactgccagagtaaagtcattctcttgatgctaaacattttcctaagtgttgaaataggccttaatgtgaggttgaaatatgcaaatatgagttctagtccaaataccacaaattgtgcaaaatctattccttttttttcttgaatcccactggttcttccttctgatttaactagttagttgtctcatattaaaaccaaaaaccatgacttataaacagtttaccattctttttttttttttttttgagacagagtctcactctgttactcaggctggggtgcagtggcacaatctcagctcactgcaacctccacctcccgggttcaagtgattctcctgcctcagcctcccgagtagctgggattacaggcatctgccaccacgcctggctaatttttgtagttttagtagagacagggttttgccatgttggccaggctggtctcaaactcctgacctcaggtgatccactcacctcggcttcccaaagtgttgggattacaggtgtgagccacccggcccagtttactattcttacttgctttttcttctctcatattacacctttgatcatattttcatagtattgattttctgacctctcagtctgcagtacctattccaggaaacccgcatttttcttagccacctctctcctgggtccctttcttctttggctccaatttttttttttttttaaagatgtagtctcgctctgtcgccaggctggagtgcagtggtgcaatctcagctcactgcaacctccacctcccaagttcaagcgatcctcctgcctcagcctcctgaatagttggaactacaggtgcgtgccaccatgcccagctatttttttgtatttttagtagagatggggtttcaccatgttggccaggatggtcttgattacttgatgtcgtgatccgcctgcctcggcctcccaaagtgctgggattacaggcatgagccacctcgcccggccgctttggccccagatttgattgactctctcagcctggggcttagttgatttgctcagattaccccttcactgctcttctcaattgaatcttttgtttcatggatcccatttcttctttttcttcttggttgatttcttccttcatcctagagtaatgttttagggtatgtggcaattaaatccttagtctatttatgatgtaaggtgcttttatttttcccttatacttgattgatactttgtttctaatattatagggagaaaatcaaatttatatagaatttatattttactatttcttattgctgatgtgaaaattggtactaggctgattcttttccatttttaggtgacttgttcttttttccttttctttttttccccattgtacttaggttcttttctttatgattggtctttggaaatttcacagagttgtgtgaactctttttgatttgccaaattaaaatttgctttaattttaaagataccagccctgggaaattttcgttttaaattattttgaggctgggcatggtggcttacgcctgtaatcccagcactttgggaggccgaggcaggtgagttacttaaggctaggagtttgagaccagcctaggcgacatggtaaaaccccatctacaaaaaatacaaaaatcagctgggtgtggtgatgtgcacatgttgtcctagacgcttcggaggctgaggtgggggattgattgcatgagcccaggtgttcaagcctgcagtgagctatgatcaccactgcacttcagcccaggcaacagagtgagaccctatctccaaaaaaaaaaaaaaaaaaaaaaagaaagaaaagaaaagaaaagaaaagaaaaagaaatgacagtctcggggggaaaaaaacaaatggtatttatgtcactcaaagctatatggctatttggatgacaaagctactaaactgaaggtaagggtaagggttggaggaagaggtgtcttttaaattccaaaatgaaggagtaattgtttttggcaccaatacccacactagcagttcttttatttattttttgttttttttttgagacagattctcgctctgtcgcccaggctggaatgcagtggcatgatctcggctcactgcaacctttgcctcccgagttcaagtgattctctcacctcagcctcctgagtaacagggattataggcgcgtgccaccatgcctggctaaattttttgtatttttagtagagatggggtttcaccatgttggccagtctggtcttaaactcttgacctcaggtgatccacctgcctctgcctcccaaagtgctgagattacagatgtgagccaccacacccagcctagcattctatgaagtacatggttcttggtagcattctaaaaggcttacttctaacaaacctttcttcattcccctgtaccttcctttgcctttctcaggtcctgccctaggaatatgctctctctttcctgagcaaaggctagtgtctcaggaaggcacagtccagaagtgnnnnnnnnnnnnnnnnnnnntggttcttccttctgatttaactagttagttgtctcatattaaaaccaaaaaccatgacttataaacagtttaccattctttttttttttttttctgagacagagtctcactctgttactcaggctggaatgcagtggcatgatctcggctcactgcaacctttgcctcccgagttcaagtgattctctcacctcagcctcctgagtaacagggattataggcacgtgccaccatgcctggctaaattttttgtatttttagtagagatggggtttcaccatgttggccagtctggtcttaaactcttgacctcaggtgatccacctgcctctgcctcccaaagtgctgagattacagatgtgagccaccacacccagcctagcggttctaattatagtattcttcagtatatttatataaagtttatatattattattttgggaaagttaaaattttggatataggtgagggaaaatgttgagtatacagactttcaattaatctctattttcaggccctcttttttttttttttttgagagacggagtctcgctctgtcgctcaggctggagtgcagtgtcacgatattgcctcactgcaacgtctgcctctcaggttcaagcgattctcccacctcagcttcccaagtagctgggactacaggcatgcaccaccacgtccagctaatttttgtatcttttagttgagatggggtttcatcatgttggccaggctggtcttgaagtcctgacctcaggtgatcctgaggtcctgcctcggcctcccaaagtgctgagattataggcgtgagccactgtgcatggcctcagccccactttttattcaggctcttctcagatttgccatttccaaattttagcttctctaggcctctgtttaatagacccttttccctttgtttcctctctcctccaactcctctctctcctgctcttccctttccctcccctcccttcattaccccactgttctgttccatttttgtatgtcaggcagtgacagtgataattgtcatatattttcctctacagtagaaatggtacttagtatcatctcaatatgatgcatcccacctatctaccttatgttgcagacacttttatgtttattttctggttgtttccaatagggagagttggtaatccttcagattaccaactgaatgtctttttttgagatggagtctcgctctgtcgtccaggctgcagtgcagtggcaccatctcaggtcacagcaagctccacttccccagttcaagcgattttcctgcctcagcctcctgagtagctgggattacaggcatgtgccaccacgcctggctaatttttgtacttttattctcaccatattggtcaggctggtctcaaactcccgacctcgtgatccgcccacctcggcctcccagcttgctgggattatggacgtgcgccacggcccctggcctgaatgtcttattggtatattttagctttctatttcagtgtaatacaaaactgtaaatgttcttttgtgacctttttcttttttaaagataatttttaatgtagaggtaatttgcataggagatttctgcctgtatatcctggtagtgtcttgaaaaagtatgtctaactgctttctaccttttcaactctataatgtttctgaagtgtacaaatcaccaagggattacattcaaaattaaaataaatatttgagattataaaggggagtttgcatgaaatcacttgatactgcttttttaatctacagaaagaatggagggaagatagaaatggagaatttaaaagaaaagttgcccgctgtgtaagaaaaagccaagagactgcttttgagtgacatttatttagcagctagtaacttcacttatttcagggtaagtttattttaaatatcatacttttgtttttttgtaagtatcctattagtttttggaaattgtgtgatttgggtatttgaattacattttttcattgacttcattttttaatggtattatcctgtagtctcgttctcaaaactactgtataatctgcttgcttttctcctaagacacccagctgtttttgactagatattctgcattcatatggttagtatgctggtctgtttcttttcactgatggtaaagtttctaatgataaggttgttatttcagtttagtttctttgtttgactttttgatctagcatcctgatcacttgggcactaatgtatcttcatatactgtattatgtagggtataggcaagactattagtcatctacctattcctttaaggttggtcttctggccaggcgtggtggctcatgcctgtaatcccagcactttgggaagccgaggcgggtggaacacctgagatcaggggtttgagactagcctggacaacatggtgaaacctcccctctactaaaaatacaaaaattagccaggcctggtggcgtgtgcctgtaatcccagctactcaggaggttgagggaggagaatcgcttgaacctgggagacggaggttgcagtgagccaagattgcaccgtggcactacagcctggacaacagagcaagactctatctcagaaaaaaacaaaaaacaaacaaacaaaaagttggtcttctatctccttggtctttacagatagggccagtagttaaaaacttcccttttattgtataacatctgtccacagttttatgttaggtctagaaaggagtcaaagatggaaggcacccatccaccttagaagaggaaataatatagattaattgctcacatgtgggttatttggtctcttcttttaaaattaaatattgaaatgatagaaactgaagtgaagactatcctttcagggatcatttctatagtttgttactatagaagttttctgaaggtgtagagcaccaaaggatacaacattgagctggtttcaaattcagctgctttgattcagcaagctgcaacagttaaaaacatagcagaaaattgttattgaatatctatgtctctgaaaacggaatagttctgcaagttggtgaataaagtctaagagttgtccagctacagaaacaagatgccagatgattcgtaagacctattcgtgatatttaaattactcaataaaagacctattgatttgtgggggttgagggagaaaccgaaatacactgtctgaaaaatcacaatccatggcacatcttgaatctacctattttaagaaaatgaacattaccattatcttctgtcccctacactccgctgctttcttctgtccctttctcatattcctaactctgggtttactattgcttttcttcataattttaccaaatttgcatgtttaaacaatgtatttcatgattttgaactgtttatatgtggaatgataatgaatgcattcttctgttacttttattgctcaatattcttcaaattgatctgtgttgcaaataggtacatttcacctgtgtgctattacactgggtaaattaccgctctactccttattctcattgcagttattttctgaattggtgtaggggtgtttgttctttttctgttatagagggtggctatccttgtttcctgatttgcatgtactgtaagaggttctctagggtatatacttggggtggaattcttaaatcaagggtacgcgtatttcattttgagtagataatgccaaattgttttctaaagtgttccttcttttcatagtcccattggcaaggataaagatcccctttgtggccaggtgcggtggctcacacctgtaatcccagcactttgggaggccgaggcgggtggatcacaaggtcaggagttcaagaccagcctggccaatatg

SEQ ID NO: 15882 - DNA, 44431 bp, Human
gcccgggaggcagaggttgcagtgagccgcgatcatgccactgcactccagcctagatgacagagccagatcctgtctcaaaaaaataataatggggctgggcacggtggctcatgcctgtaataccagcactttgggaggctgaggtgggtggatcacctgaggtcaggagttcaagaccagcctggccaacatggcgaaaccctgtctctacaaaaaaaaaaaaaaaatacaaaaaatagctggatgtggtggcgggcgcctgtaatcccagctactcgggatgctaaggcaggagaatctcttggacctgagaggtggaggttgcagtgagttgagatgtcgcctcgccactgcactccgcctgggcgacagagtgacactacgactcaaagaaattaaaaaaaaaaaaaaggaaaataataataataataataataataataaaatcaataaataaaataccaggccggaggagccacaaccagaaaaccagcattcctctagctccacagcaccaggctgagacgcagctgatatcagggaatccatctggatcacccatcaaaagccccaaagcacctttcggtccagccagtcctcagggagtgtctttgctcagggaggcaccgagaggcggagaggaggaggggcccagtcctgtcccaggaggaagagcacagaatctgggggtgtgcatgatctggataggggtcagcagctccagaccaggctggaagttgaggctctcaggagcgggtgaggggctgtgttgttggggcagggcgcagctgcagctatctgggaaagcttcctggctgcagaggcacagaaggggtttggggtttgaacagccagctgtgcgggctcaatcctggcatctctgaccctgtgcagccttggtggatggcagagactgaggctctagaaggcagagcccagctcgtggtgggaggcagataagggctggggtgaggctgtctgggtctctcaagctggagggagcggcaatcaggctgttctcttagctcctccttttggcggggcgagtggtttctgccttcctgcgacttcctcctctgacccgctgccacttctcctggccctcctggggcgggtggagctcgggagcgctgaggcggaggctcatccatctctcccctccctgggccagggtcagtcccctgggagccctgggcagaagacccccccaccccaccctctcgggcccctctggggagccccacctttgctccctggttacatttcctgctggggtgacggtgtgagtctagggtaacgagcctggttttctgaactttcttatgcaccggctctttgttaaaggttctggttatgtgaggaataacccctcgccggtgggcattggaaaagaataaagaaagcagaaacaccaaataaggagaacatccagcactttcctctagagaagacccgcttattcagaggctttcgggttccctctggagtcacttcgcagaattcgagctgggaagcaggacgccccgggcccaggagagcccagaggaggcgacgcgcagcccagagccgggtgctccgcagaccgccccagctctcggccagatcccacccctagcagctccgcggaccgggaccgaggacccccgggccacgcgcccccggctcccgacaggcccagcacgcgccccgcgggcggtctcagtttcccctctgcagaatgggcgggggacccaggcggtgcgccccggggcgcggagggcggccggaaggggtgtgatggggggcgggccccgcgccgccccgccccggggagggagtcccgggcgcagcatcctggcgcgggccggggccgccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacggtgagcgcgcgggccgggccgggccggggagcgggggccgcgcgcgccgcagtctcagtttcccctcctgcctccccacccggctctgggcgggcaggaagcgagggctccggaaacctcttcggatgctcctggggcacccggcggggctgcgcggccaccttcgccggcgccggggctgggggctgggggctgggagcgggttccagctggggagaccggacgcctggcaccctctgcgcggtcctcccggacttcccacctccactccggccccgtccaccctggaagcgttattccaccccatcctggaccgtattccaccccaacgccgcgccgctcccgctggcatcctgcaggtgcagcgcagacaccggcgggcgagggacggccggagactcaggctcggcctcccagctggccccagggtctcccctgagggctccagaaaacgcccaggaaggtgccgcttatcagctagcagccttggggcccccacccccaccccaggtcttcctctttctgcaacccgaagcggatgtggctggcggagtcggtgggggctttgaactgctgaggcgggagacccaccttcctggggtggcggagtcaaggcctcagggaactgccagggaggcctttcccatctctggggagggagggaggcttcactatcatttcatcctcacctccttcaaaggagtgtgggattcttgctcttgccaaaaggcacattgagtgccaccgggtactgtccagatgtggcctggcaccttggaggtcccatgagggtggaaaatacagaggtgccctccccacatcccttccaggcaggacctgccacccccttgctcatgcccgcagcatcgggcagagtgtgagggatcccaggagaaataccctcaccatctacagagggcagcctgggtctgcatcctttggggacttggagccttgcccttttggggttcccagccagccagaggggaaggtattctagccctgggatcctactactcagggctagcttgaaaattaggaagaagtgtcagaaaaggacttttgggttttgtattggtttatgaaaaccacctcttatataaatattatctttctggagcagaaatcctttttcaaaaaaattagttgctatatttagttgagctgtgggaggaactggggagataaatattatttaatatcccccattagtgacttggcagggaggttgtgctttgctgcaggagagctgggcagcatgggctgcctctgaccctggggtgggctgggggcgagggccggcgcaggcaggtctgcggtcccactgcctcttttgtgctgctatagcctccagcttgggaatcctgattcctgagggaaactggagacgcagcccttggcctgtccctggaatcacacaaatactgcttctgtacgaccctagccaaggtctgtcttcattctgatatcatgtcttcattggtccagcggaggaggaactgactgggagggagggagccccagccttccccacctgttatttggttagatgagatccttggggtgccctggccagcgcacacctgtgtgaactgatggggaaggctgtgggcttggcgtggtgtgtaggtccacagagggtggatgtgtgttggggtgtgatgggaaaagttggggagggatattgctgggctcccctggatcctctgggcattgatagtattaataataaaagctgatgttcactgagcacttactatgtgccaggttctagtctcagcatttttcatctattatctcatttcttccccaaaacaactccataagggaaggactgttgtcatccccattttatacagcaggaaacggaggcacccagaggttaaaccacttgcccgaggtcacatagtaggtggtggagctggcactggttacctgctcctctctgggcctcagtttccccatctgtacaagacagtcacaagttctgcaggatgcagaaccctggtgtgggcgtctgtgctaggagtttgggtcagccggcagcagctttttcagctttgcctccagccttcttgggtccctagagggctcttctctcagatcactgattggggctgggggcattccagggctctagaagtctttaggtgagcagaggggagccagctgttccttcctgcctcaggcttgccatggcttgaggaggaggtgcagatgtccctagcacagctgctggggtggagctgatgaggctttgaaccctagccctgccccttcatagctgtgcaatgctggaccagcctctttgcctctctgtgcctcggtttcttcaccataagcgaggctgccatagaacccatctcccagggttgtttgtgagtctttagtgaggtcacagacaccaagtcatccttccttgtcgcagaagaggctggggcgggctcctggccacaagctgggtggcagggtgggtcaggcctgagggcagaagggacaccccagagacatgtgttctccccaccccaggagtctgtgcacctgcaaggtcgttattgttggaaaccacaaggaagtcatttgcttaagtcctgaagcttgcaaattctgccaggggagggaggcagcggctgggcatcccacccccaccttcccaccctcctccctcactgcacacagacacttcagagctggggagcctcggcagcgcagtcagtgagcacgctagccagggaccccctccactcacacataaaaccccatctgccgtaacccccaacagggagtgagtggggaggctcctggccccagcacctcctgtgagcccacctttgcaggtgccagaggtacccagagttcagcttccttggggggcttttacttgtacatcttttttatttttgaataaaaatgtgcacagtgcaacattcaaggggttcaaaaggtatacagtaaattctccgccccgtccccagccacccattcccagtcctcccaatatcttgtgtcttcttcccaagacagtccgtgcatatacacatctggagctgtgatcttgtgatcttttcccacacggaagcaggaggaggataagtgctctttgtccctgctttgaccttgacagtcattcttggagccggtgccaggaggagcacggtggggcttcctagtggctgcatggcatttcggcgtgcggcttttctctgacttctggtggacgcttgtgttgttggcagcctctgctatgacacgcagtattgcagagtatccttgttgccacatcatgtcacgcgcttgtgaatatcactgaaggacgcattcctgggggtggaactgtggggtctaagtgggtgtatattttcagtgtcgtcagctgtcactaaacttctctgtgcagttgtgccgactgaacggctggttctctgctgcctcgccagcacagggtgggatcagacggtctgatctgtgccagtcaggtggaagagtcctctcgtaggtttgcttggcatctttctgtttaaagtcacattgggtgtcttttcatatgttaaggagccaccaaatgggctgcccatctcctctgctggactggagccaaggcaagagacctggctgtgttgggcatgtcctttctgtagctaaagtccctggagaccccagtgacctgagagtcgggcagatcccaggaggtcttctggggtggtctctgttcaagggagctggcaggccgggcagaagcctgccttcccgggccacacgcggcccatgtgcagtgagcgccttggccccagggctgccaggtgggatgagtggtccagatttagactcctgccagcggcgtcttggctctggccttatttgctgccctcaaataagttccaggccatagctggtgctgaaactcgggcaacccatatgcgtagcccacggaaaccaggccaagaggaacggagtgtgtcaggaagagggggccatctgagtggccctgcttgctgggtggcattgggcagacttggccctccctggacctgctgctcctcaggatagcagggatgggaccctgggatcccctaagggccttgcgggatctgagagggtgtggtttgcccacagccctttggaagctcaacgtctttcatgcttcaccctagttttcactcccactggcccctgctgggcagctgaagccccccaggagcagcatcaggcctgcccagctgggccccctcaccctcttacaccctaaggcagggcctgtattttcccatagcacagtcggacgaagagatgttgagcaaacccttcatctccagctccggataagccaggggtgctgcaggccccgctgcagagcggagagctacttccaaggccccgcagtggctcccgcagagcaaggtcaggtgtccactctaggtggaccccggagacacaggcagggccaggtgggctgggcgggtcttgcccagccagggcctcttcctgactctgcaagtgacgatttaattgctctgtaaatttacctttgaggaagacctgggtgagtgcttgcctctcccggctggaactgacatttagaagctgaaataccagtttccaatgaaggaaggagtagaggggggatgaggggagcaggtggtgtggagcctgggggcagcccaggggcatcgcttaccccccttctccctggctctggactgtgggctcagggccctggcctgcaccacggagcaactgagtaaacaatgactgtaaggactcagcataaacacagggatgactcagccccgccccaccctggaagtgttccagtgtggtggggggaccctaatactgacaactggtcagagaagggcacagcgatgaggtaggggaggggctttcagagaaggcttcctggaaagggggtttatatgaggagataggatgctgctgtgcacagaaggaatggcacaagcaaaatgttggaggaggaaggccgggcgcggtggctagcaccttggcatctcagcaccttgggaggccgaggtgggtggatcacttgagatcaggagttcgaaaccagcctggccaacatggtgaaacctcatctttactaaaaaataaaaataaaaaattagccaggcatggtggcaggcgcctgtaatcccagctatttgggaggctgaggcaggagaatcgcttgaacccaggaggcagaggttgcagtgaaccaagattgcaccaccgcactccagcctgggcaacagaatgagactccatctgaaaaaaaacaatatatatatatgtgtgtgtgtgtgtgtgtatatatatatatatatatatttatatatgtgtgtgtgtatatatatgtgtgtatatatatatgtgtgtatatatatgtgtatatatatgtgtgtgtatatatatgtgtgtgtatatatatgtgtgtctatatatatgtgtatatatatgtgtatatatatatatatatgaatgaggaggagaaggttttgcaaaacgggattatcaacacatcacgctggaccccataattgtgtacaattatgatttgtcaattacaaatacactaaaaagcaggggtggcaatcctgaggcttggctaacagagggacagatgtgcattcgggatacagacatgatcctagaagggcaggtggggacagatccaggaaggccctgaagcccgtgctaaagttggtctttattctgtaggccaaggacagccactgaagctctgtgaacaggacagaggcagggtcagtcatccatcacatatgtttactgagcacctgctatgctccaggagctgctctgggtgctggagacgctgcgcttaacgaagtcctgctgccctagagcttatattctagcaagtgattctggctggagcgtgttcactgtgtgctacgcattccaagtgctttatgcatgccgttcaatcttccggcatccctgtgaggtacttacatttatcaccctctttttgcagatggagaaacagacacaggggattaggtaactggcctgtggccacagaagtaccgtgagatagagcaggatttgaacttgagccctctggaccagattccttgctctaagccacgaagcttctctgatcacctccctcttttcccaggactgcaggctgactcccaggcctgcacgctgggcctccgtgaacacaggccctctcagtctggcaacatgagccaggcaggggtcaccgtggcggaggctcagattagaatagtggccagccccactgtggctctcagagagagcggcacctcctggtcctgtctctgccccctgcagcccagcggatggcactgagagtgggcagagccagggcactctctcatttaacagataggacatctggcactgccagaggcccaaggccgccatttcaaggggaactatctcagcctccaacacgcagcctgggagagagcaaggaaggaggcagcatcttccaggaatgcctggggtaggggatctcccagccctgggctccctccatcaccctggggctcattcatgcgaggggagaattgggtccttcagggttgcatttagaagcagatcaggcctgagcaggcagagcctcgtaaacccctaaagcaccatcagtgaggccagcagggccttttggacaggaggatttgggctgtgggctctctacagaggggcacgccgactgaagggatggggacatccagcccaacggtcaggacatgggacaccaagggttttcagatgagcttgggtgagcggtaaagagagtggaggagggaaggcaggacagcctaagagttagcatcggaggcccacagcagggggtcgagaaccagactgcctgagctcaaaacccttccctgtctcccccgctgtgtgacggtgaactagtcactcaacctctctgttgtgtactctgtaaaatgggcataacaatggcatcctccttcccagcttgtttgcggatcatgagaataaggcacgcaaggagttagcagggtgtctggcgcacaccaccagctgctgctgctatgacctccgctaagcacctcacgtgctcggtccccagcgtcttcccatttgttctctggtgataatgcggtaaggcacctggtacattgcttggcaggtgcttggtaaatgtgactcttaacagtaatgatgatgatgatcaccacagcaggccttcaaagtgggtgtgggtaccccacctcccaaatgaggctcaaggccccacaaggagctggctgtgtgggcaggaccagagctgtgctcagcggcaggtcaggcctccccaggtgggcggggtgagaggggagctttgcggaggaagccaggtcacagcggagggggtatcagtcaggttcagcttggatactgcagcaatcgcctccaaatctctcttggcaccttaaaggaccagaggctcatttctcactcctgctgagtgctggcagcaggctggtccccgggtgctctgtgccttcctcattctgtgacccaggtcgatggagcagacaccatctcacaggctgctggctgctgtaggagagagtgtcaaagagctccagccgcttggctatttacatttaaatgcatgaaaattaaagtaaaattcgaaattagtcacagtccaggggctcgccagctgcatgtggctagtggctgcggtcctggccagcacagacggaggatacttctgctctcacagaacattctactggacagtgacctcctagaaagtcccccaccaaaagtcaatgctccaacctggcacgaatacacatccttcttctcaaaactcacacgggggccgggaagtgccctcctactatgtgcccacaaggtgggggagaaccagaaatatttggggaacaacataatgagcaccaaagactggatcctgggtcagggtgggtcagagagcagaaggggagatgatccaggtagacaggtagagaaaggtgaactgagccgggcgcggtggctcacacttctaatcccagcactttgggaggccgaagtgggtggatcacctgaggtcaggagttcgagaccagcctggccaacatggtgaaaccccgcctctactgaaaatacaaaaattagctgggcgtggtggcaggcaccggtaattccagctacccgggaggctgaggcaggagaatcgcttgaacctgggaggcggaggttgcagtaagccaagatcccgccactgcgctccagcctgggcgagagagcaagactccatctcaaaaaaaaaaaataaaataaaataaaataagagaaaggagaacttgagagaccagccggggcaggcaggaggcatcatggggacctttgtggggaagtccaggactggagctggcacgtgtaccccatgacacgcttcccaaccccaggcctcgcccctgcccagaataaagaaaggtgagggttacaggcatcccccgggaagagcccagcacaagcccacccatgcgcaccatgaggttagtgctgtcctgattcgaggctggggcatggctggggtgacctcgaaagcacactgctccattggagaattggcccagaaaccagtcctggccctccccccgcctttcctgttcgcctcagctaaatagatcagaaggaaaaagtctgtttgattttaatctcgacgcaggacactggagattacattttccacggaaaatgtcagccactgccgaaaataggactttggagaaaatgctagaaagtgtatttttaggctatatatttccctcctggattcctacagtccagtgggctgcttgatactccccagggttcagctgccaggtgcagaccccaaagcttccaaacaggtggtccggggagagggctcccgtaggaaaaaaaaatgcctgtaggccaaaaacaggtggaccaatgcaaggacctgtttccagtgtcaggaagaaggaggtggaagagagccagccatggccggggcctcagattccgcatggctaacgagcttcggggagatgccacagatgtccggagactgtcctttgagtggcaagagacaagaggaggcagggctcagttagactgcggcctgggaagggggagcttctccaagcccaccctgcagagcctggctcccgcccctctcatccccacacagacccactcactcactgtgtggccttgcccaagccacaccgccaccctgatcctccgtgcccgggtctgtgaagcagggcaggaactccccgccacctgcctgccctttaggctgtaggaatgattcaaccacttcaggggcccgaggcacctctgcctgatacaaaaggtgcttcgggaaatgttggagataaaaatcagcacctaggcctgggcggtggctcacgcctgtaatcccagcactttgggaggccgaggcgggcagatcacaaggtcaggagttcgagaccaccctggccaacatagtgaaaccccatttctactaaaaatacaaaaatcagccgggcgtggtgccgcgtgcctgtaatcccagctactcaggaggctaaggcaggagaatcgcttgaacccgggaggtggaggttgcagtgagccaagattgcgccactgcactctggcctgggcgacagagcgagactctcttaaaaaaaaaaaaaaaaaaatcagcacctcaattgaggtgggtgctgttagagtttggaaacagtgttcttcaccatgttgtgtggggggcgactgggtatgtggggcggggctggggggtcttcactgagctcgatggagtgcagggcctgggggggactgcaccatgggagggatcctcactgcggggtgctggctgctggggtcctgtccaggggagccctgctgtgcggtggggcccagcaggccggcccagctgcagaccttgtccagctggtcccaggggagcagggatgttagaggcagggtgagcggaaggcgcctgagctggtgttctccatttgagggaggggctgccttgctgtgggggtggcagagactcaacaggactctgcggccatctaaggaagggctatgcagggagccgtgagaacagcccactctccgtgtgacctgggtgggggaagtgtctgttttctaggcctcagtttcccttctgtgaagtggggcagggaggggctggactggaggggctggaaggaccctcttggctccgtactcatcccacgatgagccaagtcaccctagatcttcctcaatctgagtcgggggagggtagaggggtggaagcatttgggctcaaaccatttatcctgtggcctcagagagccctggggatacatccagtccgtggtgggggtctgggcgggcacggtggggaggcactgccagactcccccgaggcccctgcgtgacccactcctctcttgtctcctcatggctcccgtggctgcctggatcctgcagagctcccgagtgaggaaggtgaggctggcaccgggatggacctctaggccgcgggcagcatccctgggtcgttctctgtctggtcatgacttccttctccccgctgagtgaggccttgctgagctccccaggatcacccacctgagcctctcagcgacctgggttctccctcttctgagtgcagggagggaatgggccgggaggtctcccgggccatcccagctctgagtgggcagggtcagtggtgggggcccagcctcacacatgacccccgttcccagggaagtccctgtgggagctggtgctggaacagtttgaggacctcctggtgcgcatcctgctgctggctgcccttgtctcctttgtaagtagggccctgccagccatcctgtggtagtcggtagccctggagggagagccaggctgggcagtgctccgaggtcctggagcctgggcctgtcctccacaccctgggcctgcgccctggccttccctggccctgccctgctcagacttcagcttcccttgcctgaaccctcatggcccctacattgggtccccggctcccacctgacccctccaatccatcttatcctctggctctcagcgagctccccaactcacatctgccccccgccccgccctgctgtaccctagggtttctctgcctcagcactactgatagtttagaccagatcattctttgtcggggtgggggtgggggctttccactgtaggatgttcagcagcatacctggactctacccacaagatgccagtagcacctcccggggatgaccatcaaaaatgtctttagacagctgggcctgacagctcatgattgaaatcccagcactgtgggaggccaaggcaataaaatcgcttgagcccaggagtttgagaccagcatgggcaacatagggagaccctgtctctacaaaaaatacaaaaacattagccgagtgcggtggtgcaggcctatagtcccagccactctggaggctgaggcaggagaattgcttgggcccaggaggatggagctgcagtgagccgtgatcacaccactgcattccagcctgggcaacaaagcaagaccctgtctcaaaaaaattaaaaatgtcttcggacattgccaaatgcccctggggggcaccttgtccctggctgagtgctgctgccggagccccttccgtggatcccagtgtcccccacatggattttggggtctgaacctcttgcagcctcctcttggctgccgcatctccttgctgttcctccattcccactgatgctcccctggctaatgggctttggatgcgtgcatcagaatcacctgggcttggctgggcgcagtggcgcatgcctgtaatcctagcactttggcaggccgaggcgggtgagctcaggagttcagcctgggcaacgtggtaaaaccccgtctctactaaaatacgaaaaattagccaggcgtggtggtgcacgcctgtaatcccatctacccgggaggctgaggcatgagaattgcttgaacctgggaggcaaaggttgcagtgagccaagatccagccaccgcactccagcctgggcgacagagcaagactctgtctcaaaagaatccgtaggcttgccgacacacaggtgactgggccccaccccagaatttacgactcaggaggtctgggagggaccccaagatcaacatttcttacaagttcccagctgctgctgctgctggtctggggaccacactgagatgctctgctccaggcagacagtaaggcctcggtgggcagccatccaactgccccacagccttgaaggttggcctgggtggggtggtcactcctgtggggtgggcaccctgtgccaaggccttctcggaggagtggccctctccaagccaagagctccccagtgctatctccccaaagcagggaagcaagcaggagatccggggtgccaaggaaaaggagagcagatctcggcccgcagcagggcctgagctcaccagctgtgatcctgcaggtcctggcctggttcgaggagggcgaggagaccacgaccgccttcgtggagcccctggtcatcatgctgatcctcgtggccaacgccattgtgggcgtgtggcaggtgggaggcactgggggtgggaccgggcggggggcggtctcccagccactaggagtgccctccacctggtgctggcgtcctgcagactctcctgcttccacctccatcccaggccccagaggagtcactccaagggggtggtctgcggggggcagcagggacagactgcctgccggccttctattctgcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcaggtatgccggggcctcctccttttattttattttattttatttatttatttattttatttatttatttatttattttttgagatggagtcgtgctctgttgcccagactggagtgcagtggcgcaatctcggctcactgcaacctcctgcctcccgggttcaagcaatcctcctgtctcaggcttctgtaggggcctcctccttttattatgtgggcctgggagccccatccctctctgtgcctccgtcattccggccgtatatacagagggggtggctgtcggatccctccaaagccctttggccaaaaccctgttggacagatgagactgtgggccagaggggcaggggtcaccagagcgatcacagctcaggcacccgacgcccagccccagccttgggttctgggaacccttctggcttttcccagctggtggtgcccaaagccaccctcagccaagccattctccccgcacagtgggggacaaagtgcctgctgacctccgcctcatcgagatcaagtccaccacgctgcgagtggaccagtccatcctgacgggtgaggccccccccaggaggccgggacctagtgggccaggactaagggatgggcgtgtcttcatgtggggcttctcatctctgattccctgaccaggtgaatctgtgtccgtgaccaagcacacagaggccatcccagaccccagagctgtgaaccaggacaagaagaacatgctgttttctgtaagtcaaatgtctggggcctttgcccagacaatgataaaaataacaacattaggattatgatcacgcctgtaatcccagcactttgggaggctgaggtgggtggatcacctgaggtcaggagttcgagaccagcctggccaacatggtgaaaccccgtctctactaaaaatacaaaaagattagctgggggtggtggcgtgtgcctgtaatcccagcaacttgggaggctgaggcaggagagtcacttgagcccgggaggcggaggttgcagtgagccaagattgtgccactgcactccagcctgggtgacgagagcaaaactctgtctcaaaaaaaaaaaaaaaatatttttttttctggccctgttgcccatgctggagtgcagtggtacgatctcgggtcactgcaacccccgccccccaggttcaagctactcttgtgcctcagcttcccaagtagctgggactacaggcacctgccaccacacccggctaatttttgtatttttagtagcaacaaggtttcaccacgttcaccaggctggtctcgaactcctgacctcaagtgatccgcccaccttggcctcccaaagtgctaggattataagcatgagccactgcacctggcccaacattaaggttaatcagctaaagtcctacggggaagaacctcatcgattcttgacaatacatgcaaatttatagtaataataatagcttgtgtttactggggactgtgtgcctggcactgttctaagctctttacacatactagtttatttaatccttaacaccaaatctttgaaataagtactcttgttatgcttgttatctatattttccagcaaggaaagaaacaagcacagagagattaagtaagtttcccaaggtcacacagccaatgagtggcacagctgggacgaactcagacatcctggatttctgctgggagaccctgccttcccctggagaagggcagagcctccctataatcactcgatagaaatgctctagaggaaggaggtctgccaaaatggtggaggatggtgggggatactccattctccgacaggaaaactgacccacaaggcatgatgcccggtctacctggctcttctcagggatagtgatgggttcagctttggcgggagagacctgcctctgtggcctcagagaaagctagcaagtgatactcacagctgccccgcagtagcctgaggccagcaaggagcgtttaggggcacaaggaagggtcaggccagtcagacaatggcccaggccaccaagttatcgggggatagaaaacttcctggaagggaagagggatgaagaaagtgaaactcacccagaactccttttttttttttttttttttttttttgagacagagtctcactctgtcacccatgctggagtgcagtggcacaatctcagctcactgcaacttccgcctcccgagttcaagcgattctcctgcctcagcctcccaagcaggtgggattacaagcacacaccaccgtgcccagctaatttttgtattttactagagacggggtttcaccatgttggccaggctggtcccaaactcctgacctcaggtgatctgcccgccttggcctcccaaagttctgagattacaggtgtgagccactgcacctggcccagaactcttcttgagaggggcctacctagctgcatagaagccttggacaggatgccttggggtggggagggaagctctgagagctgttgctccaggatcagcagctgtcactaagaagctttggaggggccgggcatggtagctcatgcctataatcccagcactttgggaggccaaagcaggaggatcatttgagctcaggagtttgagaccagcctgagcaacatagtgagacctcgtttctactaaaattcaaaattaaacaaaacaattttctaaagtaataataaaaagaagctttggaggaaggtgtctggctgggccctgcatgttgggggctggagctacgttgcttaagacagaagagaggctggggcctgccttctcgccagccccaacagcatatgcatttgaaggggcaccaggttcttagcctcctcagaaaaactatcttgggcctgtgttggaccactttacagaagaggacaccaagccacaaggctggctgtcccttatgctaggaattggggattttactggagccttggaaatggatgagctgaggctcaggttttctggattttttagtaaatattaatggactgtttattgggttcgtagtcagctatgctcctgtgtggctatagtgattgtttacgaaatcacattttgtggggttgatgcttgtgctgcgctggttgattatatcatcaatatcagcccccgtgcctcctctgtgcccggccccgtgctaggcactggggatacggcgatgaacccaaaccctgccttcctagagctgacactctcatgggaaggcagcagggaccccgtgcatacatagctacaggagtctggaagcactagcaacatggagaaaaggaaagccgggtagaaggataagtgccttattccggcctgaaggagtcaggggtcctgggcccctggttggctgctgagcagctttttccttgtccctcccctggccagggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccgggtgagtgacggccagcttggtgttgctgtgcgttgcagagcaggctgggctccctctctgggtctctcccccacctccttttcagtgagggatggaggagagaatctgtgggctgtcccttggcccagagcaggtccaggttttcacaagatgacagggagactatagcaaatcatgcctgggtagccacatgtcactgaggcctgtgtgtcactgtggggccctggccaggttgctgacagtctgttaacctcagtctcctcattggaagcctggctgtgtgagccctgctaggtaaacgtaaaggacataggagaggctcaagttcagccttggcataggggccaagctgggcctggatccgggttccatcctgccccatcatgactctgtgcagtcgacacctgtcaccagataagccagctccggtaacctgggaagggccagggcaggaattattcattccctgcacttcatcccacatcctgggctcactgcccacacggccaagggattctggctgagacttcagcaggcccatggggcagaaggctcctcctgacccagcagatgggtgggtggggagatggtgaaggctatgtgttccccacccttcccaggtccccagtgcctctctgtcacccctgcttccacatctgcccactgggcttggaaacccaggctctgtattctgagaccctaaggccttctgggagcccatcaaaggctgctttaggggaggggtgctaccgagctttactgtcctgctaaaagccctcataggattttatttaaacagagtgtttcttgactaatagcgatttttttttttgaggcagagtctcattctgtttgttgtctaggctgaagtgcagtggcatgatctgagctcactgcaacctctgcctcccaggttcaagcgattctcctgcctcagcctcccaggtagctgggactacagacaggcatgcaccaccacacccagctaatttttgtattttagtagagacggggtttcaccatgttggccaggctggtctataactcctgacctcaagtgatccacccgccttggcctcccaaagtgcagggatttcagccctgagccaccgtgcccggccctaataaatttttttttttttttttttgagatggagtctcactctgttgccagactggagtgcagtggcacgatcttggctgcaacctccgccttctgggttcaggcgattctcttgcttcagccacccgagtagctaggactacaggcgcgtgccaccacacccagctagtttttgtagttttagtagagatggggtttcaccatgttagccaggatggtctcaatcaagcttgacctcgtgatccacccgcctcggcctcccaaagtgctgggattacaggcgtgagccactgggcccagctaataataaagagttttaaagtgcagtgtggggaagttgtaggggccttacgtgctggatgctgggctgtgcttgctgggtgactgcccccaggagtagggaggagagcgggaaggaagggacacttatgcatctactgggcgctgggctggccatttgcttgagaatgtgcggtgaggccatgtccacgaagcaagaactgtctccccagcagagctggctgaacagacaaagaaataggcatgctgggccaggtaagcctcctgttcctgaggtgcacaggtgggggctgagtgacccagcaggccctgtggcaggggctcactctctggggacatctctgggctagaggggtctgtgccccagagaggcgtgtgggtttcctcccttgaaggccaggaactcatttccttgaaggcaaaggagggggcggttcccatgttactagtggagaaactgaggctcagctacttggccagggatcgcacagtgagatgggcaaggacccaggctttctgcctagctcagggctccctcaagctggcaactgcccccagagcactgaagaatctgccataaatccctcagaagtccaggacattgggacaaaccggagccggacacatctggcagagcagacggtccctgcctcagcctggaccctgcgttctatttccctcctggtgggcacggacggccaggccggtttggccctcggtcgggcagggggcctgcaggaccccaccctggggtcgactggccgcccggggaggagggaggcgaccccgcccgcctaagcacgcccctgcgctccccagatgttcgtggtagccgaggccgatgcgggctcctgccttttgcacgagttcaccatctcgggtaccacgtatacccccgagggcgaagtgtgagtgcggggccaggggacgcgcgggcgggcggcctgggggcggggccacgcgtggcggcgccgaggtggccgtgggaggcccctgggggcgggccaggaggcggagcctctcccggggcggggccaggaggcggagcccttctgggggcggggccaagaggcggagccccctcctaggggcggggccaagaggcggacccctctcgggggcggagccgaggtcctcctggtgaccgccccggctccgcaggcggcagggggatcagcctgtgcgctgcggccagttcgacgggctggtggagctggcgaccatctgcgccctgtgcaacgactcggctctggactacaacgaggtgggcctcaccccctttcatgacctccctagtatccaggcgaccaggacagacccttttcccagcctcaaagctcccagggttggcagcccttgctccctggaagtgccacacccagggagcacggttacccctgcacacccctctctgccgcccctccctttccgcagacaggcttcagaaccctccccctggggctcttggtctgtgggggactgccatggaaggggctgaagggctggggaaacctgtggggggaagagatttggggaacaggaccaagaaaatgttgaaagcagaagacacagcccacaaaaggcccacgttcagttaaagcctcctgcgacttaggcattcacgtggccggggcagtggaatggggcatgcagcaggcgtctgcccaaagggaggtccttggccagacccagtccgaggccaagctgagggcagtagagcaccaacgaagagttttgagcaggagagtgacatagtcagatgtgcatttacagaagatcactgaggcttccgtgtggaggccagacagacagtagaggaccgaagccagggaggcctatgtggtcattcaggccagagagatgcgggctgagccctggctggagccttggggagaggggagaaggtatgggtcagagacatttaggagccaaaaatcctgggacttggtgactggttaggtgaaagagacagggaggaagccaggggggctcctggttcttgtgctgtctggggctgtcgccggagtggcaaatacagagagtgggagaggtggcctgaggggtccccggggaacaaggttcagcaggcagctggacatctgggcttggggctcagcaaagggccccagggagagcaggtgggagggtggaagcgggcccagacagcagaaaccggtgaaggaggctgacaggaagtggacagagatgcaggcggagggcagggacggtgtgtggcgatcaatgccagtgtggggggctgaatgtcagtgtcagacaccaccccgaccccagggcggccaggctgggaagggctcacgggccggtgcaaaggaggttacacggaactccagcaaaggcagctgcaggggcaaggagtgagtgaggctggggatgcgggctggaggctgcctgcccctcactccctatcccctgggtccttgccaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtgagcagggctgggggctcaggcctccggctgcatggctggggcttctgggacatctggagaaggcagacaggacactgaagtttttgttttgtttcgttttgtttttttttttttttgagacggagtctcattctgtcgcccaggctttagtacaatggtgcaatcctggctcactgcaacctctgcctcccgggttcaagtgattctcgtgcctcgacctcccggcgcgtgccaccacacccggctaatttttgcattttttagtagagacagggtttcaccatgttgtccgggctagtctgaaactcctgacctcaggtaatctgcctgccttggcctcccagagtgctgggattacaggcgtgagccaccgctcctggctgacggtgaagtaagacttggagaaaagaggggagaaggctgcgtgtgggcaaaggtttggagttgggctgcacacagcatggtcagcaaacggcatcgtattgccatttctggggctggagagggaaatggaggccttgaatggtggggtcagaggagtgtagatgtcatcccacacagagcaagaggctctcttggggccaagcagttggtgggaaggcaggcgagagttgctggctctgtccttcatgccctgacctgcctggaccccgcaggtcatcaagcagctgatgcggaaggagttcaccctggagttctcccgagaccggaaatccatgtccgtgtactgcacgcccacccgccctcaccctactggccagggcagcaagatgtttgtgaaggtgggggcctgcctggctggcctgggcccctgcgcgccctggggaacctggtcatccacgctcctctgtgagccccagtcctcccgtgtgaatggcagggttgggttacaagttctcaggagccccttttgcctctaaccggtggtgtaggggtggttggtgccacccttggtgctctgtgttttggaaactgagtcccagggagggaaaggaatcgactcccttgcagaccactgtctacagcgtctccgttgctgctcccaaaaccgaagagagaaatacagctctagcttcaccctgcaagggaagtttaaaccccttttgaaatgaaaaggcttctgtactgggagctcgggccacttggaaaagtcagtgcctgggtgaccttttaggagcaggagaagccactgaaggagctttagaggctgttcctaggcccggggtgaggtctgaggtgagacctgaggccactgaggggcctgtcatccctggacccccttcccagggctatgcccgccataccctgtgtatggctctatttctggtccccaggcagggctcagcctgcctccctgctgctgaggcccctaccaaattggaacccgagtagcaccagggaagcagggcctgcaggggatgccattctcacccctgcctgcaaaacgctgcagtgcccgagtctgctgtgggctggtgggggaagggcatcgctaggttggtggctgcccccaccccagcacactccccccattctctttagattgtctcacagggggacccacttggttctcattctgaactttcagtgaatggattctgctccctgccttgcgtgtgtacccttgggtggcctttgcccgtatcttagtctcagtttcctgagtttgggcaggaaggagaggaggggttctgactgatgagttacctcttctccctctccccacctcgcagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgaggtgggtgcaggagccgattctccctgcagtacgaggtgggtgcaggagccaagtctccctgcagcagctgagcaggtggtaggtcagggatgggctcaggccccgcttgaatctgccccctccctacagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatggtgaggccacagcctggagccccaggagggggtgatgagtggggccacggggtgtgaaaagagcaagccgtgcaactctcccctctgcctcattcttaccttttctaacatcttattaccaaaaaattcaaatacaaaaagaaatttaaataatgttattctgggccaggcgcggtggctcacacctgtcatctcagcactttgggaggctgaggcgggcggatcagttgaggtcaggagttcgagacaagcctagccaatatgaggaaaccccgtctctactaaaagtacaaaaattagcggggcgtggtggtgcattcctgtaaccccagctactcaggaggctgaggcaggagaatcacttgaatccgggaggcagaggttgcagtgagccgagatcacgccactgcactccagcctgggtgacagagtgagacttcgtctcaaaataataataataacaatactaattttattctgaacacctacatgtctatcatctggattctacaactaacattttattgtatttgctttatcacatacctgtccatgcagccattctttgcccatccctagcccatcttttcttaggtgtatttcaaagtcagttgcagacatcggcatacttccccctcacctactttagaatacatgttaaccagagagcaatgttgtttgtggttctgtttttcctttttgaggcaaaatttgccttcgatgaagcacacagatctttggcgtactatctgatgagtttaggaacatgcacacacctgtgtaactcacagccttatcaagataggaaaatgccaggcatggtggctcacgcttgtaattccagcactttgggaggccaaggcaggaggattgcttgagcccaggagtttgagaccccatctctccaaaaaaaaaaaaaacaaaaaacaaaaaaaaaaagatatgacacattaccatcaacccatgaagttccgtcacacgccttccccatctctgtccttcgtcgcaaaacaggcgatcactgttttcggttttttttttcaccgtatatgagttttatctgccctagattttcaaatgaatggaatcatacagtatggactgttttggtttggggcttttttgagatctatctgccttgtcgtatcagattattgcttttttttttttttttttttttttttagacagagtctcgctctgtcacccagggctggagcgcagtggcacgatctcggctcactgcaacctccgcctcccaggttcaagcgattctcctgcctcagcctcctgagtagctgggaccacaggcgcgcaccaccatgcccagctaatttttttatttttagtagagacggggtttcaccacattggccaggatggtctcaatctcttgaccttgtgatccgcccgcctcagcctcccaaagtgctgggattacaagtatgagccaccgcgcccggcctattgcttttttattgttgagtagcattccactgtgtgaatatttcagtttattgaaccattcctctttggatggacatttagtttgggcctagtttttgttcttaattgctgacctattcttctgacctcagcctctcccctgacctggtctctgtttttaatcttgacctccagcctaacccagtccttaaccctgacccatggcccagccttgatctgcacaccaagcttgactatcactgcagcctggttcttgatcttatctttgacctctgtgctgactttgtccctgaccttgatgttgaccctcatcttaatctaattctttttttgtttgtgtgatgaggtctcactctgttgcccaggctggaatgcagtggcacagtcatggctcactgaagcctcatcctctcgggctcaagagatcctcccacctcagcctcctgaggagctgggactacaggcatgcaccaccatgcctggctaattttttaattttttgtagagatgaggtctccctatgttgcccaggctagtcttgaactcctggatcaagcaatcctcctgccttggcctcctaaagtgctaggattacaagtgtgggccaccacacccagcccgacataactatttacgttgagcttaaccctgatatgaattccagtcttggccgggcacggtggctcacgcctgtaatcccagcactttcggaggttgaggcgggcagatcacctgaggtcaggagtttgagaccagcctagtcaacatggtgaaaccctgtctccactaaaaatacaaaaattagctggtgcatgcctataatctcagctacttgggaggctgaggcacgagaattgcttgaacctgggaggaggaggttgcagtgagccgagattgtgccattgcactccagcctgggcgatagagtgagactctgtcccccaccaaaaaaaaagaattccagtcttgacctggaccaagaccttattctcaacgttgaccttgacactgccccacccccaatgtaatgctttatgttgacctcaactttgatctggccttcaatttttttagatggagtctcactctgttgcccaggctggagtgcagcagtgcagtctcggctcactgcaacctccgcctcccgggctcaagcgactcccctgcctcagcctcccatgtagctgagatcataggcacgcgccactgcgcccagctaatttttgtattttcagtagagatggggtttcatcatgttgcccaggctggtcttgaactcctgacctcaggtcatccacccacctcggcctcccaaagtgctgggattacaggcgtgagccaccgctcctggcctggccttcagtttgaccttgattgcaactccagacttcatgtcacttgacttcactcctcatgtggaccttgacttggcctctgcctttgccttgatcttcaacttgactacaacacctacctggctctttacccgggccatccccttgacttcattcctgacttgacctcagctttctccctaacctcagtttcatcttctaccccacatccaacctcaatttcatccctaccctcatcgctgactcaccgtcatccccatccccacctcatcatcttccctaacctcatgcttgatattctccccaactttgtccttgtctgcatcccttgccttctcctcagcctcatcctctgcccaatttctagttcattcttgaacccaccatttgttctgtctaactgtctgcttcctttggaacatcccctaagattgggggtgggctgagttgagaagagatggggaggtggaagggaagtttctcaggcacagccctacctgacctggcccacagactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctggtgaggccgggccttccctcctctcagccctctcaatccgctctgtgcccctgagatggggaaaacgcctgttcctcggatgcgctgcagggatggaggggcctgtgccctgccctggctggggctttccagggtcccaccttggagtggacaggggagagcacctcttgtcattctccagaggccctggtgacctatggatcatggtcaccccagcacccacggaggtgcctgaagagtcgcctgtcagccctccagccatgaacttcccacttgcagattagcaagatgagagaaaagccccacctttaggcagtcgtgtgtgtgtccgtgtgcgaatgtgtatttgtgtgcacatggcctgagtgcctgagtgagaggtgtgtgtaatgtgtatattttgcatgtgtgctctggtgcattttgagcgtgagtacaagcagaaggatttgtgccggcgtgtgactgtgcacacactcgtattcacatgtgaggatgcctgtggggaatggtgagcgtgtgtgttgctggacatggatggattctgcatctctgcacctcagggcagatatgtaggtgtttgcttgtgtttgccggatggtgtggcatgtgctaggtttttgcacatgtctgattcttgggcatgccctcttcgtgtgcgtgtgtgtgtgtgtgtgtgtgtgtgtgtgtgtgtacttggcctctgctaggcctaaagagcaggtatgtccaggatccagagctgggactggggaaggcaggactggccaggcccgaggcagagctgtgtacacacacccttcacatcacagctggcggagggaggaggggctgctgtggagacagtgggtgggtgagctcccagccttgggtctgagcaggagctggagcctgcatctgccgggggctaggcctaccggggctagagctcatgactctgttccagcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggaggtgagtggggcctgagccctccgtggaattcctaagcttcctaagagccttgtatcaggcttgcaagctgcagacagtgtgactcagcctggcttgtgccagtagaaactgtatgagctcatgtaatggaaaagaccaggcatggcgggatctgggtctcagtatcactggcatattttggcactgcctcagcttcattctcaggcccacgtccctcatggtggcagaatggctgctgcagccccagccctctgctcactccattacaaccccaaattcagcagaagagagagtcttttatcatgctgctctcccggtagtatgataagaatctcaggcctgggctgggcatggtggctcacacttgtaaccccagcattgtgggaggccgaggtgggcagatcacttgaggtctggagtttgaccagcctggccaacatgtggctcacacctgtaaccccagcactttgggaggccgaggcaggcagatcacctgaggtcaggagtttgagaccagcctggccaacgtggtgaaaccccatctctactaaaaatacaaaaattagctgggcatgatggcaggtgcctgtaatcccacctactcgggagactgaggcaggagaatcgcttgaacccaggaggcagaggttgctgtgagccgagatggcaccattgcactccagcctgggcgacagagtgagactccgtctcaaaaaaaaaaaaaaaaaaaagtctcaacaggcctgttctcattggcccacatagggttcacctgctcatctccaagcactggggccaagggtatggcagatgctgattgaccagccagggcccaccactggcatcgaggggaggtgcctgcaaaccacagggctgagagaggaaaagggtggctccctgcagggaattcagggaattattaggcaggggaaacagacgccagaaaaccaccgccattctctacagccggtctcctcccttccccgcagtgtacgtaggcctggccacagtggctgccgccacctggtggtttgtgtatgacgccgagggacctcacatcaacttctaccagctggtgagcaagggctggccagggagcctgttgaacttacagctcgagttgttggagttccaggggagatgggtctagagccgcatgggtggcctgcagtgtccttccccactcgctatacacgaataaacatccccacctggggagccgagctcagagcccacgggaaacccagagacaccagcacggacccccaagccaaaggcgcctccccatcccagtcagttagcggggaccaagaggcctcactgccagatgtatcttacctttgtcaagggacccctaaaacgttgaggcctcagaggaatgagcccctaaatggtgggactttaggcagagggtcaaactgaggagatcaagaatggaggggagggctgggcacggtggttcacgcctgtaatcccagcactttgggaggccgaggtgggtggaccacctgaggtcaggagttcgagaccagccgtccaacgaggtgaaaccccgtctctattaaaaatacaaacattagctgggcgtggtggtgcacgcctgtaatcccagctactcaggaggctgaggcagttgaatcacatgaacctgggaggcagcggttgcagtgtgccaagatcataccactgcactccagcctgggtgacagagcaagactccatctcaagaaaaaaaaaaaaaaaagaatcgaggggaggctgggcatggtggctgacgcctgtaatcctagtactttgggaggccaaagtacttgagcccaggagtttgagaccagcctgggcaatacagtgagaccccatctctaccaaataaaaataaaaatgaaccaggcacggtgatgtgtgcctgtagcttcttgggaggctgaggtgggaggatcagttgagtccaggaggtcacagctgaactgagccgtgatcacaccactgcacttcagccttggtgacagagtaagaccctgtctctagaaaaaaaaagaacacatcctgccgcggtggctcacgcctgtaatcccagcactttgggaagccgaggtgggcggatcacttgaggtcaggagttcaagaccagcctgaccaacatggtgaaaccctgtctctactaaaaatacaaaaattacccaggtgtggtggcggatgcctgttttcccagctactcgggaggctgaggcaggagaatcgcttgaacccgagaggcggaagttgcagtgagctgagatcgcaccactgcactcgagcctgggagacagagcaagacgcagtctcaaaaaagaaaaaaagaaaagaaaagaaaaccaaaccaaagggggtcttgcaggacacagggaataggacataggcaggcaggcaaagggaaggagtgggcacagcagtggcctcaccagtagaaatgggctcctccagggcttccccatgtgcctgtgaggcagaagctccagcccgacgcactgtctttttttgtttgtttgtttgagatggagtctcgctctgtcacccaggctggagtgcagtggtgcaatcttggctcactgcaacctccacctcccgggttcaagtgattcccctgcctcagcctccccattagctgggactacaggcgcccaccaccatgcccggctaattttttgtattttagtagagacagggtttcaccatgttggccaggatggtctcgatctcctgacctcatgatccgcccgcctcagcctcccaaagtgctgggatcacaggcgtgagccacggcacccggaccccagcgcaccttctaatgaataattccagaggccacaccgagacctatgacctggggaatactgtgtgtgtgtggcaggtgcttgctggtgaaacccagaaggtctgcactgggcagggcatttacagcaagagcaacagacccattgaaacatatttatttatttatttgagacagagtctcgctctgtcacccaggctggagtgcagtggcgcgatctcagctcactgcaacctccgcctcccgggttcaagcgattctcctgcctcagcctcccgagtagctgggattacaggcacccgccatcatgcctggctaatttttgtatttttgtagagatggagtttcaccatgttggccaggctggtctcgaactcctgacctcaggtgatctgcccgccttggcctcccaaagtgctgggaatacaggcgtgagccaccgtgcccggccgaaacatcctgacatgatcttgttggtattttcttctctgtgtagacgcataagcgtcttaagcattcacatgcccgagtgggaggtgtgtgtccctatgtttgtgtgtacatgtatggataggccattaagatctggcagggtgaggcccgacaacagtggcacaattggcaggaggatttggtcctctcggtcactgggtgggtagagtcaggttcaaagttctggaggttttcccttctctatgatcagcaccaaatagaaacgtgtggctgctcacgcctataatcccagcactctgggatgccaaggcgggcagatcacttgagcccaggaatttgagagcagcctggacaacatggcgaaaccccgtctctacaaaaaagacaaaacttagccaacagtgacggctcaggcctggagtctcagctacttgggaggctgcggtgggacaatcacctgagcccaggaagtcgaggctacagtgagctgagatcgtgccactgcactccagcctgggtgatgggagtgagaccttgtctcaaaaacaaaacaaggccaggcacagtggctcacgcctgtaagcccagcactttgggaggccgaggcgggtggatcacttgaggtcaggagatcgagaccagcctagccaatatgatgaaaccccgtctctactacaaacacaaaaattagccacgggtggtggcgggtgcctgtagtcccagctactcaggaggctgaggcagaagaatcgctcgaacttgggagatggaggttgcagtgagccaagatcacgccactgcactccagcctcggtgacagagtgagactcagtctcgaaaacaaaaacaaaacaaaacaaaacaaaacaaaataaaaagaaaacaagacatatccacttgcctcaaatgctggagcttgagttttggagaaaacgtccactatcgatttaagagattatcagattctctatctctttgttaaaatatctagccaggcttatttctcttcctgcacgagagaggagaaacgatactcagagtggccttatctgcatttgtgcagtgtgggaaaacggatgtatttatgcgacagacagtagatcagacagccgggcattttacacgtttttctttgaggattatgttcacagcacatggccccaatttctaatttaaaagatctccatggccgggcgcggtggctcacgcctgtaatcccagcactttgggaggccaaggcgggcggatcacgaggtcaggagttctagaccatcctggctaacacggtgaaaccccgtctccactaaaaatacaaaaaattagccgggcgtggtggcgggcgcctgtagtcccagctacttgggaggctgaggcaggagaatggcgtgaacccgggaggcggagcttgcagtgagccgagatcatgccactgcactccagctcgggtgacagagcgagactctgtttcaaaaaaaaaaaaaaaagaaaaaagatctccatgttcagattagactcccaagagcaggatctatatttttggtgaactaagctggttaacggttggaaacattcaccctcatccctataatatggaagagaacaagacaagttcccccaataccctccgttcagcctcttagcacgattctgtgaacaaggtttttgagcagtaagaaaactcccctgaggctataggggttatcagccctgagcgcttcatgttaattacagagaagctacctgttacagctgcaccttggcaattcattagtctctgtcagaagcacacatcagatctgatagagttcagtttcagtggcagaaatggagtgaggtatgaggtgtaaatggaatttttttttttttttgagacagagtcttgctctgtcacccaggctggagtgcagtgacgcgatctctgctcactacaacctctgacccccgggttcaagtgattgtcctgcctcagcctcccgagtagctgggattacaggcacgcaccaccacgcaggctaatttttgtatttttagtagagacggggtttcaccatgttagccaggctggtcccaaactcctgacctcaggtgatccacccgcctccgcctccctgggatgacaggcatgagccaccacgcccagctgtaaatggaatcttaataacagtgaacagggcctgcgtagccttcatcttctataccgcaaaggtgaattccactcccgcatggttttgttggttgattttcacatgcatttccctattcagtgatctccaggctcccgctagcctccccaggctaatgccagctgttctccttctgagccgctgcactcctgctccagaacgtctgcctttcccacgctgtgcccttgcttctccctggcacggtgcagctctccccaccgccgccccgaccccgcacccctcccgggatccccagcccaccccacggcagtgttttgtgtgctggttgtgcccaggcgtgggccaagggcaggatgaggcttccctcctcccacccaccagcccctcgcctgacctgccgctctctctgacctgccacggtgcccccagaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacaggtaggctgggcgcagggcctggagctggggccgaggagtgggggctgagggctgggggttccagtatcagtgtctgagggtcaggggtccaggtgggctgggcgcagggcctggagctggggccgaggagtgggggctgagggctgggggttccagtatcagtgtctgagggtcaggggtccaggattggggtctgtgggtcaagagggtccaagattggggtctgatgtttggggggttcaggattgggatcagaggttcaagggggtccaggattggggtccagaggtcaagagcatcccagactggggtctaggggtcaagagaggtccaggattggggtctggggtcaaggggttcaggttggggtctgatgtttggggggttcaggattgggatcagagggtcaagggtccaggattgggttccaggggtcaggggagtccaggactgaggtctgggagttagaggggtccagaacaaaggtctggggccaagcggggtccaggattagggtctgggggtcagtgggggtccaagattgggatccaaagatttggggatctggattggggcctaagggtcaaaggggcccagagaggattctgagagttcatggggaccggaattggggcccaggagacaaagaaggctgaaactggggtccaaagaaatcggccaagattaggtctgaggggcagagaaaggggtcccagcccgggacaggccctggcaggccgagcgggcaacagcaatgcaccgctagagaagtggtgaggctcctcccatgggggtgggtgcctggcagggcctccctgcaccccggcctaaggggagcaccctgtgccctggcagcgtctcggagaaccagtcgctgctgcggatgccgccctggatgaacccctggctgctggtggctgtggccatgtccatggccctgcacttcctcatcctgctcgtgccgcccctgcctgtgagtcaccccgcctgccccactgccctggtccctggacatcacaggccctgggctggtcactggacctctctggcccccctgcaatggaaactacctggaggagagggaggtgagaggtctggccagccaccacctccagctgtggccccaccttcaggagctcccagacctgggggacggaagagggggaaaccccttgctgaggggactgtgcccaggctggggtgggaggaaggacgagctttcccagggcagaatcctcccgcctcccaacaggatggatgggagttgacccagtgggcaagggcagaggtgggcccttgaggcagaggaagctgagcggacaaagattggggggtgcagctgaacagacaaagatcggggggtgcagctgagtggacaaagatcgggggtgcatccagggggttcttaggagcgctcatgaagagtccatcagagcccaggtggataaggccagcagatggctggggcacgggacagccagtccttcctttaaccaaacctcccttcccctccccgccagctcattttccaggtgaccccactgagcgggcgccagtgggtggtggtgctccagatatctctgcctgtcatcctgctggatgaggccctcaagtacctgtcccggaaccacatgcacggtgagtgggaggccccgtcccgcctccagcctgcctccccgcccgcctctgctcctgggctgcagtggacgctgtgggtgtggagcgcagagcctctctgtctgcacatcggggaggcgttctcggatcaccaagtggagggtgtgaaggggctctggtggctgggtcccaaggtgtccgcagggtcttgcactgcaggggacctgggctcactgggccagcaacgggagcacctcttgggccacactgcctcactgtcttcacctgccaccccctacatggccagggcactgtgtgctcttctgggcctcagcctctgacccctctgcacccagcctgtctttatccaggccttctcaggacagtctcgcaggcctggagtaggcagccgctgaccacctcttggaccccagaccacaccgggttggcctctttggtatcaccttgtgggtgggtcaaggggagggttgtttctgagctcacagctctgggtctgccttaaccccggagtggagaggacaggatggcaggtgtcgggctggagagaagtgggctgggacatggggtccatccacctgcctctgccaggtgggctctgagagtgggtgattctgaacttccaagggccagggacacagcatcgtctcgctgtcagagctgctcagagagggaggaagcaggggtgagctccggttcctgggaatttgcgcagaggcagtggccgtatggctggactgctgtgcaggggcctaggttgggctgggcagtggctgaggcctgcactggggcagctgggtcgttgggggccacctctggcaggaatgtgccccaggggagtgggtggagggactataaatagatcacgcgtctgtcattccctaggggctgagcaagggagctggcctgtccagggagtggccagacacatgtaggggctcactcgagggtgcaggtgggcactcagccaaggcaagcctgctggggccaatgggtgggggtggggggagctgagcaaggccattctgccccctgtctggttctttctggccaatgctctgtgacagccctggggagacactggaaactcccatccatgggggcccaaggcatccctgcactggccggagcaccgggccggtccgccaggaaatcctccagccgcccttgaccacactcactcacctgcacagccaggcctctgggccgtccttgaccacactcactcacctgcagagccaggcctctggggacatgacagctcaggtggcttgtcttcctcgggagagttcccaaatggccacaactgcctaggagctcagcagattttcttgagaaaacttaaaagtgagaaaattatgcccatggctaaaatgtctcagccagcacggaaaagcctgtgtctcagatgcctttcagcattggctgctggatggtggaggattccccaggcctaaagagcgggagggtcctagcgggaggggacaggctaggagggctgggagggagagattcctgctgggccaggagtgagggggagtttctccaggctttgaggttaaagcagtggttggaaagaacaggattgaacctggtggaacagggctgggtgagcacagatgttgacactcagcatgcagggcagaggggtgaggcccggcaggggcaagggccttgagtgccaaggtagagaccctggacattgtcctcagggcagtggggaagcacgggaggagtgtaagcacggtgcggactgtgtcaaccatggaggacaggcaagagggggtgagactaacgggccgggcgcagtggctcacacctgtcatcccagcactttgggaggccgaggtgggcagatcacctgagtcaggagttagagaccagcctggccaacatggtgaaaccccatctctactaaagatacaaaaattagctgggcgtggtggcaggtgcctataatcccagctactcgggaggctgaggcaggagaatcacttgaacctgggaggtggaggttgcagtgagctgagattgagctactgcactccagcctgggtgacagagcaaaactctgttcccccactctcccccaaaaagagagggtgagactaacaccaggaggtgggcgagcggcattgaacagatctggggagctggccccagaaagcacctccacctccacctccttgagatgttgacggtggtccctgtgaagtttggcttggaaaggtggtgcctggctgctggaggacagacacaggctgggtacctgcggctccatctgaggggtggggtggaggcaccccgaggaatgtgctcactggaagcccagacagccctgcccagcgctactgcagtccctggggcctcctaaagccagacggggcgggggtgagagagggaccctttgcgctcccaagccagctgggtggccttttagggaagtttttctgaagcctgatgcttgtggcttccccgtgatttatgtcatttacgagggatgtgtcctggggagaattctggatcctgggtcagtcctgggggctgggggcggtcctctcaccccacctcctggctctgcccaggtgtggctgagcagttgtcaggggaggcgtgggggctgggctgtggtggttgtattggggacagatctgggaggttacaggcgggcttagactttactctgaggacagtgaggaaccatgaaatggggtgttgggactggatttcggcttttgcttgatgctaggggcagaagtatgatgggacggtaagactggggctgggggcagggcggcaggccttgaggccttgaggcctggttggggaaggcagtgggagagatgagctctcgcaatttgggtgaaatcaggcctgggtgtgtgtgatgggcaagagaagcaaggatgagcctggtgtctgaaccttacgataatgggtggtgattccccaaaatgaaaaccaggagagtatgtactggagggtttgggggtgctgatggaacagtggagtgaaggaggcgtgggggacgttgcggggatggatcctggatgcagcttggggggtccggtggggctggggtagactgaggtctggactaagggaggccttgggagcctggggctgtcctgggagaagtggaggatggaaggggctggaaggaagctgtctggatgtgtgcccttacacatacatcttaacgcgctcttgggtttttcttccagaagaaatgagccagaagtgagcgctgggaacagggtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacggaggatcctcagcgtctgttttcctggggagtggtcccgccgtctccacctatggggcgtctgcctggggccctaccacctgcccataccacctgcccataccacctgcccacacccagtccaggaaacgctgagcaaaggtctggggttcacacatcaccaggattgctcccttggcccccaagacaaggctctggagagccacactcgagtggcaggtgcagcgcccgcagagcctcccagcttgggatgctcgctcctcacagggacggtgttgacaatttgtgcacgagttcaaggccttttgtgcattttattttatttgtttatttatgtatttatttgagacagagtctcgctctgccacccaggctggagtgcagtggtgcgatctaggttcactgcaacctccacctcccgagtagctgcctcagcttgaagggtagctgggagggcatgcgccaccacagccagataatttttgtatttttagtagagatggggtttcaccacgttggccaggctggtctcaaactcctgacctcaggtgatccgcctaccttgctcggccttccaaggtgccgggatgacaggtgtgagccacctcgcccagccccttttatgcattttatgatctgcatgtcaccccctgaggaaacagcctgggagagttccatgattgggcctggggcagggctgggcccggagcctgaatctcaggggccccttgcatcccacagaggagcctcaaccccagctcttctgtaggtcctacagctctcctgctctatctccctctcctcctcaaatcccaggatcccatccacctttggcccttccaagcccagctcaaatgcacctcacacctaccacctccccagggcttccctcagctcacaatacccagggacctctgcgaggctgcctggggtgagccggctcgcacaggtggccctaccttcctggaagccggggctcagggaagggagtcgccatggccctcgtttcaccaaaacccatcatgaaggcttagtatctaatccttcactcagctatcctgggaaggagacgcaggccctgcccacagggccagaggcaggattgtctacataatttgcagggcccattgcaaaatgaaaacctggaaccctttgaccaaaaatgacaagaattacaaagacagaagaacattcaatatgatggccggacgtggtggctcatgcctgtaatcccagcactttgggaggccgaggcaggtgaatgacttgaggtcaggagttcgagaccagcctggccaacatggcaaaaccccgcctctactaaaaatacacaaattagccaggcgtggtggcgggcacctgtagtcccagctactcagaaggctgaggcaggagaatcgcttgaacccaggaggcggaggttgcagtgagccgagatcacatcattgcactccagcctgggtgacagagagagactctgtctcaaaaaaaaagaaaaaaaaaagaacattaaaattcaccaaaccgtgtgcttaaaatgggtgcattttattgtttgtgaattacactgcagtacagtttgacttaaaagggaaaaaaagaggtagccacagaagaggtgggtgggcacatggctggcatgttggtgtggtggtgtcagaaccctcaggactggagaggagtgctcagtgtttgggggcagggccagcccccaggagttcttaatccagggcagagagaggccgggaatgagggaaaatggccccagcacagagcgtttttgagcccggggcctggtgcaggtacttggatcacacgtccatgatgccagcttgtcggtggaggcagcacccccacccccaacccaggagctcccaggttccttagcagggggcctggggttggcgccgagctcacagcaggagcagggtaggcagaaggcgcctccctccacatggtccacccgtaagacctctcataccacaggaccttctcata

SEQ ID NO: 15883 - DNA, 22611 bp, Human; identical to SEQ ID NO: 12379

SEQ ID NO: 15884 - DNA, 4864 bp, Human
tgtagcaattatcaggaatataatatacagctattaacaatagtaactccgttatactatagatctcttgaacttattcctcctatctaactgaaatttcacatcctttgatcaatatctcttccaagcccctgcccctgagccccttgtcaccaccattctttgtatttctcagtttgacttttttggatcccactatatgtgagatcatgtgatatttatccttctgtgcctgacttatttcacttaatatgatgtccttcaagttcatccatgttgttgcaaacggcaggatttccttcttttttaatggcagaatggtgtctctgtatatccatacaccaatttgtatacgatgtatatatataccacattttctttatcctttcatccattggtgcacacttatgatgacttcatattttggctattgtgaatagtgccgcaataaactataaaagtgcagacatctctttgacatactgatttcatttcttttgaatgtatacccagtagcgggattactgaattgaaatgcaagcattttgaaactaccaatgacatatctctattttaaaaataaaaatattttgattaaaaagtgagtcaaaattaagaacttgataatagataagatgtagtagaaatggtagaataaatagagacgatgcaaatgttaaaagagttaacagcatcacaatgtaaaagtattagtaataaggatctaggttaaaaatctctgatcataccaagaaaagaagcaagatggagagaaaggaagcaaaattatgataaatttcaccagtttcataggaagaagttaacagaaaggtttaatgacattgataaacagatacacagtcaaatacattttcgaaaatttaaagatgtagttatagaaacaaacataaagaaaaagacaccattacaaaagaaaaatcaaggaaaattaaaaagccaaataagacaagagaatagaagaaagcacagttgtatccattaagataacttttctttaaaaaatagagttccttaaagcaagttaaagtaagatttgaaaaactgaagagaaataccatgttgctgaatggaaatatttcaccttgtacaaaggaagattttttccaaataaagcaacgaaagtattgcaattacagtaaaaatcctatgggaattttgggagatctcaacaatcttaacctaaagttgatctgtaaatataataagtgagatcagctgagtatattttcgcaaatgacaaaaataagtagataagaatagatagtctcaaaggcaaatcagttgatgaaaaacttaaaatttgatttatgatttatttatatgtaaaagttaaatatatttcaaatgtatgtggacattataagatacaagcccttcatgtgaccattgagtagatcattcacaggtgatgctcagtgaatggtcagtggcaacactaaacgtacaagcatttggtatgcactcatgttacttcctggcattctcaagtatagcagattatatcttcaaagtaaatctcaaataataactactatttatacatgcctaatatttttcttgcatttatatttaaatgcatatatatttaaatattttagtaaatcatatcattagtatcgattttttttcatttttaatgaaaatttactaccattttatgggacattaattctctgtagaatgtagtttaagcaatgccatttaaatatattggaagatctcataaattaacaagagaatgatgggtattacagtggaaaagtggtcaaagaacaccaacaggtagttactgaaaaaaaattaaattggtcaataaagataaacatatgaaaaatattcaccttattatccagtgaagataaacattaaatcgaaatttttaattttttttttttttacttattaaatgtacaatgattgtgtgttactctctccaccagcaaaggtacatgcttttacatgttaatgaaagtatgaatcgctttttggctctctcaccagcaccatggctgttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcgtctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaaaaatcagatacggaagacctcttatgctcagcaccaacaggtccgccaaatccggaagaagatgatggaaatcatgatccgagaggtgcagacaaatgacttgaaagaagtggtcaataaattgattccagacagcattggaaaagacatagaaaaggcttgccaatctatttatcctctccatgatgtctttgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaacgtgctatttgtaaaaaaaaaaaaaaaaaaaaatcccagcatttcggcataagaattctccctgtttagttttgtctaatttataaaacagaagcgaataaaagtttgtaaataaataattagttaattaaattataacttgtccatgcactagaacacaatgcagcctttaaaatattacagaaaattatataatttcattaaaaatttcacaaattttataatgaaaaaacaggctttaaaataatataattttatttaaaaaattaataatgcctttactttaggtggttgaatagaatttctttgtactgtacttatttttattttttaaatattattttttaaagcaatgaataatcattactgagattctgaaaataatttagtactatatatgaatataaaaatatgaaaatattttaatatttaacattttaattagttgatcttgcagcaacctggcctaaaacaaatatgatatgtatacaaatgtttaaaagccacaatattacttaaactattatttgtaatagtgaaaaactggaaacaacgcaaattttcaacatcatcagtttggttaaataaataatggtgctatcatgctataatatattaggcagttgttaaaagatgttgtcaaataattttaacatcattggggaaatatgatacaatgctaagagataaaagttggcaacaatattggtataatattctgtaagtgtatattctacatataatgtacagaaatgcattgaaaaattttgaaagaaaatgcagtaaaatttagtagtgattatacctaggtgattttaaattttcttcactatacctccctgagttttcccaaactttaaaacaataagaattgaaagaaatagagttggaaaagtgaaaagttggttatgaagactgtgcaacaacatgaagatcatgcatgatgaatgagaaagtcgaagacagaattagagaggtaccctcaatatatagatggaaaatttgtgttcccccaaaattcatatgttgaagttctcatgtccagtgtgcttgtggagacgggggcctttggaagtaattaaggttaagtgagatcattctggtggaaacttcatcaaatagagtgagtgtccttattggacaagacaccagataacttgctcttcctccctttctgtgtggatgcactgaggaaaggccaggtgaggacacatcaagaaggtggtggccaggcagggtggctcacacctgtaatcccagcactttgggatgctgaggtgggtggatcacaaggtcaggagatcgagaccatcctggctaacatggtgaaatcccatctctactaaaaatacaaaaagttagccaggcatggtggcacatgcctgtagtcccagctacttgggaggctgaggcaggagaatcacttcaacccaggaggcggaggttgcagtgagcagagatcacaccactgcactccagcctgggcaacagactccatctcaaaaaaagaaaaaaaaaaaaaaagaaggtggccatttgcaaaccaggaaaataaccctcaacaggaactcaattggttggaaccttgatgttaagctttctgggctccagaactgggagaaaataaatttctgctgtttataggtgatagatggcaggccatgagaacaagtcctaatgcttctggtggagcacatgcccaaggtgggccacccatgtgtggcttccctacatctggggtattggtgcctgattttaaaaggaggtcgttggcccttcagaggagattagcaaggtctgtgaagactctttcagaaacaatatgtgggctggtgtggtggagatggaattgtgtctccaagtaattatactcaacacatttggcattctctttcaccactaagattcccttagaaattctttttaaattttaaagtaacagataggcattttagtgattatatatcagacttcagctttgtttatcttcctccattctaagttaaggaaaga

SEQ ID NO: 15885 - DNA, 29893 bp, Human
aagatgaaatttcttggcccaagtagttgtttagctaaagctctgttgatcagttttgttttctctactagctatttagtgaaattgctagactaggataaaaagaatacctaatacttaaatgtgattacaatatgacaaccaaggtcctaatacatatatatgaattcatctcacaaaaaccctataaggtaggtactattttcttcccattttatcaaagagacggactttaatctaccaatggtgggtaaatgttgccaaagcaatgtgaaatccaggcagaatgctgcatttttagtcaatgatttaaaattttgagcttttctgttcccctcaggcctgatcgtaccccaatggaatcacccaaatacttgatgctgagcctttctatggatttatcagatgaaactttggaaagggacttttttttttttttaagacagggtttcgctgtcacccaggctggagtggagtggcgcgatcttggctcactacaaccgccgcctgccaggctccagagagtctcccacctcagcctcccaagtggctgggaccacaggtgcatgccaccaagcccacctaattttcttcttttctttctttcttcctttctttctctttgcttctttttctttctttctttctctgtctctttttttttttttttttttaagagatggggtctcgccatgttgccctgaggtctggcgatctaccgactcggcctctcaaagtgctgggattacagtcatgagccagcacgcccaactgagagagactatgatgttctccaaacaaatctcatttggttgaaactctacagctgagtatggtctaatttgagtagtttaccttgagtactctaaccatggtctatagacctgggctcttctgagaactgtttgcaaatggttcacagagagagagtagaaaactctatgtcaattttgcaggtaattttatggctgttaactctaacgataaaaagttttgacttggactttgtatgtcttttcatttttctgttttattaacttgtcaaaaactaattgaaaattgaaaaaaataaaccgaccgttcccccagtgaagagaagcactgctgtaaagcttttcacactcaaatattaccaaactctaaggtcgcttctgaggcctaactccccaaaatgatgcctcggatatttttcctcgccttatttcttttttttctttttctttttttttttttttcctttttccttttatttgagacggagtttttgctctgttgcccaagctggagtgcaatggcacgatctcggctcactgcaaactccaactccgcctccgcctccgccctcgcctcctgagtagttgggattacagacgcgcgccaccacgcccagctaatttttgtttgtttagtagagacgaggtgtcaccatgttggccaggctggtctcgagctcttgacctccggtaatccacccgcctcgccctcccaaagtgctgggattacaagcgtaaaccaccgcgcccgacctcctccccttatttcatccattttataattcacattattattgatcgctgataattgcacctattgtaatgatactgataattgcacctgttgtaataatattgatattgataattgcacctattgtattacaatattattattgatatcgataatttcacctactgtaatgatcaataaaggcaggcagaaagaaaacaaaagtaactgaaactaccaggcagcgtccctgcgaacagcaaagagggaagaaacgccttgaggcgtagtaacgccaccaataaggagtcgacgcgacggatccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggtgagtgcggcctgggagaactcggcacggtggctccggagctggactgggaaccggcctaggggcgaaagtctgtcgggcgcgtgcccacgacgtccggggagaggaaacccagagagttacccttggtagggggagccatagaacctgctcgggaggtgcttcctggatccccgccctgcttaggtccccgcccttggcttgggtcctgtttgtatttggcagtttggccccccaccccgtcgcttttccgtttctggtagttgtgctcgggatggaaccttgcccctcctccgctcccccacccttttaccctggtgtgggtgaagtggctgggctacgatggttcagtatttatgaccagcgtccgtcctggtacagaacaaagaaacttggacttctggtatgcctcgtaaccgcggggaatagacacggaagcagcataagtaatcagggctttaatagatcttccctagtacgctaaaccaaatacagagtgtgtacgtcaaaagccgagtccccgcgtgaatctagacacaaccctttctgtttaaatacctggcaaaatggtttggatttctggatgcatttcatgccgctggagagttacttgtctgtgtcttgtgagctctttgacgaaacagcttttccggtgttgcatcaagatagttacggtgcctcctatttatttaattgaataaactatgtgattgcattttagtgttgcttttttcattctcaccttctcttgattaggatctctatttcacctaatacctgatttcgtattttcaattaaatgtagtttttctaacattttataggaatctctgcaattgtagaaacaaattctgtaatttgtaaatggatgtttcctcaaagttacaactgaccttacccaattaagttacccctgcagactagtttcttgatcattttgcacatattcttagttctttttggtttacattttctctaaactctattcctagtcttcatattctctagtgcagcctaatactgctgggcttagaccggaagtatgacagatccacttctgcaaacggaacttgaactagattatcataagtcagtgctattatggtcttcaggcattacaagccctttgaagctaagtgcggccaaatcaggcattacaggcttcttctgtataaaattgccagtgcactggagacggtgtgctgtattagaaacagttccggactagatatggggaccaggatgtagtgtcattgcctcatatataagataaaatgatgataacacaagtgtcatgcatcccaaagttgctggttggaacatgagatgatggatgtaaaagtggttagtaaatgtgaaaagcactctggaaaagttctgttcattctatctggagtaatgctggtagaaggagcaatagggaggaaggtgtcagagaaagtatatgtaaccagatctagtaagttaccgggctgatagattgaaagatgtcttgttactttgggtggccaaggtgggcggatcacctgaggtcaggagcaaaaaatgataaagcaatgagatgagacaaacctggccaacgttatgaaaccccatctctactaaaaatacaaaaattagccaggcatggtcgctcgtgcctgcaatcccagctactcgggagactgaggcacaagaatcacttgaacctgggaggtggaggttgtagcgagccgagattgcagcactgcactccagcctgggcgacagagtgagactccgtctcaaaaaaaaaaaaaaaaggatgaaaagatgtcatgttacatcctataaagtaagtttacatcctataaagcagaatactagtataatgtggtgatagtaatattccacgattatagttttattttgcaactaatatttctaactacaacaaactgagacatcagttagtagattatctttttaaagatctcagcattttcaagtgtgttccgcatagtgacaataaatgtaacttttgtaggtggcacagtcatcttttgatttattttcacaatttcgagagaactcagcaccattctagtttttcctctaaattttgtgttaacatttattttattttatttagcttttttgagatgcagtctcgctctgtcacccaggctggaatgcaatggcgcaatctcggctcactgcaacctctgcctcccaggttcaagcgattctcctgcctcagcctccctgatcgcttggattacaggccagtgccaccactcctggctaatttttgtatttttggtagagatggggtttcaccatgttggccaggctggtcttgaactcctgacgtcaggtgatccgtccgcctcagcctcccaaagtgttgggattacaggtgtgagccaccacgcccggcttgtgttaacatttctgatagagcacttcatttcattgtttgaaaactaccctcatgggagcaatgacaagcacatgtctaggattttttcaagcatgtttggtgatctcctaaacatacaggctgttggttaaaaagtgaacataaatgtttagaatgaaacctttttgtttaaatggggaagtgaaaggcttgcccgggcgtttccatctgcctactgtaattgatttccgcataaacggtcattactggcacctattgcagcaccagtattaaactgcatatagtaaaatcactgtgtaaaattgtgttataatctaaacagttctaatgcgatcttaaaaaaaattgtagagacagatctcactgtgttgcccaagctaggcttgaacttctgggcttaaaccatcttcccaccttgtcctccaaaggtgttaggattacaggagtgagccactgagcctggcctaaatgtgatcttaacatttaatttttgcttatgttgctaaactgcctggggaaagctgcttcatcctggttggatttaccagtactcctcccccttgaagctatgtcagaaggaatcaattatctctttgatttttaacctaaggtcaacaactgttttgaatttatctttatgactgcaacaagtaagtggcataaggatgtgccaccactaccaagagtcaatctattgagaaatcaagttattcctgtgccaacaggttattttaacaaatatcatcttaaagtgttatttcccattctaatttccaaaaaaaaatacatgaacaagaaatgggaagcaacaacagttaacttgtgagtcagcagtatcctgattttcttcgaagaggttgtggttatattaactcctttcttgtttgtttcctgttcttaacagctgtttgatgataaagtgcttccaagaaacagtactccctcaattgtttaaattgttttgatctacctagtgtacttttcccctaaaattcatgatgaaatggtagagtaaatctatctatatctccctccccaagttctgtttaactagataattgattatcctcaaactaaatatccatgtctatgtgctgaggtattaacacatgattcaatatgatattaaggtaaaaatggaataaataggctgagatagctgaaagacttgggctgcctgtgtttcgaggagctatttagtttttgttgttgtttgttttgttttgttttttgagacagagtctccctttgtcacccaggctgtagtgcagtggtgcaatctcagctcactgcaaccttcacctctggggttccagcgattctcctgccttagcctccatagtagctgggattacaggcaggcgccaccacgcctggctgattttttgtattttttgtggaaacggggtatcaccatcttggtcaggctggtctcaaactcctgacctcaggtgatccgcccacctcagcctcccaaagtgctgggattacaggtgtgagccaccacgtccggcctcaaggagctgttttcacagagacaaacttgttccattggttaagcagctgaaaggaatggattgtcttctagaatttcccaagataaacctttcctcttaccagtgaggaacaattttacaaatagaaattaatattgctggtgtgtagtttcccacagaatatttttgttacatttttatggggtaacacgtgacaaatcctattcatgtagtttaataagcaaaataagcctaagagattgagcaaaggtttgctgaccagtgtccataccctacaggtaagtattatttacttaatttttataggcctgttatgtgctaggcaccatggtaggtgttgggaatatattgggtacaactttcagtttctgcttttatttttgaaatgctaaatatttttctgagtatttgagatatttgaaaaagacacccagacaacatcctggtgtttttttcaacacacaataaaaaggtacgacaagataatagaaagcttttctgattattgaatttaggaaaatacatcattcgctttagagtgagtaccaaagacttaagaaaagttaaacattgggaaatacagtaaattaaacatctagaaaagacttagcagttttcagcctttagtcatagaatgctttggtctcacttgagcattgtaattctagagtagtaagtattttcaccatttgggcttgttgattgtaattgtgggctcctttctactatttctgttctaaacagaggggattgtttggtaaggtaggtgtccctctttttgtttatttttccctcccaacagagaaagtgctaaataagtaaagattattttaaatgtttttcattaacttataaaaactgcctagatcattgttttcccagagaattaaaaaccttactcctatatgtaaatgactttttcaagcaaataagttggtgtggaaaagtcagcatctaccattttttttctgtggtaacaagtgtatcatcaaacattgaaaccttttgggaatgtttaaaaccttctcttgagggtaagtaaaaattcaaactgggaagagagtcttccagccttggcagagatacaaatttagtttaccttgtgaaatctaacacttcaggatatttccattgtaattttgtcattacggaacataaggcttttttctttgtaactttgtgcatcttttgaatgttgacgtagcagataagatagctataggacatgaccacatttttcttttagaagactggttgatgtgaatggctgacataattgattttatttaataaatatcttttaaagtcacagatagtattgttttaaaaatcaaatggtatagacggacttactatgaaaagcattagtcattttctgcatttcaccctctttcctctgctactggttttgctctgtcacccagactggagtgcaatggtgtgacctcggctcgctgcaacctccacctcccaggttcaagcgattctcctgcctcagcctcccaagtagctgggattacaggcgcctgccaccacatccggctaatgtttttgtatttttagtagagactgggtttcaccgtgttggccaggctggttttgaactcctgacctcaagtgatccgcccacctcggcctcccaaagtgctaggattacaggcgtgagccaccgcgcccggcctagtgtcaacgacttttaactttatttttagtactgctagtgatgctccgtatctcttaaatatgttactgcaaaaagaaaagaaaagaacagaaatatgttactgctgtttgttgaataactttagacatctattgacttgaatgtaaatgaactaaatactcgtgtatacctctttccttctatagttttcactgttttgttgcattgttaaccagttgatctttaccttacctcaacttctatttcttactccatcaccagagggagtatctctagatttcttacttttaaaatgaggatattggcactcacgtgattccttggaaaaactaaaactaaagttcatggcatatgttaaaatacgtagttgcataaaagggcattcaccaagttcagtgtttgaaaacatatgccgagctatatgagaagggcatagtatagatatgaaacaaatcaaaagattgcataattcatttacgggacaagttattgaatagacttctttaagtggctcaggaattgtggcatcaaactattgagaaggaaatatgaaagacagcacaccacctgactctgctgaatcatgagtttaaatattattgatttactattatttacggtctagaatcaacctctatccaagggacagaaaatttaattatgagtctgtaataaagaacatttttatttcttaccccacttcaaattttttaatataatccatagtatgaaatatattttcaatcataacctgagatactatacatgcaactgaaaacaagtattttcactgaacagtatccttactataaacagtatttaactttcccagaatatatgtagtctgagtattctcttttctttaaaaaaaaaaaaaaattgcaaccctgtaaatgaatttcatgaccagaccattgtactaaacatcaagtatgaactaatatataagattatcacgccttttcagtggataaaaagtaaagtggaaattaagttatacatttttctctcttcataggacattggctccctggattatcaagagtttgtagttgacattgaatccaggctgaggatggaaggtgtggaacttaaagaagaatggcaagatgaagattttccgatgtgagcaatgcttttaaaagaaaacaattttagagcaaaacttcaaaatttctttatcgagatgttactttttttttttttgagacggagtcttgctctgttgcccaggctggagtgcagtggcgcgatctcagctcactgcaacctccgcctcctggattcaagcaattcttctgcctccacctcccaggtagctgggactataggtgtgcgccaccacgcctggctaatttttgtatttttaatagagacggtgtttcaccatattggccaggctggtctcaaactcctgacctcgtgatctgcctgccttggcctcccaaagtgctgggattacaggtgtgagccactgcacagctgagatgtcactgagaaactcagtaatacaaggcgatcatttgatactaggaagtaaagtttcttcggaacagttagattgattctcttgtatcttactttccaaccaagtatatatataatcttctataatctttcatttttgttttggtcacttaagtttgcaaatttttgcttttataataaagtgttttagtgtggtttgtttgttttgttttgtttttgttttcatttaaacaagatctgagggattcctcagagaaggaggtctttagttgtctttaaaatgtttctttaattttgtggccaggtgcggtggctcacgcctgtaaccccagcactttgggaggccgagataggcagatcacttgaggccaggagtttgagaccaacgtggccaacatggtgaaaccccgtctctactaaaaatacaaaaaattagccaggcttggcgctcgcctgtagtcccagctgcttaggaggcagaggcacaagaatcacctgaacccaggaggcaggggttgccgtgagccaaggtcgcgctgctgcactccagcttgggcgaccgagcaaggctctatctcaaaaaaaaaaaaaaaaatttgtgggttcccccccaccaaaaaaaaaaaaaccttactaagtaaattaataaggattttctagcttatctggccagccaccttgacatgtttgcatttgtatttacaattatattggcaccaggtaggctaatgaaaaagagagcaaaggcagaccttaagtttaaatagtgcttccgtgccgtacttgtcagaagacatcctagtgcataatcaggtgccttagcagttggatagcttagcagttggacagctgatcggagacctgagtcactgttgcatatggtggtgatagtaaatataggaatgctgatctcagaagaattgaaccattgttactgtagtctcgtgagtaaaaattgagcttcatacattgcatcatacatcacattatatttgtgcatttcagtcatatttgtttaaaattgttacctgttttataattgtataagagctgttgcataaggaatttatatctacttttatgtgttacttatatataataagtgtataagtcagctctgacagtcagaatttttactttgaaagtgtagccaggcatagcagctcacgcctataatcctagtgctttgggaggccgaggcagaaggattgcttgagaccagcctgggcaacatagcaatacccggtctctaccaaaaaaacttttaaaattagctgggcatgttggtgtgccactgtagtcctagctactcagaaggctgaggctttatcttaaacactgctaggctgggcacagtggctcatgcctgtaatcccaacacttagggaggtcaatgcacgagaatcgtttgagcccaaaagttcaaggccagcctgggtaacatagcaagaccctgtctgtactaaaaattagccaagcgtcgtggcacgcacctgtagtcttagatactcgggaggatctcttgagcccaggagttaaggctgcagtgagccatgattgtgccattgtattccagcctaggtgacagacagcaagaccctgtctcaaaaacaacaacactgctttattccattttccaaataattatttctataagctgtatgtttaatagattgaacttcaaaaaaaaattctttcttaatttctggattaaaaagtatgcctgtgtcttctagacctttaccagaagatgatagtattgaagcagatatactagctataactggaccagaggaccagcctggtaagagcttgacacttactttcattgaaattatggactttgtgttattttttaaaacacgtttctttgtccaaaaaaaaaaaaaacttgagtttttattccatcatagaagtcaaagtataagttgaacattgaggaaagcatttttagaatgctttaaaaaaaattccaaaaacatacacttggtttttggaaagttttacagtaaaggggtggaggagatcatttttagtggtaagaggtatctataaggtctgcctctatttaaaagacattgatactttattgatctcttgccaacgatgtagaagcaataatgatcagaataaaaattttgtgaataggtgctttgaaattatgttcaattaatattattttttcccaagaatggggtagttaaaatttttcttattcaactttagcatctaagcattccttgttacgtatctttttctttattttccaattccaggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaaggtaaatgtttcactgtttttaatctgatctttattaatgtactaagggattttgtttgaaatacatcattctttctaaagttcatatatttgttactaagataggaaattgtgctaacccttgaatattctcaaggacttaaaaagtgtgtatagggtacaccagtggcttttttcccctcttatttgcccactgctctcatgtttttttcatagctgtttcaaaaatatttcttgataattatggcatgctcttttttagtcaatcaagtaagaaacttttgaagagacatatagttaacagtttgtgggaagggagttctgaaaggaggcatttggggtgactttttaagtaggtttgcctgacattgctctactttgtgaaatgaccaacttaaattaatgtatacttttagcccccgaacctagtattccttattacttgtaattcaaaggaattgtgctgttttactttgcatgctttctttaattacaaaattgtctacagtatcttatatatagttgttataatttttacatatttttttccatcttgaaaatgattttgttttcatagtagtgtttagcattcagtattttactgtaataaagtgtgatatgctatatttttggtttcttttttcttccctgttttactggttcaataaacagtccagtagtaagcaatactttgtaaagatactgaaatagttttgtgcctatgtgttttgtctcttctttctttaatgctgctgtagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagatttaaaattgtgcagatggtataatgaaaattctctgtaaaatctaggtagtaaagtggttaacgtataatttgatttttgttgtgtaacaatttgtgattcaaaaactttttattttgacagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggtaagagttactgaggatttttcagattgtttaatgcaatatcagaattcttttttttttggaaggatatctgtttattaagagtaaataagccctgtacagaacacaggcgctaggttgagagactcgtcttttgtaggacatttcttcctgctaaccagttcctggagggcttgttttttttgtaactttacacaaggggcactaatggaaaatatagctttctcaagacatctgatgtcagtttcccattgttttgcttcacaaacatcaacaaagtaaacctgaacatgcttagcaatttcccaatgttctttgctgacattacttttgacatactgtgtcaaaattcttaaggtctcccctcctttggtaaagtaggcaaaaccttacaaggaaaacactataatacgtggaaatatactgagttagatttccagtcacctgctctatggctctgagatgcactatatccataatggttcctaggactgtgtccacctgatggtttggagtacggaaaaccaacccttatggcttaagagtcatctcccatggaagacaatgctggccttctgaacgctggggctcatgggcttgttgatgtggctttctggtgtgccaggatcccctggcagctcctgtatacttcagtcaagcagtccagccggggcttggcactctggaagacgggtactacttgggatatcccatgtggttccactggatccttcaataagatgcagaggtagtaaatcaccttctgcatgtaaatagcctcattgatgacaatatccttgaccttgcccatttctatgaaggtagtgctttcttagcctgaagcataagatgaagtcatctgaatgccaagggaatcaatgattaacagtctcctgatcaatcttcacaaaatggagataaccaagcagacctaagagggtgatgaagatggcagcagagaggatcatgctgttctcgcagagggtgaagagtccgtaggctgccagccacaccgtgcaggtgacagcggtgagcgaacgcagcgagagcccagggcagctgaggcagaattcccggcaggaagggaagtagtagcggcgctgcagggccaggcggccaccgcagatatccgaaaagctccgctcatcctccatgacaccccaactctgccgcccgcaccgcaccgcgcggcactccactgcgctcgcctgccctagccgtttcatgcaatatcagaattctaaatacttttagaaactctgcctagagatattatgtaattttgaaagaataataagcatttctcattcattttagaaacatgacaggtttaaagtaaaagaataaaagtaccatttaaaaatgattatatgcatacagtaagttgaaaaagtacaaaagaatttgtagtgaaaactgtcaggttgggcacggtggctcaggtttgtaatcccagcaatttgggaggctgaggcaggaggattacttgagcccaggagttcaggaccagcttgggcaacatagacctcgtctccacaaaaaaataaaaaaaataaaaaaataaataaaattagccaggagtggtggcatatgcctgtagtcccagctacttaggaggctggggtgggaggagagagagcttgagcttgggaagatgaggcttcagtggccgtgatcatcccactgcactctagttttttgttttgttttggtttttgaccctgtctcaaaattaaaaaattttttaaactgtctctaggctacccaaaactgggactgaacagtctccctaatttataaacagtgaaatgctctgatcttaagtgtgcagttcaatgagttttgacaaatgcctatataaccatatatacccatatatataaaacccatacccctgaaaatgtagaacattttcattgtcccagaagaattatttagtacccctgtgcaatgaatactcaccttcggtagccactgtcatatctaccccctgattagttttgcctcttctagaatttcatatatagtaactaaaatcatcctatgcactcttttgtttacttttcagcatgaagtttttgagattcatccatgttgttgcacgtatccacagtacattccttcttattgctgagtagttttccattgcttggataaaccataatttgcttatccatttttttttatgtgcatgtgagttgtttccagcttgggctgttataaacaaaactgctttgaacattcttgtagaagtcatttatggatataagtaaaacttggactctttttgttttgttttgttttgagacagagtcttgctctgtcacccaggctggagtgcagtggcgtgacagctcactgcaacctctgcctcctcggttcaagggattctcctgcctcagtctcccgagtagctgggattacaggtgcacgccaccatgcccagctaattttttgtatttttagtagagaaagggtttcaccatgttagccaggatggtctcgatcacctgacctcgtgatttgctcaccccagcctcctgaagtgctgggattacaggcatgagcaccgtgcccggccctaaaacttggactttttaaccttaactcttaatttgccttaaaaccgtgaacaaatttttttttcttttttttttttttgagatggagtctcattctgtcacccaggctggagtgcagtggcgcaatctcggctcactgcaacctctgcctcccaggctcaagcgatacgccagcctcagcctcccaagtaggtgggactacaggtgcacgccaccacgcctggctaatttttgtatttttagtagagacggggtttcaccatattggccaggctggtctcgaactcctgaccttgtgatctgcccgcctcagcctcccaaagtgctgggattacaggcatgagccacagtgcccaggccaaattattttttaatagagaactagttcactccacacttctatacagcacccactttccatacttatgggatatacaaaaatacaaggcttaagtccctgcccttaagaaataggaaaagccataaaagtttaagttataaatcctttcaatctaacagtaccatatatagaagttaacctaggcacattgtaaatagtgctagaatgttagtggtaagtcagaacacaactcactgtagagcatgacatactaccttaaatcctcctaacacaggacggagggcatatgggtcaagcagattgattttttttcagggtcatttccacttgatttactctctgccagatgcattcccctgcttatttctacagtcttcattcatctgaaagcaaatcacatgaatatttgtagttgcattcttctgcctaatttaatcgtactcagatgaagaaaatggcgtaatctgcatcaggaagtccacagacatacattattcagctagttcacaggaatcaaattataagacctgatttatggcttaaatctcttatctttcagaaatagcactttttttataggggaaaataagaccaccttattttattgcattaccacacttaatatattttgtgactgagtgattaagaaaggtagtgaagattctgatgttcttgaaatgttcaaatcttttcatgtgcaaatttgtaagcaatagaaatgaaggttaaagcagaagtatttgctactaaatattggcttaatatctaaagactgctgttgaaacatacatattttagcgctgttttccattactgaaaattatgtcagagatgtaatttagtttgtttttttgtttttgttttttttttttttttgagacccaagtcttgctctgttgcccaggctggagtgcagtggtgcagtctcgactcactgcaacctccgcctcccaggtttgaatgattgtcctgcctcagcctcctgagtagctgggactacaggtgcacaccaccacacccagctaattgtttatatctttagtagagatggggtttcgccatgttggccaggctggtctcaaaattcctggccttaagtgatctgcccacctcagcctcccgaagtgctggaattacaagcatgaaccacctcgcccggcctaatttagttttaatgtcctaatttctacaaaatgctagcatttttaaatataaacttaccttttaaaaatcacccacttatggctctggcgatgtggctcatgcccagtgctttgggaggccaaaggaggaggattgcttaaggccaggagttcacgaccagtctgagcaacacagtgaaaccctatctctacaaaaaaaattttataaaggttaaccaggcatgtttgtgtgcgctgtatccccagctcctctggaggctatgaggtgggaagatcccttgagcccagaagttcaaggctgcatgagctgtgattgtgccactgcactccatcctgggcaatggagcaagatgctatcctctaaaaaaaaatttaaaaaagcacccactttgccgggcacggtggctcacgcctgtaatcccagcactgtgggaggctgaggcaggcagatcacgaggtcaggagttcgagaccagtctggccaacttagtgaaaccccatctctactaaaaatacacaaaaaattagccgggcacggtggtgtgcgcttataatcccagcaactcgggaggcaggagaatcgcgtgaagccaggaggcggaggttgcagtgagccgagattgtgccactgccctccagcctggacgacagaacgagactccatctaaaaaaaaaaaaaaagcacccactttaaccataagcatcatagaaataaataaaaatacattgcagttattgtattgtgtctgtattgtattgggttatatcactatatttgtctacctgctaaaatagggctggctttttaaatatgcgaatttaagtggtcttgggtttttttgttttttctgtccaccgtcctctttaaattttactgttctctttttgggaagaagacattaaaattctatataagaccatataagatttacaaaacatacatttaatacagaaatctgtgaaaagtaaactcttatttataatttactaatcatacagatgtcttctaaaaatgcctaagagtaaaatcgtgctggtgatactgtctttggtttcttttttaggatattatggggatggattaaatgccattgttgtgtttgctgtctgtttcatgcctgaaagtagtcagcctaactatagatacctgatggacaatctttttaagtaagtatatattaaacaaaaacatttggacagaattctgagctaattagatctacaccttaagaaacttaaccttttcaaaaattataaatattccagttctttgggagactgaagtgggcagatcacttgagtccaggagttggagaccagcctaggcgatatgacaaagctctttctctacaaaatcaaaaaattagccaggcatggtagtatgggcctgtagccccacctactcaggaggctgaggtggaagtatcacctgagcccatgaggtcaaagctgcagtgaactgtgattttgccactgcactctaccctgggtgacagagtaagaccctgtctcagataaatatatatcccagatctgttcacgtgcaagtttgtgacacagaatgaaggttaaagtaaaagtatttgttactagatacaggactagatgagccttattctttgatattatgaacgatagtttccaattcaagagaaaaattgtcattttaaaactgggaaatatatctcagattatttgttccaactttgtatcgatttgttttgagatggagtttcactctgtcacccaggctggagtgcagtggtacaactacggctccctgcagccttgacctcacgggctcaagccatcctcctacctcagcctccctagtggctgggactgcaggcacatgtcaccacatcctgctgacttcttaatttttggtagagacagagtctcactatgttgccagggttggtctcaaactcctgggctcaagtaagccaccatgccttacctgtcccaactgttttatgttaacatttgcaggcacattaagtgtaaagaagtgatttttgtctcaaaatcatgtggctaaattacatttacccctagaaggccaatataattgagccaaatcagttctttttccacaaggtcattctatttctcaggttagtgcagtttttaaaaaccgtattgtggaaagtttcagacatacacaggggtaaagagaagtatatcaaatcttcatgtatcagtcacttcaacaattaccaatttatactttgttcccacttctaacccccagtttacaagtttgaagcaaatcccaggagcaaatcatttcacctagaaacatttcaaaatatatctctaaaaaataagataatcgtaatactagctaatgcggtttgagcattttcattgttgctctcattgtaggagagaggaaggaattgtataatggtacaatttagagaacctagttcagttatgcacagtgatttttaaggcttaaacttaatttgttttttacagatatgttattggcactttggagctattagtagcagaaaactacatgatagtttatttaaatggtgcaacaactcgaagaaaaatgcccagtctgggatggctcaggaaatgttatcagcaaattgatagaaggtaatacaaatacaagttgaaagctagtctgaaaaaattttataatggctttaggaaatcaaactttgtttttcgttgctattttttttttttaactttttttttttttgagacggagtttcactcttgttgcccaggctggagtgcaatggcacaatctcggttcaccgcaacctccacctcccaggttcaagcgattctcctgcctcagcctcccaagtagctgggattacaggcatgcgccaccacgcccagctaatgttgtattttttgtagagacggggtttctccatgttggtcaggctggtctcgaactcctgaccttaggtgatccacccgcctcggcctcctgaagtgctgggattacaggcgtgagccaccgcgcccagccttctgttgctattttaaaacaccatttattttttaaattttatttatttatttcatggcaggtttctgttttctaaagatagcattttagaatattgtgagggaaatcaattttgatttttctataaagaataaccttaattcttcaaacttacaaagtagctttatatttctccttatttaattgaagactttctccttatttataagatgcaattttctccacattgaacactttttttcctattatttacgtcttggcaaaggatggagaatgtagtatgtttcctatttcattacattgagttttgcctaatttatagtgcttagcatgttttatgtttttgtttttgttttgttttgagacagggtctcactctgtcatctaggctggagtgcagtggtgcaatctctgctcactgtagcggcaacctcccaagctcaggttattctgccacctcagcctcccaggtagctgggactacaggcatgtgccaccacacccagctaatttttgtattttttgtagagacagcgttttgacatgttgcccaggctggttcttgaactcctggactaaagcgatccacctgcctcagcctcccaaagtgctaggattacaggcatgagccacagcgctcagtatttatgttttttaatggtgcttatttagttgtaatctttctttggaacaagctttagaagtgttttgtcttgggagttagtcatcagtacttaatggaaggaatgtgatcttccgattggtttgatcttgctgtggctaatttaaatcaagtcagacccattaataggtttctcttcacatctaaatttgacattggctagctcttatgattatatatgtatctcactttatgtgtgaaatatgcataatacaaagagtatttagtcatttaaaaaggagaagtctaggataaaacctttaatttttaatcaaaactttaaattccttaagaataggagttagatctgatttgtttttgttcctgtggtcatcttctccactcacacttctctgcctgcacagtgcttttcatggttttgaagaacttagcaccaatttctccctagtcttggaaaatgagaatagtttacttttacattcagtattggcctctttccctgtttacagagtcctgaagacaagtgaatgtgtatgctaggagacatttagtaacaggctatactgtggacgtaaatctggccaaatgaagtaaagttcatttcatagcagtaggagggaccataagaatttaagagtgcattttcttgtctacaggggtatcacacctaattgagaacttttgggtgagatttttcaactattattttgtataaacttgcagcattagaatttatagaaatttttaattttctttgtgtgtgtgtgttttttttttaaactccaggttacggaaaaatctaaaatccctaatcattgtacatccttcttggtttatcagaacacttctggctgttacaagaccatttattaggtaatttttgagagccattgactttaattttattttttttatttatttatttttagttaacacataataactatacatacttatgggatacagagctatattttgatatgtgtatacattgtataatgatcaaacctgggtgattagtacatccatcacctcagacatttatcatctttttgtgttttgaacattcaaaatgacatgatttttgtatcttgtaaacattgtatccattgtatttgtcagaaatatggaagtaattatttttattttcttccatagctcgaaattcagccaaaaaattagatacgtgtttaatttggcagaactagcagaacttgtccccatggaatacgttggcataccagaatgcataaaacagtatgttttgttttatttccttaattgtattggatcttaacattttgatgtgcaatggataatacttttcaatactcattctttatgtattatattttataactgtgcgcgcgcgcgcgtgtgtgtgtgtgtgtaacaaagaaaaagaggaagaagccattttcccacaccatccccctaagttagcattttcttcaggctgtcagttgaagaactaggataaattatttccggttgtgattcatgttatacttttatagactacttataatctaagagatgatttctctaattgatcagtactaaagagcattctccaaacttgaacatagtgctcaacaaatttgagtaaactgatcatcaatattattattgaataatcatattgctaaataaataaaaatatttaaatcatcataaccttaatgttttccagtgactgaaattctgttctgattatcagattcacattcttccatgtaacttcttggacttggtagaaggctgttaacataaataactgagtattacaatgcatgtggaaaagtttctttgttctgctcacctgaggttttagtctatttaatgtatgaaagtcagatttattaagtaaatttttactttctacatcatgtagtaaatatttttggttttgctggaaaatttaaatgagtttatttttagtagcttttttcaagtttttattcattttcataacatgtatatttactgaaataactcttccctacaaaggtatgaagaagaaaagtttaaaaagaaacaaaaaaggtatatgcacaccttgactgggttgcatctagactagtccatttgcattgcagactaactcttccttattggttggttagcttgtagacaaagataatagcatttgcaaatataaatgtaccccaacttccaaatacagggtgaacccagagttcctaaggctgaatatgacttggattcaccatgttttattgccatatatgatgccaattagcaattaaaaaccacagacccttctctctccttcttagtctaagtactaatggtgaaaccagagaaattactaaaaatggtatttggaacaccaaataattttaagactttatctgtttcaccattttctttaaatcgctaacttgtgcttttgaaatatttttgcagactttttaaaagttctcaatttatttccctggggttgattattatatttgcaatgcatatatactttggctaaccaacattggtttccttttatgcttaaattaaatggcttgctaaccagtcaaattctacatgtgataaaatacctaaaatctcagtgtcccatttaacagttaaacacttcactttctattttaaatttaattttgaacacttctgctttgagcataacaaactattatctattgataccttgacatagatgatgaaaggcaagggtataaaatacttagaattttgtataataatttagaaaaacgtagaatttagatctagtttgttagatctttaaaatattggcaattaaattagcaaaacatagtttaatacaatcttaagagttacggtgagagatttatatgtaattatcttgaccattctaaggagccaactgtaactaactggaacattcttaactttgaacacattttgtttctgttgatgagtgagaatttagtagactttgtgatagaatcagttttacacttctatatgacacttcacagtttaaccaacactttaacatagaaatgtagacagtgattttagatcatgctgatttcacattcctttctaggcattgctgtgcattcgacagacaagtggctgaaattaaaaatatgatttgtaattgtagaatattttgaagccagctgcttcatagatttcacagtgaattgcctttgttgataaaatatgctgtattaagcctttttaaaaaaagtttttaatactgttaagtaatttagacatcagaaaaaatatggaatttgtactttttatttaaatatattgtttgaaacctgtcactattttatcttgattttttttttacttgtgtttaaccataaatagaatgattacatgtatctttcaaaaacgttctgttttttgtagtttctttagtcttaaaaaataataaatttttgtcaatctgaaaatgataaaatttaatttttaaattaaatttaggtagagaggcatgttttgttttgagacagagtttcactcttgtcacccaggcaggagtgcaatggcccagtctcagccaactgcaatctctgcctcccgggttcaagcgattctgctgcctcagccccccaagtagctgggattacaggcacccaccaccatgcctggctaatttttgcatttttagtagagactgggtttcaccatgttggccaggatggtctcgaactcctgatctcaagtgatccacccacctcggcctcccaaagtgctgggattacaggcgtcagctaccacgcccagcctaaaccaaactttacagaagctaggtgcaagggagcttatttaaggtgacaactgcatgatatgataagtagtggtgctaagaagagtatgaagctatgagtccctatggcaggtttttggggagcaggggaagaaggggcaaaaccattttcttgaggggcttgtggggaagagggttgaagaaatgttgacaacagggagatccagtgtccccagtgacagaaaaaggatagcagtttaaatgtttaaaatgtttctttcaaacaactggatgcaagtgtggccatgcagatacagattgttaaaatgtttcaggggagtttaaaaataattatgaaattagttggtaaggatatttcagatgttaagaggatttgatatattttgcatgccttatcagaaatacattccaaattttttataacaatattttaaatattttaaaatgttactttggctttaccacagaccagggcttttaggtctgtttcactaatattcaggtgggcatagtaatgggtgatgagaataaaaacatatgaaaaatatttttctttatctaataccggattgttttaaaggtcccttcatcagttattcagaccactacaaatgtaatagtaatagactgttagctttgaagggttgtctgtaattattatgtggtaattatgtaatccttctaatgcccacatgcgtaaattttgatatgactgatgtccaacccaccactaaataaataagctttttgatgggtttttgttttgtttttttgagacagggtcttgctctgtcacccaggctggagtgcagtggtgcagtctcggttcactgtcgcctccgtctccagggctcaagcaatccttccacctcagccttctgagtagctgggactacaagtgcacactaccacacctggctaatttttgtattttttgtagagacggagttttgccatgttgcccaggctggtctcaaactcctggtcaagcagtccacccgcctcggccttccaaagtgctgggatcataggtgtaagccactgtgtctagccaataattaatttatattagatatttttgaatgttaaattctttttttttattttatttatttttttaagacggagtctcactctgtcacccagtctggagtgcaatggcatggtctcagctcactgcaagctctgcctcctgggttcaagcggttctcctacctcagcctcccaagtagctgggactacagacgcgtaccaccacacctggctaatttttgtatttttagtagagatggggtttcactgtgttggccaggctggtctcgaactcctgacctcgtgatccacccgcctaggcctcccaaagtgctgggattacaggcgtgagccacggcatccggccttgaatgttaaattcttaaggcttcttactgtcaaaacaaatttaaggcattcacaaactgtgtaccaataagttttggagaataattatgggttctataaggatgcattttttatcactgaattttaaaatattgattgataattggtggccttcatggcattttcatattttagttaacagaatcatttttgagggagttgtttttcctgccattttcgtaccacctggatccctaccacagccaagttacaggtcaagattttaatatgccatgtaatttgaacttttaagaaagtttatggctgggcacggtggctcacgcctgtaatcccagcactttgggaggctgaggcaggcagatcacgacgtcaggagatcgagaccatcctggctaacatggtgaaaccccacctctactaaaaatacgaaaaattagccgggcatggtggtgggcgcctgtagtcccagcaactcgggaggctgaggcaggacaatggtgtgaacccaggaggcggagattgcagcgagctgagattgtgccactgcactccagcctgggtgacagagcaagactccgtctcaaaaataagaaaaaaaaaaagtttatatgcatttgtatgtaaagtattttataatctttaaagaaacaacggtcacatttcttgccagtgtcctcctgcctttaaaaattctcttttctggttggggaaatgatgtttggtaactgtttttactatgtctgcttctttgcaaagctttgtctttaacagagtaatattctatgctaaaatagtcattatttttagaaagaaaattgttcagttgctggtttcttattttatatattcttcattaaacagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaaccttttaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctctcattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgctcaaaatgggctgaggtttttaataggtggttttctaccacattaagtacttggttcttcagtttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatttcccatattattccattttaatttcccattactgaccaaggtgaaagtatatgtgattgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggca

SEQ ID NO: 15886 - DNA, 25512 bp, Human
tctaaactagaggccattcttggggaggaaaatcttaaaaacatttggttcttaggaatcccctctttacacgcatattttattaaagtgtaacagattaaaaggtgctctagccagggcaaatcaggtaagtggtttccaaaactcacgttgatttaaaagttcttgcacccctccaaatttcttcttaaagaggacagctatcccagcgcccatgcgacaatcctcactgatacagtgggctaaagagtctgttttcgggcatgcaaaaaggtctcctttcacataagtgatctaaaaaatgtgcaaaggaaaagacaatgttttattagatacagtaaaatactaagctatttttctgtattttgtgtcccccacgactacctctcccggcaccccttcctccaatctgatttaaagccaaaccaattacagcatgtgtaaaaggaaagtaatggatgatccctgcctagaattttgagcctttttaaagtaaatcagctagagagaaaaaaagataatgcaatcattaatttaattaaaaagtgtttatgcttttgacctccattattacgaatttcagttcaccaataagtcaatagttgttacgcactctgcttccttctggatcttcattaaggctgctggccatgatactgagtcgctatttccagaatttaagtgtttcttcagctatgagaagggaaaaggaagtaaaaatgcttaggcagccttagtatataatattctgattgccctgtacaaccacttaataggcttttttccccaacgtttatcgatgaatgtgagtttgttcggcccctgggacgtaatacaaaacccttctggggcaaagaggaagaacgcttaggttcggaggctgtctcgacccgctctcatttcgtgctttcctggagcgccccgctccgtcagcggaagcaaagcccatccctaagacacgcctcctcctttctccagggccactccggagcaaggccgatttaggacggtctccttttctctgcacgacgcaaaagtatttccccagtgggtctggcttagaagaaaacagaagggacttggccacagtcccgttaagccgcaaccacagagtgtacagggtactggcgtgctgagccccaggcgtggggaaaggaaggcggcctctcaaggaacgttcaccccccacttttttggggggtgcgtgggagaaggaaagagtctattgaagcctcccattctctgtctcctaccctagggcgggtcagcgaggacgcagtctgtcctggggtcctatgggagggtgcggggaggctcgctcaaagccccaacgtacccaagtcacccttcacctggaaaggagtcggttgtttggaggtccccgccccgcggggaagggctccggatccgaccctggtaggtggggagcagcggaccagcccaaacgcggagccaatcccgccaaagcccttaattgcacgcatctaagatggccgcccccgcccggtagcggggcggaaacgagcccctctagcttgctagccgagcccacactctttggcgaaggccgccgaacttccggcagtaaattccgtggtttcccgccgccgcccgcgcatgcgtaacgaaactgccccacgagtcgggaaaagtggcgcttgcgcattagccgcaggggtgtgtcctagtggccacttggaaaggggtgggcagctggcaaaggggctagttagcgcctgcgtagtactaagctcaaggcagcgttttgagttgaagggtctggcgcgtctggaaagcgcctgcgtattcctttcactgggggtggtgtcaaagcgggaaggtgggcgtggcttcagggaacgcctgcgcgttgctcctccgaaggggtggggcgatccctgaactggagttagtgggcgtggcctcagaggcgcctgcgcggaggcggttggagggaggcccgattcccctttgttcgggttcgccattttgctaggcagcggcagtggcggcggcagcggcggctggagcctctgattgggtttcggagtccggtactggagccaatcagcgcgggcagcgaaccgggggagcgaggcacggtgagtgtgaggagccaatatccagcggcccagagccggccccagcgccccgattggcgggtctcgctgaccactcaggagaggcccaggcgcccgtcgagcccggggagtcgagctgagcctagccgagccgggcggccagcggccccggcccggggcctgcgagcgcctcggggcactcccggccgaggcctgcaggggccgccccgcgcggggatggcgcctcggggagcaggcacctcggggctccgaccctcgcagggtgccagggccagttgggaatgcgtccctgttccccgactcaggcccaggttctcaggccccaggcctggggccacgaatggccctacactaggggacacatgcgcgccctgggcctcggcgatttcctcctggtcgttctggccgcaaacttaaacctgcccttgcactctccactctccggcccttgggacaggaagcctccccggggcccgcgccccccgctccccgctcccagcgagccgggtctgtcttatctgcagcccctctaggtcgggagggaggcctggggagggtgcgcgccgcggccgcggggtcccgtgtgcggctggcaacggggctggcccgcccacgcctcggagccctatgggcccgcccccgctgtctccctggtggggagagggggccgttagttcgcccactccccctgctccgccgcgcccctcctcccagcccgctccgcccgggtctccggcccggcgccgttaccaccccttttggctcgtcatttcctctcttccccgccccgttcgcagtggcaggaccgcacacctccgtcttggagcccaaccaagcggtctccgtttcttgtccgggctgtaagaccagtccattcggtgcctggaacctcactcttagaagattgatacccttgcgtattctttccagaggctgcacaacttgctgttcatattactaatcttatccactgctcattttgtgaaatctccctcccttgggaatatagtacagttttgggggttttttttccctttgtttttgccttcgcctttctatgttactttgtgtcaggcttgacccagtccactcatctcttggtttatgtttttctgatacactttcaagtcctgtgttaacgttttctcagcagatgtttagaaactaacagtgttgtggggttttccttagggtgagaggttgctgttggcaaccaattatccagcagttagtatatgccaggtataatccgtgtgttagggagggagtacgtagaggtcaataagaactgtgcctacctgatggaaattgacaggtgaacaggtagttaatacctaacggttagtgctataaaggggccaagttcagttgctgtgaagtatccatgcgtgagctagcctccgtgaaaggcttatcaccaccgcacttttgactggccttgaagaatgatggtaattcttccacaggaaagatggaagagcttgctcgaagagaagaaaagcatgtgcagaggaatcaaattacactgttggaggcaggaagatgggatagggaagtgggcagtagttgtgatagtttaggggggaaagcccagttggtaaaatacttgtatatcttgctaaggaatattttggaaacagttattattttgtatggaggttcaagtagaagggatctagagctatattttttcctaagattgaaaaaacgagtttctgacttgtttatgggttctgccccgtgatagtggctgagttctttggggatgaagaggagacttgtcctaggactctgaaaattatttttactcatgtgaatcatctagtgcattccctggcacataaaggtcttaagtatctggtgcccatttctaaattcacatttaatgttatacaactaataggtttcagaaaactcgtattccagtgctctttcattactaaaacttcggggacaggttttattttcactttttagggtgagtttttcattgttgcttaagtgattttcttaattcatttgattgtcacgttatccgcattagcagatgagatgatagagcttaagtagtctaaaaaacatgtatatttgcctttggaacgtttttttgtttgtttttggatacagggctttcctctgtcatccaggctggagtacagtggcgcaatcgtagctcactaacctggaactcctgggctcaagccatcctcccttcttgttctcccaaaacgttgggattacaggcatgagccactgcgtcctgacctgaaatagatgttttaaccttagtatttaaaaataggtatgttctggtcacttcaaaatcactaaatacttttgcttggcatctttctaaaaggcattataatctggtaacttttttgctaaataccttacaagcttccaccagtctgcagaagaatttctttgtctgacattttgagagaaagtagtgtggccccaagctttttttcctgtttagtccactgttcacatgctgaaatatttctgttcttgtttttatgctctcttgatttgtagtacttcaccttcctccacatcatcacatagctaaatctttctcacacttaagaccagttcatcctgcaggcctctgatagcaaagaaaaaaaaagttcaagtagtaccttttttttttttaagccttgttgatttatccccagctggaacaaatctctgtcctccaaattcccatatcactttatctcttaggattccagtataggtttttagtccattactaaacttaaagactctttgaagtttgaatcttcgtcagagatttctttttatttttaaaaccttcagaacagtgtctggcacatggtacataattagtggagagaagtgcattagaaagctccaatccagaaatctgtaggatgatggggaagctggacagccctttgttgtagtctagtctttcatcaagcgtctatcaggacccacttgttgagttgtgaaagaaattgagtgagccaatgctgggaatttttaaataatagaatagaaaatatctgccaggcatgatgatggctcacgactgtaatcccagcactttgggaagccgaagtgggagaatcctttgagctcaggagtttgagaccagcctgggtagcatagggagaccccctctcttaaaagaaaaaaaagaatagaaaataccaaagtgcatcttgtgttgtataaaggtaaatgctgtttcatgaaactttcatttcagttacatgctttatacatgtgtgcactgagttgtgataatgaaatgtgtttcttactaagggttgtggtcaaaaaagttaaaaagctactgttctaggctttgcctggtagtgattatcaactgtgataatcctatggcttttcatatgcttacactagttgagtttctgaagaggttttagctttggagtttgtgtaggtccacatagaatgggttcctagtaagtggttggctaagtctcagcttttgcaccttggaatagtggggcaaagagaattgcactgagaagagaatgcactaggaagagaattttcatgctagccagaataaacacttattatttgtttctctctctttgaggaaaaaccattcaaaactttgtgttaagagcaagagctagacagactaaatctggcttagtttgtcataatcttgggcaaagaggcactttgggaaagactatcgaattgtattgcagtcttgctaactgaagctcacagtagtaggaacatatgactttactgaagccagttgcttatagcattaaccattaacagtatcaatatcatgatacaggctaaatcactctgtcattaatgtgagagagaattgctgctagatttgaagctgctcttcaaatcttgatactcttcaaagtataaatttaaatattgctaaattggttcatttgtattaccagaataaactagttaagaagaaaatctgtacgttacatatattagtcattatgtgcttcaagttatatttagtcttgtaaagatgtaaacttctggatattagtcaaggaaaaaatctcatataagaaggaaatttggagttggggaggcgttgaaacctaaaagacattcctttcatgatccttatttttttaaatcaatttattgagagatactttagaaacaaagtataataattttaaatgtgtattttgatgagttttgacaaatttgtacacctgtgcaactgctaccacaatgaagatataaaacattttcatcaccctacaatgttcctaaggctccatgccagtcaacctccctctttcctgtctccctgtattctccactcccaaggaaccactgatccattttctgtctctagattactgatgtcttttggagattttatataaatggaatcatatatattcgtttacatcataaccttaattttattagtttacagccataaatgtgtattagagacaagatagaatttagggaagcctgttagtgcccctaacagactcacagtctggctgaaaacctgattttctattctatacccagaatctctgaggagcagacttagtcaaccaattccaaagagactggtgtaaaaatcagaaaaccggtttgtcatgttgctgattatatttgctccctgttggccaatctatatgtaaatccaaattatagctagaaatttacctagcgagcattccattagatcaagggcagtgctttggagaaccatatggccacaagtcctcttgctgtgatgacatagcctgttatttatggctcatagattcttatgttgtatccattttggttatgagtaatggggttgattaatttttattttgattaaattttgttatatttttcctaacattccaacattcatttgggaaataagaatttctcaaaattcttattctagaaataagaattttcaagtgtgcagtgaaatcaaaggaatttgaaaataaacacctgtatacctgccagttagggtctattaacatcttactataattgccttaccagatatttctccacccattcatccattttttgatgcatttcaaagtaaattttagatatcaatacacttctttctaagtacttggacatatagttgcacatattttggtttcttctttcacactgtattgagacaccttgcaaatgattaattccaccagcatgtgtggatttatggagagtggtactgtactttgccacgataatgagcagctcagttaggtcacgtcattttattattcagatgttggaatttatgagggcctagtgaaaaatcagagagaaagacctatctacatttttgtttatatatctgtcctccctcccatatttccaagatgaattgccgattgctaacttatatcattttaattttttaatgaagtctttattaaaggttctcagatatcattcagtttatctaattgtatccttatttttaaaagtggatcttcaactcttaaagtctatgagaagggtaaattttgcctaccatatgtagtggacctgagtaacatgtttggtgggaagcaattacgtgttacaacttaaagaagctttattctctaaagtatatgtgcaaacctgaaaatcagtgttaggtatgccttgtatcaaagtgatgtagcttaacgagtatctcttaggtgcaagtattgctctgacagtattgaaaggtaaggttgccagtatactgaaagcattttagaaacgtgaaaatagcattatgttgttatgattgtgccatgtaatcccagttaaaaatgatactgaatataagcatttcctattctcctatcctgttttcttgcaaataaagtacagtgataaattatccaggttaattgtctggtaaggcctttattgacaatctcactttagtttctttccccacctttctaacaggagtgtacctcacagccttctaggatctccagagtggacaggaatctcacttggagggaccatggagcagtatacagcaaacagcaatagttcgacagagcagattgttgtccaggcaggacagattcagcagcaggtatggaagcaaaactgctttaaacattacagcaatgaaactgataacagcaccactcaattggttggtctattgccctggggaattatttgaaagataccagatcttgtgagatattgggtctgatggcttgtgctgaaatgccatgtctagcccatgaccacttagaatctactcttcatgggtgcctggttatagtaaattgcctcttttatctcattttaagtaaaaacatctagtctggttttcagatggaaatttggactttaaaatttttctggattctatttggtctttttctcttcttgtttgagctaacttgtgatttagtaagtctttggccacaacagacaaaccaacatagcttccaataaatcttctgttttttgatttggtctgccacattttttattcagaaaagctctggtttaacattaggataatatttagacagccattcttatggataagacatactagaaaggaattccctgctgctggtttattcctaattaatagattgctttcttgaatttatacacaggttacattttctgatgctttatgcttgggtttattatagtaaaatttcacttttttccccaccccagaagaaaaaaatgtattatgtttctatttgaccttaggccaagattgatattttggaaatactttgttttcaaaatggaatttagctaatatagaaaagtagtagggaagggaaaggtagtattgatgatgagtttttcccgtctaatgatcaaagacgaactcccctgatagctttcccttccatacagctgctgtggctctggcagtttccttcaactgcctttttagaggaagggattccacaaagggccctccattcacaccagtgccctggagggtgggtttttattctttcagaatttgccattagtggatgtaaaaataaggttgaatcattgaaaacatggctcttaaagcagtccagttgggtagaaataatcttagttttgaagctgggcatggtgctgcatgcctgtaatcccagctactctggaggctgagacaggaaggttggcttaagcccaggaattcaagaccagcctgggcaaaacagcaagaccccatctcaaaataagtacataaataaagtttaaaaaaaaaagaatcttagttttgggacatgagagcattgacgtcatgaagatgatttcggttcatagtgattaattactcctcctttcttggtgattgcatttaagcccagaattttttatggtagtttcagggctattaaaacctaatcatttttttcttgtgaactcatctgaggagataaaaagggcattaaacaattgtgtaagtagaagtgtcagattcctgtttctggagggaaagattgcattacaaatctttgtgttaatgatgacaactgttttgagtttttgagtcaaatttttgaggtccactctggagacaaagggctaatatctttaatcctactaccttcaacaaaacagcttcaatatagggagtctgtacattttgaaagtccttcaggcttccgtctctctcctccaagaggtaaggtgatctgtgtcttgaactacacatttccttcctgacatatttcaagctcttcctgttcctgttctcagcagcagggtggtgtcactgctgtgcagttgcagactgaggcccaggtggcatccgcctcaggccagcaagtccagaccctccaggtagtggtaccctctctgattctctgtgagcactgcatgaacttctcctctcctcatgtctggtgctgtttgtgttaggatctccagtaggaatggcaaagtcagttgcatgtctttgatgctgctaacttgtctttgaggcttataagatgccagtttcctaatatttcatgccaagtcatatagagaccccgtatcaactttctgagaattggatttgactagcatgtttctttgagaatgcctggaaaagaaatggtataagtgacaggaagaaattcttataagtgacattagaatttattcagggctcggccgggcgcggtggctcacgcctgtaatcccagcactttgggaggccgaggcaggcggatcacgaggtcaggagatcgagaccatcctggcaaacatggtgaaaccctgtctctactaaaaatacaaaaaaattagccgggcatggtggcgggcacctgtagtcccagctacttgggaggctggagcaggagaatggcgtgaacccaggaggcagagcttgcagtgagcagagattgcgccactgcactccagcctgggtgacagagcgagactccgtctcaaaaaaaaaaaaaagaatttattcagggctcacactctgatccaattaattgcatggtaaaaattttgtgtatttgtgttacaatggagaaggaaatatatacatatacagacacacataaactaggctaggctgtgctttatttttattcaaggggcaactcaactgaaaaataatcattgcacttggcaaggtttatctaagcactgaatcttgttaatctcttgttaactgctattgtttccactacctttcctgggggaatagtgacctgtcttattactagatctgcaaagattaccccagatacctcttggttaggcagaagcaggatgtgctttctgtaagtcttaggtgttaaagccactgtgataattcttggttaatcaatacagttctttagcatcgtgtatggctaagtatcctaaattgggttctaatttggccagttcctataaaacacaggagtagcagcactagtctactctgtgtatgtaggttacttttattaaaataactctatttttgagaaattggcaagatttgggtaccctactttttccctccattgaattagaaatgattcaaagtagaatctagaatgtagaactggcatctcactttattgctagtgctgctaagcatccagcagataactacctcttactgtcatcactttatcctttcaatcccacccctacccctgccaccaatagtgtttggtaatgatgtacagccaactttgaacataaattaagccgaaagaaactgagcttgtaggcattccaaaattgtgttcaaatctcacagtccaacagcttgttaatgtttttcatgcttgcttcatcttactcatatataaaacagtattttggattgtcattaaccccttgtggaataggaatgtaacatgctcttaactgtatggcttcttgtttgatgcatgtgtctttgtaacatttttctgttgtaaatacagtgagctctttggagtctcaaatcatttatcatgtgcacgaatagcacatcaattggggaggaaattaagatgatgaatagatagaaaattattaatagctgtatcttaaaacttgtgtttcctacttacatagattttatttaaaagaagtggaaacactttatggaaataatagaaacctttcctctagggatctgattattttgggagaattttaaatagttattttggttattcttgctatatgtattctgagaaatctttcttgatacagaatatgcaagcatttggtgtagcaaaggggatttgatttggaatggggaaataagggaaagagatagcatgagagagtcaggctgtaaagtccttaaaaaagtaaagtaaaggttctcaatggacagtttaacaaaacttaggatttcaatgttcctggtgattctaatacattagtggtggtggcagtggcggcggtggtggtggtgattgtaggaggaccttactatctaacctactcatctaggacagaatgatctgttaactaattgctgttacttgcacatactttcattaagtgtgaatatttcagtcatgaatattctgttctaagtaatttctgtcaaagatagagtctgaaaatgaaaattttggactattccatggatcattacagtttacttctaaagcacttttaaagtgcttccagaaagcattctattaggtatttttgtattgggacttaagatgtgacagagcacttgtagtgacctggctcctacagtagtctgtttactcataggagcttgaaatttgtacacttgactgctctgtgtaatttcaatatttgttgttgcttctgataaagctaaaataaccatgtggatattatagaggccagtgaggaattccaccatggagactgcaaactgaccagaaagtgcttttaagaaatctttagtagtgagtttaaacaacaaacatatctagaattcacagagtaaaatgagcaggataaaggtatacatttgacatttcattttagcttgagagactgtagggaaaaaagggtcatcctctacataagcttccagagctgcttgctacccagcctcctagagtcattgctgggtacagtttgatttaccttcttcactttatttagaatttgtactcaaccaccatcaccaccatcacctttccctctcattgccttctctccagccttcactacagaccattcctggattggtttaaacaggcaactaaccttgccattatgattaaatgtttgtcatggatttagcccgtgtttggtgacaaatgccttatatctattgagacttctcaaagactctggatattctccattatgtctgaccttaaagtattgagcttggcatttagtaacaggattcatagatatttaaagataacttgaggacttgagacatatattttcttagtcttttctaccttttccttttctagcaaggcagcagaatagttccagtgattgtcttttggtaaaaaccattttgtgtcttatgttatttcattgttcttattttatttcattctaggtccaagggcagccattaatggtgcaggtcagtggaggccagctaatcacatcaactggccaacccatcatggtccaggctgtccctggtggacaaggtcaaaccatcatgcaagtacctgtttctggaacacagggtttgcagcaagtgagtaatatttaaaaatattgagcagtatatcagaggagaggtttcaaagaatagattattacaacctgtttgataattgatattgcatttaactgcttcctaacccacattttgcattcagttgattttctgcctttatagtaccagtgatataaactagaactatgcagaaattggacagctccagtaatgactaagatattaggcatgatcttgaattgctgtaaagtatatgaagaggttagaatctagtttatagtatattttattttaaaagaaacaaaaatgagtatttagaaagttagaaaaataacaaaacgagcaaaaagtgggtccaaattaattaagtagaaaactgacgtatagaaaggataaataaaatctagattgtttaagcagaccaataaaacaggtaaatccagttgaaacactgattgagaaacagaaaacaaaagtaagcaaagatgtagaagagattaaaggaaggccaggcgcagtggctcatgcctgtgatcccagcacttggggaggccaaggcaggtggatcacttgaggccaggagttcaagaccagcctggccaacatgacaaaaccccatctctactaaaaataaaaaattagccgggcgtggtggcacgcacctgtaatcccagctacttggggggttgaggcataagatatcttgaacccaggaggcggaggttgcagtaagccaagattgtgccactgcactccaggctgggcaccagagcaagattctgtctcaaaaaaaaagaagagattaacagaaatatgtagaaatgttacatacaactctgtggcatcatattttaaaattagatatttctcatcgagatggcaaaaaaaaacaaaaagtcattatatccactgttaggatggatgtggagaaaaagaattaatcattatttttggtaatttaaaactgtagagttattttggaaaggcacctcactatctgttaaatacaatgaatatttgagctagcagtcccacttctgagaatctgtcctataggaagaaaagcatcaatagtagggggaaattacaaagacacttttcatagcattgtactagcaaaaaataaaattgcaatctgagtgtccattaataagaataaggaaatggttggaataaatcataatatattcatagggaatattgcatcatcattaaaagaaatgaactgttgacttggggtgggttaatattgaaatatttttagtggaaataatttgcagagaaatagtgtgtgatctcatctttgtaattcataaccaaccccccatgagtatatgtttatagtcatggaaaagagagtatgagataactattagttactctatctaaatgtttatattgtttcaacagttacagcagtcatattaatgtcttagttttctggaggaatttaagttgaaaaaagcagccatgatcccactgctcataaatcaaacttgtactttttgtgtattcttttgtgtttttatgcataatttttgggcataattgtaccatgcatgtggggttgtgttttcattttttttttttaattctttcataatgttcagtcaacttgatgaatcagaatttctaatttataaaatatagttaaggattttggttttcatttgcctttgtaggtaaacatttgggcacgatagttttatttttcaactgaattctcaggataatttctttggattggggattgcttgggtaaagggtaagagtatatttgagcccactggcatatttttgccaagatagaattgtacttgggattaaaaatagttttcacatttctctttgcataaatatatgaggctttaaatatcttttcagcatgtgctttccttgattccctattgctatatcctttctgttcttctctctttgcttcctctccagtcccccttgctgcgccttctccactgttgagtagagacaatgtggtatagttaggaacagtatactgtgagtgtagtggtccaagctttcattaccaggtctgccattaaataagcattctgatcttggccaagttatttaattgtcggtttgctcatccaaaaataaaatttatatgagatgatatctagggttcattctagctctaaattctgtgatttttatggggttttattttgctataaggaaccttcaaatagttatttccctgcttccaagtagggctataactaaccaagctgaaaaaaatatattctgttacgtaaataaagctctctaggtgagattccatagcctcccttacaatacttaaggctttaatcccctttgtataggagttttttttctcattagtgttgagtagccattttttaaagaagactacttcttaaccttttttgaattgtattctctattttagaatcctagtaaagcttgcaccctctaagaaaaagtagagatgtccagtctcatgaaaaattctgcatataattttagattaaaatccttggcctgagaaagatactggaaccagagagacagccaagaaatagatagaagaatattggaagttggcatataataaaagtggtataaacatatcaatgaagaaatggctgaagaatgatacagaaaagaaactgatttctaattcatactgtattttaaaaaatatttgctaggtggattaaagatctaaatgtagaaaagtaaacttggaaaattcaaaagaaaatataagaatttttatgctatagagaaggatatttttaaaaacaaattgactaaaacataatatgcattgaaatacatcaaataaaagtaaacaaggtgaaaacttggaaaagatatttttaatacatacaaccgagtttgtattcagaatatgtataaataacgtttatgtatttatacaaaaataggaaaatgggcgaagaatatgaatagatggaagaggaaatcctaacagccaatataaacttagaaatgaagttggttcacataaccagataaatttgtttacttatttatttgccaatactttctgaatgccaattatgagctgagtatttggaaaaaataattcagaagacctaggcaatctatcccctaacaaagtaggatccatgaatgtctctaagacatggaacccattgacctgtttttttcaccttccttccatcagtagtcctttttcctatcagctggtagactttgtgataacttaaggttctaggcatgttcttctttccagaccaaggtggtcccaagttgaaattatggatggaaagtgacctggctataaaaatctatctttctgaaagtatcctccttccagactgccatctatgttgaagcaatgctcaaataaaaaaagtttgttgatggaattaatggtcaaagaagcaaagagaaggttacttagtactagccatgtattctggcttttaagtttgggaggtattcttgaatataaaatacaagacattttgagctatggggctctcctcactgctttctcttttgcacttaaaaaaaaaagtgttcactagttatatgaaaataggattttgtacacccaacatttaaagggttgtattgcagttttttagttccaaaatttagagaaatatttttcaagcttcttgtcaggtttctgataacactcctaataaagtggctatagccattaaaaaaaagaaagaagatagatttggatagcacacgatcccttgctttccataattgctttataaggtttagctatccaatcctaggaccaaataggagatacaaattaaatcaacaaaaatttgacaaacattaatgacagtagtgagtattggtaattggaaactaataggaggaatataatctgtcacattgccttaattatctattaccatataacaaattatcctagaagttagcagcttaaaacaacaaacatttggccggtgcggtggcccacacctgtaatcccagcactttgggtggccgaggcgggtggatcacaaggtcaggagatcgagaccatcctggttaacacagtgaaaccccgtctctactaaaaagacaaaaaaaaaattaagccaggcgtgatggcggacgcctgtagtcccagctactcgggaggctgaggcaggagaatggcatgaacccaggaggcggagcttgcagtgagccaagatcacaccactgcactccagcctgagccacagagcgacactccgtctccaaaaaaaaaaaaaaaaaaaaaatttattttatagtttctgtgagttaggaatcctgacacagctgtgttggattctttcaaggtcctctcaaggcccttatcaaggtgttgtcctgggctgcagtcacatttgactagagtagaatacattttgggttttttctttgtttgtttttttgagacagttactcgctctgttgcctaggctggaatgcagtggtgcggatcttggctcactgcaacctctgcctcccaggctcaaatgatcctcccacctcagttccccaagtagctgggaccacaggcatgtcctaccatgcctggataatttttgtatttttcagtagatacagggttttgccatgttgcccaggctggtctcgaactcctgacctaatctgctcgcctcagcctcctgaagtgctgggattatgggcataagccattgtacccggctttcagcatttttaatatatatagtatttcctctgtaaaaaagtacttcatcattcaccaaaatggcaagattaaaaaataataataaagcactttagagtgtattttatttttttatttttttgagacggaatctcgctctgtcgcccaggctggagtgcagtggcgtgatctcggctcactgcaacctccgcctccggttcaagtgattttccggcctcagtctcccaagtagctgggattacaggcatgcaccaccatgcccggctaatctttgtatttttagtagagacagggtttcatcatgttggccaggctggtctcgaactcctgacctcaagtgatccacccacctcggccttccaaagtgcaaggattacaggcgtgagccaccacacccagcccagagtgtattttaaatatgcatgcttttcaatatatataatcataccactgctatctttcataaaaaccgacattgatttgttaatatcaggtatccagacagtgtcgaaattccctatttgtttcataaatggaaaataagttgtgtctacttcataatggagggcagagcaggacttcttttttcctcttcagaacattttctgctttctagagaaatgtggataactctcggggaccaaaggagaccagtgtcagtagagtacaatcctttttttatgttcttttctgcagatacagttggtcccacctggacagatccagatccagggtggacaggctgtgcaggtgcagggccagcagggccagacccagcagatcatcatccagcagccccagacggctgtcactgctggccagactcaggtaattccactagctctgtcacacaggagcaaaactgatttggaagagtcagataactgagtcagatatttcatgtatagcatgtatagtagaaaaggggatgaaaaccataaaaaaatatatttttggccgggcgcggtggctcatgcctgtaatcccagcactttgagaggccgaggcaagctgatcacaaggtcaagagatcaagaacatcctggccaacatggtgaagccccgtcaaaatacaaaaattaggtgggcatggtggcgcatgcctgtaatcccagctactcgggaggctgaggcagagaatcgcttgaacccaggaggcggaggttgcagtgagctgagattgcgccactgcactgcactccagcctggcgacagagtgagactctgtctcaaaaaaataatttttttttttaaggactacatcgttctttgttagtatctttgggatctgttgaattgtgtcattacttatttcctccagacacagcagcagattgctgtccagggacagcaagtggcacagactgctgaagggcagaccatcgtctatcaaccagttaatgcagatggcaccattctccagcaaggtaagtgtacccataagcttccctaggactttttggggcaacttttttgtcccttagacaactgacatctttagaatttgagtggtgaacttgacactacatattttttggacaaaaaaaaaaaagatttcctctagctctccattgattgttggtttcttgtcaccatctgtgaccaacagtgattccatgtgtagcagtttctatagtggttgctaatctagggattgtgtaagcttttagggaagaagtgtttctaaacagaagaatagaaatagggagttcattggtaaagagagaaatagatcaaaaatcaagttggctttagagtgctattgctgcttatgtttttttctgggtcattccattactttaaatgactattatgtatacagcacttttactaagaagggtcctcaaagagcctctagtctagtaagaaagacgtgaacaaataaatacaatgcagggccctcatggaagtatgttctaggaatagataacataaataatagatgtttggtctgggaggaggagtgcagaaactgaacttgaaggcttttggaagcacctgttagtcaaatagttaaatcaaaaaaggacatctttgttagattccatgactttgtgattgcaaatttgcaatatacaggatccagagagtgcactaactgtgtgctcttgtattactccagggaggccctgaactggattgagcccaggcaagagctcaaacagaatggtgaacaaatcctcaagtgctgctattgatagtctggggacttggaatgcttggtttaattttaagttttaatactacaactgactcattgtcagtttgagataaacaaagtataagttttaaaatctctgtcctgaagcagattgctcattatgtacaagagcagtaggtatagctgtagtcagactgacctgtagaagaggaggcctccaaaccttttcaccttttgaaaactgctaaggatagagttactcaaaactgggacctagacagttaatagaatttcaaagattgtgattacttagattatatatagcacaccacagtgggagagtactttttctccccttgtgtttttcagtgtgttttgccaggatcggtgagtgtataccagatagaagagggactaactatgttcccttctttctgttctgtgtgcctgttttttgtttgttttatgttttgttttcttaaagttacagtccctgtttcaggcatgatcactatcccagcagccagtttggcaggagcacagattgttcaaacaggagccaataccaacacaaccagcagtgggcaagggactgtcactgtgacactaccagtggcaggcaatgtggtcaattcaggagggatggtcatggtaagaaaatgtatttttcagctttgtctttgaaattttcttgaacatgcaacttgatgcctcctaaaatttattatgttgacctcttgggattgagatcgatccttaaggcactgtcggtaatctactttgacaataacattatgacaaaccataattcattctgagcacctactatgtgccagggactattcaccagggactattctagatgctggagataaagcaatggataaatagtgattttatggaattcttttcagaattcaaataacgaagggaattatatactaatctttgagaagtggaaagtagtattgcccatgatggacaaaataagaaataagctaaaaattagaaagattgtaattgatagagaaaccaaaaaaaaagtgtcatgtaaatgtattgggaagataggaagatttgggtggtgtaactgaaagctaaatcctcatatgtcaaaataggatgttaaaatgcataaattaagaatgagtaacagaagtctgcacagaggtggaggaagctatgaaaagaaacagaaccaaccctggctcagtggcatgcacctgtagtcctagctacttgggaggctaatccaggaggatggcttaagtccaggagtttgagctcagcctgggcaatgtagagagacctcgtttctacgaattgaatgaaaaataaataatttttataaaagattcaatacagttattcaaagcggttgtatttgggaaagagctgtggggtacaggactctgttacttgtttttacctacatttagtacagtgttttggtgttttttaagaaaaattaggattgaattataagttaactattatttttataaatataggcatttagtagcacttggtctatctatttttgtgctgtttttttgtcttatgactactgttcctgaccattagatggcagcagaaatatctagagccatgggtggacatgaattagggcatggttatatagtttctcagagtggcacctgaatctcctatgacacagtcatctggggtgtttgtttaaagtgcagatctttagtataaatttctccagggatccgcatttacccaagtaccctataaaaattactttttgtggcatttacaaaaaaaatggatgaagaggaaccaagaaactgtttctatgtccatacttcatgccaccaataagctctggtttcctgttcacacagatggttcctggggctggctctgtgcctgctatccaaagaatccctctacctggagcagagatgcttgaagaagagcctctctacgtgaatgccaaacaataccaccgtattcttaagaggaggcaagcccgagctaaactagaggcagaagggaaaattccaaaggagagaagggtatgtataacattgggaaggatataggaaaggagaatagcagggttctacttttgaaattatcttttatatggcttgttttctcacgtaccttccaaacaattgacgttagatacttgttgtctcttttgtaagagttagcatttgttattactaatatgcagctgcagttataataacgaaaacaaacagtggcttaaataagatgttattccttttcatacataaaagtagtccagagataaattatcctggactggtagcacattttcacagttctcaagacctgtttcactgctttaatattgctagtgtgctgttcatggtccaagattcctgcttaggctccagcctaggaagaaagggaacaagaaaggtaccctttcttttttttttttttcctgagactcagtcttgctctgtcatccaggccggagtgcagtggcacaatctcagctcactgcaacctgcaccttccatgttcaagtgattctcctgcctcagcctcctgagtagctgggattacaggtgtgcgccaccacgcccagcttatttttgtgtttttagtagagacggggtttcaccatgttggccaggctggtctcgaactcctgacctcaggtgatccacctgcctgggcctcccaaagtgccgggattataggcgtgagccaccatacccggccaggtaccctttctttcaaggaaactttgaagaagttgtgtaccttccactagccggaatttagttacctgatcacacctaacatgcagataaggctaggaaagtccagcctggtgtggtggcaaatgcctgtagtcctacttggaaggcagaggcaggaggatcacatgagccgaggaattcaaggctgcagtgattcatgatcatgccactgcagtccaacagcaagggtgtcagagtgaaaccctgtttctagaaaataataataataaactttaatgctaggaaagtctttttactgaacactcatttgctcaaacgaaatttggcctgttattaaagcagaggaaagtgtatatattgtgaagtgtaggtggtagtctgttattttttttaaaaaaaattcatactataagcattcacagtcttacagtagttatatatggttagctatattacttactaggtgttttctccaaagcttccatcgtcattctaagtcataattgtcccttgtgactttgatcccagctgtcttaaactttggagaatggaatttgtgcactagataactgtgctggttctggatagtattaatagttaaatggttttatttctcgttttagaaatacctgcatgagtctcggcaccgtcatgccatggcacggaagcgtggtgaaggtggacgatttttctctccaaaggaaaaggatagtccccatatgcaggtaggaagacatatacattttattcttctctttattaccttgtattgacttgagttgaagccttcagcagtgtcctcttgctattttcctactctgggactactcacattctctaaactggatgcaatcttatgtctctttagattatcttttatcttaaaaccactaggccagacttggtggctcatgcctgtaatcccaacactttgggaggctgaggtgggaagcccaggatttcaagaccagcctgggcaacatggcaaaactccatctctacaaaaaaatacaaaaactagccaggcctggtgatgcatgcctgtagtcccagctacttggagggttgagatgctcttcgtctttgtcacttattactattcattctttcttgaaaatcacacttttcttaattttcaaggaacaagttttatttttattgaacaggttttattaccccatcacaaatataatttgaatgtttacttttttcccttctaactgatgtgagcctggtctaatcctctcttctttggcttagatttataaaatagctgcttaatttggtttcccttcttccacttttgttcccctctagcctactctccacatcctagtgtgatctttttaaaatgtttatcctatcaagtccctgttctgctcaagctccttcaacccctaccctttcccatttgcacttagactgacatccaaagtgcttactactatgcccagcaaagccttacatgctccagctcctgtctacctctaactgcatttctacttcttggtctctatgctgctgtttactgttcattggtctacttcctgccacgggtctttgtccttagaattttcagtctgtatgccctttatctttttcatgcatgtctatctccctatctgttaggtctgggtttaattaaataccctatctagaatagatctcttctctctcagtatgttcttacaacatcttttctttttttggaggcagtggtgtgattatggctcactttagtcttgacctcccagctcaagtgatcctcccactttaggctcccgagtagctgggactatagccacgcaccaccatgcccagctaatttttaaattttttgtagaaatggagtctcactttgttgcccaggcaggtctcaaactcctaggctcaagcgatcctctcgccttggcctcccaaagtgctaggattacaggcgcacaccattgcacttggcccttttctttacagtgtaataatatttaagttgttgaatttttcaagattgtttccttcactagactgtaagttgtatagagggtagaggattgtttcgttctctgttatatttattggacttaattctatttaagtaagttgtatttaagtactgacttagatgtatttgttgggtttagtatccagttctgaaccaagcaatcagtgtttcttgaattaatagattcctcccatttgctgatactccattctatattaacatcacattccacttgcactattgcaatatccatcaaattaatctccagtctcctctaattggccttatatagtacttatacagtacatggttaaagtgttttttttaacctgccagtccccaggtcaaggatgcatgctattaatagttctcatttcttaactgcatcaaatctcaaactatttctgtataacatctaagcaactttgccttatcaccccctcaacaatcaaactaggtttcctcagtgtccccacacatgaacactaacaactctttcagtgctattaatcctcacctgtagtgtgagagcccctcctttctcattgctattcattcataacggtgtatgaatgtgggcctgacagctattgtggcaggagggcattgtgccaggaactctcctcattctgtgtgctaacaatatgatcttggtcaattcagcctcttttatttttatctgtaaagtggaatactgttgatacttcacagcaatgttgtagggatt

SEQ ID NO: 15887 - DNA, 25512 bp, Human; identical to SEQ ID NO: 15886

SEQ ID NO: 15888 - DNA, 41772 bp, Human
agacactcttctcagacttctgctcccagacatcagaactccaggccctccaccttgagacttgaagatttcacaacttggactgagccagctaccagcattccagggtctcctgcttgcagatggcctgtcatgggtcttttcagtctccataatttcctgagccaattccctaataaatctcctcatagatctgtatctatatctatctgttatctatcctattggttctgtctctggagaaccctaacacagggactgaataaataaacaggtaaatgactttgataccttacaattattattaaatgtagtggagttttacaaagaaacaaaacttgtacccacaattaataaacattcacagagtattttgactttttcttaaaaaaaaaaaccctggaaaatcatctgctttccaaattaatgatatctacgacaatctaaatggaatgtaaatcaatacacttatgaggttttgttttgtttttgtaaaaaggccttgctctgtcgcccaggctggagtgcagtagtgcaatcagggctcacttcaagcttgaccttccaggcccaagtgatcctcccacctcagcctttcaagtagctgagactacaggcatgtgccaccatgccaggctaatttttttcatttttgtagagatgaggattctccttatgctgcccagactggtccggaactcctgggctcaagtgatcctcttgcctctgattcccaaagtgctggcattacaggcatgagccaccacgcccagtgtgtgtgtgtgtgtgtgtgtgtgtgtttgtgtgtgtgtctccgtgtgcgctcgggtgatcctcccgcctcggcctcccaaagcgctgggattacaggcatgagacactgcgcccggccaatacactcatgattttaattataatatttatgccaatgaaaacactagcaaaaaggtaaaacagctgccaatttaatgtgaccacttagtctaaacaggctagtagaaatgaagaacttttaacctgcaaatgcaacaaaaagccagaaatgaatgggaagacattatgatctccagaaaagtttggctaaattttccccagcccattgtcttagcggggtagggaattgcagacagcccttaaatactgtcatttttggttgagaactcatgtggaaagtcctcaaagccaaattccaactcctgttttactgttttttaccctcgagcttgctgagttgtcttggctctcctggaaaatacatggctcaaaaaataaaatagaagttttagcggtgtgaatctagtagtcgactacagggggtattaaaaataaacactccatcccggttaacacgtgaaaccgcgtcgctactaaaaatacaaaaaaaattagccgggcgtggtggcgggtgcctgtagtcccagctacttgggaggctgaggcaggagaatggcatgaacccgggaggcggagcttgcagtgagccgagatcatgccactgcactcaagcctgggcgacagtgcgagactccgtctcaaaataaataaataaattaattaattaattaaaaaattaaaaccaccaccagagcaaaaacttacagcgcttacaataccttccacgtgctgttttattttacataaaaccatgacgattaaaaagctggcctctcagctttccgggtattggtttgttttccccctaaactgtcgtttttataggcacttgcactgtcttcttagcagaattgccaatggccttcctcgagtcctacgtttagcgattggcaagaatcatgcactgacagagctcgactccggagggcacaaggaagtagacaacaaagcaggaagaagcaggaggcgcacagatgggcgggatctgcactggaggcggtgcgaccttgcggggcggtgcaagctggcggaacccgcgtgagagaggttggtgttgcgaagggaactagtccggtgcaggacgtggggcttttgcagctcagctggttccggctggggaagatggcggtggctggggcggtgtccggggagccgctggtgcactggtgcacccagcagttgcggaagactttcggcctggatgtcagcgaggagatcattcagtgagaacagttcgggtccaagcggggaaggagctctgggatgtgcactgcctgagcgaaccgggaagcggggaggactgaaaagttaagagagaaatgtgataaaggggctgcagtctgtagtctgtaggcgtcgaattttggcctccacctttgtagtttagtttctggaatagggtgtccggctccacagtctgccggtcgggcttttttcctgggaagacgcccaatctgtaataattagaaatgcaaggctgtcccaggagccagtttcctttctagagagaaggggcaggtcaaactgtatttcctaactttgaaccccttactcttttatttatttattattattgttgttattattgagacggagtctctgtcgcccaggctggcgtgcggtggcgcgatcttggctcactgcaacctccgccttccgggttcaggtgattcacctgcctgagcctcccaagtagctgggattacaggcacgcaccaccacacccggctaatttttaaaaatttttagtagagtcagtgtttcaccatgttggccaggctagtctccagctcctgatctcaagtgatccgcccgcctcgacctcccaaagtgctgggattacaggcatgagccaccgcacccagatatactctgaacattttagtcggcccaatctgagttgtgtcagtagagccaacagggtcagctgtgtcaataggacctagaatttaagtggaagcagcgtggtagagtacaaatagcttctgactctggagtctcaggttctatattctgttgtcgtttacctgttttagaacccaggacaacttaatttttctctctgtaccctggtttcttcatttataagattaatcattagtagagcttatcatgctttatgactcctatgaaatggagatggtgtacatgacttaatatctactttcaactgattgaagaacatttgttgcgctgctgttacacgccaggtgctggggtaacaaagacaagacagttgggttccccttcgttgatgagtgctgaggttggggaaatgaaggggcttgttggagcacaaaataaaggattctcattaagatttgaaaaactcggaaggtttattggaaaggataactttcacccgagaactaaggaatagacagaggtggcggtccaaagtgttcaggcaggggagaaaactacaaaaatgggacttgatcgaagaactgaaagtgttccttcatttgattccttggtcactgatgttgaaacctaaattgctgttctagggcttttgtaggaagtaagatgagtttctgagtttcggagaaaatagacttttggcaaggagacagttcaagtaggttattttaatggatttttttgaggccctaggagatggctcaagcccttattcccagcactttgggaggtagaggtgggaggattgcttgagactgggagttggagaccaccctgggcaacatagtgagaccctgtctctacagaaataaaaaaagtaaacaacaagataaaggattttttttaacactagaatagacaacaaaacaaaacagcgaaatcttatggtttggctttacccttgcttgaacgcagtcagattaagtatttagtagttttcaaacattttttaaagcagtggaatgctatcaaatgaaataatgaaactttgcaatatataaaacagaaaagtgttttttacgaatataagttcaaaattttcacttttttttttttttttttttgagacagattctgttgcccaggctggagtgcagtggtgcgatctcagctcgctgcaacctccgcctcccacgttcaagcgattctctttcctcagcccgagcagctgggattacaggcgcgcaccaccatgcctggctaatttttgtattcttactagagatggggtttcaccatgttgaccagggtggtctcgaactcctgacctcagatgatccaaccgcctcagcctcccaaagtgctgggattacaggcatgagccaccacgcctggcccaattttcacatatttattgtaaatatgtgtaatatattaaatatcaaatatattaaatattaaatatatcaaatattatattaaatatattaaatattaaatatatcaaatattatattaaatatattaaatatgtgtattatattaaatacagtattaaaaaaaaaagattgaggtggccaggcgcagtggttcatgtgtgtaatctaagcactttgggaggccgaggcagatggatcatttgaggtcaggaatttcagaccagcctggccaacatggcgaaacccccactctactaaaaatacaaaacttagtcgggtgtggtggagcgtgcaggtcatctcagttactcggaaggctgaggcaggagaatcccttgaaccgcggggcagaggttgcagtgagctgataccgcaccactgcactccatcctgggtgacagagtgagacctcgtctcaaaaaaaaaaaggaaaaaagaaagattgaggctatttttgataaattaacaatttgaaatagggtaagaatgataggtgtagtcttctcagtctagaatccagttgtattttgtttggattacacagtatcaagaaaatgcgttctcaggccaggcgtggtggctcacgcctgtaatcctagcactttaggaggccaaggcaggtggaccacctgaggtcaggagttcgagaccagcctggccaacatggtgaaaccccgtctctactaaaaatacaaaaaaaaattagccaggtatggtgacgggcacctgtaatcccagctactcgggaggctgaggcaggagaatcgcttgaacccaggaggcagaggttgcagtgagccaatatctcaccactgcactccagcctgggcgacagagcgagactccgtctcaaaaaaaaaaaaaaattatattccgcctgggaaggaggtcagtgcccgtcggcatgtattacgctaagatactatttgaagcatttgttaggtattcactagtattccacaacaggctattatgccatgatgaaagcatttgctgtgccttgcctggcatttaattgagaattacccaggtgtatgtactacagtaatgtactaacttgaacaattttatatgagtggactgaatttttgaaatagcacagagctattaacttttttttttttcttttttgagacggagtctcactctgtcgcccaggctggagtgcagtggcaggatctcggctcactgcaacctccacctcccaggttcaagcaattctcctgcctcagcctccccagtagcttggactacaggcgcgtgacaccatgcccagctaatttttgtatttttagtggagatgggattccaccaggttggccaggatggtctcggtctcctgacctcgtggtctgcccgcctcagcctcccaaagtgctgggattacaggtgtgagccactgcacccggccttaactttctaattagtgatacatttataagacataaatagctatccacagagttaacaaaataaactttggtccacaatctggatgagttcatattattttgataagatttggtatataacatatttggatgaatgttgttctttattataccttgttaagtagttaaaatgacatttattcaaatggttctgaaactctcttccctggttgtttgaaaaatactccagggttggccaggtgcagtggctcaacctgtaatcccagcactttgggaggctgaggtgggttgatcacttgaggtcaggagttcaagaccagcctgcccaacatggcaaaaccttgtctctactaaaaattcaaaaaattagccgggcgcagtggtgcacgcctgcaatcccagctactcaggaggctgaggcaggagaatttcttgaacctaggagccagaggttgcagtgagccaagatagcaccactgcactccagcctgggtgacagagtgagactctgtctcaaaaaaaaaaaaaaaaaaaaaaaagccaggtgcagcggctcagcctgtaattccagcactttggaaggctgaggcgggcaaatcacttgaggtcaggacttcgagaccagcctggccaacatagtgaaaccccgtctctactaaaaaaaagcaaaaacaaaacaaaacaaaacaaaaattagccgggtgtggttgtgcacgcctgtaatcccagctactcaggaggctgaggtaggagaatcgcttgaacctgggagatggagtttgcagtgagctgagatcgcaccactgcactccagcctgggagactaaatgagactctgtctgaaaaaacaaaaaaaccctccagggttaaatgatcccttgggattccttacagttttgcaagtctttgatagcagttaatcttttggtggggactggtaagtttggggatcaagatgattaaaatgtgtaagtcctgaaaaaccattgtcttttctaatccatagtaattagaagatgcctgtttttggggggtgtgtgtatgtgtgtgtgtatttttagtagagacggtttcaccatgttggccaagctggtctctaactcctgacctcaggtgatccacccgcctcagcctcccaaagtgctgggagccatcatgccccaccgtttttgcttgtttgagacagagtctcattctgttgctcaggctggaatgtagtggtgcaatcatggctctgcagccttcacctctgagactcaaaggatccttccacctcagcctcccaagtagctaggactacaggaacatgcctccatgcctggctaattttaatttttcttctagagacaaggtctccctatgttgcccaggctggtctcaaactcctgggcccaagtgatcctccagcttcagcctcccaaattgttgggattacaggcatgggctcccgaacccagacagaatattctcttagtgaggcccaaaggcacaaatttgtttacctctagagcataattctgcaattccaccattacactgtgaaaagaatgcaatacatacgataccaatcataggacaatttcataatttttaaaaagttaaaggatatagcactatggtaataatttttcttgcattccatatcattgtgtctgaattacagtttctgtgctgttttcagtgtcttgtatgttaattttttttttttttttttttgagaggaagtctcacttgcccaggctggagtgcagtggcacgatctcagctcactgcaagctctgtctcctgggttcacaccattctcctgcctcagcctcccgagtagctgggactacaggcgcctgctaccatacccgcctaatttttttttgttttttttttttagtagagacagggtttcaccgtgttagccaggatggtctcgatctcctgacctggtgatccgcccgcctcggcctcccaaagtgctgggattacaggtgtgagccaccgcgcccggccgcttatgtgttaatttataagtaatttttatcacttctttctcttgtaatgataagatgttcactgtagaaaactaaaaaaatcagaaaaggataaaaaagtaaactaaaattaccataatactacaacccagaaataagcactgtttctttctcttttttcccatatatattataatgtaatacattttaaaaacgtatttattgtaggaaaaaagaaaataaaaataaaactacctttaattccatcactcactagtaatcgttttggtgtataacgttgtttttttcctacacataagtgtatgtatgtatacattcataccagttaggatcgtatcgtatttctagcacctagcatagtacttggctcaaagtaaacactctaatagattaatgaatggtttttactacctagatctctgttaagattactgagaaacagtgtaagttagtcttgtttcaacaacttatatctttgcctcctgaggtacgttttgtcaattgagagtgctgaagagatacgagaatatgttactgatctcctccagggaaatgaaggcaaaaaaggtcaattcatagaagaacttataaccaaatggcaaaagaatgatcaggagttgatttcggatcctttgcagcagtgcttcaaaaaagatggtaagttaatgtaattatgcaaatgttgaaatattggtaagtgggcaggcttaaagaattattattattatttttttttttgccatcttgtgtttcttcacagctaacttaaacagaatcatatgtatacatatttttagttcggttctactcaatccgtaatgaatattgctctagttctttttcaacttagaaaatatcacaaaaaggccgggcgtggtggctcacgcctgtaatcccagcactttgggaggctgaggtgggcggatcacgtggtcaggagatcgagaccatcgtggctaacacggtgaaaccccatctctactaaaaatacaaaaagttagccaggcatggaggcaggcgcctgtagtcccagctactcaggaggctgaggcaggagaatggcgtgaacctgggaggtggagcttgcagtgagctgagatagcaccactgcactccagcctgggcgacagagcgagactccatctcaaaaaaaaaaaaaaaaaaggaaaatatcacaaaaaaatgtgtgtttacagacacaaatgtggcttcagaataatttgaaaaatttatacataaagaaacatttttcagtcgtgcatacctggatgtaagtaaagtgttgattgactatagtatgaatagcatttagagataactgcttaaatagtacaaaagataagcaccaaactaaataatctaagttattatgcaatctacaatatcagaattttgtttgttttgagacatggtctcactttcattgcccaggctggagtgatgtggcttgatcctagctcactgcagcctctgcttcctgggctcagatgattctcccacctcagcctcctgagtagctgggactacaggcgtgtgttaccacacctggctaatttttgtatttttttctagagatagggtctcactctgttgtccagggtgctctcaaactccttggttcaaacggtccacctgtctcggcctctcaaagtgctgggattatgcatgtgagccactaagcctgattttagaatatcagattttaatttaacttcttagtcccagccacttgtttgacttctttttcattgactgcactcttggaaatgatgatttaaatttaattctggtttgacaggaaaagataattaaaaatcttcctgatgatatcttgactctaaatattaagcatcaccttagtttattagctatattagttcaccaggaatcctcttatcaatctgtgtgtgtgtgtatttttttttttctatctttaaagaaattttagatgggcagaaatcaggcgaccatctaaagcggggtaggaagaaagggagaaacagacaggaagttcctgcatttactgaacctgacacgactgcagaggttaaaacaccttttgatttggccaaggtgagtgcttatagattgaagctttttctgactattggagaagaggaagtgactaatacatttcagagagcaaagtgtacaaattggtctagaatggcaatttttcaacaaatgcatgaattttaggtagaaaaagttacatatactcctttctatatggtagattttttgtttggcaacctgattagtattataaagacatctttgcttttttttttttttttccccaagacagagtcttgctctgtttccagtctggagtgcagtggtgcgatctctgctcattgcaacctccgcttcctgggttcaagtgattctcctgcatcagtctcccgaatagctgggactacaggcatgcgccaccatacccagctaattttcttttttttttttgagacagagtctcactctgtcgcccaggctggaatgcagtggtgtaatctcagctcaccacaacctctgcctcctgggttcaagcgattctcctgcctcagcctcccaagtagctgggactgcatgcgcacactgccacgcccagctaatttttcgtattttagtagagatggggtttcaccgagttgcccaagctggtcttgaactgctgagctcaggcaatccacccaccttggcctcccaaagtgctaggattacaggcgtgagccaccgcgcccagccctgtttttgaactttaaattaatggagctaaatagtgtgtactcttgtatctagctgcttttttttttttttttttttgagacggagtcttgctctgtcacccaggctggagtgcagtggcgcaatcttggcccactgcaacctctgcctccctggttcaaacgattctcctgcctcagtctcccaagtagctgtgattacaggcacacatgctaccacacccagctaatttttgtatttttagtagagatggggtttcaccatgttggccaggctggtcttgaactcctgacctcaagcaatctgcctgccttggcttctcaaagtgctgggattacaggcatgagcaactgtgcccagccagtgtctagcttctttcaatttatgagattcatctctactctgggcagctatactttctcattctcattgctacacagaattgtattaagtgaacacatcacaatttatccattctattatttggatagtttccaattccaatgcaacagtgaacattcttgtatgtatttttggtgaacatatttacacatttctgtttagtatatatctaggagttgaattgctgtgtcatagaacatgcatatgttcaacttcagttgatatgagtttgcagtcctgccagcagtgtatgagaggtctaattcttttgtatctttgctaacacttcatattttctctttttcagtttagccattctggttggtatttagtggtattgcattttgttttcgtttttgcattattttgacgactaatgaaattgagcactttttcatatgcctgttagtcattaggatatcttttgttatgaagttcttattaggttttttttgccctttttttgtttgagataggatctcgctctgttgcccagtggcgtcaactcgactaactgcaacctccaccttctgtttttctattgtattatctgtccttttcttagtggtttctgattaagtcaactttatatttatttttcctattttattgatggcccatatttccaaatctgtgaatatcatctgcttttagaggcattcttgtttcttatgatctccaatttagctgtgcttaaagatgtcatataaacagatttaactgctacatttaccctccactagctatagtaatgggctgaaagctactagcagaaaagacaaggtaattatcagctagtttttctagagtataacctttcctcagaaccttgattataactaatttgtatttcttcctttcactgccttctttcttggttcttggatagtatataagttgttactgaacagaacggagcattttctcccttgactttttacattgtcattaattatttgatgttattttgatgtctttgtacgataggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtaaattatttcttttctattttattttactgtgctttgtgttaatacgcagagccagtcagatctcaagtaatttctctttttttgtttttttttggttgagacggagtctcactttgtcgcccaggctggagtgcagtggcacgatctcggctcgctgcaggctctgcctcccgggttcatgccattctcctgcctcagcctcccgagcagctggaactacaggtgcctgccaccacgcccagctaatttttttgtatttttattagagacgggattttacagtgttagccaggatggtctcgatctcctgaccttgtgatccgcccacctcggcctctcaaagttctgggattacaggcgtcagccaccgtgcctggctttctctttttcttagtaaatttcttccctaaaatatccagtgaactcgagtgtcagggatatgattagttagaaacccaaggttaggccaggcacagtggcacacgcctgtagtcccaacactttgggaagccaaggtgggttttgggaggctgaggtgggaggatcacctgagcccaggagtttgagaccagcctgggcaatgtaggaagaccctgtctctacaaaaaaaaaaaaaaaaaaaaaaaaaagtttttaattagctgggctgggtatggtggtgcacacctgtggtagcatttacatgaggggctgaaatgggagcttcacttgatcccaggacgtccaggctgcagtgagacagcgagtccttatctcagaagaaagaaagaaccccaggttatatcctagtactgaggccattaatgagaagggtttgagaacatacattgttgagagatccaagggctaggagccactgtgacagaatcctcagatcattatagcttctatttccaggattccaccttgtcatagctctgctttgtctgagagaatgacctcaagaatgcagtgataatgactcacagaaacccttaatgagctatctagaaagctaattttaccaagttgagctggctgtcagaagcaatgacatttggtgttggtaaaggcatccgttttatattacttcattttctcctcttttctgatggggcccttaattttttcttttttccttttttttttttttttgagacggagtctcactctgtcgcccaggctggagagcagtggcacaatctcggctcactgcaacctctgcctcctgggttcaagcaattctcctgtctcagcctccctagtagctgggacaacagggacacaccaccacgcccagctaattttttgtatttttagtagagacagggtttcaccatattggtcaagctggtctcagaactcctgacctcaggtgatccaaccatctcagcctcccaaagtgctgggattacaggtgtgagccaccgtgcctggtgggacccttaattttttcatatgctcagaataagctgatagacaatggatgacctgaaaaatgtagtgtctaccaataaaaatgtccattaaatggcagtaaatctcctcccatatggagctttctctttagagcaagctcttatagctgctggcaggaactctgtgtgtcattgaggcaactgctaggaagtattgtacagtgttttctcctaggtcccttgaagtaatgtaaagcagattggccttgaagtttgtttgtttgtttgttttttgagatggagtctcactctcttgcccagcctggagtgcagtggctcactgcaacttccgcctcctgggttcaagttcaagtgattctcctgccttagcctcttgagtagctgggattacaggtgcccactaccacgcccagctaatttttgtatttttagtagagacagggtttctctatattgaccacgctcaattgaactcctgacctcaggtgatctacctgcctcggcctcccaaagtgctgggattacaggcatgagccactgcgcctggcccttgtttgttttttagacagagtctcaggccaggcatgctggcttatgtctgtaaccccagcactttggaaggctgagttgggaggatgacttgagcccgggaggtggaggttgcagtgagcagagatggtgccaccgcactccagtctgggtgacaaagccacaccctgctcaaaaaaaaaaagagaaagaaaaagagaaaatatccgtctctctcagagataaatatctctcactgttgagaatactagataacacatgtgtgtctttcccataaaacgcaccccatttctaatcatgaccccaactctgacaagagagttttttataaagagatgtcttattagaaagaaccagaagccaggtatggtggctgatgcctataatcccatagctttcggaggctgaggagggaagactgcttgagcccaggagttcaggaccagcctgggcaacatggcaaaaccccatatctacaaagaagtcccagctcctaagtagctggaactataggcacacaccaccacgccaggctaatttttgcatttttttgttgaaatggggtttggccatgttgcccaggctggtctcgaattcctgcactcaagcaatctgcccacctcagcctcccaaagtgctgggattacagtcatgagccactgtgcccagcctttttttttttttttctaaaccattaagtcattcagggacatgtgcagtgatataagttttttgtttgggtcataaaaaagaaatggaaagagatctggagaaaactcatttgcatttttatattttggtgtgtttggattaaaaaacaccaatagtctcattattttatcatcatctaatgtgtaatttcaggttacttttagatatatcaagaaagcaatataatttaactgttggatcacatgtcttactcttactattttacaggtgtgtactcatgaggaacaagatattttacagcgtgactcaaacaagagccagaaactgctaaagaaactcatgtcaggtagacagcagtcttgtaattggatcactgggatgatgggtaccttgttgcgtctgtggttgtttctcttttctgtatcctggagtgcaagatgcagtttattcactcattctcagtttttttggggggtttttttttgttttgttttgttttgttttgatgtggagtctcactcttatcacccaggctggagagcagtgacgcgatcttggcttactgcaacctccgcctcctgggttcaagtgattctcctgcctcaaactccctagtagctgggattgcaggcgtgtgccaccacgcgtagctaatatttacttttttttttttttttgagatggagtctcgctctgtcacccaggctggagtgtagtggcgctgatctcggctcactacaacctctgccttctgggttcaagcaattctcctgcctcagcctgccaagtagctgggactacaggcacatgccaccatgcctggctaatgttttgtattttttagtagagatggggtttcaccatgttagccaggatggtcttgatctcctgacctcatgatctgcccaccttggcctcccaaagtgctgagattacaggcataagccaccacgcccagccaatatttacatttttttagtaggggtggggttttgccatgttggccaggctggtcttgaactcatgacctcaagtgatctgcctgcctcggcctcccaaagcactgggattacagatgtgacccactgtgcctggcctattcactcattctataagcatctattttttagaaaaattattaagactacataacattgaacagcaaaataaataatagtattacattataatctaaataaaattaatatccatgtgaccatacttgtataaataactgaataagttaataaaatggagaaaggacaacttcttataaaagaattccagttaataaagtacaagaaatgaaaatactagaaaatcacaattagaacactacagtagtaactgccacaagcacgatccaccaatggatactgaaattattggttgaaagtttaagaacaagagatttacaatgtcatgaaagacaagaaaagattgaagaaacgtcacagatcagagtagattaaggatatatatgacgactaattgcagtatagatccagtattagatcctagaatagaaaaatgacattaatgggaaaaaaatgttaaaatccaaatagtctgtctatagtattataccaatattaatttcttagttttgataattgtactatggttttgtaagataagatggtaacattaaaggaagctatgtgaaggttatataggaactctacttattttctaattattttgcatgccttttatgcttgaaacacacctgacaaaaatggttaaggacattttttttttttttgagacggagtttcactctttttgcccaggctggagtgcaatggtgtgatctcggctcaccgcagccttcgcctcccaggttcaagcgattcttctgcctcagcctccccagtaggtgggattacaggcatgcgtcaccaccctgactaattttgtatttttagtagagacagggtttctccatgttggtcaggctggtcttgagctcccgacctcaggtgttccacccacctcagcctcccaaagtgctgggattaaggtgtgagccaccgcgcccggccaacatttttttttttttttctgagacggagttttgctcttgttgcccaggctggagtgcaatggcgcgatctcagctcactgcaacctccgccacttgggttcaagtgattctcctgcttcagcctctcaagtagctgggattacaagcgcatgccaccttgtccagctaatttttttgtatttttagtagagatggggttctcccatgttgactaggctggtctcgaactcctgacctcagatgatctgcccacctcaacctcccaaagtgctgagattacaggcgtgagccaccgcacttggtcagttaaggacattatttttatttatttattatttatttagttagttagttttgagatggagtctcgctctgtcgcccaggctggagtgtggtggcgtgatctcggctcgctgcaagctccatctcccaggttcatgccattctcctgcctcagcctcctgagtagttgagactggcgacgcccgccaccatgcccggctaatttttttgtatttttttagtatagacggtgtttcactgtgttagccaagatggtctcgatctcctgaccttgtgatccacctgccttggcctcccaaagtgctgggattacaggcgcgagccaccgcacccctatttttaattttttttagacggagtctcgctctttcgcccgggctggagtgcagtggcgcaatcttggctgactgcaacctctgcctcctgggttcaagcgattctcctgcctcagcctgccacgtagctgggactacaggcgtgcaccactacgcccagttaaattttgtatttttagtagagatggggtttcaccatgttggttggccatggtggtcttgatctcttgacctcgtgttccacccgcctcggcctcccaaagtgctggaattacaggcatgagccaccgcgcccagcagttaaggacactattaaaaagaaaaacaatatactcattactcactacttacgcaaatatttcattttgttcctaccttggttcatagtagtttttgttttatatcgacagatttgttgggattataatgtagtcatctgtgtaaaaacatttgtttttccattttccaactaattcataattagctgccatcttgctatatattcataattgtttttagtagctaaaaatagtcttttaacttggtttattatagtatgattatttcctaattactggatatttgtttccaaattttaaataatattacaaattgtcacctttattaacatagcttttgatttacttccttgtgataaattgctaagaataatgttactatgtcaaataatgtgtctttttttgacacttgagatgtatttgccagattattttgtcaaaatatataaatagccgggcatggtggctcatgcctgtaatcctagcactttgagaggccgagacgggcggatcacctgaggttgggagtttgagaccagcctgaccaatgtggagaaaccccgtctctaccaaaaacacaaaattagccgtgcatggtggcacatgcctgtaatcccagctactcaggagactgaggctgggaattgcttgaaccccggaggcggaggttgcagtgagccgagattgcaccattgcactccagcctgggcaacgagagtgaaactccatctcaaaaaaaaaaaatcatattaatctatagcaatattagcattgtacccagaatcctgttcactcttgagttttgacatttcaaatttgttttagttgtaaaaggctgtaattttattattttttatttttatttttatttatttatttgttttgagacagagtctctgtcacctaggctggagtgcagtggcgtgatcttggctcactgcaacttctgcctctcaggttcaagcaattctcctgcctcagcctcccaagtagctgggattgcgggcgcctgccaccacacccagctaatttttgcatttatagtagagacagggttttgccatgttggccaggcctcctgacctcaggtgatccacccaccttggcctcccaaaatgctgggattacaggcatgaaccaccgcgctcggcctgtaattttattattaatgaggttgcacatgcctctatgtttttttcaattagattttaaggtaatcattctgagaaaaaatagttctgattgtacgtactttccttgtttgtttgtttgtttttagacggtctctgtcaggctggagtacattggtatgaacacattttactgcagcaattctcctgcctcagcctcccaagtagctggatctacaggcttgtaccaccgtgtctggctaatttttaaattgtttgtacagatgggctctcaccatgttgcccaggctagtcttgaactcctaggctcaagtgatcctcccacctcagcctcccaaagtgctgcaattacaggagtgagccactgcacacagccacctaacccattttggatcttgggtgtatcataatctatggctctcttttctgggatatacaaatttacaatatgctgtcaaagaagaaaacacaaccatggaatcaatgttggctttagagttatactcgagctcagattttgtttctatggtctaatttctttttcttttcttttttttttttttgagatggagtcttgctctgtcgcccaagctggagtgcagtggcacggtctcggctcactgtaagctcagcgtcccaggttcacgccattgtcctgcctcagcctcccaagtagctgggactacaggtgcctgccaccatgcctggctaattttttgtatttttagtggagacagggtttcaccatgttagccaggatggtctcgatctcctgacctcatgatccgcccgcctcagcctcccagagtgctgggattacaggcgtgagccactgcacccggccactggtctaatttctaactgtgtgaactcagtaaatttatagtcatctctgaacttcagttactttatctgtaaaataaagataatacaaactgtcttacagggttattgcgaaaattaaataacatgtatactaagtgactcagcatttagcaggttctcattaaactgaaactgttcattttttctgccccttttgtgaaattttcttttttcttccattatttagtgtttagttttgataatataaacgtatatttaggctggcatagtggatcatgtctggaatcccagtactttgaggtgctgagttgggaggattgcttgaagccaggactttgaaaccagcctgagcaacatagtgagacccgcctctctacaaaaatttaaaaattcagacacaatggcatgtgcctgttgtctcagctattcaggaagctgaggtggaaggatcgcctgagcctaagagtttgagactgcagtgagctatgatcacactactgcactccagactgggcaacagcattagatcctgtcttgaaaaaacgtatatttaaaggtaatattgagcaaatgtcttcttcactgagaaggcatttttatgtcacattcttaaatactttggtgcccttagtgaaccaaatttttataaaggaagaaaagatccctgccatttattgaaaacctgtcatgtgtcaagcactgcttactgctgtacaggtaaggcctggactgtgtacttgttttctgttgaaatgaaggctccaggccatcaggccagaaccagatcttctgatgttttgttctttgttgcacactggtacaactaatttgtatttagaggctgacaccatttgacttccttattgaatttcaggagtggagaattctggaaaggtggacatctctaccaaggaccttcttcctcatcaagaattgcgaattaagtctggtctggagaaggctatcaagcataaagacaaactgttagagtttgacagaactaggtatgaaagggttagaataacaaatgctaagaaataaactagtccacagattctggccattattttggtacttgataccttctcaaagtggagtgtgaaagagtttatagcaaaagaagagccagatgctctacataggaggcctacatcttgttttttaatccacggttgaataatataggctcctatgaaaagaatcctgtcctgtagcattttttgattcctgacaaatgttagtatatcccctggacagttatgtgagttgacagaattcaccacttgttttacttgtagccattcattcagtcacctgtattagagtacgtgttatttgcaaactgttaggctgggctctggagaatctgtaaggaattgcctctgggagaacacaggttatgccctatcataggagggcatgatttacccttctcctttactttgactaaatttgttttttgattcaataatcggtatattaaaatacaactaaattagctttatactactgcattattattgtttagcccattgacttctgtttaggagatagatttatgataattctgtttttgacttcctccttacttacatttttttttcttttgaaaaaaatatttgttgaaaaccagttagtggtaaaaaatgtttggataggatttatatgctcccttctcaaatgactctgagggtcctcagagagaccctgaatctcttgtaacctgagagtctgttgctgacagtgtaatcttttgatgggacattcctgctacttccaaaccatttgctatgaatacatgagataagatttagaaaactattccttaaataaacccatcacaaggtgtataactcatattcactcttcatcctttcagtatcacatttcaccctactcagtagaacgtattattagaaatagaaatggaagccgggcacggtggctcacacctgtaatcccggcacttggggaggccgaggcaggtggatcacgagatcaggagatccagaccatcctggctaacacagtgaaaccccatctcactaaaaatacaaaaaaattagccaagcgtggtggcaggtgcctgtagtcccaggtactcgggaggctgaggcaggagaatggcatgaacccaggaggcggagcttgcagtgagccaagattgtgccactgcactccagcctgggcaacagagtgagactctgtctcaaaaaaaaaataataataatagaaatagaatgcacttactttttgataaacagaaagtggaaaagggtctctccctattgttgctgttttgctggtgtattcatggataccagtttcattatctaggtttttgtataagaccaatttccaccaggcacagtggctcacgcctgtaatcctagcactttgggaggccaaggcagacggattgcttgagcctgtaagtttgagagcagcctgggcagcatagcaaaaccctgtctgtacaaaaaatacagaaattagccaggagtaatgttacatgcctgtaatcccagctacttgggaggctgaggtgggagtattgattgagactgggaggtggaggttacagtgaggcgagattaatccagtgcactccagcctgggtgtcacagcgagattgtctcaaaaaaaaaaaaaaaattcctccagagtactgttaaaaaagtttctactctaagtctgctttatttttgttttttttttttgatccgccagcctcggcctcccaaagtgctggaattacaggtgtgagccaccgtgcctggcctaagaagacaaatttttttttttttttttttttttttttgagatggagtcttgctctgtcgcctgggctgcagtgcagtggcgccatctcggcttactgcaagctccgccccctggactcacgccattctcccgcctcagcctcctgagtagctgggactacaggcgcccgccactacgcccagctaatttttttgtatttttagtagagacggggtttcaccgtgttagccaggatggtctcgatctcctgaccttgtgatccgtccgcctcagcctcccaaagtgttgggattacaggtgttgagccactgtgcccggctgacaaaatttttttataattctagctgagtatgaaaatttgaagccaatatatgaatctaacttcagtatttcccttatgtctatttatgtcactatttgtaattatggggaaacgtaatcttaactggatttatgacattggagtaatcactcaacttctatgagccccaggtttataatatgtagaattagagagttagaccatcaagattccttccaggttttagtgtctctgtcagtatgatcttagagataggcctaattgtcatattttggaacttggccccagtgcattagtgagagcctgcaaagtggggtataggtaatgacatatagtagtagggtaatagaatgtcttaagagtaaatagttggccaggcacagtggctcacacctgtaatcctagcactttgggaggccaaggtgggtggatcacgaggtcaggagttcaagaccagccaagccaagatggtgaaaccccatccctactaaaaatacaaaaattagccaggcatggtgttgcgcctataatcccagctactcaggtggctgaggcagagaactgcttgaactgaggaggcagtcacaccactgcactccagcctgagcgacagaacgagactctgtctcaaaaaaaaaaaaaaggtaaatagttaagctacagaactgagacttaagcatagaactccagtaagcaaataagcctagcaagaataggctggatcccagttacagagggactaggatatttagtaagctgtcaaacttgaactcagatgcagcaaaaccaggctgaagcccagctttcagaaggtagaggctggactaatatgaaaggtagaaggaaaatgtattatggtgctgtgtcttttcttgcctgaggttgagataagttctaggagctgagcctacactggagataaaacatatgcagagcttgacctgattttggaacatatttgagatattaagttaccttgaaactgttttccaataatcggtccttatttgtcaacagatgacctaattaccatgtgttccctttttctcagtattcgaaggacccaagtcattgatgatgagtcagattactttgccagtgattctaaccaatggttgtccaaacttgagcgggaaaccttgcagaagcgagaggaggagctgagagaacttcgacacgcctctcgactttctaagaaggtcaccattgactttgcaggaaggaagatcctggaagaagaaaattcactagcagagtatcatagcaggtaagtgagcagcactagaaagggtctcaaagaaggaacaggttgaccataaaggattttccctttctagtggatcttttatttttgttgatttaaaaaatgtgtttatttggaacagaaaacatgttaagaatagctaagaaaaaatgtttaaatgagcactcctaccagataattactgatttttgtggtttggtttttttttttttttttttgagatggagtctcgctttgttgcccaggctggagtgcagtggcctgatcttggctcactgcaacctccgcctcccaggttcaagccattctcctgcctcagccccttgagtagctgggattacaggtgcccaccaccatgcccagctaatttttgtatttttagtagagacaggttttcaccatgttggccaggctggtctcaaactactgacctcaagtgatccgcctacctcagcctctgaaagtgctgggattataggcatgagtcaccatgctcagcaaaaaaaagtttttaaaacaatgagatatagtatgggcacagaaatagatcaatgaaacagaatccagaaagagattggtatgtttacattgtgtttgtatgtgtgcatgggtgtgtgtatatatgtatgtgagtttagtaatcaataaagctaacatttttaattgctaaagcaataattaaatatgttattttgggataattgcctgtttagaaaaaaatctaggtaatgtctttatctcagaccattctatgatgctgtaataagtttcactaaagagttaaatataaacaatataaagggatcagaaagaaatacagaattataggagaatataattatagtcttggtgtgataaagctcttcctaagcaagatacaaaatcctgaagtcatgaagatataagatattttaaataaaaaagacagtaccaagttggaagaaaatattttaagtggttttaacagtcaaaggaacaatatccatactatataagtaagaactcttgcaaattaaaagaaaatgaccaaaaactccagcagaaaaatggacaaaaactaaaaacaatttacaagtggggaagtacaaatagccagtaacatttgaaaagatgtttaactagcaatcaggaaatacagattttaaaacaatatatcaattttctttggctcatcaaatttggcttaaattttttttaaaggataatattgcatattgtgtgggtataggaaaatggggatattctgttactgtgaatgggagtattaaaatgatgcagcctacatactgtatgattttaactattcagtagttccagggattagaagagagggaggaataaatagaaggagcacagagaagatttttaaagcagtgaaactactctgtatgtagttataatggtaaatacatgtcattataaatttgtccaaacccataaattgtacaataccaggagtgaacgctaatgtaaactatggcttttgggtgataatgatgtgtcaatgtaggttgatcagttgtaacaaatgtaccactctggtgagggatgctaataatgggggaggctatgtatttgggaggtctcagggaatgtggataacctctgtatattcctctcaattttgctctgaacctaaaactgctctaaaaaataaagcctaaggctgggtgcggtggctcacacctgtaatttcagcactttgggaggccaaggtgggaggatcacttgaggccaggagttcaagaccagcctgggcaacatattgagaccccaccttaaaaaaaagtctattaacataaatacataaacaaaaaagttacaactttttagaagagaatatttaaattgtgcatactgttttttttttttgagacaaagtctcgctctgttgcccaggctgggagtggcagtggccgcgatcttggctcactgcaagctccgcctcccagattcacgccattctcctgactcagcctcccaagtagctgggactaccaacgcccgccaccacgcctggctaattttttttgtagttttagtagagacagggtttcaccgtgttagccaggatggtctcaatctcctgacctcgtgatccacccgcctcggcctcccaaagtgctgggattacaggcgtgaaccactgcgcccggcactaaattgtgcatacttttgacttatcagctacacaccacatatcaagataacaatttccttttcccttgtcaaagatttttttaaaaatttgccattttcagacatgaaaaatagtatttcattctaatttttattcacattcctttgctttagttgtatgttagtaagtttgagtgttctgaaaatgtattcatttgcttttttactatttcttttatagagattctagagttctggatatacttatcattttactgtgtcaaatttattcctctctttcagacctcactctccccacgctattttagacttacctcatcatacaaattcttatactttttaaaagcttcaggcctttgtttctgatttttccttggtttggaaattcctcctccattctttgcatttcacatacctacctctcccttgaacctacatgatacaacatgttggatgatggaataataaccactaaatggattgtgcctgtttcatagtaattattacatcccctcatgtatgattcatcatctatacggctttcttaaatctgccacttggattgaaagcctctttaaaaaaaaaaaaaagcctcttgaaggcaggaacaatgtcttccccaccttttaagctgccttatatatgaggtattcctaacaaacaatatattgaattgaattgaaggtcaagtttagcctttcctgttagttgaagcttttcattatgttgtgcctcacaattattattgttatccacaaacgttttgtcaagcatccaacaggagtattgaatagagtagcaagtactgtagagctatagaatgaattaagatagggttccttcagggcttatgatctcttactaactaaccagtaggtttccacaatctttaaatgaaaatcatcacattcttttataggtttagagccagatatccaatgccaacatcataggcatgggataacaggggatgtatccaatgattgtttagatagtgggtactataggaccttagagaaaggattaagcatttttgttctgggccagtagggtacctctttataacttctgagccttcaagcaaagatagaatgcagactagcaagaaggagtggagaaaggactgctgagcagacagaggaataactgtataggttgtattgcgaagatgagctgccatagaatactcttctgtgggtcagggtattcctaggcaacttttttttttctttttgtgacagggccttattgactattgcccaagctggagggcagtggcgccttgaactcctgggctcaagtgatcctcccatctcatcctcccaagtagctagaactacaggtgtgagccaccatgcccagctaatttattttttgtagaaccagggtctctctatgttgcccaagctggtctcaaactcctggcctcaagtgatccgccctctttggcctatgatagtgttggaattacaggcacgagccaccactcctggcctctaggcagcttttctggtcttggcatgtttaatgatcttgttgagcaggtgaatgactgtagcgtgccctatgtattttcttggtattctggaacttttattttatttatttttatttttttttaattttttgagacagtctcactctattgcccaggctggagtgcagtggcacgatctcggctcattgcaacctcctccgcagtttcaagtgattctcctgcctcagcctcccgagtagctgggactacaggcgtgtgctaccatgctcagctaatttttgtatttttagtagagatggggtttcaccatgttggccaggatggtctcgatcccttgaccttgtgatccgccctccttggcctcccaaagtcctggaattacaggagtgagccactgtgcctggccattctgcaatattcattaactcatattccttagggtttttggtgtgagaaggaagttggagtggggagtagggaaggtcatccatagactcctctttatattccaaattttattactattaaagcattttatgttggtggtaagcattctgagcatagaacattaccaattgttacatccttttggtttattatcacagactagatgagacaatacaggccattgccaatggaaccttgaaccagccactgaccaaattggatagatcttctgaagagcctttgggagttctggtaaatcccaacatgtaccagtcccctccccaggttagtggacctttgctctaactgttaataagaagtttggccccaattttgccttcttttaagtatgtctatttcatagacttcagataccaatcagctctctcaatacacctgtaccaatcagctctctcaacacacctgccaaccttattctctggcccacattttttccatttttattgcagtacttctgacaaattgacttgttttatcttccaagtacttcccaagaaagggttttgttaagtactatagaaatttagacagaaattccatggttcttttgttaatgctctttctcttttttttttttttttttttttgagatggagtctcactctgttgcccaggctggagtgcagtggcatgatctcgggtcactgcaacctccgcctcccaggttcaagctattctcctgcttcagcctcctgagtagctgggactacaggtgcccgctaccacgcccagcgaattttttgtattttttaatagagacagggtttcaccgtgttagccaggatggtctagatctcctgacctcgtgatctacctgcctcaacctcccaaagtgcccagctatcaatgggttttatagggaagctggcattcattaaaagtaaatattcaccaggcgcactttgggaggctgaggtgggcagattgcttgagcctgggagttctagaccagcctgagcaacatggcaaaaccccgtctctactaaaaatacaaaaattagctggccatggtggcgtggtgcctgtagtcccagctacttaggaggctgagtcgggagaatcacctgagcccaggaggcagaggttgcagtgagctatgatcatgccactgcactccagcctgggtgacagagtgagaccctgtctcaaaaaaaaaaaagcaaatatttttgaaaaatatatgtttgggaatggtggagaaaaaaattccaggcagaatgaattgtaggaacaaaggcatgtgtacacaaaaacatgggatatagatataggaatttccaagcacacaaatctggagagggaatttccaggcagaaggtacaacacatacaaaggctcagcagcgtgagagcattgcaggtttggggaatcacaagtaattaactattgttatggactgataagtgtattagtttcctagggctgctgtaacaaagtaccacaaattaggtgacctaaacaacagaaatttattatcccatacctggaggctaaaagcccgaaatcaaggtgttggaaagactacattccctctgaaggctttacaggagaatgcttacttacctctttaagattctggtggctctaggtgtcttttgccttgtagctcattactctaatctctgcctctgtcttcacatggacttcttccccatgtgtgtctctgtcactgtgtgctctctcctcttacaaggatacaagtcattggatttagggcctactataatctaatataacctcatcttaaactgattacacctgtaaagattatttccaaataaggttgtattcacagattccatgaacgtggacattgattttggggggatactactcaacccagtacagtaagcaacacctgatcatgaaagattttttgtcttatgctaatgagtttaggttttgccctaaagtaggcaaagaagggttctggaagaattttaacagaagattggcatggcttccatgcctacgtagagaatggattggagggaagagtaagtaagattagaagctgagaaattgccaaggtagtcattgcaatagcaccatggaaagatgatgccagcccaaattagtattaaagcactagtggagcagtagagagttatttaaagaccaaaagtgggagccgggcctgagatgtagtgatacacatctatagtcccagatacttgggaagctgaggtgggaggatcacttgagaccaggagttggaggctgcagtgagctatgattaagccaccacactccagcctggatgacacagtgagaccccatctctaaaaaaaaataattatcatcataaagactaaaaatgtagatgaagagacctgctggcagattctttaatagtattatcaaaagataatgaggaattaatttaggaaagtggctgtgtaattagagggaacagctgtagtagaaatagaaaaaataatttgggcctcaagattgttcacataccaacattttatgaaattatttatttccagccaggtgtggtggctcacgtctgtaatcctagcattttgggaggctgaggaaggaggatcacttgaagccaggaggtcaagaccagcctgggcaacagagcaagacagtgtctcaaaaaaaattttttttaaagaaattatttatttaccctataatggatcaattctttttcctctttggtcctctgtaaaaacttctatctcctatttagtatgtagtcaattctgccttatgttttgaatagttatttatgtgtctgtcttccactaggctttaagttccttgcaagcaagaaccgtatctttttcatattttatgtctccctagttaatgtgcttttcacagttaagtactcaataaatgtgtatttaatttgtaaaaatgtgtatttttaagatatgccacaattgacaagaatcataaaattgtatggcagaaagatccttagaaatttatttagtccaacttcatccttttccagtttgaaaaactgaaatctttaggggttaaatgcctagggtttcgactaccactagaagttttttcctataagttattttatgttcatttttatttatttttgagacaggatattgttctgtcatccaggctagagtgcagtggtatgatcatagctcactgcagcctccacctcccaggctcgagagatcctcccatctcagcttctcaagtggctcagactacagtagccacgtgccatcataccttactaatttgtatatttttttgtagagaaggagtttcgccttgttgcccaggttggtcttaaacttctgggctcaagcgatcctcctgccttggcctccttaagtgctgggattacagacatcggccatcatgcctggcccttattattatttttaaagacacaggacctcaccatgttgcccaggctggccttgaacttatgggctcaagtgatcctcctgcctcacctcctgagtaactagtgaagctacaggcatgcttcactgtgttcagctttataaattattaattttttaaaaaaagataaccccaaatatcatcatgctaattgcctttatttttaaattttaattttggaggacatggtatcgttgctctggaagaaacattaacctttgccattctctgtctgaactgttgccaagactcttcactctcctgtaattacctgtaccttataattctctattctttttatatgatgggagccctgttttagtagtcctccaccctctctttcaggagacaagttcttcatttcagggtaagagaatatttcatgcatccagtagtcagaactgctgcctctgacctgacaacatctgtttggctttgtcatggtgccagcatgtgacactgcccctaagcacatgcagaattgtggaccaaaatgttgaactttcatttagctcacagaattctattgaaaaattatccagaaccaagtatggatcattaagtataaattggaaataattatagctcttttggtgtgatatttgtgctgttgctggaattagtaagcattgtatggagatttcaacattctaattattctttaagatgggccttgttatcatacctgagacttctactgaatgtatactatctctacccttttggccttattgcagacaaagatgggattatttttcatttgttgttgttgttgttgttgttctgagacagagtctctcttgcccaggctggagtgcagtggcacaatcttggctcattgcaacctccacctcctgggttcaaatgattctcctgcctctgcctcatgagtagctgggattataggcacctgccaccacgcccagctaatttttgtagttttagtagagatggggtttcaccatgttagccagactggcctagaactcctgacctcaagtgatccacccgccttggcctctcaaagtgctgggattacaggcgtgagccacgatgcccggcctgggatatatttttctaagaaaaatgttcccaatatgatttcctcattattagcattcgcatcattttgtctacctaccccagattcttgccttataagatagaactgtatgtttgtttttctgtgtagtgggttgaccacacaggtgcagcctcacagaagaaggctttccgttcttcaggatttggactagagttcaactcatttcagcaccagttgcgaatccaggatcaagaatttcaggaaggctttgatggtggctggtgcctctctgtacatcagccctgggcttctctgcttgtcagagggattaaaaggtaagaataaaaatgaatctgggcagtggaagatcttagagtgacataaatttaatttagaaatatgaattggaattagttttcctcaatctagtgatgatttataatactcttcaataaatagaactttgaacaacatattcatgttactgacttggtagcagtatattttaaaattaatttcaaaacatttaaattgacaaatatagtagtagtttttgtactgaatagcttaaacaaactgagcataaaaaggctaagaaagtcataacaaagatagaagactaattttttcatctttggaaggaaatctattgaaaaatcttctcttggctttgctttggaatatactactaagcaaccttaataatttgatcctatttgaaacatagttttgatgcctatttacttattaagataccagcataactgattttattttcctgtccatatatctaactattaatctggctaataatattgagaaactattttattacaaaatgcttttctacaaaagtaggggaaattgagataagtagaggtattatacagctgagttacacctgttactgataataatatttaatagcttactattccgtggtgtcttgtgtttttttcttttcttttcttttctttttttttaaagaccgagtctcgctctgtcaccaggctggagtgcagtggcgtggtctcggctcactgcaacctccgcctcccaggttcacgccattctcctgcctcagcctcccaggtagctgggactacaggcgcccgccaccacacctggttaattttttgtatttttagtagagacggggtttcaccttgttagccaggctggtctcgatctcctgacctcgtgatccgcccgcctcggcctcccaaagtgctgggattacagacgtgaaccaccgcgcctggtgtgtttgtttcttaattcagtttttaaaaatagtgtttttcttggcttttattatccatgtaaatggaaaactgtaaagcacagaaaagtagctagaaaaagaaagattacctataatcccacaccaagaaaccgctgttattagcattttggagtgtttctatctttcttttttttgagacagagtcttgctctgtcacccaggctagagtgcagtggcctgatctcggctcactgcaacctctgcctcccaggttcaagcaattctacagcctcagcctcccgagtagctgggatcacaggcgcccgccaccacacctggttaatttttgtatttttagtagagatgaggtttcaccatgttggccaggctggtcttgaactcctaacatcgtgattcgcccaccttggcctcccaaactgctgggattataggtgtgagccactgtgcctggcttctttctttctttttttttttttttgagacgaagttttgctcttgtttcccaggctggagtgcaatggtgcgttatcagctcactgcaacctccacctcccgggttcaagccattctcctgcctcagcctcctgagtagctgggttcacacgcatgtgccaccacgcctggctatttttgtatttttagtagagacgaggtttctccatgttggtcaggctggtctcaaactcccgaactcaggtgatctgaccacctcagcctcccaaagtgctgggattacaggtgtgagccagtgcgcccggctgtttctatttttcttgtgtaaattgttaaatggtgagagcatgatatatatgtttgtgtttttcttctttcacttatcattacaacatatgtcttttgcttcttatttctttttttttttttgaaatgaagtcttgctctgtcgccctagctggagtgcagtggcgtgatctcagctcactgcaagctccgcctcccaggttcacacctttctcctgcctcagcctcctgagtagctgggactacgggcgcccgccaccatgcccagctaatttgtgtatgtgtgtgtgtttttactagagatggtgtttcaccgtgttagtcaggatggtctcgatctcctgatcttgtgatctgcccgcctcggcctctcaaagtgctgggattataggcgtgagccaccgtgccaggccatttcttatttttttctattagaattttatatgcctggcaatgtcccaactcataacagtaaaaataccttatatttaaatagaattttagttttcaaggcagtagctctatgaaatacacgcatgtgctgcataacgacttttcaatcagcaatggaacacatgtacaacagtggtcccataagattagaataccggccggtcacggtggctcatgcctgtaatcccagcactttaggaggccgaggtgggcggatcacaaggtcatggtgaaaccctgtttctactaaaaatataaaaattagccaggcgtggtggtgtgtgcctgtaatcccagctactcaagaggctgaggcaggagaatttcttgaacccgggaggtggaggttgcagtgagccaagattgcatcattgcactccagcctgggcgacagagtgagactccatctgaaaaaaaaaaaattataatactatatttttacgctaccttttattttctttctttctttcattttttttttttaagacaggatgctcggctcctgttgcccaggctggagtgcagtggcatgatctcggcttgctgcaacctccaccttccaggttaaagcattctccagcctcagcctctcgagtagctgggattacagacatgcaccaccatgcccggctaatttttgtatttttagaagagatgaggttttgccctgttggccaggctggtctcaaactcctgacctcaagtgatccacccgcctccacttcccaaagtgctgggattacaggacatgagccaccatgctcagcctttactgtaccttttctatgtctagatgtatttacatacgcaaatagttaaccactgtgctccagctgcctacagtattctgtacagtaacatgctgtaccagcttgtaacttaagaataagaggctgccgggcacggtggctcacgcctataatcccagcactttgggaggtcaaggtgggtagatcacctgagttcaggagttcaagaccatcctagccaacatggcgaaaccccatctctactaaaaataacaaaaattagcggagcatggtggtgcatgcctataattctagctactcgggaggctgaggcaggataattgcttgaacccaggagacagaggctggagtgagccgagattgcctgggtgatagagtgagactcagtctcaaaaaaaaaaaaaagagcaagaggctataccatagcctaggtgtgtagtaggttatactatctaggtttgtgtaagttcagccaatgaaattgcctaaagacacatttctcaggacatatccccattgttaagcaagatgtgactgtagattaggccagtattattatagtctttgacaaatgaggatactgaagcaggcaaaggtaaaatggattgccctgaaatatgaagctaggtgatgacagagatggaactagacttctggttttcagagtgctctttcccctctactgttcaggcttcagacgtttctctactttacttaaaagcaaatgattatcagcatttaggcataatcatttctactttggtagtttcactattagctgccatttctctattgtgttaaggtgcactacaccttttctcccctcttgaaggtcaggtttccttgctttggctcctaattgtttcatagttcatgtctgtaaacgccattagaacaagtgcatgggaatccgcttctgctccaggatgatcaaacccttagatgtctgttcttctcattgagttttctgcaatttaggtgtcttgcttttccaaagtagaaaactaaacaacttgccttctgctaagggaatcagagtgtttacatttctctcatcctatttggatctgttattcaaattttctcacagaagcgaaagaatgagcagcatctagtacacagtcactttattttaatcccacagaaataaagtaggtggttttgccacatttgtgggaccattttcccagtaattcttcaggttatttggcctagagggaagatatacattggttcattccccatatcgtgcacctactgtgtgcctggcactcttccaatttatctatattgggaaaccaaggatatgaaaaattcatgaccccattttccattataagaatgggataagagggatatattatcaaggtactttatttaatttggtgggaggggaaagagaaacatctttttgtaatccttggaaagtagcaattaaattctcctgaatacattctgttattctctttagaggttttttcaaactagtccacaagttgtttaataatcctcaaagaaaaccccaaatacaatttaaaaatgcaaatggagccgggcatggtggctcatgcctgtaatcccagcactttgggaggccgaggtgggcagatcacaaggtcaagagatcgagaccatcctaacatggtgaaaccccatctctactaaaaatacagaaattagctgggtgtggtggcacgtgcgtgtagtcccagctactcaagaggctgaggcaggagaatcgcttgaacccaggaggcggaggttgcagtgagccgaggtcgcgccactgctctccagtctggcaacagagcgagactccgtctcaaaaaaaaaaaaaaaaaaaaaaaaagcaaatgggtgtggttctaattgaagagtaaagataagcgtttttatttacttaaattattttaaataaataaaaagtaacattcttgggagttgtgtgtagatgaggatttttctgtcaggttggagaacaaatcaactaatcttctagggaaaggttagcctttgactcaagggcaaggatttccatatctctaatatgatttatatgccttgaaaatataggatttgtattggagaagcaccaagactggtcagggttccaaatctgagttgtagggatcaggtgaaaagcagtcaagagttgagagagatgacttgtcgctattctgatggaggagaaattagtggacagagttcatcctcaagtgaaaagtattgtgagagaaaagtgtttttgacaaaagatactgctcttgagaaggcatcatctatagacctcttggttcaactggataatttgctataggatttgttatatattatgggatattccaggaaactagaatttatatccttcccactaaatttctatttgtttaagggtggagggcagatcctggtacaccccccacagaggacgactttggatagcagccacagctaaaaaaccctcccctcaagaagtctcagaactccaggctacatatcgtcttcttcgtgggaaaggtaacagccgcatattctcctttcaattttactttatggagagaagtcattgacgttcatcttctttcacttccttctttctttggctttttctttgttaaaagagacttttaatctttgtatatgtttgtttgtttagtggtaaatcattgacagcgttcaaagcattaatctgtcaaaacagtgcaaataaaaatatcaatttccaacacaagaaatcaactagtcttaatttttttatctgagaaaatcatcttctttactctaaaggtaaaatgactagtgtaaactctgagatccttacattgggaagaacaaccacaaataggaattttcattgagagtggcctaaatagacacctactattggatttgtacaaatcaaagttgattgatttaagcaacgtattttgggaatcaccccaagaatactaactttggatccttaaaaagacttctgacctttgggcatcctgtttttcctttgtgttatccagctcatacagttgttttgagggtagaataaaaggacaactacacaaccatctttaaaggtttttaagaaacaaggcttaaagaatcactaggaataaaaagttcatgcttccttaaaagcacttttcttttttatttttttttgagacagagtctcgttctgtaaccagactggagtgcagtggcgccatttctcctcactgcaacttccgccttccaggttcaagtgattctcctgcctcagccttccgagtagctgggaccacaggcgcatgccaccacacccagctaattttttgtatttttagtagagacagggtttcaccatgttggccaggctggtcttgaactcctgacctcaagtgatctgcctgccttggcctccaaaagtgctggggttataggtgtgagctactgagcccggcctaaaagcacacttctattcctattgatatggactggcttgttttaaagacattcattcttatggttttaaccacattttgatgttttttttttcttgtcacctgtaactgccttactttgcttccaaaactcatcactgccaaactccaatctgatccaatggcgtatagtagaatcgatttgtattaggatgaatttgtggggtccttgaactttgatggtatgagggcaaaggaaaaattttctagcttaacatgtggatagtggactaagccagccactcactagatttttttgctaaaatgcaaacagttgtgccaagtaaatttcactgttttccttatgtctacaaatagataatggaaaaagttattaatgtttgttcagaattgaaaacagattcctgagttccaagatcacaaagaaggaaatttattcaatatttttgttattcctgattcagatgtggaatttcctaatgactatccgtcaggttgtcttctgggctgtgtggacctaattgactgcttgtcccagaagcaatttaaggagcaggtgagtaaagaatactttttttttttagagacagggtttcgccatgttggccaggctggtcttgaaagcactttaagaggctgggcctcttaaaagtgctgggattataggcatgagccaccacacccagcctggtgcatataaatatctgtataaaaagctgtttccaggccgggcgctggtggctcaggcctgtaatcccaacactttgggaggccgaggcaggtggatcacaaggtcaggagatcaagaccatcctggctaacacagtgaaaccccatctctactaaaaatacaaaaaattagccgggtgtggtggcacgtgcctgtagtcccagctgctccaaaggctgaggcaggagaatagcttgaacccgggagatggaggttgcattgagctgaggtcctgccactgcactccagcctgggcaaccgagtgagattccttctgggggaaaaaaaaaagctattgccacaatgcagctagcaagtatatagggtcttcatcccttaccaaaaccttgcttcttttgaagaaacccttgattatcccttgaattattttgattggggggtgggaatactaggatctgttattgctaattctggagcttttggtccaggctattgaactcatgataggcaaatgtatttgactctgattgccaggactgtgccatatttgggaggaggtatgtgtatttatgtatgaatgtacatatgtatgaatgtacatatgtatgcatttatatattttaatttttatcactaaagattgaactgacaggtcgggcgcagtggcttacacctgcagtcccagcactttgggaagccaaagcgggtggatcactttaagtcaggagtttgagaccaacctggccaacatggtgaaaccccgcttctactaaaaatacaaaaattagcctggtatggtggcgcatgcctgtaatcccagctactcaggaggctgaggcaggagaattgcttgaacctaggaggcagaggttgcagtgagctgagatcgtgccactgcactccagcctgggcgacagagtgagactctgtctcaaaaaaaaaaaaaaaaaaaagatgggcatggtggctcacgcctgtaatcccagtgctttgggaggccaaggcgggcagatcatgaggtcaggagatcaagactatcctggctaacacggtcaaaccccatctctataaaaatacaaaaaaaattgctgggtgtgatggcacgcgcttatagtcccaactattcgggaggctgaggcaggagaatttcctgaacccagaaggcagaggttgcagtaagccgagatcatgccactgcgctccagcctgggcaacagagcaaggctctgtctcaaaaaaaagaaaaaaaaaagattgaactgatgtaactaaagtacatttttgagcagcagagggagccgaaatactttaacttaattagaaaattcctgaaatgtaagacctttatgtttagacacagaactagcagaaatccaaaacaggaaaagtccatccttgaagcacaaacagtcttacctatcagtatggttttcctgttctttgaacagttgctttagataatagggcttccaccagtgtgctgaagaaaaagagcttcagtttcatttttcccagcaaattctctttttcagacttacttacctttcattactgttattactgtctactgttttcctttactgttcccagccattttaccctctctattctttactctttatttattttttttggaaactgggtctcactctgtcgtccaggctggagtgccaatcttggctcactgcaacctctgcctcctgggcttaagtgatcctcccacctcagcctcccagtagctgggactacaggcaccacaccaccatgcccagctaatttttgtatttttagtagagacaagatttcaccatgttggcgaagctggtcttgaactcctggcctcaagtgatccacctgcctcagcttcc

SEQ ID NO: 15889 - DNA, 45755 bp, Human
  misc_feature (1)...(45755): n = A,T,C or G
cacattgcatgctgggatgcgtgagctattttcttcggaaggcagcgaattgtattctgggacttgtagtgtccgcctggtagaagtggatgtaacggtctgttaaccgcgactgactcactcagtatccgtgataagttaaagatgaatcctgaaggggtaggggaaaggagatcttgagttctccagcacggagactctttacaattatttctccgcgggatccgctgacagccaacgtctttcttacttcctgatcggacaggaagtaggtttcagttgctgtgaaaagggatgtcatgggaagccagtgaggtagtcaggtatggcatggggagggctttttggctttctcgtctcctaagggactcagtccagcacagcttcccacctttgaacgaatatttctgctaatggcctccaaagacaacttagaacataagttttcccgtgtctaatgtgtacagtggtgacataatggagatcgccatccttaaaagtgtatcttggccgggcgcgatggctcacgcctataatcccagcactttgggaggccgaggcgggcggatcacctgaggtcaggagttcgagaccagcctggccaacatgggcaaaccccgtctctactaaaaaatacaaaaattagctgggcgtggtggcaggggccttaatcccagctacttgggaggcagaggcaggagaatcgtttgaactcaggaggcagaggttgcagtgaaccaagatcgagccattgcactcaagcctgggggagaagagcgagacttccctcaaaaaaaaaaaaaaaaaaaaagtgtatcttaagccctctggtgttcgtgggtgtgatggatgccagtaacaaaatcgattttattttatccatccatccctccgatcaaatttgtaggtactaatttgccataggtgatccataggcatggaagatacaaagataaaacgctgcccccgccttcaaacagctcacatgacctgtgagggagtccatccctgaatttgcagttacaaccaaactaactaaacctcttgtcaaagttggtgacaaatgccatttctattgagaagataggattatcttgcagaattgtcccatgctaacatgcccatttatctttaaactccagtcttgtttgtctagttaatgtaggccttaggatcaccagacaatgaattgcttaggtcccaaggaaattttggtcagggttcaataatttccctgccgtctattccactccacttactccacagcaattgagaggataatcctaacatttttccagccaaatctaggacactgaggcctcacttcatctgtgaggcctccctacttctccaagcagaattgattatctctttccctgtgctcccacagggcaccatagcattgaacatgtcgaactgtcgattaaatacctgatttctgtatctgaaactcacagcaaggtgccaggcatacagtagatgctcagtatctgtatttcttaatgaattaactgaatgttgctcaaggaataagtggtgaagctttcttctagtcttgttcagatacctcaatcgaaatatttattgactctctgtgagggcattgtgcttggcatgggtagatggcatgtagaggttttcaaacattttagtgacactccttcattcagacgaactcttagaagcctgttggataaagctatccagagcacaaagggccctagaaacctgagcagcccctaactcctacttttctgcccctttggccccactcgttaatatctcagcatcgcgaaccaggcctcggatttgctgcgcagcctcagctggccgggtgcccccccgcccccagcgcctaagccccgcccctaggtctccgcccctcggatcccacggggtcccttgcggccctcccactcctcgcaccgttggatcgctttgctcacggcgctatctctcgataaagttgttgttgcggcttccgccgcgggtggaagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcgtgagtttgcacccctcggggtagcaggcgggagggcaccccgaaagggaagagaggctaagcgagaatcggggaggttgggcagagtgggcccggtgagaccttgcctcggtgtcagcagtccgggccccggggaccctggatgtgctcgaagcggtagagcttggcttcccggcccccaggcgggaagagtaaagaatgagggttgtggtgccttcgtcggctagctccctaacagccgagaaccgccgacgccgtcctttgaccctgcagtgtggtgacactccacggatccacggggttattttgcaggtcgtgtcctgccaaggcagattcagtaggacggaataagcgaatgggatgcagacctttcccccgtcttactgcttctaagatgaatagcgttatgtggactagcctggggtggtgacccgcccaccagttctttctttagcccagcatttaccgataataaccaaaggccctttctggatcttagtttacaaaagttatgttgattcttctgatctctaggaaaatcaggccagaggctggtggacagaaggcactgccagataaatcactacatagatcagaaagctttctcctttttaaagggatgtgttcaagtgcccacgtacctcactgggagcaaatctgaaatgtgatgaggaaatggtgtttcccgtaatgttaccggtaggaggcccttgagtgtaggttgtcgaggttcttggcattttgaacaaataattggacaaaacgcacaaaataacaaaggaatgaaacacaaacgaagcagcgaaagcaggaatttattaaagcgagaaagcaccccacagggtgtgagtgggccggagcaaggggctcaagagcccacttacaaagttttctggattttaagtgctccttttatggttcctatgggttaccccttatctggatgaaggatttggtctgtggctaattaaaggccgaggtgaattggcgtcctgtgcagatgaacggatggtccctgcttggcctgcggccagtctaaggcactctccctttccatgtgagacgtggtggatggggagggttgcagggatagtagcctttgatcctttgccactcgggcgtgggcagatgggttttttccttttggtttagctttaggaagttggccttaattggccttaggttccctgcccccaaacccagggggttccttttgggaagtcagcacgaattggccttagattccttgcccccagaccttggtgttttctcttttagaaagttaacgtaagttgacctcagattccctgcccccaaaccttggtgtttttccttgattcagcatgaattgcccttaagtttcctgcctccagaccctattctcctgcctcagtaataaatatccgggtctctaataagagttaggtattagaaaaaaataatctttgtaatgtggaaatcagtaatcagttatggaaccagtagagatgttttgggctattttatgagaatatttactcataccacttggtataggttgttccaggctgtaaaattcaatgctgggtctgtgaatttatctgtttggcataatgcttctcttcacagtagctactcagtgtgtaaccaactaaataaaacagctataaattctttatgcaacatgtggtctgaaaaagtttgaggctttcctcatttgtgtcagattttccctgtcctgtattcagaaattgagtccataatctcagctcataaggtgcttgataattctaatataacaactaaaactgtcaaatgaagtctcttattctgagaaataataagtctttgtgactgtcataaaacaggaaacaatttttgtttgtttttagagacatagtctccctgtgttgcccaggcttgtcttgaacttctgggctcaatggatcctcccttcctcctaagtagctgggattgcaggtgcatgcctgagaaataataattcttgccgctaatttagtccttctgtatgttattttaagtaagtatttagtctgttcctttagtaattcttctataagtcatggaagacagctactgttggtaactgctggaatgatgtgcagactgagaatatgaaaacagaaactctgacactgaaagtgattggtcacataggcaaatgttgatttattttccaaaaaggaacctggaagagtgaggagttattttctagagttaacctgaagcagtggccgagtgccatgcacacgtgtaatctcagcactttgggaggccaaggcaagaggatcacttgaggccaggaatcgagaccaggctggccaacatggcaaaaccccatctctactaaaaatacaaaaattatctgggcatggtggcacgtgcctgtaatcccagctagggaggctgaggcacaagaatcacttgaacccgggaggcagaggttgcagtgagccgagattgtgccactgtgctccagcctaggtgacacagcaagactctctctcaaaaaaaaaaaaaaaaaaagtagaaatttaaaaaagaaatgtaggaggcttcagtttgattcatcttaccatactttatggagttatcaatacctcttttttgtaagactgtaaaaatcctttgcctaatttccagctaaaagagagttgaggaggtcagaatgaccttgttctactgcagaaagcataattatttttatttagatatgatctaggaaaattgagttgctaaggaaactaaaatgccacctataagccatttttcaagctgcccatcctgatgttaatcttcaggatgccaagaccccaagagagctcgctagtttaactgtcttgttaaacagccataaagaacaaattataatccaataaatgctttagttgtgagccaaagaagatagaggattgcagcacttgtggtattttaaagaacaacattgaagaattaagtaattaagagtgtgggctttgaagtctgatttaaatctaggctctatggctggctagcttatccctgaacatggtacttaattactctctacagtttcctcacgtgtaaaaagtgaataatactagtatttacctccaccactattgtgaagattaaattaaaatgcctgtaaagtgcttagaagatgttccctccataataaacatttaaagagtgcttactttttgagggcatgagctgtatttgttggtgagcattttgtaaactggaattactctaaaaaaacccacaaaatctaataatggattagaaaagttaacattaaaagtgggtaatacagttgatcaaagtcaaaactattattagcctggcatggtggcataagcctgtagtcccgcatacttgtgaagctgaggtgggaggatcacttgagcccaggagcttgaggctttagtgagccaggattgcaccactgtactctagcctgggcgaaaaagtgaaaccccatctcaaaacaacaacaaaactagtgatatttatttgattagctaaaagcatcaaatagacacttaatgacttcatttttttgagacatagtctcactctttttgttcaagctggagtgcagtggcacaatctcagctcactgcagcccctgcctcctgggttcaagcgattctcctgcctcaacctcctgagtagctgggattacaggcacgtactagcgtgcctggccaatttttgtatttttagtagagatggggttttaccatgttggccaggctggtcaggaactcctgacctcaagggatctgcctgccttggtatcccaaagtgctgggattacaggcatgagccaccatgcccgaccgacctcaatagcattttgctaatttaagttaatcttcatcttttattttgtttcatgttggagacagagaggagcattgaagaattttgaagttgaggcatgtaaagttaaaactaatttatggtatgcccgtaatttcctgggcattgatacaactgctgctgttaatcatcccatctgctctcttttacagcccaagaggctttgttagttcagtaattaaaatgtggtttaatttatacttgaaagagcaggcttacacatgcatctcagaatctgtaaaccagttacttaaatgggagagaattggccaggcgcagtggctcatgcttgtaatcccagcattttgacaggccgaggcgggcgtatcacaagggcaggagttctagaccagcctggccaacatggtgaaaccctgtttctactaaaaacacaaaaattagccgggcgtggtggcacacacctgtaatcccagctgctgtggaggctgaggcaagagaatcacttggcttgaacctgggagttggaggttgcagtgagccgagatcgtgccagggcccaccagcctgggtaacagagcaaaactccatctcaaaaaaaaaaaaaaaaaaaaaaagagactcaaaaaaattactgaaataaatttgaagtcattgctttaaaactacaaatagtttagagagttatgtaagttatgtattaacatttaggcaggaaaggacatggtcttttcagaaactactcctaaatctgtgatcactataacatcttgcgagagaaggcaaaagctttttatttgtttgttgataaataaatacaaggtttctgtctgtctcccaggctagagggcagtggcaccatcatggctcactgcagcctctacctcttgagctaagtgatcctctcacctcagcctcctgcgtagcatgtgccaccatgcccagctaatttttcatttatttatttttttgtagagatgggggtctccctgtgttgcccagactggtctcttaactactgggctcaagtgatcctcccaccttggcctcccaaagtgctagaattatatgcgtgagtcaccacgcttggcccaaaaacaatctttttgaaaaaactggggtaaaattcacatgacaaaatttgccatcttaatcatttttaagtgtatagtttagtagcactaagtatattcacattgttgtgtaacagagatccaaaacttcctcattttgcaaatctgaaactctgtacttattaaacagcttccacagtccctggtaatcaatcaccattctaactttgtttctgtcaatttgtctatttttgatacctcatataagttggagtcaaatagtatttgttttgtgactggcttattttacttagcacagtgtcctcaaggttcatccatgttataacatgtgacaagattttcttcttttttaaggctgaataatattgcattgaatgtatatagcacattttatttatctgccagtggacatttgggtttgctttctcctcttggcaattgtaaatagtgctgatgtcaacatgagtgtgcaaacatctcctcaaaatcctgcttttaattcttttggatatatatccagaagtaggattcctggatcttgtggtagttctattttcaattgtttgaagaacctccatactgctttccatggtagttgcaccattttatggtctcacctcagctttttaaaacctgtttaattttgaatcctaaccaacctctggtaacagataccaaattacagctagataggaggactgagctctcttattctgcagccctgtagagtgaatgtggttaactgtatttattgtatattttcaaaaagctttctgaaagagaggattttgaatgtttacagcacaaagaaatgataaatgtttgagatgctggatatactaattatcctgatttgatcattgcacattgtatgcatatattgaaatatcactcagaatcccataaacatgtacaattgtcaactaaacataaaaagaaaaaaaattaaagaataatgcttgttaaagattttttgtagataccaagttttttaaaaagtttccttctattgctgttttgataaaaattttaaaatatctattgaattttattattttttgacatcccttggtcatggggtttctgtcttaaatctgttatatggtgagctgctttactggagtggactcaacgtggttattgtatattgtcttttttgtattttttattgatatagttgtacatatttttaggatacacatggtattttgatatctgtatacaaagtgtgatgaccaaatcaaggaatttgggatattcatcacctcaaacatttatctttttgttgagaacattagaattcttctagctcttttggaacatacgataaattattgctaactgtaatcttcctgctgtcaaatactagaacttattccttctaattgtatttttgtacccattaaccaacttctcctcatcctgccctgccttcccttctcagcttctgggaatcaccattgtaccctctacctccatgagatccatgtttttgactcccacagatgagtgagaacacttgacatttgtctttctgtgcctgacttctttcacttaacgtaatgacctccagttccatccatgttgctctaaataacaggagttcattcttttttatgcctgaataatagtccattttgtatatataccacgccttctttttttttttttttttttttttttgacacagggtcttgctctgtctcccaggctggagtgcagtggtgcaatcatggcccacttcccttgacctcctgtgctctggtgatcctcccatcatagcctcccaagtagctggggctacaggtgcatgccaccatgcccagctaatttttgtatttttagtagagacggggttttgccacgttgcctaggctggtctcaaactcctgggctcaagtgatgtgccctccttggcctcccgaagtgttgggattacaggtgtgagccaccatgcctggcctataccacatattctttatccattcatccattcatggacacttaggttgattccatatcttgactgttgtgaatagtgtgctggaataaacatgggcatgcagaagaaatatatatgctttgatatatttgctttcttttggatacatacctagtagtggggttgctggatgctatggtagttacatttttagttcttttagtaatctccatactgttttccataatggctgtgctacttcacattcccacccacagtgtatgagtgttcccctttctccatatccttgccagcatttgttgttttttgtatttttaataatgtctttttttatacattgctgggtttggattgctattatatattcttttacatctacgttcataagataaacctgtagtttctttctcatgaaaattgtatggtttggggaattaagattatatggtaatttcttctattctttcgagaatgtttatactattggaatgatctgtttcttaaaaattggtggtacctataaaactgttcaggcttggtatttttgtttatgctttatggaaagattgttaactataaacagtttatttctctgagtggttatagagtttggtagttttattaaaaagccataagaaaaatgatggttaatctggctaatactttaattctctgttctgtgaaacatgcatggtggttgttcccaaagatataacacatcctcattaagtttcttgatattagcccttctctgatcttaatcagacttctgaaagtgaatctttataacagtatctttaaacaaaggtgtatcacttagtttgtttagttactagtttagtcatttatagctaatattggtaaaaattctagtgtgtagtgttttctacagggatattgcctcaaacacttgtttttggagttaacatacatcaagtggtcacatctggtcaaatgatcagaagttgaaattctaccttgtggtaaatatattcttgaaaaaagtgataggtatatgcaaagactcattttagtgctcagctcaaatagtaaagttttacttcgcataagtttagatttccctgaaatacataaactcattaatttcttgatcattgtattgtactagcaattaacttagctttcagaattatggaggaaaagctaataaaagtaattatagaacaccagttttggagtaaagggtttttttttttttttttttgggacggagtctcgctgtgtcgccccagctggagtgcagtggcgcgattttggctcactgcaagctctgcctcccgggttcatgccattctcctgcctcagcctcccgagtagctgggactacaggcgcccgccaccacgcccggctaatttttttgtatttctagtagagacagggtttcaccgtgttagccaggatggtctcaatctcctgaccttgtgatccaccctccccagcctcccaaagtgctgggattacaggcgtgagccactgcgcccggcccagggagaagacttttaaagatggctaataggccgggcactgtggctcatgtctgtgatcccagcactttgggaggccaaggcaggtagatcacctgaggttgggagttcaagaccagcctggccaacatagtgaaaccccatctctactaaaaatacaaaatttagctgggtgtgacaacgcatgtctgtaatcccagctacttgggacgctgagacaggagaatcacttgaacccgggaggcagaggttgcagtgagctgagattgcgccactgcactccagcctgggcgacagagcaagacttgatcttaaaaaaaaaaaaaaaaaaagatggctaataataacctgacttaaaatttatttaaaagtagggtttggggccgggcacggtggctcacgcctgtaatcccagcactttgggaggctgaggtgggtggatcacctgaggtcaggagttcgagaccagcctggctaacatggcgaacccctgtctctactaaaaatacaaaaattagccaggcgtggtggtgcgtgcctgtaatcccagctactcaggaggctgaggcatgagaatcgcttgaacccgcgaagtggaggttgcaccactgcactccagcctgggggatacagcgagactctgtctcaaaaaaaaaaaaaaaattaggggcttatgagagaaacaataaaggttgccgtcagacttctggtttctgtaagggttgccaacccattgtttacttaggtggtaaggccactctgacaacttggccatttgtagttcattagtttggactggagaaaagaaaaaaaaatctgatatctcttccttggtcctcaagcttctcagcactcaagtaacttttgacataaataaatcatgagtagttgatagttactagagcaagtagccgtaagtatctcatctccaggaaaagctgttgctcaactttttctggcttattcttttgcttcgtcacgtggacagctggagcttcattctgctttcagagcagatttgaactgggtttgctttttcaatttagaaggtaatccacccattaatactgtgattcttctgcggttttctgggccctttctaagttttgttaggttgagacccaaaaagtttagttgggaaattaaaccagagaattcagtagaatgtctgaggctaaatctggggtctcatgaggtctctaatggccttgcacatgattttccttaactagctcagtggtcagcttcatgctattttccccatccttccagctctcccttttccattttcattagtccctctactctgtatctcagaagttctttaccttttttgtgctgtgggccaattggcaggccctgtaaagcctgtggacacatccccagaataatgtttttaaatgtatgaaataaaatacattaaaatatgaaggaaaccaattatattgaaattcagttttaataaattaaaatgattttacattaataacatacttaaatagagatgagcataaatgagactttgagatctataaaaaccataatctcatataaaaatatctaatatcagttacaatctcaggtacttctattatggtttgttgcttatctttatgattaatgtatatgccaaatttcagttcaaggttaatgaaaatgaaattataataattttattcccatccaagttcatagattaccccctgaagtatgtggctaatggaccccaagataagaacccctagtttaactccttaagctatggagttaaactctagtttgtagagttaggtacaccctattctgaaatccagtggacattgaatgtccattctcccaagcacaaatacttttagtgcatctgtgccagttttgaaacgtggtgggagaggagtcactgtctgctgtaggctgaataatgccccccttccttttcccaaagaagtccacatcttaatcctgcaaccagtgagtatgttaggttatgtggcaagggggagttaaggttgaagatggaattaagattgctaatcagctgaccttaagatatggaagttatcctggattatctggctgggacagtgtaatcacaaggatccttaaaaatgtaagacaggctatgaaagacgatatggaagagacgcaaagagatgaaatgttactggctttgaagatggaagaagtgggccgtgaggcaaagaaccctagaagccagaaagggcaaggaaacagattctttcctagaacctccagaaaggaacacagccctactgacaccttgattttagcccagcaaaacccattggactttttcagaactgtaagataatttgcattgtttaaactgttaaatttgtgatgatttgttgcagcagcaataaaaactaataggctgtcccacctcactcatttctccctagaagtaaaggtggcaaaaccaacagtatttcatgctaagttcttccagggtagtttttaaagactccatggaggcccatttatgatctgggtatagctcctgggatagatttactcctaattgtccttgtcctgttacattagtgtgatcacacaactccttagctctatcttgccttactatgaaatatactaattttccctcaaaaaatgagttatctcatcctccaagagccatgttaccttaccatttaatttggatttgacctctaaatacagttaagttttaacagtacctacgtttttgagatcctttgactgtaatgtaagggttctgtgtggagcaaagagcagttaagcaacatgaggaagaatcacaactggacaacctaaaggtaagttgcctagaatcacagcagtgcttaaagtagtgaatggcttcgtcagctctgaggggcagcaagcctgtttctgtccttctctgagctaagaaaattgtgctagtggcctggaatggcttgaggctggtaattgtggagaaatacctgctcttaacaaaagtgctctctctttctggcacacctttctagtacctctctgcaaattagtattggtctgtctgtatgctcttttaattataaacagaaacagttgaactcttaaacaggctgatcagtagaaccactggctagaattaacagccaaagggagtaagcaagtgttggatatcccagctaggattttagctgcgaaaaggaaaaaaaaaaaagcaagggcgattctttggcattatttactgtgtcacaaacagtattttcatcacagagaatagtttcttgcctagaaatttagcccctttcacacaggtgaatagttatgtgacttactgactgctaaggagttttttaaaaatatgggttattggccgggcgcagtggctcacgcctgtaatcccagcactttgggaagccgaggtgggtagatcaggaggtcaggagatcatagaccatccgtggctaacacagtgaaaccctgtctctactaaaattacacaaatttggcccggggtattggttgggcgcctgaagtcccagtttcctggggggcttgggcagggaaacgccttgaaccctgagggctacgtagcagtgtgccaagattccgcactgactcaccaccggtgcaagtgtgatccctcaaaaaaaaactaaggaatgaggtgtgcctcatacgacgtcatcacagatgagcgcctgaaannnnnnnnnnnnnnnnnnnnnnnnnnnnnnnnnnnnnnnncatagcatatgaagtgtgttataatgtccaggtggctttgtattttgataacgtgctattattatggactcaaatctcgtggaagacttgttttcttttaactgcaccatgtgaatatacgataccatgaacgtgagtccatttcttctttaaaagtggttctgctcagtttttttaaaaatctgattttaaataaaacttgataatgttattatgcctcaaaggccaactgtgtacaaggtactcttcagccttaaaaaacttaatttttccagtgctggaaataaatttgataaggacaaaaataaaatatcaaaagagttgggcacagtggctcacacctgtaatcccagcactttgggaggctgaggtggacagatcaccttaggtcaggagttcgagaccagcctggccaacatgatgaaacgccgtctccactaataatacaaaaatgagccaggcgtggtggtgggcgcccataatcccagctactcaggaggctgaggaaggagaattgcttgaacctcagaggtagaggttgcagtgagccgagatcgcgccattgcattccaggctaggtgacagagtgagattccatctcaaaaaaaaaaaaaaccaaaagagagaaagttggggaggggtactgtacaatatgcgagagaaagggttaacatacttctgtgtaagaaaaatgcagacctagggtaggcgcagtggctcatgtctgtaatcccagcactttgggaggccatggtgggcagatcgcttgaggttaggagtttcaggccagcctggccgacatggtgaaaccccgtctctactaaaaatgcaaaaaagttagttgggtgtggtggcacgcgcctgtagtcccagctacttgggaggctgaggcacgagattgcttgaacccgggtaacagaggttgcagtgagccaagaccacgccactgcacaattaaagaaaaaaaaagaaaaagaaaaatgcacacctaagtaatgccaacttagcatagaaaaataggtgaagaacataaagacaagtcacagattcaaatgaccagcaaatgaatggaaagaaattttcactactcaacctagtgaagatttttgttttgttttgttttgttttgttttgtttttttgagacagagtctcgttctgttgtccaggctggagtgcagtggctcgatagctcactgcaacctctgcctcctgggttcaagcagttctccctgcctcaacctcccaagtagctgggattacaggtacccaccaacacacccggctaatttttgtatttttagtagagacagggtttcaccatgttggccaggctggtctcaaactcctgacctcaggttatgtaggcacctctgcctcccaaaggttgtctgcccacctctgtctcccaaagtgctgggattacagatgtgagcaactgcacccagcgcaaagattttttaaaagaatgcttagtgttgctgtggatgccgcactcttacacacttctgggggaatgtaaattgttggtcttcctggaagggagcttagcagagcctttgataccacaattctacttaagaatctatcccaagaaaataatcagatgtggatttatatataggatgggtctcacagtagtatttggtggaacctggaaactgtccagcattaggggaatgattatgtcatatatccataatggagagttcagtaactaaaagtgggatttttgtacgctttttaatgacatgagaaaatgctcaggcagtagaggggaaaaaacaggatacagagttttacataggtagaagattaatattgtaagagaactacagaaaaaagattaggatagtaagtatggtcatgtctatcttcagctctcttagaactcagccatgtgtgatttttgggatggagtcccagaggatatctgagagcagttttctgttctcacaagtagttgttatctagcttactaagggaacataagtctgttttaatcacagtttgggtttgttttgtttttgaggcagggttttgctctgtcacccaggctggagtgtagtggtgtgatcatggctcactgcaacctcgacctcctgggctcaagtgatcctcccacctcagcctccagagtagctggggctacaggtgcacaccatcacgccaggctactttaaaaaaaattttttttttagagacagggcctcactgtgttgctgaggctggtctccaactcctgggcttaagcagtcctcccaccttggcctcccaaagtggtgggattataggtgtgagccaccacacgtggccacagtttgggcttttgaaaaaagttaggtggaggaagagaggtatgagtactctagttttcactgcagtatcccatttgtgtgtgtctgtctcttgagggaaagatagactactattctaacactgctccggaaaatattcttagtcattaaccttccaagttaagtggtggatcagaaatggaaagctggctttattcatctttatatcacaggaatgggtccttctaggcattttttaaatggctaaattctaacctatgccttttctgttgttttaatctcccccgtgagctactagtaaattacatttgtatacatgtatccttaatgtatactggattttaatctctcatacgtctccatttggagatgactggtgtcagtaggaagtgaatgaaatcaggtggcttcacatgagatctatgtactgtacaagagtgtaggaaggaagtagtgtggaagaaggtggttggttattggtgatgtgtgaagcaaaagggaaatgctgcttttgtatttatcctgtttctgtctttctgcagtgattttttagttttgtttttaagattgttaaagcagctagaggacaggaccactatctctaatagacttggaataacatttaagcttatacaactaagtgttcatgaaacttcattagcagggaatagttccagtagaaggattgtttgctcatataagtctaaatattggtatgtttcttttcttgttcttttttcttcaaaaaaattttttaagactagtcaagtgcagtagtgagaagtggggaaatatcaaacaagggtttcgatctgtaactgactgtgaacagtcaattgagataactcactaccttcagacctgctaacagtttcttttctgaaatctgtccccaatatttagatgaagctatttgcaaatttagagtacccaaatagattgtcatttcactttgttgggtcagaaaaggtctgtctccaaggaacaaattccctcagatttgttaaggaagtgtgtcataaaaggttccttaagccaggtcttttaactgatctgcccttagggtctgacttcacaacactgcagtgccataccatggctttcgaagccacattctcaactttcagctcaggttctgcacaatccagctttgttcactctggtaccggtctggggacccaccccacccttgtttgccgctgatcactgagctttgaataaaggctatggactgactgtattttcaccatgtgctcactaggctaagcatgattagtttttattctcctagcttgacacagtgtgttattgaaaattgtatttgtgtgagttaaggatgaaaagataaattttacttttaacagcattagaacgtagtgttataccttcctttgcgtgtcagatgggtcagtaatatccacacagctgggcttcagttaacagtttagctgaggctacagagtaagcatgggtcagagcttgagttctggactccagtgtagtatcctggtcactagaatgtgcacagtcagcatttgaaagaataaaggtcatcagctgagaaagagaaatacatttggacatgttcttttgaaaattatctgtgtgtacacatacccatgttggtatcatgtgctttggggtagggcatttgagcgaggttatgctgttagaaattaaccctaaaatgtatggacttatttttgctctgtcatgacttgggcagcacttattttactaataacgatttgctgcttattgaactggctgactggtggcaactgagggaggcattaaaagttgctttctaggcaagttgggtttgtttttcatggtaatgttttattcagagtatctctttgttttcagagtaaacatcagtctccaaagataactacatcccttcttcccatcaacaatggctccaaagaaaatgggatccatgaagaacaagaccaagagccacaggatctctttgcaggcaagtttggactcaaaagttactctaggaacctcctaaatggctttgttaagttgctgagttaaagtcaaaaccaaaaaaaaaaaaagtattgggaacataactttatgtaaagtacttttgtggaggattccaaagtacatgaaatacaggccctgccatcaagattctttcagatttagggagtaagatataaatacacaattgtttaagaaggtgagttaaactgttaaacaataacagaaatgcagttggaggaatgatagaaatactaagtcacaggagctcagaggagtgtgagaccagtgactaaagcagtgcgtgtagccttgtgtgaccaagactaggagtaagaattgcatttggtgtcataatccaaaaatgtgcatactggtacaaaacagaaacaaaagttttattaaatgacttgcccttactacttctaatacagcctgaaactttctattgtttcctttttcagtgctctttgcaacacattgaattgatttcacaatccaccaacaagctgtaacctccagtttgaaaaacactagtataggacagtttctcaaccttagcactattaacattttgggctggataattctttgttgaggggtgctgcactgttctcaacagagggggtgcttttgccccccagaagacatttggaaatggttggagacatttttggttgtcacagctggtggtagtactactgttatctagtgggtagaggccatggatgctgctaaacactctgtacacaggacaggccctcacaacaaggaattgtttagcctaaaatgtcagtagtgctattgttgaaaaaaccctgtctaaagtgatcttgggccaggcacagtggctcacacccgtaatcccagcactttgagtggccaaggtgggtggatcacttgaggtcaggagtttgagaccagcctggccaacgtagtgaaaccccatctctactaaaaatataaaaaattagctggattccatggcgcacacctgtgctcccagctactcaggaggctgaggcaggagaattgcttaaaccctggaggtggaagttgcagtgagctgagattgtgctactacactgcagcctgggtgacagagcaagactccatctcaaaataaagaaagaaagaaagagagagagagagagagaaagaaagtgatcttggaagaagcaggatttatgcaggagaaaaggaaaaaggggccccatggttgggcaggaagtataaggtatgtttgagtggcagtcagtaaagttggtggaccacagcaggacattcttggagaagtcatggaagataaggctggaaatgtaatttggaaacagatttgggaggaccttagacattaataattcgagtctggattttcatcttaatgccaattaaaagccattggcagctttgtgtaaagaatgtggtatgggcaaagtaatgttttaggaagactgacctagtggaattggaattatattaaattagttgcagtgggcagagaccagataatttttcgaaggtaatcacaaactagttcaagaatgaaatagcaaagactgaacataaggtaataaaagcaggaaaggaaaggtgaaaacttttcaaaagggaaatcaacaaaatctgattttagtgattgaatataatggatatcaaaaaaaagtggggattgaagacaaagtcaaaaggtttcaagtccaagggttgagaagaaaatggtatcattatagaaccccattctaaagaagaaactggctttgggaaaaaagtaagctttggttttagatactttaaatttgaaatgcaaagggaaatacccaggaggtgacttgaacttttctttcctacctgagggaagacaagagctggacatatgggaatcatctttctagaggtggtagttgaaacttccatgtgaacgagatcctcaaaagagtgaatggtgaggagggagaaagacaagggtggagggtaagatcttgggacgactcttacgttagaaccttggtaggaaatttaaaagacatacaaggaaagaagagattagaagaaagaatagaaaaattgagattttccacttcccttcatccctgaaatttaaatatacaatatttattctgatactgattattttttggataaaatttctggaggaggccaggcacggtggctcaggcctgtaattccagcactttgggaggccaaggtgggaagattccttgagcccaggatttaagaccagcctgggcaacgtagcaaaacctcgtctctattaaaaaataaaaataaatttctggaggagaagtgatatgaaggcaaataatgaattgtctttggttatatggcagattgaaaagaaagtgaattttctatctttgggaccttaacatttatatgatctttcattataaggagacctgacctgacagtttagtgtaatagttacccagtgattgggttttatacacatgaacatgtagatctttattagggtcatatttgttcatagtgaggattctaatttacttcattcccctactagttttttaagtagccaatacctgcctcacttctaagaaaggaacataaggtatctctagaatggaaagtctacaatgagacacttagtttaggacttcagtagcttctcagttgttttaggtatttgactgtggaaacttaaacgttctgatatcatttttaaataataaatctagtgatgatcagagtctctcatggagcctgaatgcttttccagtactcttaacaggagttcaaagagaaaagcatgttttaatataagttttggcatctttgtcacatgaatttcagtagaagatgcacagctcttcaaaaggcttttttttttttttttttgagacagggtctcactctgttgcccaggctggagtgcagtggtgtggtcatggctcactgcagccccgacctcccaggctcaagtgatcttcccacctcaaccttctgagtagctaggaccacaggtgggcaccaccatgcctgttaatattcgcatgtttgtttggttttattttttgtagagacaggcttttgtcatgttgcccaagctggcaaaaggtttttagtagctttctaaagggccaaatattttagatgagtgatacttcctgtttcatttccaaacatgtttgttaactgaattatttgtgtgggacctgcatgatgtgaatatcctacgcatacttcaactggttgcttgtttcagagacttctaatatgctaacatgttcattatatgtatagttagtcctcgaacaatgcaggcgcagtcaaaaatttgtttataacttccccaaaacttttctaatagcctactaatagcctactgttgactggaagccttaccaataagataatcaattaacatgtcttttgtatgttacatgtattatatactgtattcttacaataaagtaagctagagaaaagaaagttattaagaaaatcataggaagggaaatgtatttacctttcattaaatggaagtggttcatcataaaggttttcattcttgcatcctcacattgagtaagtaggctaaggcagaggaggggttggtcttgctgcctcagggtggcagatgcagaggaaaattcatgtataaatggacccgtgcagttgaaacctgtgttgttcaagggtcaactgtacttttttgcttgtttgttttatactcccaccccagagtcagattatgttaccacctttctcactttcctgatagggatcagatttcatttctaacagtgtggcacccctgtttgcagacttgattcacatttagtgattagaatactgatctgggacttgattatgctataggcatatatgcataaaccatcatctctggtttcgtttagccccaaatgaaaaagaagcagcagcattctttgtatttcctaagattaagatagaatacttactgatcagaccaaacccaaattgacatttatgttttctgttactaaaaaagaaaaaaagtttggactgtttaggcttagagcatctagttccactgctccaagttgaaagtgcattctttttatttgcataaaaaattttaatgcctagaaatggtacataatgctatttttaaagtcccttctctggaacactgagggaatgagtcgttctgttcaactgagtactccccagatagacaaaggcagcccttaagcactgttttttaaactgttttgagtaggaagattttcagatattacatgtcttttttcacaaattggatagcatatagtaagtataatttaacctttacaaggagatctaaaccattaggaaaaattcttaaaccatgacaaaataacagtgctgtcatcaggtgtggaaaagtgccctttcccaaatgttactgtgcttgtgtcttggctccatttttttctagcttatagctttcctgacacttgctttgacgtcatttttttcctgtcagtatgcctgcctcttctatcatattggtgtgtaaagcaaatatctgaacttcttttacaaacaattttttttcttttttggagacagagtctccctctgttgcccaggctgaagtgcagtggcgcgatctcggctcactgcaacctctgcctccccagttcaaacaattctcctgcctcaacctcccagtagctaggactacaggctcaggccaccacacctggctactgtttttttgtatttttagtagagacggggtttcaccatgttgcccagggtggttttaaactcctgagctcaggcagtcctcccaccttggcctcccaaagtgctaggattacaggcatgagccgccacgcccagccttttacaaacaattataacaagaataaatagggctcatataatgttctaaaggaatactccgaagattaaaattgacagactaaattagctggctgtggtggtatgcacctgtagtaccacctattcaggaggctgaggcaggagaatcacttgaacctgcgaggtggaggttgcagtgagcccagatcgtgccactgcactccaacctgggtgacagagtgacactctgtctaaaaaataaataaaattgataaacttattttggctgtgttgtctttttgcttatccttggttcttgtataaattctaggtaggagagggtagccaagtggttgtatttggaaagaaggagaggttgttctactaagcctgtgctagaagaacacttcccttaccttcctccccttttctccttgtaaacattttatgactttcagtctaagagcctctatgtattgagagtgcttgctattgttcttgtaagttcttagcctatacaagtttagccttcaaagactcattactgaccttcattttaaaatatcaacttcattttagatgccacagtggagctatccttggacagcacacaaaataatcagaagaaggtgctagccaaaacactcatttctcttcctcctcaggaagccacaaattcttcgaagccccagccaacctatgaggaggtgaggatctgtgctcttggtcttatcgcttttagatatttaggactgtgtacggccagtctgaagtgtagttgagtatgaaccttgagaaaatatttgttactcttgaaggagatctttatggttaatggacagccagaatccaatacaggagtctttcttgagcagagtatctattgcccagagagcacgaaggctttcagtggttactaaagatacttagtgtgcgaagcttccacattcaggagtatagtttctcctcactcccttcctagcctgcaagaggcaagtctttctaaatctggcagttattcattgtcatcaaaataagattttaaggggatacatgtaacaaagacttgtaagctggctcctaatttaaaattttgagagttggtacattgggattgttgggaatggacaaaagctgaacactgaaggatacatcttgattttattagattggtataaggttattacagggtaaaattgatagctttttttttcatatcaactctcatgatttgtcttttcttgaaaaagctagaggaagaagaacaggaggatcaatttgatttgacagtcggtataactgatcctgagaagataggtaagtggttcttaggactccttgtgatgttaggatgtggctgtggaaagcataggtagctaatttcaggatggctacccccagagttgaactagccaatgtgaagtacttcattagtatcttttctgtaaaagtagaccccttgctatgtttctaaggccagagactgctgttactcaatgcgttagtcagtcttttcttggcttcaggaagaaaaatcagagtcatcaaatactactagaatccctttttatttttattcttttggttttttgttttttagagacaaggcctcattttgtcacccagaatggagcacagtagcactatcatagctcactatcatctccagctcctggactcaagcagtcctcccgcctgagccaccccagccgcccaagtagctgggactgcaggcacgtgctaccatgccgactaattctttttttaagagatggggtcttgctatgttgcccaggctggtctcaaactcctggcctcaagtgatcctcctgccttagcctcttaaagcaccgagattacaggcatgagccaccgcacccagctagagtctctttttaaaaaccccaacaggccagccatggtggctcacacctgtaatcccagcactttgggaggccaaggcaggcagatcacttgaggtcaggagttcagccaggccaacatggtgaaaccccatctatactaaaaatgcaaaaattgaccaggcatggtggtgtgcgcctataatcgcacctactcaggaggctgaggccagagaatcgcttgaacccgggaggtggaggctgcagtgagctgagatcatgccactgccctccatcctgggtgacagagcaagactgtgtcttaaaaaaaaaaaaaaacacacacacacacacaaaaaacattatcttctccttcagagttgataagaccattttactgtcttttgagatagtaaatccaatgtaagcaccctaaaaaatacatgttctaaaattgagggacactgaacttattttttccctcaagaagtttgaaactctcatttatacacatacttttgataaccttatgaggtggggaagtctatctgtgggatccaagttgaattgtactcaaaattgaagttagatcttcaaaaagcataacacttaactttgtctggacttggatttttaggatggctttcccctctaccaagcttgcaagagttatccctgagtggagaacaataggcctcatctttccttgttctagctatagtcccttatggaagaggctatacagaacctgtcttcctaaacaggagtggtgtttatacagttaagaggacaaatgtaattctcaactcttggtctgtttggtactagggacaggaacttgttagactttatgccaaaatggttgtctttttttttttttttttttttttgagacggggtctcactctgtcacccaggctggagtgcagtggtatgatcacagctcactgcagcctcgacttccccaggctcaggtgatccttccacctcagcctcctgagtagctgggactacagatgtgcatcaccatgcctggctaatttttttatattttttgtagagacagggtttcaccatgttgcctaacctggtctctggccaaaatggtggtcattaaactattgattttaggccaggtgcagtggcttacatgtgtaatcccagcagtttggaaggccaaggcaggaggatcacttgaacccaggagttcaggaccagcctgcccaacatggcaagaccatgactctacaaaaagtaaaaaattagccctgtctctacaaaaaaataaaaaattacagaggcatggcggtacatgcctgtagtcccacgtacttgggaggccgaggtgggaggatcatttgagcctggaaggtcaaggctgcagtgagctgaggtaatactactgcactccacgttgggtaacagagtgagatcctgtctcaaaaagaaaaaaaatttttttttaatttgaactgttgagttttacttttcccagactgttggactggtaggatgtttttgagcgtcttacacagttctgtcatctaacagaaaaggaaattgaggaccaaaaaggaagtagctttcctggtagggcacagtgtggcccatgatagatcctggaccaggactttggattatatgtctagattctctcttgcttctctaatatttatggatagtctataaacacattaattttaagctagttattcaccgctttaaatccttggtggaataagatgaatgaatggcacttattctcttaaaatgtaataagtcatgatgtctgaaccaggagagggaacatactggtttcctaaggctgctgtagcaaagtaccacaaactggttaaaacaacagaaatttctcacagttttggaggccagaaatctcaaatcctggtgtcggcaggccattctccctgtgaaggtgctagggaaggactgttcatgcctctctcccagcttctggcagtctcaggccttcctcggcttgtcgatgcatcacttcagtctctgcctttgctgtcatgtggcatccttcctaagcgtctccacattgccttccctctatgcatgtctatctctgtgtgcacattccctctttaacaaataaggacaccaacctgagtggagtagggcccaccctaatgtcttcattttaactcagttacatcggtaaagaccctgtaagatcacattctgaggaactgggagttagaacgtaaaatgtacctattttgaaggggacacaatttatcccattacagagagtaatttaaacagcccatggatcagatgcatttaaacacaaatcactcttggtgataagttttcacctccttgccctgtagtctagattcttagtcatgttgatgccaagaaaccagctaattaaaatattttcatattcaaggcctgatctttataacaacgcattctgtttgtgtgggctgtttattcaacatgtgcttcttgttcctgcacacgtctaaataatttagaattcaacttttaccaggatatgctttttagagccttggtaatttgcatatgttatcttcaactctgaaattattctggaaatttacgtaaatttaaaaccttgtattactagcttatttgcagatctgtgtgctctctatgtacatgcagtatgtctcttttcatgtacattgcctaagtaaaagcagctgagaaacaaaatatctgaagatcctgcttttctgttttctctgtgtttgcatttagactttcttaactgcaggcactaaattatgggattgacttcttggacatttgaccataactattctgctgtgaatgaaattttgaatattacttctataaaataaacttagatttcttttttttttttcttttatcagtagtaaacatccttagtagtattgggtaatgttaataaggtggtttagaagagaactaaagttggtaatcagtataaaataatttctaaagtttagcttatggtttctgttttatatacacccttttggtaggggctggggaagtatagcagacaagccctgtattcctgtgtaatcttcaaattcttggtaaatttttcaaaaagcaggcatttccagccatcttactgaaaccaagttgtaatgtgggaagctgctgatccagtactgcctgctcttccttcccttggcccctcacccctcaccccagaaccagttcaggggcttaagcagctggtaactgttgacctaggttttccggtttgatgtgggaaggaatcaagggtgggggaggcagggaacaaaaccaaccccaaacaccatagtccagcactggagctgtgtctgtttggattccagaatatgtcttttcagtgctcaggatatcaatggcatctttatctccttaagtggtctaggtcaggacatcaccacagagaaaaacaatagcttgaatcccaaattatttaacagtcaaagacttcttcataaaaataattgctccaggaaagggagatttgtgtgacattaggcagccaaagtgtcttcctgccagaccctttgctcttggtgaacatgctagatcagagaggtcagtgtcccccccggcaccaatggagggggttgtgacgatatttctgaaagagcaaatcgagcccagagctagcctagggtagaactacttgtttccttttatatcagttgcttccttctcctcctgctttatacagcaagagaattgtttggttttggacagatgtgtgtaaccagcccaaatattggcatggtaacaactgatggattgtcagtatccagtgctgctttgtggagggtataaatggagcctggcctggctttggaacagagggctgactctcttgtgtaactcaaactggggctcagccagcatccatgggggcttgctatgtgccacagaggccctgaggcaaagtaggaactggattctaagattgcatataaagcttggagatgaaacaagcatcccttcttatccagggttcctatggcttttatgattcctggtcaaatgttagctggattggcactgctttggtttacaagataatcttctgctttcttgttctctcacaggggatggtatgaatgcatatgtagcctacaaagttacaacacaggtgagtccaggtgaccctgctgatgaccatcttcatagactttggtgcttataccaaggtcatcattcagattatttctgggtatctcctttgtttctttgccaacatcttcatgtttactcaagatagagcaagcctgcatccccttggtaatctcatctgggtactccagactgagtctttttaatactcttccagaaagctaacatttcagtgtgattctattaactcgtggtatatctgatacagccccatccctcttagagaaccatgtggtttggagctagattcacagattgccctaaaccatcttttaaaatcttcaatgcttctgaggtttcagagagcttttttaaatacttaaccttttgcccctctagtctgctcttcttttgtatataatattaatgcatacaaaatgtatacaatgttgtatacaagttaggaagcataataaatgaagccctaaacttaccactagtcttaaagttgagtatcattggatccacctgcgtgtttttccatcatatcccctgcctcataccttagaggtgtcctttctcctgagttgtctctcatttcctttataagaaatctttacatataaatctttatatatatatatatatatatgactgttttgctttgttttgagtttcataaaaatagtatcatgggggccggtcacggtggcgtcacgcctgtaattccagcactttgggaggctgagacgggcagatcacaaggtcaggagatcgagaccatcctggctaacacagggaaaccctgtctctactaaaaatacaaaaaaattagctgggcatggtggcaggcacctgtagccccagctgctggggaggctgaggcaggagaatgacgtgaacccgggaggcggagcttgcagtgagccgagatcgcgccactgcactccagcctgggcgacagagggagactctgtctcaaaaaaaaaaaaaaaaaaatagtatcatgctgataattgtgcttgctttatttagcattgtttctctcacccatccttgatggtcatggctgtagttagttcatataccacaaaatatttatgttttcctgttgtgaacattttctgctgtcaacatgtttctggtttttgtaactgggaactttcttgcacatctctagtacacacgtagaaggatttctctagagtatgtaaccaggagtaattcccgtgggtcataggtactgcaaatattggacacaaggaatacaaactgttttttaaagtctttgtaccaatttgtaccccatcagcagtgtataaaagttcccattgattcacttccttgccagcaattggtgaggccaacctccttaaattttgcctatctggtgagtttaaagtgaactctcattgtgatgtagccctaacttttttggtagaaatctgctttgtattgtctctctactacttgttggcctgcgtcctgtgagctctagattatgatactttagaggttactgtctacagcttagacatttcatccaattcccaccctgctcatcacctgcttccccttcttagaagcactttttgtctgtctttagtttggctgctgtaattccagcagctaatacccttaaataagtcaatgaggcttggcgcagtggctcacgcctgtaatcccagcactttgggaggctgaggcaggtggatcacctgaggtcaggagttcgagagcagcccggccaacatggtgaaaccccatctctactaaaaaactataaaaattagctgggcctggtggcaggagcctgtaatcccagccactcaggaggctgagacaagagaattgcttgaacctgggaggtggaggttgcagtgagccaagattgcaccactgcactccagcctgggtgacagagtgagactccatctcaaaaaaaaaaaaaaaaaaaagcagtgaagaatgagctgggcatggtagcgtgtgcctgtattcctagctacttgggaggctgaggtgggaggatcgcttaagcccaggagtttgaggctgcagtaagctgtgatcgcaccaatgcactccagcctgggcaacaaagtgagatcctgtctccaaaaaaaaatagtcaataaaagatgaatgggttactggttactatagaattctagctttaaactagaactgaacatttctttctttagaacaagagttcttaacctgggaatgaaactgtatttgaatttttttttctcaagggtcaccatggcttcagatgtatttgaatttaattgattgcctttataatcctatatattttttgcatttaaaatcattattctgagaagagctccttaggctcccagactgccaaaggggaactatagttttaaaaagtttaagactctctgccttggagaaagttatttgccaggtgactgaagggcagggatctgggaaatgggtttctttaatgtcaataggatgactttcaagataccatcccctatttggaatgaaattgccttgtgttttttcctgtccccaagacaagcttaccattgttcagaagcaaacagtttgcagtaaaaagaagatttagtgactttctgggtctttatgagaagctttccgagaagcactctcagaatggcttcattgtccctccgcccccggagaagagcctcataggtaagcctgtggtctttcattccacttggattgttttcctttgcattctctccaaaattcactcactgttcagtatatgagactacttctattaacagtcttgtggttagaaaagagacatttccagtgttttcctacactggaggtctagagaaaaatagcatattttggcatgttctccttgggtgcagtaggagctctgggtttagcctccagagatgttcgtttgttttctgttggtcttcaggagtcttacatgattgcggttgcctccagattgaaatagactacattggattaggggtcagaggaagaaacctcttcattttgtttgtttgtttggttggttttttggtttttgtttgtttgtttgtttttgaggtggagtctcgctctgtcaccaggttggagtgcagtggcgcgatctcagctcactgaaacctccaccttccgggttcaagagattctcctgcctcagcctcccgcttagctgggactacaggtgcccgccaccatgcccagctaatttttgtatttttagtagaaacagggttttaccacgttggccaggatggtcttgatctcttgacctcgtggtccgcccgccttggcctcccaaagtgctgggattacaggtgtgtgccactgcgcccggccaggagcctcttcattaacatcagttgatgtttgtactcagggttccatggccgcctttttaagaaaatgtttactctgcaagtcctagagtttagaaccttcagcacttagagactagttttcaaaagtggctctcatgtaaagaaccttttgttcatccctgcatataacatagaagtggccttaggctgtgtgctagcctcactgcctttcctcctgttgacacttaaaaaaaaaaaagatttatcctcttcatgatgatttatggttattttgctttttaaattccattctagggatgacaaaagtgaaagttgggaaggaagattcttcttctgcagaatttcttgaaaaacggagggccgctttagaaaggtaagtgccatgcagccattttcctgaataatgtgaggacaaatgaaaagctgaaaagtgagtctaaatgacgagacagtccattgagttagagatgaaacgtgaataaattgaagttgcacacctccatattatctcttaacttttcctgagtcgcttattttcccaccttgagaatagaccatcttctgttttttccccatcctgagtgagcaggcagtcatattcttagacaatcaatcaaatatgaatggctctgaggtttctttctgaccagttatttttccctccctttttggaaatgtcaggaatgtgaacttgaatatgcttacaaggagagacctacttaagtaccttatcttagggtactttaagtacaaaaagtacagaagacatggtatcactgccagcactgtgtgacgcccagaaccttctgaggccagctcaactaaccagatgataactgcttaccttttaggtaccttcagaggattgtaaatcatcctaccatgttacaggaccctgacgtcagagagttcttggaaaaagaagaggttagtattcagtgcaaactgaatttcataatttatatctgcccctagtgaaacgaaactagttcattccaaaaatatgtgagcacttaacatgcctagtactagactgtatcctagttttgtgtgaacccctgagagtgacaagtatttttcagcctttgaaataaaagaagctctgcccgaagtcaaaagcagttggttgtaagggtcaaatagcagcctagtattgtcttactggatcaacacagtgatctatttggcaggtccttggcatgttgtaggttacttcttggctcagattgaatgtatattttatgccaggcgggtcactggttaacagttaccacaaaccacagaactaccatgtaggaaaagtgttgattgaagtagacagtctctttcacaggctatgcgtaggctagtcatgattgtcaaaaactgaaaacagcccaattgctaacagtggaagaattaagtaaaatatatcaatataaccaaatacttgattctcatcataaacaaagtatacagaaatgttagtacatggacatgtatgttaaaagaattacaaaatttgaaacatgaaatagcatataaatacagctgtagaaacatgtaagtcattaaggatcaaaagaaacactggagtgaaatgttttatctcacaggaaagcaaactagaaggaagtaagtgactgggtagggctatcattttgctttaatttttatttttaaatttttctttcatttgtatgtagtatgtgttactccagtgaagaaaatgatactaaataaatgagggggttttctcctctaaaatgaaatgttttcattaaaaattccctgtcaaatgcttcaaatcttttagtcttttcttgtggatattcttaaatcccttctgccttttcaccctctcgtctttactccatacccctaagcagggtatgtctgtagcagcactgtggacactttgggtcagatagttctttgttgtaggggttgtcctatgcattgtagagggttttagcagcattcctggtacctacccactagatccaggtagcaccccctccccagttataacaaccacaatcatctccagacattgccaaatgtcccctaggaagcaaagtggccccaagtttagaactactgccaggccaggcgcggtggctcttggctgtaattccagcactttgggaggctgaggcaggaggatcacctgaggtcaggagttcgagaccagcctggccaacatggcaaaatcctgtctctactaaaaatacaaaaattagcgggtcgtggtggcgggcacctataatcccagctacttgggaggctgaggcaggataatcacttgaaccctggaggcagaggttgccgtgagctgagatcgtgccactgcactccagcctgggcgacaagagcaagactccgtctcaaaaaaaaaaaaaagaactactgccatagagtcctgaacactaaaatctgactttttagcatagtgtgctgtatatgctatagatttttcagcgtcctttccatgccctaggagagtactggggagactgaacagcaatcagattgtttctaaatatttggcatgcttgactactaggttatccctgaaagtagccttgatctgaatcaataattttcttgtcctcggatatttgttcactgaagaaaattcgaacacagcacgatttcagtgtcttaagacttttaagtctggttttgtacaaagtgtgctaatccaagggaacttttgacttttaacaagagtatgcttggtacttaagcagttcatgcctgggtaggcagacaatctcaatttgaggtcacctggccacgtaacaccccagtctactttttttctgtataaaatatcaaaagctgaaaatgttgctgattctttttaacatggttctttgatttttctgtatggacatgttagttgtggattcctcagactgcctttgaaaacaatttacagttcaaataatttgtctggcaagttttggcatgccatctgatggatactaattcttctgaacctaaaataggggcagcagataacttgccatccctgccttcttggtcttgtagctgccacgtgccgtgggtacccagacattgagtggtgctggtctcctcaagatgttcaacaaagccacagatgccgtcagcaaaatgaccatcaagatgaatgaatcagacattgtgagtagccctgtgcctcttacctccacctacacctcaggcttatgggtcagaacccctaaggagtcctgaaatttctgagattagaaacttttttataagatttttcagtccctttttgagaaacaactgctaaagaaagactgtactgcacccataaaagtaatctcattaaagttctgggcttttgtgtttcagtggtttgaggagaagctccaggaggtagagtgtgaggagcagcgcttacggaaactgcatgctgttgtagaaactctagtcaaccataggaaaggtaacaagctctgaaatgcacttggagctaggggaaattgttgtctctagtgaactggagatgcgagggcatgctgttccaatcctctcagccatccaagttgaaattctcagcccacctggtccttgatgttctgataaaaaaaaggtatgccctgtgtctcctggcagaaaacatgattcaaccactgtgggcattgtgctttctacctgggaggggtgcagggaagccatcccagatacagcatgacctgggatatgggcttctgttgattttgacttgatggcttacatccaaaatgatgtcatacatgcttgagctacatggtcaaaccagcaatgcgtaaatgcaaggaaaccacctgtctcctaatccttctgcatctctctttagtgaaatttgcttaagagcttgtgaaattttcccagtttgaatcttttccctctttgccttaaacatgctgataattagaaattgaaacagacagaagacccatagcatgaggccagggtaagtaagggttggcaaagtataatctggcccatgggccaaatctgaccctggttcctattgccatgagctacaaatttaggtttttacatttttaaaggaatgaatgaggggagaaaagaatctgtagcagactatgtgtagccttcaaaatctaaaaaatttattattagccggtcgcggtggctcacgcctgtaatcccagcaatttgggaggccgaggcaggtgggtcacgaggtcaggagttcaaggccagcctggccaagatggtgaaaccctgtctctgctaaaaatagaaaaaattagccaggtgtggtggtgggcatctgtaatcccatctgcttgggaggctgaggcagagaattgcttgaacccgggaggcggaggttacagtgagctgagatggcgccactgcactcctttacacaaagtttgccctactctagaacgtgcaagactatacgatgtgcacatgtattcactcttctctcttgtacagagaggctaccactcatgagcttcaacataaatataagaatagtttctttggcctgtttgttatttaacaactgggctttggttctccagggatattggagctgcttccttcaggtaggcctaacccagtgaaactcaggacagctggtgcctctccctcctgctcctgtgaccaggccacattctctttactctctgaatacagttaactgtggtgtaagtgactgggttgcagagccctcagttcccagatatgcagtgggcggcattgctaagacatgccatgcagtgtcagctgatttgtcccttttccttgtgagatcagagaggcctctgctgtcttttcctccttccagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgtaagcttctgtttccttttctcctccttcccttgatttgatttgtttttcctttgctggtccccttcccaagacagtttcatcccattatagcttgtaaataggtgtcactttttctacttttaagaggaaaggtatcctgtaaaccaagcaatctattcacctgttagctagttatcactgaatcattttgagccccacagccaagattcctagatggcatttggagaaaagaccactcttgaatttccgaataggttgccctttattgttgaggccagacagtgtcttctgtggtcctttcttgaagcaaggttgcttacagacctactctcttggtcccctggagcagtgacttcctcagtcctttggtctttgcctccttaacagtaactggtggctttgccctggttaagagctcttgctgacttccacttgtccttccagtatgggcagtcaggtaactacatggaactggcttggcattgcatggaggagtgcggccaggggactgagagagcttgtcaccagagccttcctgtgctgtgtcaccccacactggtaacattccagcctgcccctcgtcaagcacctcactctttctcctggtgatcaagcagtgtggtttccccgtgagcactcctagtgattaaggttaaggaattttgacagtagtattagctgtcgcatggcctccctaagacagaggaaagaaccaagaggaagcctggcacctacactctaagggcctaagtctgtccttgatttcgcttgggatcaggatgtgtgagcctcagagttagaacagtgccccccgctcgttccccgtccccaacatatctcccattagggagcttgtgcgttgtgtcaggagctgagctgctcccaggctgtcacttaccccgtggtggagatgcctcatagagcctggaaggttgctcattgtcctctcccattgctatttggtttgctgctaactccagagtgatgagtctacctgctatgtaattcttagaactgggcaggctacttagactggagagccagctgcaggaagggcaccctctgggggaagctttctatgaggagcattgtttggggtctctggagagcacagttcttggatatggcccccaggcagagtgagcttgtaccacaggggtgagggccttgcttagagctacatgggctggggctggggaagtgtgcctcatggcacataattgcgaatggtcttttctcagagacccttcatctgcctacctcatgcttatgagcctggtggtgggattggagagaagagcaaaggtttcttttctgctcttccctgagcatggagccggaccactgttaggccagtgggttgggcttgagtctaactaactcagataagaggttgccctttacctaatcttttgacattgaggtgttaagatgctgcagggtagcagcagtgacaatcctggggcaggtgaatttggtggcattgcattccctaaggttcaagttttggcaaaagcctgtgctgaggaggcatagacaatatgcagggaaggttggggcgtggtggctcacgcctgtaatcccagcactttgggaggctgaggcagatggatcacctgaggtcaggagttcgagaccagcctggccagtgtggcgaaaccccatctctactaaaaatacaaaaattatctgggcgtggtggtgtgtgcctataatcccagctactcaggaggctgaggcaggagaatcgcttgaaaccaggaggtggaggttgcagtgcagtgagccaagatcgcgccattgcactccagcctgagtgacaagagtgaaactccgtctaaaaagaaaatattcggggaacttttgcagggcagtgagggagccgctggaacccggctgggcggctggccccaggcacagatccttgatccaggctgctgcttggggcctattaagcaagtccgggtgggcgtggttagtcaggccagcagcttccttccctggaaatgctgattgtggtcaaggaactggaaacaaggaaaactagcaaatagattttggggagcttcttggaggccttggtagcctagagcaggtgagtgtgtggttgggaaaaagcaatgtggccctatggtggttttaggtgttgatttaaagatttgttaagctaaccttgtgcattatttgggtgtcagtttaaaggctgggtccttagggtggacttccctgacatatttcccaggctaagctaggcctctggtttcatgttatagtaccctgctgctttcccagtagtctgcatacttgtatctatttgtaattgtaaatgtaatgttggccttttccattagatgacaagttccatgaaaatgggaccatgagtttcatccactgtattcttagctcctggcacatggcaggcactcagggaaagtatgtagccttatgaactgactgatctgagggaggcacttctgtaagccatagtattggtcactggcatgaggccacctactggatccctgccatccagccctgggagtagcatgaagcagcatggcactggccttctggaagcttggagaggagtcttacccaagctttgctcctagacattaaacttcccagctgggcactaacatgtggctgcagaacctgcccttgctcagtctgtccctggtgcagctgctgggagagcctgcctcgaggcagagccagcagagctcttgaagagctggttgtgctcctcctcaaccccacccccacaggctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgaggtgagtccactgaggcagcccagccaggggtgttctgctggttccaaatgaacccagggcccatcccacccagaggtttggaaccccacagggggaagagcgctgattgagtctaaagggccgtggctgctgaggaagcctctgagaatgactccaggccttcctgaggcctagtccccctgttctttttctactctacgcagacttgtcaaatcagaatctctggcccggcatggtggctcgcgcctgtaatcctagcactttgggaggccaaggtgggcggatcacttgaggtcagaggttttttttgtttgtttttgtttttgttttagatggagtctcgctctgtcaacaggctggagtgcagtggcgcgatctcagctcactgcaagctctgcctcctgggttcacgccattctcctgcctcagcctcccaagtagctgggactacaggctcctgccaccacacctggctaattttttgtactaccgtgttagtagccaagatggtctcgatctcctgaccttgtgatccacctgcctcggcctcccaaagtgctgggattacagcgtggccaccgcgcccggccgaggtcaggagttttagaccagcctggccaaccatgtaaaaccccatctctactaaaaatacaaaaaattagccagggctgggcacggtggctcacgcctgtaatcccagcactttgggaggccaaggtgagtggatcacgaggtcaagagattgagaccatcttggccaacatggtgaaaccccgtctctactaaaaaaaatacaaaaattagctgggcgtggtagcacccacttatagtctcagatactcaggaggctgaggcaggagaatcgcttgaacctgggaggcgaaggttgcagtgagctgagatcacgccactgcactccagcctggcaacagagcaagactctgtctcaaaaaaaaaaaaaaaaaaaaattagacgtgatggcacacgcctgtagtcctagctactcaggaggctgaggcacgagaaccgcttgaacctgagaggcagaggttgcagtgagccaagatcgcaccactgtactccggcctggatgacagagcgagactccatctcaaaaaaaaaaatcttggcaggaggggtcctggctgggtctttgaaaagctacctagctgattcagatatgccttctcgtgagaactaaattaagttttccaggcctttcagccctgctggtgagtacctaaactggaggctgctggcatgtcagagccttcttgaaggaccacacttggtcccagatgcctgaaacacaggcatctcttttccagtcagcccctaaagtagccttctgccggactctgacttacgtgtggaatcctctgtgacacctcatcttacccacagggacagacagacataatgatcaattgagccctcatatgtaaaatcgctgtccaaatgtgaaggcttaataatggtgccataatatgaggtgatcctttctttcctctttcttcccagtgggagtctcgggtgactcaatatgaaagggacttcgagaggatttcaacagtggtccgaaaagaagtgatacggtttgaggtgagatagaaaatcctacttctcacttagcatgcagtgcttgttttgggagtactcttggtgttgtccaactctgttgggtaaagagagaggtgccagtaacttggcagttctcgtgagcaggcgtggccttctttgggggggtgtgtgcttgatcctaggaacagtggcaatcttacacttgtggctggaccacagcagttaaacacaaatcttgcagctgccatataccctcggtcccctgtcgtttctcctccacttcccatctcctgccctccaacaaagcctttcaaggccttggcagaccctctttggctggaaattacagctgttccacctgctgcctctactttctgagactgtgtttggccttggtcagcaataaacaccaccatcccatcgaaagggaaagcaaaaactggatggtcagtgtagaatcttgtctcctagaaagagaaatccaaggacttcaagaaccacgtgatcaagtaccttgagacactcctttactcacagcagcaggtatgtaagttgtgtgtgaccttcatcctctactgcctgctccaaaggccagctgcctcctcggggcttctgcaacaagatgtgcaggccctgcttctgaggggctgggccctcctatagtccatcattgaaaataggtcctgctgctctgacatggagcatccaacagggtcttttaccaagcaggagggcccaggtctgctgccctcattctgaggtgagttagtttttgaggacaaaccccatctccctgtaactgcttacccttcgaggagccaccccatggtaccacctggccctcctgaggctgaggcctcatcggtatgtgaaacagtggccccactgtgaggaactaactgagccaggcaaagctgtggccaccacaggggtgctccctctggggtggagccaagactgtcttcagagactgcccttgcacttggggctcagtaactgctgccttccctgtcgagagggaggtgtgaaggtcatgtggcctgtgcagctgctcggagcctgcctttgtgtggcaggcgcttggggagcgccagggtactgtgcttgattcctcccaggctggcttaggctctgccactaggtgggggcacttgcttaatgtccccacttctttgcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggtcacatgactcagaatgttggtggtttttgcttaggctggggagcagttgggaatcaggtctggaatactcctaaccaagaagttgcccaggtatagtaagtttttctctaccgttcacaagttttgtgctgctgcttccctctggaaatggggtttctttctctccgcctacctcagctacctgttctgagggtctcaatctgtttcgtattcccacttctttagggaaggagttttaaaaacatctcttaaaataagaggagcaaaatctattaaaacctattctcctgcaaaggaggcagagactttctctctctcttttttttttttttttggtgtccctatcattaagcaagagcctttctcttttattcttcctgcttccctaagctgctcagggttctctgagtcttgccctctgatggcaagtcttatatataactaaacctatttttgtcacccatcaaaacacatcctcagtagactgtgtgaaggtgtgaaggtctgataatgacttgatgctttatctccatagacatgaaagccatgccctctgcctctagatagggtgatccaagagctcctgaaccttaggaggttcaaagaagctctactgtctgtgcccaggaggtagcctgccagcaagagccctcaggagttgcacacacagccaaagggtgttcacacagatctctgccggtctagccaggggaggccagagtctcgtcagtcaaggatgggcttcccccttagctgtgtccacagctgctcaagctatactggtcagagtgggctttgaagctcctttgtgagctcgagctgctgactgccactatgggagccttgccacctccagcccctccatcccaaagacgctcctgccactggggccccaggtcctgctgtatcagttctctttggtggggggctaaggtttggggcgaggcaacctgagacaagaaaacgcagtaaacattctgattccctgtacacagatgcagcaccaggggaagggccagtggtgcaagtatttctttttaacaggtgaagtttttggaaaaagtcactctccctacccctcagtatccttaccatcaactttggttttatccttccagtctttattatatgcttgcttttacatagttgtaataatatacacataaagtattttgtatcctgcttttatcattcaacattgtacatgttataagcattttactatattgttatatatcttcacaaagttgatctgtaaagctgtgtaatttgaaggcatccatagggtgactgtaccataattttgattcatcccttgttgttggattcttggtcaggggttgtttgttttgttttattggtaactttaaaattttgaatacaatttcagatttacagaaaagttgcaggaatatcacaaagaactcctatatatcttttatccagatttactgagtgtttacattttatcccatttgccttatctatatttcatgttgcattttcttaatcatttgagaataatttgcacagataccccattatgcccaaaacagtatgcatttccctaagaacaggacattctcttctaagagaagaagagaattactttaagcattattcagtatttttttaagtattattatcaaaatcaggaagtttaacagtgatttaatactgttatctaacccatgattcatatttaaattttgccatttatcccaataatgtcctttgtagccattcttttaccttgtgcaggatcatgttacatttgtaaacgtgtgtctctcaatactgcagattcctcaactttcttttgtctttcattaccatgacatttttgaagaatacaggctattttgt

SEQ ID NO: 15890 - DNA, 144922 bp, Human
cattaggtgttgtgccccacctcaatcccaacctctttaaaagtgactatttcaccccatcccaccaaattcaaatctcaaccttttgaagttcttctcatattttaactagaattcagattctttgattaattacctgatatatgagtgtcttgaagaggcatgtgttcataaataacttagtctggttctgctttctgaattcttgctttctgttaatgataccactctgtataggtagtcgcccttagaagtgcagaattgcctttgatgccttaccctttctcaggttgttatcagttaccagatccagctgattccttcttcttcagtcacgcacgtgtctgtttctctatcgccacctctgccgacctggtcatgccacagcatgactcatctcctcaaacctcatatctcttccctttagtgcatcttgttacctgcccaggctgccaaaatgcacagttttgattgtgtattttgatttgtgcattttgattgtgcattgtgaaaatgcacatttcttcctccctccctccttcctcccttcttctttccttctttctctctctctttctccttctttcatttgttcattctttcgttctcctgacagagtctcgctctgtcacccaggctggagtgcagtggcgcaatctcggctcactacaagtgattctcgcacctcagcctcctgagtagctgggattaagggcgtgcaccaccccacctggataatttttgtatttttggtagagacggggtttcaccatattggccaggctgatcttgaactcctggcttcaagcaatctgcccgccttggcttcccaaagtgctgggattacaggcgtgagccatcacactcagctgattgtgttttctttcctgctgtggatccttctatgattctgcattgtccagaatgtacagtctaacatccttaactttgcatttaattcccttccctgagcttcgagctccagtcagatttgcttactcagggtatccaactcactttccactttcatccctgctctgcttttgtttgcaccagtttatcctcgcttgggcatcatccaggaaccaagagaaggtcagtgagcccaggctgtagtgggcgaggggagagtggcagggctgaggttagagaggggcaggatctgcgtagtcaggcccttgtacattgcattgcaatttcttctttctcccaagagcaagagatggggctttaagcagctgtgggaagtgatctgagggacagtgttgaaagatcactctgatggcagagtggagagtaaattagaggacaagagtggaagcagggggaccagttaaagctgatggcagtggctcaggccaggtccattggtgcatggactaaagtgttggccgagaagatggagggaaatggacaaatatgacattatattttggaggcaggacagatgggacttcgataggatgtggaaggggaagggaatggaagcatcaagggtaacttctgggcctgtagttttagtagtggggagacagagagagagcagcctcccggggggtggatttgagcgggatctacttgcggcatcaccttacatgtaggaagcccttcaaatgtgagcttgtagcattttcatatgtgtatgctgcgccctgtgactaaattataagttccctgaaagctgaaggccatgctttaaactactttttccaacagcaataacttagtgccctagccttgaaagatggtgaataaatattaaattgatggatagaaactgttccactctttttttggtatcatctgtaagtcctaattatttgaagtatgcagtgaaaggaattggggaaattttcattgtcgtaggtcataaataaataatgaggcttttctatttccctttgcatttggaattatttaaaatgagtaagacgtgggattccatctgtgccgtgtctccaggccagctccccacttgccgatgcctcctctctccgcagatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctaggtaaagtttaattaataatgccatttggtgatgacaataaagtgttattctacatctttatttgtgcatgatatcaggtgctcctgagatatcagtatacagctaagaactagggggaaaatgtttattatcctccaagtagataaaatagatgccacataatacattttattcacagaacagcaacttgaaatcagcaaaaaattaaaaagtctactaaccgctttatagtgatggtagaactaaaaatatatacaaagcaagtacagaaacaataccaggataaatgtccagggacttctagtgtaagggcaagaacaattcaactttaattaactcttaactctaattgttctttcagtgaagaacaattatttatgttaataaatgataggctgagtcaggaagttaaggttatattatgttcaaatcataggtacatcacggccagtgccgtggctcatgcctgtaatcccagcattttgggaggccgaggtgggcagatcacttgagatcaggagttcgagaccagcctggccaacatgccgaaaccctgtctctatcaaaaatacaaaaattagccaggtgtggtggtgcacacctgtaatcccagctactcacaaggctgaggcaagagaattgcttgaacccaggagatggaggttgcagtgagccaagatcatgccagtatactctagtctgggcaacagagtgagactctgtctcaaaaacaaaaacaacaaacaaacaaaaaatcataggtacatctaatttatttagaacaatttgtactggaaacagtaaaatggaaaacaaagttttggcattttaagtggttttttgcaggaaaatttattaatatggagtacctttacctttaattctttctgaaggcagagtaataaaagaaatacattggcttctaaatttcttaataatgccagatgtgtaagatatttatttaggcatctgaatgaactgaaaactacaaatgctttatagctaatgctgcaatatcattcatgtctttattaaaattattgcttttcattgaaattgtttctaatgtcaaactctttgaaatgtgtgtgtttttaccagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggtgagaagatgtttaaagtgaaatctttgttgtgtagcatgttggagggataagggagtattaacctcaaatttcagtttgctggtaagcagttcatgttactacacgtaattttttattgactctcttaagctttccatcctataattttatgatgaatgaaaaagactcatgtgagttaaccatcagtgattgtgaaagacttgtatggtaaaggcctgactttttcctccaaaagaacaaaaagaaaaatctgctggcacagcgaacctgtggacacagtctattctactgttagcctcaggcacacctgtcagtgaaagctttgttttggcaaatagcagacatttttagagctttctggacataccttttatcccttgaaattgtattgcttgaaattgatagtgctgaatctaactcgcctgaaggaaaaaatatgtaattgattacttacagaaataactttaaaaatatgtaatgtaaaacacactaacaggttatatcatttttattgacatgtcttaaaattttaaaaatagggtaagtggaataaaatcctctccaagttagggatttgctcttaggttttaatagtaaaatttaagtgacatctggtttctcctttccattcctagcctttcaggtctgtgtaaaggcttcatgtgctcaagacagactcacatccatggagggctgtggcacataggatcctgtggctagagtgcttactcatgtgacatgaaactgtgttgctacttgtaacagaagttcaacccattgcctcatgtccttgacatttttatttccctgaaattgttagaacactgcataccgggaatctggctctatggggaaataaatcacccatatttagacagtagagcactatcatgcttggtgtttttgtttcttttgcttttttagtttttgttcaacatggtaactgtgtgtttctaatgtttttatatatacgatctaaaccttttagaagaaaaacaacaaaaactgtttattctaggttcttcaaagtgttctgtggattctagtgtctttttaatgtgtttcttgaattcagatatctggttgtcaaaagacacgttattgtgagaattttctcctaatggtttaattctgtgctattctcatctaatttgaaaggactatgattctattgtgaagctggtagagactttagaaaaactgccaacctttgatttggcctcccatcaccatgtgaagtttcattatgcatttgcactgaataggtaagaagaaaaagttcccttccagaatgcgttaacatattattgtgtaacctgcaattctttacagagaatgtgttcactgcagcattgcaagaagtccctattaaaatgtaatattagcatatctgcttcagccccatgaaatataggaagcatgcattctcatttttttctgatttatttttcagtaaaaaaaaagtcgcacactgttggtatatttaaattcttacaggttttctgctctgtcaaagtttgtatttgctattcatattttttagaattgtaaaagttacatgaatatgatgttatctttaagcaaatacactcaacaccagatggtcattcacacaaaagttttcactagagtaaggatggttatgtctaggtgaacatagtgttagatagttattaccaaggataaaaaggaatttcttggacagaagatttgaagtagtaattgagaatagaaatgataccttttttataatagctttattgaaacatatttcacaggctgggcgtggtggctcactcctgcaatcctagcactttgagaggccaaggtggtcggattgcctgagctcaggagttcgagagcagcctgggcaacacggtgaaaccccgtctctactaaaatacaaaaaaattagccaggtgtggcagtgtgcacctgtagttccggctactcgggaggctgaggcaggagaatcgcttgaacctgggaggcagaagttgcagtgagccaagatcatgccactgccctccagcctgggcaacagagcaagactctgtctccaaacaaacaaactaaatatatttcatcaaaacaataaattttaaaacattttcatcactccacaaggaaaccctgtacccattagcagccccccttccatttccctcccaaatcccccaactctaggcaaccacgaatctactttcagtctttacagatttgcctattctggacatttcatataaatggaatcatacagtatgtggtcccttgtgactgacctctttcacttagcataatattttcaaggtctaaggaatgataactcttatagaatttttatctggttttgtgaactgtctacacatactattttaaagcatgctacataaagcaacttccttagataatcagttagtcacacgtagaaatcaagcagttcttgggtttgatttgatttttggtatcatctgtgaatgagtttgctaagttttggagcaaaagccattgaaacctaaggtcagggttttgtccctacttggctttatttactctaccctattcaaagacacagactacaactctaatctcgtttcaccaacttgaacctgcatataggctgcagggaaattggaaggattgtggatgagtaagtacaaatccatcaccattattaacacagaaactcaaaagaaatccttgttagacctagtagacatacaatgggataaaacaaaaaattaggcttaggacagaggtttacagaggactctcaaaatctaattgtttctgtcctggcaaatttctctaatatgaatcaacatgttaaatagggtttttaaaaaagaattgatctatattgcttctgtaatgtatattgaaacaacaatgttttctgccttaggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggtaagtaaatagtatataaatgagctacttacttagtaaatccatggcataaaaaagtatttgcaaatgagagtgttaaagtattattataatccataagattgtgtattatgaactaaaccttagattttattttattttattttatttttgagatggagtcttgttctgttgcccaggctggagtgcagtcatgtgatcttagctcactgcaacctctgcctcccaggttcaagcgattctcctgcctcagcctctccagtaactgggattacaggtgcccgccaccacgcccactaatttttacatttttaggagagacgggttttgccctgttggccaggctggtcttgaattcctgacctcaggtgatccaactgcctctgcctcctcaagtgctgggattacaggcgtgagccaccgggccaatcttagagtttataactttagtaaataatttgatgaaattcatttaacatagtatagtaaattgggataaatagatgaaaagataatttaagaaatataattttaaaaagatattttaaataagtaatataaataataaaatataattttgtagaaaaatttatataaagacagtttaaaagacctgaatgaaaggaaaaaatataccgagtttgtagatgagaaggcttgatattttaaagattttaattccccccagcaggggttttcatgtgatttgacaaaccaattccaaaatttatttgaaagaataaaggactgagaataggcaaagcaattctggaaaagcacaaggtggaaggacttgctccaccagttaacaagactcattataaagctgtaatgattaagatattgcagtatggctataggcatagacaaacaaagcactggaatacaagagacagcctggaacagactaagatatacatgagtctagatttatggcagaatcagcttcatgagctgtaaaggaaaggatggaatctgtagtaatgatactgggaaaatttctttatctgcttggaaaaataaaataaagttctatccccattttaagccatgcacaaaaaaatgaaatctaagtgagttaaataccaaaatatgaaaaaatactttagaaaaatatttttagaataaagtgtacaaattatgtatgactattggataagcaaagatttctttcttttttttttgagacaaggtcttgctccgtcactcaggctgtagtgtagtggtgcaatctcggcccactgccacctccacctcctgagctcaagtgatcttcccacctcagcctcctgagtagctgggaccacaggtgtgtgccaccacgcctggctaattgtttgtatttttggtagagagagggtttcaccatgttgccctgactggggcaaagatttcttaaacaaggcttaaaaacgccatataccataaaagataagactgggaaaatggtctacatgaaaattggcttctgctcatcaaagtagtagcttttggaaacagcagagtagattctattgtgcttatcttcctgttgataacaattataaatgttggaaaaaagttggaaagcactgaagagtgattaaaagtagctagaaactggaaaggttttcatccttggatgaagggcaccgcataggataaactccacatttaaatggcttttccctcaagacattccctggtctgcagggagcaggacagatagaactctagcaggaaatcacagtcttattggcctgagagtgagtttgaggctgccggaggacctggacattgagtgggataagcctttgtgtgaacaaggtgaaccaccaataatttatttaccttttattaaaaaactacatactcttaagaggaggagaacaaatccaaactctctacagcttatcatccaaaatgtctaatacaccataaaaattactaagcaacctgggtgtggtggcatgttcccattgttccagctactcaggaggctgaggtgcgaagatggcttgagcctaggagttcaagacctgcctggacaatataaaaataccttgtcttattaaaaaaaagaaaaaaagaaaaaaaagaaagaaaaactctcaactactaaagtggtgaagaaataggaaagtgtgattcataattaagaaaaaaattattcatagaaataaacccatagataaaacagagtttagaattaccagacaaggacataaaaataacaatgataattatatcaaagaatctacttgaaaagatgaacataatgggtgaaaatatgaggaattataggagatatttggaaactggaaataaccaaatgggagttctagaactgaaaagtacaatatctgaagttgaaatgtcatcaaatcagattaacagcagataggacacaatacgataaaagagcaataaacttcaaaacagattattagaaatcattgaaattgaagcagaggaaagaaagagatgaagtcattaataattccaatgacctgtggcatttagtggtctaaatacttttttttttttttttgagacgaatcttgctctgttgcccaggctggagttcagtggtgcaatctcacctcactgcaacctctgcctccggggttcaagcgattctcgtgcctcaacctcccaagtagctgggattacaggcatgccccaccatgcccagctactttttgtatttttagttgagtccgggtttccccatgttgtccaggctggtgtcaaactcctgacctcaagtgatccacctgcctcggcctcctgaagtgctgggattacaggtgtgagccaccgtgcccagccttgagtggtccagatacttttaattagagtcccaggagaggagagatatactgttgcagggataatagttgaagaattagtggtcaaatattatccaaatctgttcaaacaaacaaacaaataaaaaacagctcacagatctaggaagctcagcaaaacccaaggagcataaatatcaaagaaaattatctcttggcacatcatagtaaaattggtgaaaaacagaaatacaagaaaaggtcataaatgcagcctaagaaagaagatacatcaggggaaagagtgagtgctgaaggaagccaaaagataatggaataacattaaagtgctgaaagaaaaaaacccaatcaagcaagaactctatatccactgataatgtctttaaaatatgggggtgaagtaaagacaattctagatacatcaaaactgagataatttgttgccagcagaacttcactacaagaaatgttaaagtctttaggctgaagggaaataaaaccaaatggatctataggaaaaagcatatagcactggaaatgataaatatatgaataaatataaaagataccatcaacaaagaaatcacagggaacaatgcatgtaaccaatataggatatgtattcagtatatataaataactcctcaaaatatctttaagaaaaagagattaaaaaatgcataggatatgaacaggttattcacaaaaatggaatcacaaatggccaataaacatatttttgaaacttataaaaagattatttttatactactttacactattcagattaaccaaaatttataaatctgacaatatcaattgttagccaggatgttagagaaatgtgagtcctaatgcctgctggttgtgccataaatttctatacgcacttaaaagattttggcattattgaggaaagttgagaacttgcctcccctaggtccagcagatttatataccctagagtaaatcttagacatttctctacattaaagttttaacataaaaaaaaactttaaaaaagttgagcaaagtaagcaagtggcagaaggatacagagtacagtatcatttatagaatgtttaaaaacagtcatagagatttagtataagtatagatgcacggatgggcatcataaactccaaattcagtataatggttaccagtagggaggaagaagtagaaagagatcctggagtgattcacatgcaatttcaagtatattaaaaatattttatttcttaagctgagtaggaagtatatcggggtgttgcttatattattcttttgtacttagtatgatagggaatgtacctatcacattcccaaaatagtccttgattttaaaaaaaaattcaaggaggccaacttagtttaggaattcctgtatggtagctataattttttttttaagttttgaaacagaaatcttagcttttagaaatcttagatcattttcacactttagagggactgtttagttcttttatgtgctgccaaaacagaatacaagagactgggtaatttacaattaatacacatgtacttctcatagtcctggaggctgggaagtccaagatcaaggggctagcatctgtcaagggccttcttgttacatcaactcatggcagaaggggaaagagagagtgggcaaatggggctgaacatgttcttttaaaaggagcccactccctctatacagaaccgatttctgatgtaacagcattaatcctttcatggggtcagagccctcgtggcctttcacctttcattaggctccatctcctaacactattgcattggggattaagcttccaatacatgcttttggggagaaacattcaaaccatagcaagaactgaaagtagggtaatggggagaaggagaaacacttggggacagtagtttcctagatcctttagggaagctttggtctggacttctaaatttgtactatgaatttttattacactgctaagagtttcacagtttatcttaaccaaatttatttttaaaacttttattttttagaaatagtgtcttgctctgttgtctaggctggagtacagtgacacaatcataactcactgaagtctggaactcctggcctcaggcagtcctcctgcctcagtctcctgagcagatgggacaacaggtgcacgctataacacttggctaatttttgaattttttgcagagatgcggtcttgctgtgttggccaggttggtcttgaactcctggcctcaagtgatcctcctgcctcagcctcccagaatgatgggattataggcatgagccactgtacttggccttaaccaagttttttttttttctgctattacaaaagaggagtgtaattgtgcagcccttttattatcctgatgtttacactttatgaaaattcttagttgtgggagatttagaatcagatatttgagaagcattatgcccagtataaatgctttcgtatgtgacaatgaaatgcataggtaatccaaaaaggcctggttttcaaggtgaatgaattaagataaaaaacatctcctatgaagttagaatgcattgtgtacaaggataaaatagaagtgtttttccatttgaaaacaaaataatttagaagactgagagctttcaaggtcgcataaagttcagttaaggagcagagttttttctggttttgtttttgtttcaattttctgtacttacaaattctggctcttttattttaataattcccatttagcctaggaacattaactgcctctcaaaagagctttgtgttcaaggtcttcaggtcaaattgaagatgtcaggatttttgtgatttcattttaagctatcttatttattttctattaagaacagaaaatggtgttagagctcaaagatttctagattttttttttaaattatactttaagttctgggatacatgtccagaatgtgcagttttgttacataggtatatatatatgccatggtggtttgctgcacccatcaacccgtcatctacattaggtatttcttctaatgctatgcctcccctagccccctacccaccaacaggtctcagtgtgtgatgttcccctccctgtgtccatgtgttctcattgttcaacacccacttatgagtgagaacatgcggtgtttggttttctgttcctgtgttagtttgctgagaattatggtttccagcttcatccatgtacctgcaaaggacatgaactcacccttttttatggctgcatactattccatggtgtatatgtgccacattttctttatccagtctatcattgatgggcatttgggttgggtccaagtctttgctattatgaacagtgctgcaataaacatgtgtgtgcatgggtctttatagtagaatgatttataatcctttgggtatataccaataatgggattgctgggtcaaacggtatttctggttctagatccttgaggaatcgccacactgtcttccacaatggttgaactaatttacactcccactgacagtgtaaaaagttcttatttctccacaccttctccagcatctgttgtttcttgactttttaatgatcaccgttctaactggcatgagatggtatctcattttggttttgattggcgttttgtaatgaccagtgataatgagctttttgtcatatgtttgttggccgcataaatgtcttcttttgagaagtgtctgttcatatctttcacccactttttgatgggattgttttttttctggtaaatttgtttaagttccttgtagattctggatattagccctttgtcaaatggatagatagcaaaaattttctcccattctgtaggtttcctgttcattctgatggtagtttcttttgctgtgcagaagctcttttgtttaattagatcccatttgtctattttggcttttgttgccattgcttttggtgttttagtcatgaagtctttgctcatacctatgtcctgcatggtattgcctaggttttcttctagggtttttatggtgttaggtcttacatttaagtctttaatccatcttgagttaatttttgtataaggtgtaaggaaggggtccagtttcagctttctgcatatggctagccagtttacccaacaccatttattaaatagggaattctttccccgttacttgtttttgtcaggtttgtcaaagatcagatggtcggagatgtatggtggtatttctgaggcctctgttgtgttccattggtctatgtatctgttttggtatcagtaccatgatgttttggttactgtagccttgtagtatagtttgaagtcaggtagcatgatgcctccagctttgttctttttgtttaagattgtcttggctatatgggctcttttttggttccatctgaagtttaaagtagttttttctaattctgtgaagaatgtcaatggtagcttaatggggataatattgaatctataaattactttgggcagtatggccattttcatgatattgatccttcctatccatgagcatggaatgtttttccatttgtttgtgccctctcttatttccttgagcagtggtttgtagttctccttgaagaggtccttcacatcccttgtaaattgtattcctaggtattttattctctttgtggcaattgtgaatgggagttcactcatgatttggctctctgtttgtctattattggtgaataggaatgcttgtgatttttgctcattgattttgtatcctgagactttgctgaagttgcttaccagcttaaggagattttgggctgagacgatggggttttctaaatatacaatcatgtcatctgcaaacagagacaatttgacttccgctcttcctatatgaatatcctttctttctttttcttccctgattgccctggccgtaacttccaatactatgttgaataggagtggtgagagaggccgtccttgtcttctactgcttttcaaagggaatgcttccagcttttgcccattcagtatgatattgcttgtaggtttgtcataaatacctcttattattttgagatacattccatcaatacctagtttatgagctcaaagacttctaatgggacagtcttcaggagttgatcttgcacatgacacttactgatttatttagtaatgtaagaatgccacttttactgtagaggacctatccataacctgccattattgtcattatatccatttgtcctatttaacactaaaagggagcccccactccccaatcttaaaatggatgccttttcatgctcttgcttataaagctattttggtatttcttagtgttttgtccagtttccgctgtagtgcaaacatagtcttatttctgttggccttgtccccaacctccctttctgttggagctaagaaggaaacctgccctgtcaaggtgctcacagggaggagggctgctgaggttgtcaggcatctggccagatatacccaggattatgcccctcattagtcatgggtcccaaagggatgtttcaactgacccttgtttttttcttttgagtcataatcctctgggttttcatttcttaaatgctgttgctggcataaggagtgaggtgttagggcaggtagtcagtccctcaggcttctttccatggactgaatcattttctgttgacttgaataaacagtaagccactgatcatggaaagtttaaggataagagttccaactcaatggaaagagaacccaagcagttgtgattacaatggctcatcgaactctttctgcaattctcttttttaataatattaataaatgttcctgacccacagtggagggaggaagttttactctcctgggcatattatctgattcaagtactaaatggcagcgttttagtgctacagagagtctctaatgtgatctattttccgatagctttagttgtgggttcagaatgtgaaaacagaaaatagggggaaaatggtttagattattattattattattgttttagagcaggatcttgctctgtcatccaggctcaagtgcaggggtacaatcttggctcactgcagccttgaactcctgggttcaagcaatcctcctgtctcagcctgctgagtagctgggactacaggcgcgtgccaccatgcccagctactttttgtatttttttttttgcagagacaaggtttccctatgttgcccaggctgatcctgaactcctgggctccagatccacctgcctcacctcccaaagtgctgggattacaggcgtgagccaccgcgcctggctggtttagatttttctaagtgtgctgaattacagtatattgttgcaacaaactgtgattcttgactcttatgtgagacagagagtgaatggtttgaatgaatacatcctaatttaagcattaaaaacatagttctctaacatttgatgttttgcattgtcatttccttagttatttttgttcatcccagctcttgagaatggctgaaataatgcaatttgtatttaaaaggctgtggcatttttctcatagcttttcaatataaagatttaaatcagttaaaggcagcagtggtgcccgtcacatgctagttagaggacaacttgggctgcaggagaaggagcaagatgacagcagagagggtgagaagctgggaggagagccagctttcaaggggtgagaatttgtgactaaagagctgagacttacatcctaaaaaacagccatcaagtttctgaagtggcaaacttaacccctggagatgatccaaggaagtgttagggacaaatcaccatgccttagaggaccacagaagttctcattgccagattatctccacattttcttttttaagcaaatctaaaaagaaataaccatgaaatggttatgctgaattcctatgcagtatgacttatttagaaaattttgttatatgcagtatttgctcacataggtagaaatattaataataattgagcccttaacccttagagttcacacaacgtttctgtgcatgttactaatgagggaggcttacaggaaccttgtgaagtaggcaaggctgacatttttcttcctttttttttaaaaaaaaaaattgagatagggtctcattctgtcgcccagtgcagatcacagctcgctgcagccctgaactcctgggctcaagtgatcctcccacttcagcctcccaagtagctgggaccacaggtgtatgccgccatgcctggctcattttttattttttgtagagatgggatctcgctatgtggcccaggctagtctcaaatacctggagcaaagtgatactaacaccccagcttcccaaagtgctgggattacagatgggagccaccacacctggtcacttcttcccattttgcaactgatgaaattaaaaatcaaagaactccagtgaatttcgtgttgccctgtgattaataaaatttcagatcttattttttcagatccagtgttgtttttactgtatcctaggccctccttcctgaagtttccaggaatagacatttccagaaatgtctagatttcagttttgttgaagaagtatgaactaatgggagactcacaagggatcagtgtttacacaatacttggaaacagtgtgatcttgggcaaattacccttagaatattctgttttattacttaaaaaaaattaacacttgcgtagatgagttagaatgctcttggcatattgcaagtagcagaacaccttactccaatggatttaatcataagaaagtgtatctcctaaaacatgaagttcagaagtaggactggctcaagtgcaggttgaaccagcagctgaaagacatcagtcaggtcctttttcttgctatggccatgggtggctttgaccttgggctgcccctactcgggattgcaagatggctatggccattccaagaccaacccagattagctgcaccagtgtcgaggggaactgaggcaatgttttcctgtatctttctcttaggactgagaaaacatgcttgtaaaaacttactccagactttctttatgccttcatgcttctagtatttcatcagcctcaaactacacaaatcactagcaaagaggatgggattattacaaccggtttagactaacctctttgggatgagtgctttgttgtgaggattaaatgaaacaacatatgttaaagtcctgaaatttagtaagcctttagtgttatatccttggtgttaatacatctttagtgaataattttgtatttttttctgctcccccgccattttgtatgtctttacatatttgatatatttatccatgttcaaaatggacattgactatattaaatttcccttgttctaaaatatttctaaaagtctttttttttctttctggatgtagctaaacattttagctaatgagggaaaatgtatagagtctgcataatttttacacaggccctgtctgaatttcatatatcagggctattgtggcaccatgtaggataggcagtacttgcctgaaatcacatttgattttggagaaaacggtgttctcattcttaagggaagatatgaagtcattttgagaactctgaaaggaaattaggtgcttgtactgtattagcataatcatgtctttcttgttataatgccaaaaaagatccatagccaggaaattaaaagcattaagtctgtttttagcattaatatgttcatttttccatagtaacttggggaagaacagcgagcctggccttatcaactagttttcttttacgtcagtgacagtgctattcaaacagtaatgtgtgcctaataaagatttagtttttacattattaatggggttggctctactttggaagagttatataacaaactaatcaacagacaaataaagaccaatgtcaattttccatttgccagattagccttgtttcctttgtcttggcttcgagttatgtttctcagtgttctcttcatttttaccaccctccttccccctctctccccacctccagagttttatctcactgttgttgcattaacattatttttgcttagtcctttattgtgtctattatatgagtccccaaattttggatgatttttatttttagaacacaaggcctgaaaagtttttagtaactcagcatgacaccagctcattggtgaccagatagatgtacaggattcctaagggatcgctagttccaggatgacctaggaacttgggtaaaacacacagtgtgtccatagctgctttgtaaacaagtgccctggaacattggtctcatgctttgaccttgatttaataccacattcagcagatgatggattggatgaagctgtgttatggcatgaccaagttgaggtctaagaattcataattttttttttttaaaacagagtcttgctctgttgcccaggctggagtgcaatggcacgatcttggctcactgcaagctctgcctcccaggttcacgccattctcctgcctcagcctcccaagtagctgggactacaggcgcccgccaccacacccggctaatttttgtttgtatttttagtagagacggagtttcaccatgttagccaggatggcctcgatctcctgacctcgtgatctgcccaccttggcctcccaaagtgctgggattacaggcgtttcgttttgctttgttttttgagacaaggtctcgctctgtcacctaggctggagtgcaggggtgtgatcatggctcactgcagcctcaacctcctgggttcaaactgtcctcctgcctcggcctctgaagtatccatgactactgatgtgcaccaccactcagctaatttttcaaattttttctagagatggggtctcactgtgttgcccaggatgatcttgaacacttgggctcaagtgatcctccttcctcagccttccagatttctgggattacagtcgtgaaccattgcacatggccagaataagagtatttactatgtctctgtagaggtctcctaattgactaacaaagatggagcacctaaggagagaaactaaggcttgctttatgtaattcagttattagagaaatgagtgagagaactagatatttgccaggcattatactgaaaaggaaggagaatatggaagaataggagtgatttcacttagtgaaccaaagcgattgtttgcaaatctggctgagaacatcagaattgcttagggaattttttaacaatgtgaaattgtttgccctggaagattctgctttcgtggttccatctgacagcatagattaatcataataggttaatgtgactattccccttgcatgaaatatttagattttccccatatttgctgtcactcccttcctcctaaatctttactgttcttcatagcctccaagattaaatctacacccccagccccgccccttcctcccctgcagagctcttccaagggtatctcttcccatctttccagccttctcagaatatgggtttgcattgttgtttaaagaattggggcagttattgcaagagtaagtgtacatatgaaaactattcacccttaagagtaatcaaatttgagctattcttttttgttgtaatcaattggcaaagatgagaagagatgagaataatttatttttgcatgggtacactgtaaaagtcactctcctacactgctcttgagaatgtgaattggtaaagacctttctggaaagcagtttggtattgtgcatcaagagctttgaaataattcatgttctttgatccagttctgtcactgggaaactatcctaaagaaatggtagatatggaaacaaagatctgcaatggtgttcatgacactgaactttatggtaacaaaaaattggaagaaatctaaatatccaaaaatagataagttgttaagcaaaggatcacgtttccaaaggatggaatatcatttattcaaaatttggtggtaaaatatatataacataaaatttactcttttaaccattttaagtgtacagttcagtggcattaagtacattcatattgttatgcaaccatcatcaccatccatccacagaaaattttttcatcttgcatgactaaaagtctgtatctgttagacaacagttgcccattctctccttccgccggccctgggcaccaccattactttctgtctttctataaatctctctgaatttgactactctaggtacctcatgtaagtggtattatatttgctttgggttttgtgtgtgtgtgtgtgtgtgtggctagcttattttgctaagcataaggccctcaaatcttcctctgcattgtagcatatgtctgaattttcttcctttgtaaggttgaataataattgtgttgtatgtatataccacattttgtttatccattcatctcttgatggacatttaaatcgtttccaacttttttggctattgtaaatgatgctactttaaacattggtgtataaatatctctttaaggttctacttttaattattttaagtatatacccagaagaaaattgtggttttgaaaaatgtttaatagtaacatgcgtcatgatatttcatcaattaaacagcagatcataaaaatagggtgattctctttttttggaaaaaaaatatgtgcgtggtaaaaggactggaaaaacacagttagaacttggggttcttttatttttgttcctgagttttctattataacaagatatgtacacaaataagtagtctgaattggagggttatacccccaccagcagatcacagcagcagggtgattcagcattagtttcttcacatgctgtcctgctttgtttctgagttattttatgagtgttaatttcagaaatatccctagagataaaaaaaaacatgaaattctaattaaattacctttgtgtctcatagaaagaatcacaactgttatatcacaaacaaggaaaaatagcaagaacttgacttgagctcagtgtcttctttgttggaaagtacatattccagctagaaatgatcagtccaagaatatttcctttatttttgatttctgttgaatgtctcagtgcggatgcaaaaagtgaaaagtctttttttgtgaagacttcatcactctatatcaaagacttaactgcttttaagctagtttgcaatcaggtgacaaatacagtactaatcataaggcaattctggaacaaaaacctattgctttgaaagctcaaaagagaagtttacatcttttaaatgaaataatgaattaaatagtgcaaattatttgcccccttttggctgggtgcagtggctcatgcctgtaatcgcagcacttcgggaggccgaggcatgtggatcacctgaggtcaggagtttgagatcagtctggccaacatggtgaaaccccatctctactaaaaatacaaaaattacctgggtgtggtggcacatggctgtagtcccagctactcgggaggctgaggcaggagaattgcttgaacctgggaggcggtggttacagtgagccaagatagcgccattgcactctagcctggacgacagagcgagactccatctcaagaagaaaaaaaaaattatttgccccctttcaacaaatatttagtgctaaaataaaaaaaaaatcaacaggagtggaaataacttcgtatggttactcaaagatagccactaaatttctcttaatatgtaaatgtatagttctctaagatttatttccttcttaaagtcttacccaatttagcttcatcattttatttctctatctttatagatagttttgcacttttaatcattgtttagatttctttatgtatagatttacatattgttcatatttatgtatccttttgctaaactgtgacattctcagcattataaaactcgtttggtgtgtttttatgggtgcatttcagcagtactgccatgtaagtctttttgaaatattagtcttttgttttatgagagtgatcaaatatattgtgaaaaataccatttttttcttagaatatatcagcatctgtttctgttgtatatagaatacaagttttatccttaatataaaagcaatacaagctttatccttaatataaaagcaatatttatttttcctgtttaattcaactcccttttattaaaaacaaaaataaaaaaaacccagaaaataatgaaaaagaactacaaaaattgttagtacaaaccaaagggtaggcagagccatacaaagaaaagggcctaggcttatggaatccagcagaactgggtagagttcctgcttgaccacttccacactgcataacttaatattcctgtgcttcaatttccttgttggtaaggaattccccctactttaaagagttgtcagaattagaagtattatgcctgaaatgtctcattcaatgccttgtacctggtaggtgctcagtaagcagaggcaggtactatagattcttttaccatttgatgttaatcacagctttctttgatagagaccgtcatctatgctgttgtattattgttagaactacactgtcctcatttgtaggaagattaaatattcccacccttgacaccagacttggttgtgtgtcttgattgatgtgcattctaagcagaagctttgagagcaattttgtgattgtaccacatgtactttttccttggccatttccatgagaaggctgctccttcaggctggatcccagatggaagacaatgtggagcagagctgaaccatgacacagagttcatgacacagacatgtggcatgaacaggagttgcaagccactgggatttgcaagttgtttgatactgtaacactcttaccctaaaatgtctgagatagcatcttcagttaaagtggagattgccaggtacggtggcccacgcctgtaatccctgcactttgggaggccaaggcaggcagatcacgaggtcaagagatcgagaccatcctggttaacacggtgaaaccctgtctctactaaaaatgcaaaaaattagccgggcgtggtggcgggcacctgtagtcccagctacttgggaggctgaggcaggagaatggcatgaacctgggaggcagagcttgcagtgagccgagattgcgccactacactccagcctgagcaacagagcgacactctgcctcaaaaaaaaaaaaaaaaaaaaaaatggatatcatcattattttaacatctacaaaaccaacaaaatgagccgggcacagtggctcatgcctgtaatcccagcactttgggaagctgaggcaggtggatcacaaggtcaggagttcgagaccagcctgatcaacacagtgaaaccttgtctctactaaaaatacaaaaattagctgggcgtggtggcgtgcacctgtaatcccagctactcgggaggctgaggcaggagaatcacttgaacccaggaggcggaggttgcagcaagctgagatcgcaccactgaactccagcctggatgacagagtgagactctgtctcaaaaaaaaaaaaaaaagaaaagaaaagaaaaattaacaaaatgataaaatacatatgaaagttaacacaaagaaattagagaatgtaaatatggcaataataagtatcaacatgcttgctatgactaagcttcaagccaatatgctttttagtgatagaatgaaaaaaaaaatcatataccaattcttcagaggaagttaaactctccctagcagtaaattaaaggaatttctcatgacagaccctgtgtaaataaaatctacataaacaacaatcaataaaagctatataaacaacatcagtatttttattgaagtcgtgaactccaataacattaagatgtaacacagtgaataatgtaacacagtgaaagtgatatgcaattcacttgtttaaggtggtccaaggatgtagtttctagtaatatagttttatcaagatcagagtttagatcactgaaggaagttaaaagattatttgtatcttgtatgaactgacgtatttaccagttatctcagcctggttcttggtaggaagtggatgcattctttcttcatttcacaagtatttcataatcacctgcagcgtgtcaggtattctgatgattcaagtaccggagattcattggtcagcaaggctgttaaggttcctgctcttatggagcttacattctcttggagcagatagacaacaaaaagaagaatttcagattattataaattctgttaacagatatggagcaattcagagtctccattttttccttgtgtcatgcttacatgtgattttaagaaattttttcattttacccatgttgttatatttattggcataaagttgttccaaatgtcctttgcttttaatgctctatcatctgtacggatgaccgtctttttgtttatgagggcttagcgttaatttttatttctctctctttcatgagaagtctgcctaggagtttatcaactttattaatttttgtaaagaaccacattttgacactattttctttattgcatgtttgctttttatttcactgatttcagctttctttattatacccttctactttgaagatgatatgctgttcgtttactagatgaaagcttggagcattgattttcaaccttgctccttttccaatatctacatttaaaggtataatttgttctgcatcccagacattttatctattagactttcattaccttatatataacaacatatatatattgttcagtttaaataccttctaattttcagtatgatttcttctttgacctttgggttatgaactgagttgcccaatttccaaatatatctttctttattgttctgtggtttaattatattatggtgagagaacacatttttcattatttcagtcctttgaaatttgttgagaagtactttacggcccagaatatggtacacagttgttaggtgtagtgttccaggtaagtcagttagatgaacttggctaataatgttattcaaatctatatcctcactgataatttttgtctgtttgtttgatcatcactgagaaagtgttttaagatctctacctatgattgtagatttctatatctgcttttttagttctgtgcatttttttctgtatatgttttgaagccatgctattaggtacatttgggactgttatattttcctattgaatttacctctttatcattatgaaacgttccttttttctcttataataatttttatcttaaagtcaattttgtctgatattaatatataatgataacatttatttaatatttggatggtacatctttatgcatcatttcactttcaacctacctgtgtcctaatacttaagtatcttttctatataaaatgcttgggaccagaagtgttttggattttttttatatttttgaatttgggaatatttgcattataattgccagttgagcatccctaatctgaaaattggaaatcagaaatgctccaatgagcatttcctttgagcatcatgttggcactcaaaaagttttggattttggagcattttagatttcagatttttttattagggttactcaacttgtatttacagtgtgcctttttaaaatgaatatacttgcattttttgctgttattgttcagtctaatttgaaaaatctcttattaggaatgattagatcatttacatttaatgtggcaactgatagttggggctatatcaataatattgactatttgtcttatttattttttattggtcttacatgttttttgttcttttagtcctccattcttgctttatttttattaacttagtattacattttctcctacattagcactttagtaatagttttcatattattctttgagtattccctagagattacaacctgcatcctcgacttttatagtctaccttacattttgtattttactgcttcctgaacaaggaaagaaacttggagcagtttaaataatcaatagattttaaataatttttatattttagatctagtcacatatttactctttctgatgctctttctttctgaagttcagtgcttccaaatgaaatcactttcctttagtctgaagcacttttagtatttttttatagttcagatctgctggcaactagttcccagtttttgtctgaaaatatcttttttagacttttttttttcttttattactctaaagatgtcactacgttgtattctggcttccatagtttgtacggcaaagtctactgtcaattttattgctcctttgaaagtaatgtatcttttttctctggctgattttaaaagattttccactgtgttttcggattttggtaacatgttttggcatttagactataattatcttattttatcctgcttgagttttgctgagcttcttgaatctgtgggttgatgttttcatcagttttgaaatgtttttatccattatatctcacatatttcttgtgctccatattctctttcttctctttctggggctacagtaatacataggttagaccatttaactgtgtctcctctgtttcttatgctttgttgttttatgtgtgtgtgttttcttttttttttttttctatatctctgcttcagtttagataccttctattgacatgcattttagttcaccaaaactgtttttccactttgttgaattaacttgtaagcccatacattgaattattgttttcaggtattgtatgttttggtgctagattatgtgatttctttgatgctgattcttttttgaagttgtttatatcttttatccattttatctttttctctatattctttaccgtatttgtcataattatcttaaagtccttgtctataaactccagcatccgaattatctgtaggtcagcttttgtgtgtgtttgcttttgtttattggtcacaacttgctggctctttgcatgtctcgtatcccagacattttgtattaaaaaactattgagacttggagatgattttattttcactcacagagattctccttttcctctgttagccagatagggtaagaagctgattacttcaacaaatgcagttgagtcgggttgggtctgggttttcattttcattgaccttatctgtttctgttttatctctgcttcttagctgtgaccctcttgaacttttaattgataggcaggcatatttctatcttcttatcccttaaatactgtcggagatttcttatctgtccttgagagttttgtgtttagctctttattctccaaaatttggtagattgctttttttctttttctttttcttttttttttttttttgagatagagtctttctctgttgcccagggaggagggcagtggtgtgatcttggctcactgcaacctccacctccggggttcaagtgattctcctgcctcagcctcccgagtagctgggactgcgggcacacaccaccatgcctggctaatttttatatttttagtagaaataggatttcaccatgttggccaggctgatcttgaactactgacctcaagtgatccgcctaccttgtcctcccaaagggctgggagccagtgcacccagcccaaaatgtggtaaatttcttaaagggaagacttttttcctatggttgttgtagacttctttccctagtgggacttttctcctaaacactcaggagatttcactctgtcatcccagctctactccacaccctagcctcctgtacaactcagcattcaacgaatgtcctgtgaagaaaacagcaacacatttgggactccttcgggtttcattctgtcgtgccaaaccacgcaattgtcaagaaatccactagtttctctttttcttggtaaagtttaaaatagacagagtttctctgcccatgccaagcccaagcctaatctcagggtcagaatcagcaaatgccccatgaaagacaacagcaattcagctcatcttggaaggccacttccctctttggagtttatttcagtgattttttttgttgcttccatagatctccagtgtctgcaaaaatgtgtttttgatatgtattcttatttccccctaattactgaagcagaagtaatggctcccaagtagacgactacatcttacttggaaacacaagctttccccctcacatttaatatttgtccacaatacaaatggctatgtaggttcccaacatttgtataatattttattccatgttatactttatagtattattggaaatttagggtaatttttcatcttgtaacaaatgcccttgtaatgaaacttctgattacatgtttaatgttttttcttggtataaatttgtaaatgtataattgttaagagttatacatagttttaaaaaatttctatagttggccgagtgcagtggcttacacctgtaatcccagcactttgggaggccgaggtgggcggatcacctgaggtctggagttcgagaccagcctgactcacatggcaaaaccccatctctactaaaaaaaaaaaaaaatacaaaaaaattattcgggcatggtggtgcatgcctgtaatccgagctactcgggaggctgaggcaggagaatcgcttgacccctggaggcagaggttcctgtgagctgagatcgtgtcactgcgctccagcctaggcaacaagagtgaaagtccatctcaaagaaacaaacaaacaaaaattctatagttttgatattggcaaatttctgccaagaatactgtacttctttgcttttacagtatgggagaattcccacttcctgcagtggtatactaatgatatatgccaggattttatttctttcgtaatatacctacatgctcttttaatctccagaaaacattaagactttttcctcaatacagtactcaatttagtctcatggattgaggggagctcaagaaaaatgtgaattattaattttattggtgtttatcttttcatttaaaatacaaaaatatatattgtttgtggtaacagaaaaacagatataaacccaaatattcatttaggttggttttggcacataggagatattcagccaatatttattgattcatttcgatatgtcttcatttttgcatcttccttttcatatctttaagagacatttcatgttctttggtttcagggaaaatgccataatgtatttaatgaaaaatattacgtatcttgatatgaattggtagaaagggaagtgtctacttctttcttctcctaaatccttttttgttgggacattatacttgcctctgaacaaagacaaagaactttgagacttatgttagtctaagacctgtaagttgtgacttgccttgatatagtttcgaatatctgtagtctaggtgtatatacttttttcattttagaatggaaacatgtatacttctggaaacattaaaaaatgctttttaatcacctatggtgatgcagtggtaccttttttcatattccataggtacataactatcagagccaactagttaagattcatagttatttttgcttccattcagagatgcttgttctaattaaagagcaagacatttaaaaaagagacatggtcctcaatattcagaaaaatatattttttgttttcatttgatgtttaatttattttaaattatggaaaattttgagtatatataaaagccaagaatatacatttattgtgcctacaatatacactattgtgcctatcactatgtttactattcctgtcttttatttacacagttatgacttaggtgagaatgcttttatcttggaattataatgtatttcttcccacataacctttttttttggtgtcatcaaatggtcatttgttagatatttagttcttatattttcttcagcatgatttttttaaaaataaaagtttcatttttcatgcattggcctcaggcagttcctcttagtcactagggcatttattttatttttctcgttttacatatacctaagtgaaattatattgaatatcgttgcccgtttaatgatgcatgtgaggaaacccttaaaagtatcctaggaagtattaccttgaaaataaagtaaatattcaaacactgaagtccttttaaatattgaagtattttcaaaggttgatactcggttttatgcatattcagaaaagtctttttataactctctgagccaaaattagtatgtagagacatactctacatctctgcttttcttaatttcatcctataattgacagtttatttcatttttatatcattcttatggaattgatcatttcagtgtgttacctatcctcagtgctctgtatatttttaagagtttgtaaaaactactttaaaaaatatgtgcggggttctcatttttaaatgtttattgtacacacacacacacacacacacacacacacaccctgaatgatggcttccaagtagacgactacattttacttggaaacactagttttcttctgacttttaacatgcttctacaacataaatgactacatagctttctaacatttggaatatatgttattccatatcatactgtataatattattggatatttagagtaatttttcatcttgtaacaaatgcccttgtaactaaattttcacattcacatatttctggtagatggttgaagagaggattttttttaaagactagggttactaggtaggttgagggtgagctaagcgggggaaagcaacagagctgtggacaaagataagcagtttctgaagcgttaagtcctaatagcacaccagattctggggtgaaggccagtgcaatatttttacttgctcaggcattggagttatacaaacagaagctattacacacccagggtttcatgattgagaaagttaacttgtacatttgtggttttttataggttcaaaaaggcatttgaatctgagccaacactacagtcaggaattaattatgcggtcctcctcctggcagctggacaccagtttgaatcttcctttgagctccggaaagttggtaattacaacttgatattttacatggaaatcaagaaactggacccaacttggtgcaaagaaaaagaatcatgaatagataaatcttttgctttctgtcttttcatacttcccaaagagaaaaaagaaacttattatatctccttgtttggtgtttcatactgttgtacagaatcctgatattaggacataattcagtttttaatttatcttacctgtttctaaaagtccccctggttaatattccagctcaaactaatattgaggatatgggttctgcattcaacccccaactcctaaataaggttactgttttgtgagacatcaggaatatttcctattttagattgcgcttttgtggtgcttttttttcaaaaacctctgctgtttcctttatctgtttctcaagcacacctttccctatgatttcaccggtgttgggggaagagcctcccaaagccccaggagcaacaggttaagcaaatggtggtcttggtaggaagtaggctcctcagaccatctctgaatcatagccatcgacagaatgtgcttttgtcccttttatctgtagacattatctcatctgctgcctttccctgggaatttaaagaagttagggcatcttagtgaacaaatttcaagtgattttcttggttttggctttgatcacattttttaaagattctagatactggaatcctgtctatgggaatcatattttgctccgttgggtgtctaacgacctcctttcagagaatctttccaactcttttaggaattactacagacatagaaatattcagccttgtttttcatagggaaaaaataacacgttcatcttagtgaagctatgaattgtagaagaaactttttcttcaaaataaaagaaaaatttttttggaaaccaggtttcactctgtcactcaggcaagggtgcagtggtgcgatcatagctcactgcagccttgaattcttaagctcaagtgatcctcccactttggcctcctaagaagctgggactgtaggcgtgcaccaccacagctgactaattaaaaaaaattttttttataaagacgtggccacactatgttgcccaggctggtcttgaactcctggcttcaagcagttctgccacagcctcccaaagtactggtattacaggtgtgagccaccgcaccgggcccactttggcgaatttcttgttacttttcttaaagagaaatgaatcctagactttaaaaaaaagacattattttggaagagcttgtatctttatgtaatgttctggagaatctctgaagctaaataaagtcagaatatttatttgtttatttttttaaatgcccagactaaaagaatgataaagtatttattactgtgggatagcaggggtattaaaggcataaaggtctgtttgaaataattttttttttcttctgagacagggtctcactctgctgctcagggcacaatggcacaatcacagctcactgcagcctcgacccccaagacttaggtgatcctcccacctcagcctcccgggtagctgagactacaggcatataccaccacacccggataatttttttgtattttttgtaaagatgaggttttgccatgttgcccaggctggtttagattgtgctttcttagtgcttttttcaaaaacctctgctattttatttatttatttatttttaaggttggctctcactctgtcacccaagctggagtgcactggcacgatcacggctcactgcaatctcaacctcctgagctcaggagatccttccacctgggcctcccaaggtgctaggattgcaggtgtgagccaccttgcccagcctgaaataattcttttgattggttcagtgaaatcggagaaggtacattgcaatttgtgctgttcagaaattatgattataataaaattttgtgtctaagactaaattaaaaactctatactagccaaaatccctatatcagtgttctaaaaatatttttattgctcctttgttgcttttttcattgtttttattgatatgcaatagatatatatttttcagtatatatgttctattttgatacagtcatatatttattgttctgttcttaactcaaggtgaggttttgttgaagcctctaaattgttgcaggaattgacagtgatttgcatatgtaggcaaagcaatgacaatggtttgaaaatgtacttattctaaatctcattttgaaggtaaatacttattaagatggtcagaactctgaggtttgaggaaatgtgattaatatgtaaaagaaacatgttaatttttttcaggaagaactcacttgtaatacatgttaaacaaacatttgaaaacatacaaagttagtttaaaattttagaaattgcataacatatacagacttaaaatatggcttatcagtgaatttttagctatcatgagaactgttttaggcttctaaaatactgtgatatgcattctaaattgtattgtccttcaataatgaaaacatagttaaaactcactaacttagattctattcaattgtaaattatgctaatcaacatagattgatctaaagttaatttttatatggtaagaggattaaatggattttcgaggaaagacaagttggttaaataaattaatagtttaatataataatgatgttaattgatagtatataataaaaatgagacaatatacttggcatattttaaagatacacctagtttcattctttctttaaatgctccaatcagcttttccagtaatttatacctcccattcctcctgttggcctctgcaaacatacaaattattccgaattaccgagttcttataataaccagacatttacttatgaagtcccttctttaagatgctttttgaaattttgatttatttataaagggtaaacaattaagatgagcactcaatctgaagctccctaaatgtattatcttaagatctcaaatgtaagaaatgattcttaactgtcatgctgtgttgcccaaagactcttaattctagttgtgtgtttgtttgcggttatgactaattgcttcatggatctgtgttttacttttccagtttttgaagaatcactgatgcttaggctatttagagctaggatttaaaaacacagagccatatcctacatcttcttcctgttttcacctttgcaagccttaaaaataatattcaaactttagctaaataacaagatgatgcttccatcttctgtggaattttccaattgtgagacattttatgggtgagagtcagacttagaggtttgagtctccaacagtaatgatgatacagtaaaagaacactatgtttggaacttagacaaccactatttaaatatcattttcagtgagcattaaaaaatattgaatagaaaatatatattactgtacataaaaatccatgaatcaatagagataatcaaggaaaagtcatcagaacaaaatctatcaccaaccactgaaaaactcctttgtcacctatggaagtgaccaacttttccgaaaattagaagttataaggaaagaagtaagtacttttccttcctctttcagagatactgtagttcatcccgttgatgaaatatagcacttcttaggctgggcgtggtggctcaggcctgtaatcccagcactttgggaggcggaggcgggtggattacctgaggtcaggagttcaagaccagcctgatgaacatggtgaatccctgtctctactaaaattacaaaattagcccggtgtggtggcatgcttctgtaattccagctccttgggagactgaggcaaaagaatcgcttgaacccaggagacggaagttgcaatgagccaagattgtgccactgcactccagcctgggcgacaagagcgaaactccatctcaaaaaaaaaaaaaaatacagctcttcttgagctatgctacatagtaaatgtattattcttccagagaatgtattcttcaaaagtacactattatagttaataaagtaatgataaagctgataatgagagtgatgttgaaataattgattctggcaaggatcatcaatttgaactaaaagtattaaattgaaatgcttatttaaaaaaaatttacattttaccccttttacatgataccaaagctaactcatagataacttgttagtcacaaaggaacaaatgtacctgtagaatgggaagacccagctgtcagtgatccatccttgtatcactaataatagggtggcgagacatgtgcccttaggactttattatgataactgtgaagtgtacagcagctcttctttttgattttttaacttttattttttgagatagagtctcactcttgtcacccaggtctggagtgcagtggtgcgatcttggctcactgcaacctccacctcccaggttcaagcgattctcatgctgcagccttctaagtagctgggattacaggtgcgtgccaccatgcccaactaatttttgtagttttagtagagacaggattttgccatgttggccaagctggtcttgaactcctggcctcaagtgatctgcccacctggcatgagccaccacatccggccgagtgtacagcaactcttgtgaaatattgtcaccaaaaatgtttaacttgaatcttaagatctaaagttctcttaataggaatcacaagctctagagaaataagtcaaataatcccaagaagttacatcagacagatcagaaggtgagcacactagagcagcagtccccaacctttttagcaatagggactggttttgtggaagacaatttttccatggaccaggggtggggggtggttcagggatgattcaggcacattacatttattgtgcactttatttctattgcattgtaatatataatgaaataattatacaactctccataatgtagaatcagtgggagccctgagcttgtttccctgcaactagatggtcccatctggggggatgggagacagtgacagatcatcaggcattaggttctcataaggagcgcacaacctacatcccttgcacgcgcagttcacaatagtgttcacgctcctatgagaatctaatgctgttgctgatctgacaggaggcagagctcaggcagtaataagagcaatggggaatggctgtaaatacagatgaagaagctttttgctcacttgcctgctactcacctcccgtgtgtggccccattcctaacaggtcacagaccagtaactgtccatggccctgggattgaggaccctgcaccatggcactccttgtcttttcgaaaagtcagggtcataaaaaaaatgtgtagagggattgattagattaaaagagattgaggccggacatggtggctcatgcctgtaatcccagcactttgggaggccaaggtgggcctcacttgaggtcaggagttagagatcagcctgcccaacatgatgaaaccccatctctactaaaaaaaatacaaaaattagccgggcgtggtggttcacacctgtaattccagctacttgggagactgagacaggagaatcgcttgaacctgggaggtggaggttgcagtgagcagagatcatgccactgcactccagcctgggcaatagagtgagattctttctccaaaaaaaaaaaaaaaaaaaagtgagaaatttagagacataaaaactaaatgcaattaatgttccttgattggattctggtttggaaaaaaaaactataagagacatttgggagtcaatccaagaatctgaatcaggactagatgatagataatatcagtgaattgtttttgttaggtgcaataatggaatagaatatataggaagatattttaggtatatgctgtaatatttcagagcggaatgtcatgatgtctgtaatttaatttgaaatggttcagcagaaatattcagggagatgaagcaatagcaaaatgttaacgattgttgaaaatatggtcattcattgtagttttattttgatgtatgtttgagattcttcatgatggaaaattaaaaaggatctaacctccaccacttataaggtgtatggctttagacatgttgcaatacctctctgggctttatttttccttactacaaaagggagataatctctaactcatcgtggtggtgtatggattgagagagttaacattttcagtacacacagtgctaggcatctgagtattcagtaaagtctgccattttccactaaaacagccttgaacataataacagctgcaaggtgataagactatgacaaaaagtaaatgattaaaaaatcctcagtgtaagtcaaccaattttaatgacagcattgtcagcatttaaattgcataaatatgcaactgaatcaaataaatggtgaagtggttgttaacacagcaatgacatactgctcattgcttaaaaattcaaccaaaatatttttaaatagagaaaaatattgatctggaaggacttggttaaaaaggtacaactgaacatcacgaattgtgctttattaatttttctgtatggatgaagagcctaaaaatattttagtctggaaccaagtataacagtactcctgaaattctatcctatggaaaaaatcctaaatacaaaacaaatttgatgcactaagatgtttatttctatattctgtgtgggtgtgagagagaaagagagaggaagagagagagagaaaggaagagagagagggagagaaaggaagagagagagggagagagagaaaggaagagacagagagaacggacttctaaatataaaaaattagagccatgttcttaactccatacttaaaagattaatgtcttcatgtagaaacaagtttgtgcaaagagcataaatgctcattcacaaaagaaatacaaacatgaaaagagagccaatctcagcggttaaaaaagacaatgttcctttttttcctctgtcatattggtaaagatgaatgcacgtgatagtccccctcactgggaagggtgtgggtaagaccttattgtcagatgcctccagtgaaagtataaattggtacagcattttctaagggcaatttggcaaaaatgcatcaacactaaaaatgggcatgtcttctgtccctaacaaatccacgtttagaactgtattataaagaaataattgagcaaatacacaaagctgtgtgtacaagaatgtttagagtaataaaaatggccacccatctgcatttgggtaaataaattatgatacatccatatgctaaaatactaattgacatcaaaaatatacattttatccaaatgctggctgggtgtcacaatcatgtgataaatgtatggcaaggccaaaaccaaatatcaccaccacaaaatgaacttctgaggttcaagagtgcatctgaaattttattttaaaactattattgggtcaggtatggtggttcatgcctgtaatcccagaactttgggaggccaaggcgagaggactgcttgagcccaggagttcgagatgagcctggcccacagaatgagaccgtctctacaaaaaaataaaaagtagaaactacaaagaaatttaattagccagttgtggtagcatctgttatctcagctagcaggtctaaggcaggaggatcacttgagcccaggagttcggctgggcaacatggcgaaaccttgtttttccaggaaaaaaaaacaaaatttagctaggtgtggtggctcatgcctgtactcccagctacctgggaggctgaggtggaaggatcacttgagcccagaaattcaaggctgcattgagcagtgatcgtgccactgcactccagcctgggcgacagagtgagaccttgtctcaaaaacaacaacaacaaaattatatccagatagaagaccgtggatgttgtcctatgcgtgtgtaatatttttttttcatctcgtgaaacagcagtggcaaagctgttctctctttaccctcacaaaatgtgaagaattcccaaatggacattttcctgaaatacttgtggtttgagtggaattatacgataaaaagtaacatgaaaaattttaaatgttattttgtttctttcacagataattttcaaaaagctaaaatcatgactctcatcaaatataaaatggacacatataaaatcatgaccctcagcaaatataaaatagacacatagaaaatattttatttaactcaactaatatggaaactagtaagatggaatgtccagttcaaaaaacatttctattcatagacaacaaagaaatgttaagataagatatctgagtttgattaaggaaaaaaaaaaaagctgttttgtgtccacaggccataaatcttagggatttatccattccactctacagaaatttgcatctctactggacaaaaatctgcaagttaacaagtaaacttctgtaagtctgggacctttaataagtagtacataatgagatgaactagcgtcactttcctgagatagtccttgagtggccttatcttcccatatgatattgaaatgatatatcctacctttttgccttatttctaaatctcagataattttcccaacaatttaatgtgatggatgttagtggcaccaaacaatgctacaaggatatatttttttaagcaaacaaatacttataaaatgcaaaaataatacaagacatagtagaattgaaaatatataatgaaacattaagaacatagaagtgccaaaacagtgttgaaaaagaacaaagttggagtatctacattaccggatttcaggacttttaagacagtgacataacaagacagtattatctgtcagtctagttcctttttttttctgttttttcttttttttagattttaaattttttttcatgagacagaatcttgctatgttgcccaggccagtctagtacttctgagttcaagcaatcctcccacctcggccctccgaagtgctggggttacaggtgtgagccaccgtgtcaggcatatttccttatttctttaatgttttaagtgtataatttttgtgtctaaagttattatagcattttattcttgcgaaatatatatactgtatgcatttatacttcaactgatagaatttcagcgtaaaaaaggtaagattttccttttaagttatttaagaatccatgttgtaaaaagacaaagaagaaggttacataacaatgtttgtattatgaccttttaatttatgcatatactgacatatataaaaattgtagatttatgtacattaaagtgaccatagcagttatccttgggttttcaaattaaaggttaattttcactttcttctgtgtacctttctggttagtctgacttactattgtttttttaccaaagtttttattgtgataaaatgtacgtaacaaaaatttccatttgaagtgcacgcttcagtggcattaagaacattcgcactgttacgcagccaacaccactattcacctcccgaacttttttatcttccaaattaaaactctgtacacgttaaactatcagtcctcattcccttcttcccccagtccctagtaacctctattctgctttccacgtttaggaatttgactgttacaggtacctcttgtaagtggaatcactcaacctttgtctttttgggtctggcttatttaatttagcatgttttccaagttcatctatggtatgtatcagtgttccattcctttttatgacttatttttacagtgaactgaagccaccttaataatcagaaacttaacaaagctgttttaatctgaaaagaggaatgaaagcttaattttactttttagtgaaaacctggttctacctgtgtggggtgcatttgtaacattctacttcctgtttgtattctaggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtaataattagctattatatgttgatacaattaataaacagctccatattgttcccatattatatttattgaactgacaattagatgattttatttgcttataaaataaaatgcagaatatagaggaaaattgtgatattcataaaacgtgttacacatcaattctgatgactttggacataggtgatgtcagcaggttcctgacttagcctctcctgcacattgaccaacccactggcccagattggccagtgtcacccatgtgaatcatgcagaggccatgcattttgcacctgcaaatataacttatgttcggggcctgagaccacatttccattgcagctgttagacctctactccaaacatatgccctttgtttcctctgtgatctaatctcagttttggaattctcattcttgattttgttttcttcttacttaggatttgactgatgacacatttgagtgtttcttatatttgtgtgtttttctaatttgaaattgttcttggagtgcacccaaatctcatcattatttttgtggtaattggagaggtggaaacaaaattccatctgcattcaggaccatattgaaaaacagtgttggccgggcgcacggtggctcacacctgtaatcccagcacttgggaggctgaggtggacagatcacttgaggttaggagtttgagatcagcctggacaaccgggtgaaaccccatctctactaaaactacaaaaattagctgggcatgatcgcgggtgcctgtaatcccagctacttgggaggctgaggcaggagaatcacttgaacccaggaggcggaggttgcagtgagccaagattgcgccactgcatttcaacctgggtgacagggcaagactctgtctcaaaaaaaaaaaaaaaaaaagaaagaaagaaagaaagaaaagaaaaagaaaaagaatttttattagcatcacatgtagcgattaaccattagctataaagattttaaaaggctaaccatgatatagtggaagcctgtttccagagccgctcagagcccaggccaccgactcggctgttttcatcacagaaaccgtgtgaggaagagaccaccatgttaggccctcatggctgtttaaagaattttcctcatgttcaggtctcctttagccaatcctccccagggatctttctaaagatcacagtgatctttcaaaagtgcacacctgacacttctcctgcactgaaatccttaaatcaatatagtttaattgttcctcacagcctaaggaataaagtccatcattttgtcttagcaaacaagatttgcctttagccattccagcctcggctcttgtcacactcctgggtttacactgctgtctcttcataccacactgctggtttcatgcatgagtgtctgagcacgtgctgagcatgcctctcagaatgcacacattctccgaggaacactcatccatcacaccagctcacaaagccgaccttgacctagagcccttcctcacacccaagtcccttctttagtgtttctgtcattctttagttatgcttctcttgatactgagtgtatagctttttaagttgtctctctgtttagtcatatctccatggatatttattcttggtgttataataccttttgatatttatccccacagcactgtgtgcagcagtaggcattcagcaaatgatatgaaataaaggaaccaatagatgcacgcatgatattgagtcacatttgctatttctttacagtgaccattctgatggcagtattttaggcatcctggttttttaacaagaaaacaggcactattctatgcaatggtactcgcagccacaaaacagtgccttaaggttccactaacttaatttttatggaatgttaacttccatgtttatagtccataaagcgcctgcatagccattatcacctataattatcccactcctcatttttcctaactttttcttttgaggcaccatctgtcttattaggtttgagggtatttgtataatatataagctgagttgcttcagagctaaataatgatctcttatgaagtgtctatttaggaaagcttcctcaaagaagcataattaaaaacaaatgcattaaccgcttccttgaatagaatatacacattttaaagttcaagttttaactagatgtatggccctagtccaagttaccaagccctctaagcctgtttcctcctctctaaaatagggataaaataaccaacgttattgagtttttgtgagatagaaatgagataatgtgtgaaagcacggctgggcgtggtggctcacacctgcaatcccagcacgttgggaggccgaggcaggtggatcacttgaggtcaggagttcgagaccagcctggccaacatggtgaaactccatctctactaaaattgcaaaacgtagccaggcgtggtggtgcatgcctgtgatcccagctactcaggaggctgaggcagaatggcatgaacccggcaggcggagcttgcagtgagccgagattacaccactgcactccagcctgggcgacagagcgagactctgtttcaacattaaaaaaaaaaaaagtgtgaaaacacacgatatgcaacaaataacgaataacggtgaatctgaatgcataactattaatgtcatgtataaattacatttacagaattagactgggatacatgggaacaggtggttctaaatttgtctgttacatgttttatatcttttccttctcaggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtgagtactcttcctttaaatctaagtacatttctttatttaaagaacatcttgtactgtgattgtatcagtgcttgggggctgatttttggtgccttaaaactgcagtcatctggttaatatctttatttcctgcacattggtttgctttagcttacttttaaaaataacttctcaaaatcagagaaatgagatctatttttatgtttttgccatggaatttgggtggttccttttgataagtggtggagtgtacttcctaagcaatgcaaagactgtctcttggcttagcttcatgccagcccgatgtatgcttttccttaatactgcagtcacgttgacacagtcttcagtattatctcccgtattgtggtgaaaagtatcaggcttacctgcattgttatcccatccccaccacccattacccaggtgggtcagagttagatgtaatatccccaatcactatttacaatgttttagaccatgggaaatgacttgcagtttctggtctgcagctcatttttgctggtctctagtggacttcagacatatagatttaaatgtataatacacacacacacacacacacacacacacactttaaaaaaatttattgctcttctcagatggtgccatgcccctctggatggttcttaatatcgtccagcatccaattcaagaattactggcaactccctgtatgtacaaatttctttccacatcaaagtgatgccataaatctctctgagctctctaatctctatcttccatacttagaggcggtgacagttctcaattctttttgtgaaatcttgttttctagttcttgttgataggatcatctacttcacttaattaaatccattgctgacatgagcatgctttactcttgcttccagatgaagccttgagctcagcagggtccttaagcgaaagcctttctaactgaaacacttcactttattttctagcctagataatgtgtagcctaggaaaatacttaccttagaatgagctggcagcttgcctgtagctggtgctctcagtagcagtaaatgtagtgaaagaagagaacatagaattcaggtatttaattgactattgacttgattgactagaaaactggctatgaaaggaaaccattcaaattcgtcactttgagcccgtttagattagtatcatatgaatttgtctgtcatactataaatataagtgaatataaaaaatatttgacagaatttgtctgtcataaatataaataagtgaatgtaaaaaataaaccagaaaatattgagaagttaggagaatataggtataaacaccagttgagagaggcatccttaagcaagaaaaggacttataagacctaaaggaaaatattcaccaacttgatttcactaaaaaatggatatttttgtttgattaaaaaaaaacaccatgaacatgccaaataggaactgctaggcagggagaaaatgttttataaaactgtgcaaaattgtcaatttgccaaatatgcaaaaaaatcctataaagtgataagcaaaataaaataagaagaggccaggcatgaggacttatacttgtaatcccagcactttgggagaccgaggtgggcggatcacctgaggttgggagtttgagactttcctgaccaacatggagaaaccctgtctctactaaaaatacaaaattagccaggcatggtggtgcatacctgtaatcccagctatttgggaggctgagacaggagaatcgcttgaacctgggaggcagaggttgcggtgagccgataccatgccattgcagtccagcctgggcaacaagagcaaaactccatctctaaataaataaataaataaaacaaaataaaaataaaaagaagaataaaaaatttatatgaagagataattaacttctggttagtcaagaaaatgcaaattaagtgagacactatttttttgcccattggactcaaagaattaaaacattttacaacagttgacaccattgtggagacaagagcatttttagagcctgctggtgggcataggaattgctgaatattctgggattctatctgggaaggggatgataggattgtgtaagggatcctgaggacctcaactttatttgccacatttcatttctttagaaaacatttcgaagcaaatatgacagcatgttaacacttagttatctgcgagtggtaggcacataggtgttatcttgccaacatatttttggcatatttgatttttctcagcaatccatttccttcttgaaactttgtggcttatttggggtctgtctttttgtgacaagactctaaaatgcagtgttttccccctcatctctaaatactactcctacatcagaattcataactcagctactcaaaacttcttttctatagtttgttgttacacagaggacaaaattgtacaattttgtagtccttcttgagttttcctacaacgacttcatttgtgtctagaaaatgccagtctaccaagaagctccaaatttaatggaaattgctttaggattaaccgcttgattgttttcttatatttacatgtatgataaagcgttgcagaaactgtaaagatactgctttaaaaaataatgaaagccatatagatgatttttaaatctcagtatacatgatagcatagcagaaaaacaggacaaatatttgggtaataagttgtaaccacttccggaatttgccacccgtgctctccctcatagagaaaggcagccttttagtacctgtggggcgatcttggtcgctgcaccttgtcatgtccttagcatagcatcttccgtggctcacactacaaaggttgcagtaggtgttgattaggatgataacattatccttcttttgaaatgcatctaaataaaatccaggatggcctattttagaaaatatttgattgtttttatttatctcaatactgtattcattctcatttctccaagaattaactgtgactctgggcaaaagaaaattgaaagtttatttgggaaatgatttgaatggtaccatcatttatcacttcaatttattcttttttcttacctctcctcttggtatatttcctttccttcttacattgaaaagtttggagaccatcaactcattatctaacgtcgggaaagaggaaggagagacgtatggtacttcaaagaccctgtagaaacttaaacatctggttaatatctatcctttataggccttgcagtcttcctttttgattcagatacatgaaattagcagttaattataatattaacctaaaaacaaggaactaaaagcaagaatatataaactcataagtgaggtatatctacctttaagactttgtcaaattgcctccattccctggtctgtttcccagcctttctgtgacctctgtaatgtgtgctatgcatttctcacattttgtcatttcaaggatagagcaaagagctcaacaaatattagacagtgatagttacaaccttgtttttatttcctgtctcaagttagggacacatagttcagattttatctgttagaaatactgagatgacaataaagacataatttaacaagagaggagttagtgcttttcttttcttctgttgagtataatagtgtgcccacataatttgggaatggagtatattctcacttgtcaatgaagagagttggatgatgttttgggaaacccaccttttattctctattgttttgatttcatatacattgcgatactcagatatgagagcaccatttctgcaaagtttagatgggaaaatgattttcattattcatcattaccgcttatgtctctgttgattggaattaagattttgattcactgggtgagtttgttcctgagtcagaatatgttcacttatgggctctcactgtgtgtttatttgttgcatagcccatcttattttcacagctagagactgactgagaattcttggagcccttaacgtttttaatattcaaagagtaaagaaaaattgtttttttctacctccctttctctagttccctgtaccttaagtaaatgcgctgttaaggtaagttgagagtaaaacaaatatgcccagattcttgtgcctgctttctgagagtgcatttcatgttttactgtattatgaatctgtaattccttatgggtggagccttctgaaggagttttcctccacttttatttggaaaacttgcttgattcaagattagttctaaagataattttcttgagtgttaagcagtagagtagaatgattattccagttcctctaatagttaagtattgacttttctttttttaaacattcctagtgaagtctgcctaggaaatttgggccaggaagatgcctttaagcatctatacaagtagataatgaatcatagcacctttgaaatcagggcatgtgtgttattttagtattattcactccaaatgtgagatattagtaataatataatacttcatgctgtcctttgatggagattctcaactcatttatcacataccccttatagagcttcaaaataggaacaaattttatttctctttttctcttacaaggctaaatgtatcattattgaagacgccagtttcatctggaaggcagtgcaaaaacgtgtttattatttcatatagctaagtttgtttctttggtttgtatataaaactcaggaataaccaaaaccatttctaagtttatttacatgggtatgaaaaccatactactacatctgtatgataaagtgtgatagcagaaaaactaaaataaggatgtgacattctatgtatggaccttttctgtctttctttgacacatttatatttatagaaatagcttatgtagtacatgataaaatagaagattttttaaagttatcactagtagattccctgaggatagctgaacccatgtatggacttcaaaaatttatttctaaccttattagcaatacaaggtgatgcattattgaaccttatgataattgataaataatgtaaaatgcttgaaggatttataggaataacagcaatcagaagttgaaatggtttactccaggaacagattcagaagctcatgcaataatcctctacgttggtgctggggtgttatagcagctctaagtggtttcagtcttaagtcactgatattagtttctttgccgtatcttttcaaggtattaatattagaaccaaccaaaatctatcaaccttcttatttgtctatcaacaatgaagttgaggaaaagacaatctctatttggcacgtgcttcctgatgacaaggtaaattgtgcagttattaacacaagagcattagtaacaagggactttacacccttctagcatttacatactccagcaaatgtctgtgttagttaagaagaaatagctcagctgtgtgtctgtcttggcataaatgcattccgtattataaaacttgttaaatttgaattatgaatttttatcagtattaataaaatataattgaactatttggatttttattatagatggcataaccatccaaagcatactcagaattggaatatttctcttttgtaaattcatgccgtaagttatgcaccgaagaactaatacttaaaatacgtgacataaaagatgcatatgttaattttaggaagcctgtcagaatgatgccacttttaatcttacactggtaccattatagttatcattacatctagctgttttgttatctaagtagttgccaaatctcagattagccactgactcagtgtgctgtgcacaaagtgaggtgggctgtgcgaccacctattttgagaaagatcttaaaacagtctcacttccgctcatagcagtcatgtggataagcctttccacttctatattcatcagttttaatgcatgtgcaaatcatcctactattttttacaaacagacattttcaggacctggcttcagtccacaggataaaccaacagaaatgagagaagtcttgtggaaaaatagttcatttattttctttctcgtaactgtttcccagaatgcccttataattttatttaaccatcattcatcaacttactcatttaataaatgtttattgagcacttactctggatcaggcactaccagacacggtgttagaccctagggaaacagctgtgtccaaaatgagtgaagttcctgcctccatggtgcttgctttccactcagatagggcaataaagcaataaataaatgtataggtatattcaatggtgagaagggaaaaataaagcaggaagtggaagcaggaagtaaatttgggagtatgggcttgcagttttttacatgtagacttgagtcaatagacctggattcaaatcccaccactgcccttgggcaacttggcttctccaagctatggtgtcctcatctgtagaatgagataataatatccatctcaaaaggctgttgtgaaggttaaatgaaataatttggtagagtgcatttcacagagcctggcatataatagatgttcaatatatcttaactacagtaacaacaaaaacaattataaatcactgcagtgtgcatattatgtggactaaatcctaactttgaaaccccagagtttaaccctgctttgccctttaaatggcatgggagtaatcatttgggaggttgttggtgttgaactggggcacaaacctggctctgcatcagaattatctgcaataccctggatcccaggagaccgacttagttggaatcctttatacttagagtgaagcttggacacatgcatttttatgaagatttatccatgattctgatgtgcacccatggttgataacaactttaatagggatgtaaacatagtaattactcaattgtagtagctcaagaattattacatccttgactttatggctaagctggttcctggggatgctgcttttcaagatgtggttccctggaacaccagcattagagtcacccagggagctggtttaattaaatggcagattccagctgggcacagtggctcatgcctataatcccagcactttgggaggccaaggtgggtggatcacttgaggtcaggagttcgagatcagcctggccaacatggtgaaaccccatctctactaaaaatacaaaaattagccgggcgtggtggcacttgcctgtaatccccactactcaggaggctgaggcaggagaattgctggaacccgggaggcagaggttgcagtgagccaaaattgtgccactgcactccagcctgggcgacagagcaagactctatctcaaaaaataaataaaataaaataaattgcagattcctaatctgcatgtcagacctactgaggacaattctatgaggtagactttcagacctcacgtatgtgaaccaccaccttaggaagttcaacaggaaaacaacacagcatgtccataatctagcaagaagaatgtcccgtgctttgatgtgtccaaatcagctgggacagatccttcctggatgtcaatcatggccaggccctgtgacctctaccagagtggcaagaaatcaccagtcccggtgctatagtttctaggaagggcagtatcttgtgtttaaaatgaatagatactaagcagcacccagaatgcatgttatttatattttaatttgttctatgtttagataaagttggtcacgttaagtcttgtaacttagtattttagcaggcacactaaatgttggcaacatgaaattacataataagcatggagaaaaacatccattctcatgctctcaacaccaagtccatctagtagcactgagcaataccgagcagcatctttcagaactgtggtctttctccaatcccagtttgtgaaacactgtccaagctgacacttttacaagtcagtttgggactggctacatccaaaatttagagacactctaccaataggttgtggtaacttaaggatcttcacccaacaggccccagattacacatgccaatatttgccactgtgtgcagagtcagaagcttgattctttttcattattagaagtgtcaattgtatggaaaaacacttgaaaaagttacttgtgatactaatttattcataacagaaaacttccttgccaaaggactttgaagacaggctttcagctaagacatagcttcccatgagactcacttccatgagtgcagtaaatagagggaagactttgaaagaagtcattgccccagcaaccccatcagcaacatttctaacatgtcattttaattgtgttaaaatgcatcatgctacacccgaggaaagcactgttgagatgatggtagagcaaatcaatctaccagcgttcttttgagttctgtggactttgggactgtgctggttcctgaggaggacattatgggttcttggtctgtggcgttcagtgaggaggaagatcagtgaggcatggagtccttcgagaaggcttgctaaaggaggtggaacctggactttggctgtgggtagaactagaagagataaatgaacacgggaagacaaactagattagaagaataaggcagaattccaaccaaggcaccaaagtgaaagcaagcatgggacgttcaggggccggcagagtctgactcattctacaaggggaaacgtgttgagggaggtgggagatatgattggttgggcaggatgacataaaactctagagtgctatgtaagctaggaagaagaattttaaacatgtgtcggtaggaaacaggatgtcactgacgtttctgaaaatctgagagctggcaggaaggcagaacagaatgtgaattatgaacccagggtcagcatcaaagtgcataggtgtgaaggttgatgttagctcttgcatgcttcgtggcctaggcatgcgcttcaactcctcatgctttagttgccatgtatgtaaaatgagaataacagtacctcatagaattgttgtgaagattaagtgagaggatgaatggaaatcatttagcacagtgctaagtggcttggaacaagtgctccataatggttgctagtgtagctataagactgatctggtcttgacatttgatttctgaagtctgaggctctggagggtcacagagaagactgttagaggaactagctagatatgaggcaggtagagatcctagagtggaataatacaattgtgactgcaaagggacagatgatttgatttggaaagaaaagtatacaacttaatcacaaattaggaagaaggattaaaaagagggagtaagtgtaaggtgactcaagttttgattgcattgataaaggtggtaggatttttagaaggaaaacctgagttgtagaggaatcatgaggaatttcattttggacgtgtttagttgaaactaatggcaagactccaagtggaatcatccagtggcaaaattgggaataatcaatataactgtctatatacatgttagtgatattgctttaaagtgcagtgcaatatttatattgttttgcatgtatgcaagtatacacatacatgttctcacaagctgagatacactaatcatccagtggaaactacaaaaactaagaacagttaggagacatgaacattatggagacgagagcaggactggaggaggagattttcaaaggcttgattgaaaagagcaaggttatccaaggacacttggaaacagagtgaggctagaggaattagcgattagcaaggcctagagaatgagtagagagccagaagaatttggaagacagaaaaagaacagaaagtaagccagagatttttggaaaatgagtactatttccagcaatttgttattgttttctccttcctggaggttctttgctcagtaaagtgagcctcgttttcattctcttatgttttgtgacaatcatagagacaatttttatattatgctaagaaatattaggatatatattaggatataaacaagtgcattaaatagggttacaaatttaagttatgtactgtccattttccattttcaccatcttttgatcaggaggaattttatttatgttgtccttatttcctataacttttagtgctaaaaaattctccttgttcaaaaattgaagctttcttgtatcagtttccattctgaatttatgtcaatttctttgcaaaccctgattctatccatagtgtattcattatcactaccattttctcaattttttaaaataaaagtggtaaaattggaaggaggacaagcaataaaaacaaaaaaactttattattaccatgttactttaaaacaactataaataacagagaagcaaccagtttaataggtcttatgttaaactaaaaatgggttgtttttatcacagaatgtttaaaaatttttcctaaaattagaatagagaatgtagcttttcatttatcatgtttatttctttagtcactcctctcactatttttattctaacatatggaataaatagctctgtgagctagtatatactttatactgcaactttcaaaacttgaagcacattatataccaattcccaaggactcttagagagagctactctacattcaggggtaaaattaattgaaatcccgatcttttaacagttctctatttgttgaatgaatggttgctgctgaaaagtaagttagtccttgaagaaagtctgcatgtgtacaatgaaagaaaaacttaagattgaggaagagagaagttatttgcagggcgttttaaatggttatttagaatttcccccccttttgggggttgaagtttgggcacccttggcctacctcacggattatcaagcaaaggcaggggcctagtggaggactaagtgctgactctcctccctcacttcagctccagccagtggccactcacagaaggcccaggaaatttatgagggaaacatgcttacccctgattctagattaagatgatttgatgctgtcatccaccaaggatgctttctgctacaaactccctgccaaaagcagcttaaataaagaaatggtatttcatattacaagaaattacaggccgagcatggtgactcacacctgtaatcccagcaatttgggaggccagagcaggaggattgcttgaggccaggagttcaagaccagcctgagcaatgtagcaagacccccgtctctacaaaaaaatttaaaaaaattaaccaggtttggtgatatgtgcctgtagtcccagctgcttgggaggctgaggcgggaggattgcttgagcctaggagatccaggctgtagtgagctatgattaccccactacactccagcctggatggaaaaaaataaattttgaggtggggtgattctgagggtagtttcagcatcaggattctgaattctggcttctctgcgtactcttggtgttagtctcatgttcttaagtagctagctattccaagaagcacctcacacaggcggcatcccggggaggagggccaagccctctcctttataccataagttgtatcacatgaccatgcttacacccatccccagcaaggcaaatggacttaccgtggccaatttagactaatcagtttcaccattcataaacattgccacctgaacctgggcaaaatttatttttttgtcagcagaggagaaggatggaatgacagttgctgagggagctgacagtgcctactacagtataactcctgccaccttcagtcaatacagtattaacttccagctcctattctagccctaactggggcctgggatctgaggctaacccgttcctagaaaatggtgcttgtgctgattaaattaggttgagtgttggtttgaggcctgttggggctaattatagctagcgctgcgtttggccttgctgttttccctgattcccagacagatcccaggagcctttaaactacctgttggctttacagctcatcagcgcctccttgtggtgtgtcctacaggtaggtggggagggaggcctccttccaccttccatctcagggcttgggctttatttacatcactgaaatggaacgttccctggcagcactggcaacctttcaggaaccaagcattctggaaatgctcccctcctttcctacaaaaccagtccacaatttttacttagctgttcccagaaaaggactgatagaagatgggttttaccagtgctgtcttgttagtatttgccagttgctgtgttcaggggtgggtttgcatactgcctcagctctgcacttgcctcccacctcctgctcctggacatggtcttggaaagcagctcagctgcaggctctgaggataaggctgcattgtatgcaagtagtgtacaggtaacagctgcagctcctgggtcatatatatatatatatatttagaagttcacctgaggccaacaggatttagaagcaactttccaaattaccagctgaggctgcagtctgctattttaatttcactccctctgtactctggttaagacagccaccacatacctttttatggtatcttccctcctggacttcatgcaacaaaatttgctctgcgttcattcagatcacatccccatgacctgactgacatgcactgaaactagctttttagtaaattcacatctgacttgagaggatctatttttactttaagttgcatggacctagcaaagaattatgggctgtagatataaattgtcgcttttgagttgctttagccaaaaggagggttctaggccacctcagagccacaaggctttgtcacccattttattagcccaggcaagacctcagcctcctggcagtgggtgggtaagaactccttttcatggttgttttaactttacagaattgaatgtcagtgtcagtttattgccgtactgtacttgctcaacttagacacatggataaactactttgtttctgtaaaaatatttatgctattttatactgttgacatatttttaaagggattatgatccattttgttatttattttagggacatatgaatttgataataattttatcttagctttagtgataaactcaagaaataaattcccacatttttctttaccttggctctgcaaatcacccatgtttatagtatgacaatcaaatttttgatgttcatactttattagcatatggaattttgcataaattaggtagcaataccttgtagttatgatgggcactgtacacatgtgtgttcacatacattcttgttctactagtttctaaagaaatagaaccgcctatttagttggaaatcttaactaaagataattcagaaatagttatctttaaaaccttgccgagatgttattcaaattaatgtttatctttctcggaaaagaagtatttctcaactgtaataatagaattaccttgatcattgactttttttacttaaaaattaacacacaacagttattactagatatcaagttttagaatttaatgagactaattctcctaggctcttttggaagctgttttattgaagtacaggaattattaagtagagtaatcattacccttgggacttgagaatgaattgtgctttccatccagataattctttcatgaaaaatagtgtaccaggaaaaatggctgtgtatatcactttaaaaataattaaacaaaattattgttgttatgttattttccatttggatgactcagtatattttcttgttgttgttctagaaaggtatacatgagtggaattttagtgcctcttctgtcaggggagtgaggtaagtttccttggtacattttgttaacttataagacatttttctccactattcatgggctggatagaacttctaatcatgattttaaaatacaaggaatgtcaagaatcattcaattggtggaaatgcccagccttcttcagtgtcactatctcctttaggaagagatttgcaacaaaatgttcactgctggttgaactgattctgtgctcctgacctacttaaaatgtaactgtggggtcaatgtgaactatggaccagaatcaaaatgtagattacactcagccatgtggaggtcctctttagctgagctgttggtttatgtaataggatgatttctgtccttttggtatacaaggaactcagctccctttgtgtggatacaaagcacacatgccgtctactacactgtgtcctgccactaattttattttattttattttattttattttattttattttattttattttattttattttatttttattttattttatttattttattttattttattttattttgtgagacagagttttgctgttttcgcccaggctggagtgcagtggcatgatctcagttcactgcaacctccgcctcccaggtccaaaatgttctcctgcctcagcctcccaagtagctgggattacgggcgcatgtcaccatgcccagctaatttttgtaattttagtagagacagggtttcaccgtgttggccgggctggtctgaaactcctgacctcagtgatccgcccgtgtagggcttccaaaatgctgggattacaggtgtgagccactccgcccggcccctgtcactaacactaatgacttcagatgataaggagtccattaaaaaaaaaaaaaaccttctgtaaggtcactttcctgcattgatcttgagattacagtggtgaacttcagtttggttcagttctgactgctgtcacaatgccagtagcttagaaaatgccatttcttgggatttagaaataatatatatatatttttttaagaatcaagagtcagtggttaagtctttaaataattgttctattgaagctcatgctaaatcaactcttgcagatttcaaaccaaattagatgtgctaactactgtttacccccacgtcatagcaatgagagacaacagatttttgcagcctggttatgcaatatcctgttgcttttggaataataataattggttttattagagcataaattggtagagcggtctgagtcactaataattggagttctcctggtaaagctacctgttacctcatgaatgatctgaacagaaacaagcaagatgatggactgactcattatatatctttcagtcgatactttctcaaataaaactgtactcttaatatttaatttttaaagccagtcattagcaaggcactcactatttattgctgcatttttaagcaatccacttaagaaagtatggtaaatgtaaatttcactttatcatatctgttttccaatgaataaattttctttaattaggtatggtagccctatgtaacagttgttgtgatttatgacttatacataggctgctactatctatcttactattgctggcttatatgctgagaaacttgagttgtagtctgtgacttcaaagagagctcattcttcctggcctcctcctccacaaagaagagatgacaaactatggaagaaaatccaactaggtcagcagcttgccttgcgtcacctcagaacttgcacagctcgagttagtgggcattaactgagcatgagctgtgtgtcaaatgttgagtcctgttctgccaaagatacaaaaatgactaagacatcaactcctctcttgaggaattcacagcccagcagggagaggaacagacatttaacaactcatgacaatacagtgtgagaagagcaatgaaagaagtatactcagaggacacaggtgtaagaggaagtctttctgtttagggcagaagtagggcagggagagaaggtgaggtctaagctgggccttaaatcgtgaatagagtttcttttaaaagtaaaaaacgacatgcattccaaatggaaggaccagcaggcacaaaggcacaaaataaggattgacaaactgtgccccctggactacatctggtccttcacctgtcctgtaaataaagttttattggaacacagccatgttcattcatttatgcatcctcttaggcagctgtcatgcttcagcagcagaattacatagtgtggcctgaaaaacctaaagtattttactatctggcctgttacagaaaatggttgccaatccctggcataaaacagcatggcctagtgggtcaactgaaaactgtttcatattgccgtaaagtcagccactcactgagtcctaaccgagtgcacttgcacattgcttcactcctctaaaatctctataatgaatgaggtgcttttactgcctccacaaattgactgcctagctttggaaacatttcattgttctacagattgcatagcaccagaatcaccgaggttagccagccagttggtatttatgcttttcctcccagcacacagaatagtgtagtaggcaggacacctttccctgctctgttgaaaggatgtgtagtttacgtgtgcttgcaacaccctagagcagccctgctctgcagagatgaggaggaggacacctctcggaagagtaaatcattttagtagtgtggtgcaggaagtatcactttttaaagtgctatttataacttcttgttataaacaacattgatataaatgggattgaatttaaaacatttctttttcatcataggactgtagaagaattgatagttctctgaataatgcctttttgtttgttggtttcagtatttctaaatttgaagaaagatgctgctttctttatgtgcttcacaattctgatgatttccaaatctatttctgtacagaacttcattgtaaaaagtacgtattagtcattgtgtgtgaaaaagattcttcttacctgatcattattttcaagtaatgagtgaacatgtacctcctgtgaagaatgcatggctatgtggttatataaatattttatttgggctaatattttataattatatcataaatttaacagattttgggggggggttttctttaataagtcaaactttatcttagtcataacttattttcccacagataaaacattaactaagacttattggttaattgttaaatattataactcatattttaagtgctcacttactgtatatgattaccagaattttcattctcaaattcttttaaatcgtctcagtattatctacaatagtacctctttaccttggctcatattagttagatccacctggtaggctttaaaaaaacatgcatggcccccacctcagactaattatattggacgttctggtgggggtgaagcctgagttaagagccactgatctgatctataccaataaaagagatcatccaaaaatccatggactgcattgtatgtttgtgtttttctccattgtatgtttctcttgggctaataattaaattcttcttacttctttagaacactatgattgactgtgggaaactagagaagtgagtgataatttagaagccaaagtgtaggtgaaagttagtttggactcagaattttgctggggattgttcttatttaaataattactatttgaatccattataaatgactgatatgctagctacaatatacagtcgttcatttttatcttggtgtgaaaaagaaaagtgtttgttgaatccacaattcttggctcaagctttattatcataaaacatatggtgggggaaaaaaaaacacttggaaataagaaaattcctagctcttgtatggactaattctctacttacacttaaattctcaagtctgttgacctgtttctatgataattatagctaaaatttatgaagtgtgtgccccagaactaatatttgtttcagtcttcaaagaaaccctattagatgggtagtattaatatctttattgaaaagaattaaaaaagtagtcttggagagtatagcctaaaatcatgtagtcaataagcataaaaatctggggtttgaaccaggcacaggagacttcagaatggaagcttctaaaaattacgctagtgctcccatcccactgtcgagtgttatattctgcctagagatgttcatattgaaaatttttgcatgagtggctgatgcaaatccttaacccagatcttaaatcatgtctgtaacaccagatttttttttgatctttcactttattcttcctcttggttaaactagcttttctctctcattcattgtgctatttaatagcgcaaactgttattccaatcaggcttgggaattttttttcttgtcatggacctccaagaaatgtgtgtagagacaggaagagtgaggaagttgataccacatatgaactccatcaatggggtccaaattccaagatagactttgttcatcatcatgctctcaatggccagaacagttctttatcctagtagacactcagtgagtatttgttgaatgaatggatggatgggtgggtaagaaaggttctgagttgtgttaggggaacttttcttatcacaccataacctgctcttcccttaagctggcatcgcatagcatgacctgcctgtgggatcatcagcccacgttcacagtgcttcccggctttatgtctgtgaaccatcagcctcctctctgaatggcctagtcacagcgagcaggatgccaatctgtttctcactgtaatcactttgcttgtctctgaaatggtctctagaagaaaaaaaaaaaactttacaagaagagttcctgaagaaaaatgtatttgaagtgaggcattaggttagaaatttctagaaaatcctaccaacctgcattttctttttgaaaaattgtatttttcacatgatcttgatagtgtgttattgcctggttctggagactctcttagctctcagttttggttctgaagtcactttgagatgtacttgcttatatttactattgtttgtgttatgaatgctcacgtgctaacttgtattgtaggttttttgagatggtgaacaccattaccgaagagaaggggagaagcacagaggaaggagactgtgaaagtgacttgctggaggtaatgacttaggtgtccatttacatttagagctcattttaaaacaaactatttgaagccttactgaggcaggaggcagggtgtatgaggggtaggagactgtctgtaggctttcctttagtgttaaaagcaacttccagaattcctttggtaaaaaggggctaaaaagtaaacattggagaattcttattccacagcaccaagcgttagcattttacttacctgatagcgagtaactatgctttatctatgacagtgtcaatgcatgggccacggtgtccttacacattctctattctcctctgagatatgtgcaattcagacaaagaagattcactgaagattctggttgatagcacccttgtggcaggcattaatatgctacacagagaacctgaaaccatggaagattaatggaattaagagaggagggaataacaatgacttcaaatgttgttcctctcaactggaatccttttattaatgtctaatggacacagagcactatggatacctacttttatatggtttttatttttatttttatagagacttgttctcgttatgttgcccagactggtcttgaattcctgggctcaagcaatcctcccacctcggcctcccaaagcactagaattacaggcgtgagccaccgcacccgactgctggacacctacttttagtttgtgtccattttctctgccatgtctgctgtgtgaagaagagccttcctccactgcaaggaccaatgctggagtgtgtcaacaatgctgactccagcatcttcaatgtctgaagaatgacacttctccaggcttgacacatggccaccattttctccaagcccttcccagtgtttgacttgggagagaactctgaatccaagtgacttagtccattgggctgctgtaacaaaatactgtaaacaatgtggcttgtaaacagtagacatttattttcttatacttctggaggctgggaagtccaagatcagggtgctggtagattcagtgtctggtgagggcctgttcctcatagaaggtgccctgttgctgtgtccttacatggtagaagaagctggctagctctctgtggtctctcttacaaggccactaatgttaccctgctctgccttcaagacctaatcacctcccaaaggcctcacctcctaataactgcaccttggggtatgatttcaacataggaatttggggaggatacaaatattcagtccatagcaccaagccatactgaaaattatatttttaatgttaaagtgaaaatgaagaatctatagctcaccagtctaattggcatacttatttattagatcactttgataatgtcatctcataaactaaaatttttatagaaacactgaattagtaaggtaacagttgagaaaaaaatttaatataataaattgtttgttttttgagaccggctcttgctgtgttacccgggctggaggtggagtgcagtggcacaatcacagctcattgtagcctcttgacctcctgggctcaagcaatcctcccacttcagccagagcatgccaccacacctggctaacttttttttttttttttttttttttttggtggagacgggatctcactttgttgcccaggttggtcttgaactcctgggctcaagcagttctccctcttcggcctcccaaagtgctgggattatagggataagcaccatgcctggcctataatagctagttgttaactctgcccgtagttaagttctatgattatctagcaattgtatagctttgatatttgtagttaagcctaagcctctttcattaaagatgtaaaaagatgacaggcctaatttggaaaaaaagatttcctgtgcattagcttgctgtctatagaagtaatagatactacttcttatttatgtatgttttatattttacaattttttatttcttattcaagtgattgttaggaattagctttcttgactcctacttcagggctcgtttgattataccttgttatctttgtttctgtgttaaattttgcatcacttgatacatagcaacttgccaaggtaaaacttaaagaaattgaaaatgaaacaattctatcaatcatatagaattatgaaggggatgactggaaaattcatgaagtattcttcaatgttacaaatttctggctttttttttttttttttaaaccagagatagctatcctttgtttcatgccctcctttcaggaactaactgcatcttaccaaaaatatgcatagcctagccaggctgtggtggcaggtgcctatcatctcagctactcaggaggctgaggcaggagaatcacttgaactcgggaggcagaggtttcagtgagccaagattgtgccactgcactccagcctgggtgacaagagcaaaactccgtctcaaaaaaaaaaaagagaagaaaagaaattattctgaagtcaggtgtggtggctcatgcctgtaatcccagcacattgggatgctgaggtgagtggatcacttgaggccaggagttcgaaaccagcctggccaacatggtgaaaccctgtctctactttagctgagcatggtggcgtgcacctgtagtcccagctactcaggaggctgaggcaagagaattgcttgaacctgggagttggaggttgcagtgagccgagatcgcaccactgcactccagcctgagctgcagagtgagacttggtctcaaaaaaaaaagaaaagaaaaacataagaaaaacattcttacatttctatcctttgcatttcattagaataatgtaaaatttctgacagagaatggcttctacagtattcccaatggactttagagcctgtaggaagaattcaagcagaccggcttcaagagtcttggcttagtttgccattgtgccagctagtgatattgctgatgttttttgtgggtgttcttttagcaaaacgtgaatgaatgcatgtttacagggatgctctggactggaggatggtgaaatccatcgtggttgtccctctccctgaatgtccttttgtagccagggcatctttccaatatgaattattaagccttaacttacatttttgcataacttataactctccattatatatttggttacatttcttagatgttttcaacattctttattaaagttattttatcagcatcctgcatatttgattaaaatgaattctttaatttcattaccacaaattgaactcaaacttcagcccatgaataacaagctaaaaataattcctccacttcccattctttacagtggaaacaaaaagaatgactttagagatcatctgaacacagtgattaagatttgtatgcagaataattattttctgatgtttacctcaattgaaggtagaattaacattgtttcaatacatgcgtcaattattcctgaagcctttggctaccttggcccagaacaaaataaaaatgttggaaaggccaggaaatgctacttaatgtttttaacttcacttagggtgttgtcagcagtcagcaaaacagtaactattaatgtgattctataaactacaaatgtgaaactaattcctagaatttgaaagacttcttagaagcccaaggcaataactccttttctttttgattggaacaataaggtttatttgaagcagtacaactgtgggtgggatttggcttctttcaggtcaccagccccttcttccttctgattcaagctggatctactaagaactccaggctggggtcaggagccttgggccctggttctgactttgccaacagtcagtttcataaccccagacaaagttcatactcccgctgggctaagatgacttcattccttaagttagagttgaaaagaatatatatatatatatacatatatttattttattttattttttttcagacagagtcttgctctgtcacccaggctggagtgcagtggcatgatcttggcttactgcaacctccacccccgggttcaagcagtgctcccaccgcagcctcttgagtagctgggattacagacgcccaccatcatgcccagctaatttttgtattttcagtagagacagggtttcaccatgttggccaggctggtcttgaacatctgacctcaggtgatctacccacctcggcctcccaaagtgctgggattataggcgtgagccactgcgcctggccaagagcaagaggatctttaatgtcttttcctacctctaatttttaaaataatattcaagattggtataaattgtacaaggttatttcaaatataatgcaataccacttctcagagaaggattttctgtcttttaacagaaagaaaatcaatttcttttgattcaaggctatgttttttgactcaaggatgtattttgacgtggaagggtaatgaactcatatctcaagtattttaatatgttattattataatacttttatattgaaatcatcaaacaattgatcagagttaaccagccttggtctccattgttcttcttcctgccttccatgtcttcattaaaagtaaaggcatccagcaacccaagccagattcctgagaaacccctcccaaacccgtcttaatccctcatgcccgttctttcctgcagccccttcatttcatcttcttggtcactcccctgatctcaggtcttcatcctctatcatagcctaacatgtctcatgctttgtctctgttatcatcagagaaatctctcatacagatttaatcctgcgactccccagattaaaaacctttgatgctcctttttgttttttgatacagagtctcactctgtcacccaggtgggagagcagtggcgcaatctcggctcactgcaacctccgcctcctaggttcaagcaattctcctgcctcagcctcctaagtagctgggactacaggcatgcaccaccatgcccagctaatttttatatttttagtatggagtttcaccatgttggccaggctggctttgaattcctgacctcaagtgatctgcctgccttggcctcccaaaatgctgggattacggacacgagccaccatgcccagctgatgctcctttttgtagaaggaagtatttgcaccatacaacattctcaccccctctggctgtagcttcccctttcctttccactctgtggtccagcggtgccagcctcctttccactttccaggtggccatgcttctccggcctctgggcttgacatgcagacgcccaacctcacaaacttttctcctcagtcccacttagtgaccaaagccttaatttttcagatccaggtcctgtgtccttttctctttgaatcatttctcaactccccttcttgcttttctctgttctcttagcattttggcccactcctctggcctagctcttctccatgcattgtaatctggtagcctgcactggactggactgttaatgtcccatggcaggatggtggctttttgccctttttaatcacatgagctcacatggtgccaggtgtccaagtaaaagagattcaatctgaagggtttgaagctgggcagtgacaaaatcagagttgttttaatattaggttgtagcaataatggcaaaaaccacaattacttttgcaccaacctaatatctcaaactgggaggagagagatatggatgggagaaggcctccaatccatatggacctctctgcttgagcccgagaggtcaaggctgcagtgagctaggattgcgccactgcactccagccttggtgacagagccagaccctgtctaaaaaaaaaaaagaaaaaaaaaagtgacattattttcatttgactcaaatatctgcaggaagatggaagaccttactgttttcttttctgatgattggcctcatataccttagtaattatggttcagaatttattttagtcagtttggaatcatcatgtagcaaactcttttttaacatcctatttctatttttgtgcagatatgaagctgaatacccacagttacttccctgcctgagaaaatacatcacttatagtgttgtatgatatgagtatcaatttgttattcattcattcattctgttgggaacggggaaaagcctttttcttgtaccagcttatgttcaatggtcaggggcctgcaaattaactgacaaaagacaagttgacaggagagcagacaaactttattcttttgttttgttttatttttgaaacagaatctccctctgtcccccaggctggagtgcagtggtgtgatctcggctcattgcagcctctatctcttgggctcaagcgatcctcccacctcagccttctgagtagctgggactaaggtgtgcaccaccatgcctgactaatttttgtgctttttatagagacagggtttcaccatgttgcctaagctgctgccttggcctcccaaaatgcagagattacagatgtgagccaccatgcctagccaaaatttattcatgtagtcaatgctaagtcaatgaaagagacttacacaaagaattggctccctaaacagctagagttgagtgtttatatatcatcttagtaagaaagagggttaagactttaagaaagtgtatggtgggagactaatgagaaataagtgtgaggaacagaaagttttgataaggttttgtttatgcaacatctcctctaggtgcaagtggtctatctcctctttggtcattaacctcctggagaggaaataaatggcagatgtattttaggaggcattgcttatgtccgcaaaagaaatttagataaggtttttttctgctgctgctgtttttctgatgttttcagcctaaaatcatcttcatccacatcagtgggtccaaatggatctcactaatgcactcacatatttttggacagctattgaatggtaggcaccattccatgtgctggagagatggcagagaacaaaatggagagaaattcctgctatcactgagagcttacatgctctcatctaagtcttaatcgggcccaactctgcttagcttccgagatcagaagagattggacgcattcagggtggtatagctgtagactcaggttactttctaatgagagacggacaataaacacaaataagtaaaataccatctatagtatgttagatggtgatcagggttaaggagaataataaaccagggaagggtttaggaagttacagtgtagcagggacgtgcaattttagataggaaggcctgggaagctcattaagaaggtaagatttaggccgggtgtggtggctcatgcctgtaatcccagcactttgggaggcagaggagttggattgtttgaggtcaggagtttgagaccaacctggctaaaatggcgaaaccccatctctactgaaaatacaaaaattagccgggcatggtggcaagcgcctgtaatcccagctactcgggaggctaaagcaggagaatcgcttgaacctaggcactccagcctgggcgacagagtgagactctaaataaataaataaataaataaataaataaataaataaataaatgaaggtgagatatggccgggcgccatggctcacacctgtaatctcagcactttgggagaccaaggcgggtggatcatgaggtcaggagattgagaccatcctggctaacaaggtgaaagcccatctctactaaaaatacaaaaaattagctgggtgtggtggcgggcacctgtagtcccagctgctcgggaggctgaggcaggagaatggcgtgaacctgggaggcggagcttgcagcgagctgagattgtgccactgcactccagcctgggcgacagagcgtgactccttctcaaaaaaaaaggtgagatgtgagtaaagatctaagggaggagagatccatcacactagatatttgtacctgcagtgtttttggcattctattaatgttattagtagttattaatgttttggcatttacatataaagaaggccatacagactgaacattaacagagctgccatttgggtctttgaggtgattactcacctaatgtgattaagcccccgccgaaagtgcatggttttttctaaggtggttgtttccttcgagagtgcaaggactcagtgagtcaccacttcgttgtttggccttgtcaatgttgccttcctacactgattctcttcccgctaccagttttgattgttctgagcagacagcaataaagagatgattctagaaaaattctcatgattgcctcagaatgaaattcttgtttcccttagcaacaacctgatttgctaacctattaccatagaaatagaatgcaaaatatataagcaatgtaatgttaccttttattttttaaaaccctctcttctactattcctggacattacatagatgattctctgtccttctaggctgaaccagtctcttgtttcttttcagctttctttcaaaactgccatttcaatttctatctttatctcgtaagaatagaaaggggagatagaaaaacaaagcagcaattacccacagagatggttttacttaaataacactgctctttttacaattccttttcattttactatcaccattttgtttaacaggagtcagcttctatatctaatcttctatatctaatacataatcttttaaatctgtatctaatacgtaatcttttaaaaaatagtcttctgatgccttagattcctaggggaaattaaaactttagcagcctcatcaaggtttatgtattcttcactcttctatataagcatacctgttgtagagctggacctggtggtgtgcacctgagtcccagctatttgggaggatcacttgagcccaggactttgagtccagcctgggtaacatagcaggactccatctctttaaaaaaaaaaactgctgagtatgatggctcccacctgtactcccagtggttgggaggccgaggcagcaggatcagttgaggccaggagttcaaggccagcctgggcaacatagcaagaccccatctctacaaaaaatagaaaaaattagctggacatagtgctgtacacctgaagtcccagctgttgaggaggctgaagtgggaggattgcttgaacctaggagttcaaggctgcaatgagctatgatggcaccactgcactccggcctaggcgacagagcaaaacactctttaaaaaaaaaaaaagatttaaatatatctattggaaaaatgctttcacccaagaataaaccaataatgactctaaatgttttgttttgggatctagttcttttctaaaaaagttctcatcacatttttctataacttgattaattagttaagcaaataattactgagcatctactacaagctacatgctaaaactggggatagagtaattaaggatgaagtcccaagtctcgaagagctcaagtgtccagacgaggatgacagaggtagccgtaagatcttgaagggcattgtcttggtccatccaggccgctataacaaaatgccttaggctgggtaatttatacccaatagaaatgctttgctcacagttccagaggctgagaaatccaagatcaaggcaccagcagattcagtgtctggtgagggcctacttcctctagatggtaccttctgtgggtgctcacatggctgaaggctcaaccaggctccttcaagcctctttcataaggggactaatcccattcatgagagctctagcctcatgacctaatcaccttctaaagggcctaactcttaatacattgtgattcggtttcaacatacagattttgagggcgctgaagaggggggtacgcaaacattcagaccatagcaggcatttatgctgtgctaaggagtttggatttcatccggaaagtaacaagctgccaataaaatagatgcagtggcactgacatggaaagttcatgtggaactttggactttggaaagttcactgtcaatttagtggagaataaattggggaatggagcaacaagagaggagaaaagcctctgaactttttttttgcagagaagtgcttttcttctgtgctacttctacagagattctgaggcaactccggtgagaataaggaggtaaaatggatttgtgagattttaagaagaaaaatctgagaacagttggcaataaatttgaaatacatagtaaaagaaggaaaaaaacaaaattctaagaggacagtggctaccagatgtctgctaaaaaaaagcaaatggatgttccatggatattaacaatatactgtaatatctttataacactggtatttggaaacaactaataatcaccctgtaagctcttattctatgatagggtttccctaatgcataggtagtggaaaggatacaaaatctggaatctcacaagctggtttcaaaccacaactctgatatattttcactggaaaaaaaaatttctgatcatttgtaaattgaaagtaatcagaaacctattacacatgcttatgatgataagtgaggtgggttattgaaagttggttttttttttcctttaagattataaagcattgtagtgtaaaatggtggtggtactagatggagtgtataggtttctaatcctttgagagggcacatcggcaaagttgagcttctttacctgctgctggctgggtcccactggtggaattccagcgtggcaggcacagcattgcagaagtctagactacaggaattgggtgtggagacttgggctccttcaggtggcgttgtttggattatgcttcctgtctcctcgcaggagcccagttttaactctgagttagagcatgttgctaaatgatccctgctgcctgttccttccctctgatcacctatcacctggtcactctgatcatctaccctggaccaagacagtcttcagctttatgttaggcagccagaacagggctattctctaatgtgccactggatacttggcaatgggtaagtagtcatctcccttccagagcttggcctctgtcctgagccagagaagaattcatgctaaggaggccagtgctcactccagccctagcattgtattaggcataattttccccagaagacaccacccgactgccttctataagggcctgaaaacctgttggaaacaaataacctggagctggtagggacatgctccaccccagccccatcctctcgagtcatgcgtgtgtacccaagagtttgcagagcgatctgatgagctacctttgtaggtaatttgcccttttatgatctttttgtctttcgtattttgtagtttccctatgtcatatctcagtgagtttgtttttatttttcctatttagggctgaatttctggaagttgtattcaattctctttcaagtctggccttttttagaatatcttatcttctcatttttaaatattttatatctttatgttaaatgtacatattttataactatattctatcatttctgacttaatgaagtcttgaggattgagatttgtcatatatgttttcactgatgttgaattgtttccttacatagtttatattttttggattgtgagttcaactttagtggtgcattatcagtaagaattctgcatagcaaacttcaaggggtctgccatgaaaatgtttttgctttgtttctgccaggcactccagggatatcccaggctcaagagcaattatgagtattataataagtgttaatttgaagttcaaacagcaccaggatcagctgtggttgaaagtgtttagagaagacctatttttgctcctccagagctcagtcttgagacaaaccagctttctttttgtttcacagtgtagtgggctgacttttctgatctaccctttcaccaagggcctggttttgtgtgtttctgctctttgcctggcgtaggcactaggccatacttcctatcccctcctgggcattaagacccaagccccacatgagaggtcagcaaactatagccccaggatcaaatccagctcactcttaatcttggtaaataaagccttattggaacataagcatgcccatttgtttatatatcagctgggctgctttcacatcacaatggcagaattgagtagttgctacaaagactagatggccctcaaagctaaaacattcactatctgaccttttaccaaaaaaaaagcagacaaattcccgccctagattaatgaaactgaaaatcttgccttcatccccaccctttgggctgcaggagttcttgtgattacctgctagtattcctttcctcttcatttctagcttctgcagtcacctttactctttagtaagcccagctagacatttaaaagtatgtctgttttattttacctatgtgtttttagcaggaaggttctcaggtatctggtctaccatcttgccaaatccagagcctctcttctactgtcttggtagcaatatgttattctttttctgtttccttgacttgaccattaaacttattcatgttaaatttttattttctaatggatttttttaagatcatgaaatttttcatctacctaactccatatctatggaatttgataaataatgtttttcttctcatttaaaaaattactgtgtaattcccatggtcatttcctttttaacccattggttattttaaaggaaagtaaaatatacttttggctgtcttatttttagtattctgtgctcagagatcatggtctttatgatatcagttctttggaatttgttgaaatttttctttgttgtctaatatgtaatcagttataatatatttttcatgtatgcatgaaaggaatctgtatctggatacagagctctctctgtagatgttatatcaaacttgttcattgtgccattagattctctattttaaaatctgtgtgccagatatattcctttctaaaagagttctgttaaaatctattgtggttgatatttgtgtatttttctttgaaattttatcaactctgcttttatatttcaaggctatgttgttaaagagcataaaaactcatgatcattgccctcttcatagattactcatcagtattaacgttaagtttgttgacttatacatgttataaatcatttttttttctttgagatggagtcttgctctgttgcccaggctggagtgcagtgtcgccatctcagctcactgcaacctccgtctcccaggttcaaccaattctcctgcctcagcctcttgagtaattgggattacaggcgtgcaccaccatacccagctaatttttgtattttcagtagagacagggttttgccatgttggctaggctggtctcaaactcctgacctcaggtgatgcacctgcctcagccttccaaagtgctagaattaacaggcatgagccaccacacctggccagaaataattttttttaatggccaactcagaccctgctgtgaggtgaatctaactatggactgccagttttaaactccagcaaaatgtagactatatgaaaagcttgttctaatgttctctcccaggggtctgtagttttatgctgggtttctacagggacatgccttgatcatgtgatggccctaaatcatttagttccagtccagcacaaaggatgtggctttggggtgatgcctccagatctgaggaggtctctactgaatcctttctgtagatccggttttccatatttggctgacatacttgacagtttggagtttagaactatagatatttcctttctacatcagagatcaaaattttcctctatttttcacttaaaaaaatgtttttgggtcttggggaaacggtggggagtggtgaagtaaaataatcctgactttatcattggcacctggtaagatgtcaacattttcttcttacccaaagcctttcggtggttttattctcctggcagtgtgaaatgctttaacagcatcaaaagctgaataacaaaaggaagatttattagatgtgatagacattgatagatgttgatgctagttatacactgtttcactgatctccagaatcaatgaaaaacaggactgagtgggtaaaagaatccacatggcttttggagaagcaattctatgaagttaactatgtaatccccactgtatttgtaacagtttgtgaaaacataaacacagtatctgctttatgttgggagcatttatttgttcatccttgaagctgcttcttagaacttcagcctgttaatgccatctgataagataaggaataatgctcttggaaaaaaatttgatgtttgaaatgtagaatgaactaatgttttgatcttttctccccgtttttccttttgtagtatgactatgaatatgatgaaaatggtgacagagtcgttttaggaaaaggcacttatgggatagtctacgcaggtcgggacttgagcaaccaagtcagaattgctattaaggaaatcccagagagagacagcaggtacagtaattgtagctactaaaagctgttctgtagtactttgggttgttgacagtattttagaaaatacttgatgatattctaatgaatgaaactgtgaaaacttcactctgtgaattagctccttctgaggtttcgctgctgcatcattcagtgtttgaagtgccagactggtggggaagaacggggctttcaaagactagaaaagagaatggccctgtgtgtgttaggctcaggttgtcttggataaaggtggatgtattatgtgaatagatgaggaataagcactatcagaaatcgtttaggttggaaccagttctaggttccagtcgggcatgtgaggagcttggaagttgtcattccatcttaacaagtagaaagctgaagagactgaaatcagtggctcttcttggattcgtccgtgaagttgcaagggaggcagctgcccctgaaattggagagactggaaaactgagagactcataacttactgagcagaaatccatgatctgctcacctctgtgggaaccagtgctggggtaggaaaactgaactgtaactgacaaatctctagaggcccactgtgaagtctgagttaaaaactccagtgggacccagtcactgagggctggggatgagggtcacactttcatgagttttggagctttaccaggtcctcagagagacttgaaataagagaaatcccattgtgcttctggcagcaagaaaggaaaagtcactatttcttttttttttttttttgagacggagtcttgctctgtcacccaggctggagttcagtggcacgatctcggctcactgcaagctccacctcctgggtccatgccagtctcctgcctcggcctcctgagtagctgggactacaggtgcctgccaccacgcctggctaattttttgtatttttaatagagacgcggtttcaccgtgttaaccaggacggtcttgatctcctgacctcgtgatccgcccgcctcggcctcccaaagtgctgggattacaggcgtgagccaccatgcccggcaaagtcaccatttttaaatacgctgaagcattctgttcttaacaaggtctgtccacaagagactctattttaccggagcctaaccaaactaggggaagtggagtaccaaatttagcccaactctagctgtcctgtctcacctaagggggctaaagctaaggagcacttgtaaaattcacagcccaggggcactggctcactaaaagactgagacctaatcacagacctgtcgaactcttcccctccctgactgcttcccaccacatcactaaaggcctatttactgcagcactttcacctaggatatcatgtccacctttctatagaaaactataaggcatactgaaagacaaaaaacacagtttaagcaacatagcaagtgtcagaacctgaaccagatatggcggggatattagagttatcagattgtgaatcgtattcacatgcttagggctctcatggaaaggtagagattgtgcaggagcagatggtaatgtaagctcagagatggaaatcctaggaataatttttaaaaatgctggagatcaaaaacagtaatagaagtgaagaatggctttgatggcttattagtagactgggcacagttaaagaatctctgagtttcggaatatatcagtagaaactttcaaaattaaaaaagcaaagagaaaaaagactgaaaaaaaaaactgggacaatatccaagaactgtgtgacaactacaaaatgtataatatatacatttttgccatcaaaagtaattaatggcaaaaaccgcaattacttttgcaccaacctatgcttgaagaaatgagttgaatctcacatagtgaggccttgtgaaaggtggaatcttttttaggaacaaaaatgttcaggaaactgaagcgctctggtgataggattatctgttgctcactgctcttgtgctctgccttatggtttatttctccaactaataattctgtcttctctcaacctcatgatttctgctgccttagggcttcccttacatctctctgtaaggcagtgctcctgtaattagtgcaacgcagttgtagtgtatgatacacagttgtgtgtgttgtgtattcaaagtctgaaagagagaagattggattatttaatagatggttattattatccatatttggccaggctttaatgctgggctacatcatgggctgactctggctgcccttgactccacgttctgtggccgtggtcataggccacatgaccagccttccttaggaaggacccacccctgagctccccaggttacctgtctaccccacatctccagttatagatctcaaaggcatctcaaggttaacaggaccaaaactgaacctggatttttttccttttttaacttttattttagaaccagggggtacatgcgcaggtttgttacaaaagaatattgtgtgttgcttaggtttggagtacaaaggaatccatcaaatatacctaggtagtgagtatgtaacccaatagcaaacccagattttatttttatttccttatttctttaagtcagagactcactctgtcattcaggctagagtgcagtggccccatctcagctcattgcaacctccacctcccgagttcaagcaatgctcatgcttcagcctcctgagtagctgggattacaggcctgcatcatcatgcctgcctaatttttgtgtttttaatagagacagagtttcaccatgttggccaggctggtctcgaactcctgccctcaagtgatctgcccacctcagcctcccaaagtgctgggattataggcgtgagccaccacgccaggccgtgaacccaatttttattcccaaatgtactctccctaaagtactccttgtgttatcagttactgtctccccatgtatccagctgctcaggctaacctccaggattcatttgattcctctctttctcttgcactccacatctactccatcagtaagtcgtactgtttgttgtatcagcctctgcaagatattctgaatctctctactctttctgatcaccacagctgcacctctaatctaagccttcaggcctgtcgctgggactcccttctagtctctgcaatcacctcctaactggtctctgctttcgctctttcctccactcctagtccatccttctttgaggagtcacagaggtctttctgaagttaaaatcaaatcatgtagtgataatgatgtgtcagtgaaggtccatcagttgtaacaaatggactactctggtggggaatgttgataaggggggaggttgtgcatgtgtgggaaccaggagtgtgtgggaaatctctgtacctccctctcaatttttctgtgaacttacgaactgctctaagaaataacatctatttttaaaaatcacatcacgtcactactgcctaaaacccttcagtggattcttattgcaaccagcatgaaacccagaacccttactttgaatcacaaggccataggtgatctgcttcctctgtggcctcacttccactccagccacactggtgtctctctatcgggcataccaagatcaacccagaccttggcaggattgcctcattttcatcacttaagctttaattcaaatgtcaagccctcagagaggtcttctctgactgtcccaaactgaaaaagacaccccctcccatgcaagcactgtgtccggtcccagctctttatccttagtgcgtgactttcaccctgcctccaggctccatatgtcagtccagaaggaaaaggaaaacagagcttcccagaactgcccagtatactttctcctctgttgcactcgcccaaaatgcctacccctacctacaaggaactaggaactccggctttttagccagccatttgtttctccaaacaaaatcatagaaagagggaagaatagatactaggtaagcaaacagctgttgctgcctgccgcatgtgtagtttcattcaatttcatatttgtttggtgtcgttccagagtttcctcttagttaattcatgagacatgattatggattcttatgaaacagtaatagaaattactcattaaatacctaggtaatatatataaagttgtcatcttaaaatttttcttttagtcctatgtgttcttaaggagcatatgtatagatagtgtagactttgaaacaatatgaaatttaacgaggtcatcactatcaaattgctgcagccaaattcactaacctttagccacagctcctctcttctctactcctgatggatttaggtgaacacttggaagaaactcacttttaaaatcaccctgtagtttaagtttattcaaatgctactatacacacacaaagcacaccaacaccaacaagatgtttcagctcctgttctgtaacaatgcagttggtatatgtgatttgcacatgacaagcccttagcttgaacagctggtgcagggcatcttcttattgacaatgtaaagagatcgcagacaactctattattgtgaagatacagcaaacaaagttgtttctatccatgtaacctggaggggtgtggacgttctgttgaaaaagatagcagttacagttacaaagcataattacaaaagtagtgtgatgtgaataatgcatgatacaacctgagtgtacactaaactaccatctgtaaagaaggatcagagcaatggaaacaatttctcctctgtttccttcatgttctaaaaccactttgttagagaatcaaagtggttgtaagagggaagaggtagatttagtatgctctcatcatccacccccaactagttgttaatctcaggttggctttctcttctgatattctacatatcctgaactggttatttttattttattttatttttgagatggagtttcattctgtcgcccaggctggagtgcagtggcgcgatctcggctcactgcaacctccgcctcctgggttcaagtgattctcctgcctcagcctcccaagtagctgggattacaggcacctgccactacacccagctaatttttatatttttagtagagagggggtttcaccatgtggccaggctggtcttgaactcctgacctcaagtgatctgcccaccttggcctcccaaagtgctgggattacaggagtgaaccactgcaccggccgtggactggttatttctatgtcatttttcacccagctgtatatgagagacaacaggggagcttttaaaaatactgatgctcaagctctacttctagaaatcctggggtggtcctggacaattagaagccctctaggagatgtaaatatccagtcaaggttggcaaccactggtctagatggttagcagtagggatttgactcagaggggatgtctggcgatacctatggattaatagttttgtcaaaaccaaaatatgtaagtatctctgattatctaggccatttcttctttcccttgttacaggtaattgagaagaaatatgattttcttataattctcatagataagaataatttgttgatgtgaacaaattataattccatccttgtttaatgcttggcacttacacttagtgaaaatgctgggtgtttgtaatattttttatattggagaagagtacttgtccttagctaggttggattctgactattattgcaaattttgagctatctccttagtttaagtaatgaggtaaggatattgcttctccagggtcttaagtttaagcattgatgttttgattttcagtagagaatcaggaggtgggagtcttttgattaataattaactgagggcccggtatggtggtgcatgcctgtaatctcagcactttgggaggctgaggctggcggatcacttgagctcaggagtttgagactagcctggacaacatggtaaaacaaaaaatacaaaaattagctgggcatggtggtgcatgcctgtagtcacagctactcgggaggctgaaatgggagcattgcttgagcctgggaggctgagggtgcagtgagctgtaatcgtgccactgcattccagcctgggtgacagagagagaccctgtctcaaatcatcatcatcaccatcatcatcatcatcatcatcatcatcgagttacttgattgtttcagatttttctttatctcttaactctgtagaatacagaggcacagtatttgccactaatctatatcaagagcagttataagccaggtttgttggctcacagctgtaatcccagccctttgggaggctgaggtggggagaggtgatctgtggtcaggagttcgagactagcctggccaacatggtgaaactccgtctctactaaaaatgcaaaaattagccaggcatggtggcaggcgcctgtaatcccagctacttgggaggctgaggcaggagaatcacttgaactcgggaggcagaggtttcagtgagctgagatcacgccattgcaccccagcctgggcgacaagagtgaaactccatctcaaaaaaaaaaaaaaaaaaaaagaggagcaggtatgaaccaacatcaaagtgttttaaccctcatggaagaagcaacttgtaaatacccttatagttgagagtcattacctaagtatcttattggtaacactgtatattgatatttctggtgttatctcactcaagcaattatcaaaatgttgttgctatctctaactggtatactattaaagtgctcattttaatacgtgcccttcatagttcctgaagtaattctaaagaaaaaaagaataatcgatctaaaatacaagtcttttgttattgttattgctgttggctgctttctggaaatattacacagataataaaaattaatttaaattaaatgaatttaaatgtttataaactaattgctttagctaaagcacttactctaaaaagcttattgaaaatagcattattcagcattaaccaatggatttgtcagtgtaagatctaaggatttcctacatgtaggactgaagcaagtgtgagacaccaggtttgcactaatgtgaattattagtgtatttcacacctgtagcctccattatagaagatatatatatattcaatttagattatatatagatctatatctcgaggaattgctttgagtctgtatttattgttgctgacaccctacaatatttagcttcttaagtaaaatttgaggctactgatttggactgagctcctgcactaggctccaacagaccagcctgtggaaccatgctagggttccacatcaccaaaccaaaactaagcagtttacttgtaagatctgaccttctgaaaaatcaggagagagatgatagccaaattctccaacaggccagttttcaaaaaacaaaaacaaaacagagtcacagggactgatcaaaaggcacccagccaacctgagctggcatgaaaagaagtcccctctgctttaacccctgcaagggaagtaacctgaactaacctaacgttaaccacttggtttttgctctgtgttgtttttcttcctgctcaagctaccttaggaaagaaaacccactgttttgccatgcccagcggacctcctattttgattggatactgcctggctcatgaatcatgaataaaagccaatttgatttttaaaactcaatttgctgaaattatgttctttggcaagctgtacaataattacattagggctacattaaattcagggtggttaagagtctataaagctttacagtacttccaataatcatcaaaagtgttgttctgctccagaaatataaaataacttttataatttgaatcagcaacatatatcaagtacataattttgaagtcacactttcaatgtggaggcttcatgaggattaggtaaaaatcatgatataatagaattagtggatacagtaaggtgaagattttgacgcaaggggctcaaagagatttgacatatgagtggttttatgtttgctattgaaaaattgacgggcctttcaggaagttctggaatgtacattatgcaagttttgtcttcctgggcaagagtctcctgattaatagtaaattgtaatagtaaagttttatagtcaataataaagttgtgttgatgaggccagtggaatagaaagtcatgttaatatgttaatatggagagtaaactgtggacaatttccgttctcctgggtttgaatcttagctctgtcacttaatagctttgggatcttgagcaagtcagtcatcctctctgtgaatcagtttcctcatctgtaaaatgggcataccaatactaccttctcatggaaatgaattaatgtatacaactggcttagtacctgacacatttcccctcagatcctaccacaccttcaacctcatagaatttaccttaggagaaataaaggccttaagtggttgttttggttttacatatggacatatatttggctgacattttccatttgtattgtttaaatttatacagtaaagtctggctacataattaactcattgacaattgcatgtcttttagatactctcagcccctgcatgaagaaatagcattgcataaacacctgaagcacaaaaatattgtccagtatctgggctctttcagtgagaatggtttcattaaaatcttcatggagcaggtccctggaggtaagagatatttctttctttaaaaagtgtgaatgtttagagcttcggaggggagtaaaattgaatgggatttactagcgtacaggtcttaatctgtctaaactgaaagaaaaattggacatgtgacattacctccagtttgttaggagatgtcaaccataaatgatgagatttagaaaatatcctaatgtatagagtttattccagtgcaaagcttgaggatagccacccaggaaacacagactccaaaagaatgggccagtgttccaaagtgaggaagttcatgtttcacttatataagctgaagactaacagggtggcaacatcttctacccaaagtcattacatttaagtggttacagcttgctgtattccaaggcacattattttaatgttccataaggaggggtaatggtctcgggggatcttttctttggcaccattcagtcttctccaatcatttacaggacaaaaatgcggaagagatttagcctataatcgcagaatcagaagttacaactgaatgctatatgactcaggccacaaagtcacattccttaaataataaggctcaaataatttaaagttctagaagctttacatgtgaattatgtaatttcacagagacaatacataaatatgggaaccatttcagtatctatcatcatgacttgaattaaagttggcaattgacattggccttttacttagacatatttgattacaagcatctttagagtagggatatttgcaaattcatgtttgagcccgatatccagtatagctcctgggccactgtgaagaaccaatgactgttagcttaaattactgttacattattaatacactttaaagagctcatttgaatgaggatttatttactatttatccctactttacaggaagtctttctgctctccttcgttccaaatggggtccattaaaagacaatgagcaaacaattggcttttatacaaagcaaatactggaaggattaaaatatctccatgacaatcagatagttcaccgggacataaaggtgaggtacaccagcattcattttcatgagttctttctttgctgggttattattttacttgcaaaagtcatattgtgttatgagtattaatttagaatggtgaataagtaaatcttagaaacagcagaaatataaaatatcgttcaaccctgaatcagttatttatgttcatgtcttaacgcttctgctcaaggaacacactgcttaactgcgttcagccaacaagattgtgctcccaccacacaatgtttcctaggagctctgtggtgtgggatgcagctgtcaaaagttaaacaggagatggcccctggtcctgaggagcttataggctggttaatctttgtatccttgcccatagtagctactcagtaaatacttattgaatcaatggatgaatggttagaagaaaaaaaattcctcttttctcacaagtatcacatattcattgatttaactataattataaggtatagattctctaaaataagctaaaataataactttacattctctttttaaaaagaaaattcagaactaatacattttttacaaagtctggactgttgaaaataagttaatattagtaccctaaaatcaaccaaaaagcccatttatctatcatgtccctacatattccaggaaaagaagtaaagaaacatagaaaagaaagtaaggtaactggaaagttatgaaaatcgtaatttaattatacatacatcattatatatctgtaaatagcaacaagctctaaccaattaggaatcatatttgatcttgtgatctgagtagcagattatgaagaacttataaccatccaatgagttcatgttgcccactgaccagatagagctgatttctcaagatgtaagaattgcaattgagaaagagtttaatacacatagagatggccaaacaaaatattggatcttataattattcaaatcagcttctccaaaaatttagaggctagggtttttcaaagatagtttggtgagcagggggctagggtctgggtggttggggatgtaattataggggtgtggaaaatggttcttgtgtgttgagtccacttctgggtaggggccacaggactggttgagtccagagtcacaggtctgggtgatgccatctgatagtcagaaatggagaagcctgtaaagacatctcaaaaggccagtcttcagttctacaatagtgatgtcaattataggaacaattggggaagttgcaaatcttgtgacccccagaataatgggctgataatcatttgactgtgcctacatcttagcggactttaggcccctctcatcctcctaacctggtggcctttcattagttttacaaagatagtttagttttggggaagggctattatcaactaaactataaattaaatttctccaagtgagcttggtctacaccctggaatgaccaagggcagtttggaaatttaaagcaagatggtggtggttagatcagatctcttttactgtcataattttctcactgttgtaattttcgcaaaggcggttggtttcaaactgataatatgtaaacaaaaaatagtgtcaagaatgcactattgagataaactattaatgaagaatacagaattaatgtcgttggtagctgtaaggacaccttttttttttttaaattggacttaccaagtcaacaacagacagtatctgaagaaagataacaattgtgattaaagtcctctgttctctagggtgacaatgtgttgattaatacctacagtggtgttctcaagatctctgacttcggaacatcaaagaggcttgctggcataaacccctgtactgaaacttttactggtatgtttttgcaatgatgatacagatcttatgtaattaaagaaataattgctgagtttgagcacaatgtgagagagaaattcagttggtgttctcacacacagtaatgttggtatcttttttctttcttttcttttcttttctttctttttttttttttttttttttttttttgagacagggtcttgccctgtcacctaggctggaatgcagtggtgtgatcacctatcactgcagcctcaaactcccaggctcaagcaatcctcccacctcagcctcctgagtagctgggactacaggcatgcgccaccacgcccagctaatttttttgtatttttgatggagacaaggtttcaccatgttgcccaggctggtctcaaactcctgggctcaagcgatatacctgtggcctccaaaagtgttgggattacaggcgtgagccactgcgcctggccaatgttggtatcttttgatgctcactgaaaaatgtgttacagaatttgatttggcccttttctcttcctgtatttatatgacttgcttagttagtctcctgcttaatgccactgaagatttttttttttttttaattctcaacttgttacttatttttcttttcatgtaattacttctttcctggttggcctacaataactctagcaagatttttttttttttttttttattaaacatttccttggcccaacctctctgtgatgcttactcataccctaatcacttcccatttggacgatgaattccctcttttactgtttactctctgtggttgactcccctactccacaatataaataaccctaggatttcaattcagaagaggaagtgactcaccgactcagaagaagggagggagagagctttcctgagaaagtaggcaacgcaaccactgagctgcctctggtgcaaagtactgggagggtggagaccaagtgatttccaaaaaggtaacagtagccaagaggaagctcagactcaagagattcatgactgcccaacagttatagggagggtgtgtgagacttcaaacctgatctccatttagttcttatcactccatcatgctaattctcatgaagtgttaagttcttcttatagagagaaatttagcaggaaaaaaaaaagggtaaggggaagggaagagaaaaagatcatgaataatctttggtctaatatgaagcaacatggccccatctcaattctgtgaggtaggtgggagtacctccattttgtagatgaggaaattacctgggagagaagtgacattgcagtcagaagtcacagcagtgtgtaccggatagaactcagactggttttttgtttttgtttttgttttgagactgggtcttgctatgttgcccaggctggtcttgaactcctgggtttaagcagtccacccaccccactctcctaagtatctaggatgtcatgcctggcaaaactgtttttttgtttttgttttttcttttgagatgggttctcgctctgtaacccaggctgaagtacagtggtgtaatctctgctcactgtgacctcccctaccccgggctcaagtgattctcctacctcagcctccctagtagctgggaccataggcacgcacctccatgcctggctaattttttgtatttttggtagagacagggtttcaccatgttgcccaggctggtctcaaactcctgacctcaagtgatccacctgccttggactcccaaagtgctgggattacatgtgcgaacccccacgcctagccagaactcagattttgtatctactgtttgctctttgcttttaccttctggctctagtccatctttctctctaccttcctgcaggaggagagagagacattctgtgtaagttttttccctagagcattcagtcagcaatacccctggcccagctcccacctcagggcaatggatattttagggtacagaattaaacacattttgaatatatttttttgaaaaaactaaattctgacctattaataacttcaaatgtctttacatttctttcctcttactcttaacttggcaagcagcagtttcagtgctgtcaagactcagtaatttctgagaggaaaatccctcgtttcacacactttgtgggacaggatgttaacacagtatcttctgctactaatctggggaacatcttttttgtaaaatctccaaaggaattgtaggaaagcagtcctcacagagcccttttcttggacctcttccactggtgtcacgtaagagtgacgtgtgtcactaacatgtatagatctgtccccagcaccggtcccgagggccctgcacatcataggcttcaaacgtgaacttggtggtcactaagtcccaggtgggttagtcccaggtgctcagtcaataaattggtctgcatcaccttttggtgattttgatgagggaaaaggcagcagtgatcaccatttatggagtgcttactgtgttaccttgctctgcactaagtgctttacatatgttgttttattgaaattcatacatcagccttaatcattaggtatcattatcccagtttgtggtgagaaaatgaaggttcaaagaggttgaataacttgcccaaggtcacaaagctagttggtaatagagctgagactcaagcaagacttaacaggccaaagggaattaattatcttctcccaaacctgtccccggcacactcttctgtcccagttggcagccactcccgacattgttatccagggcacttctcttttctcacactccaacccagtccgtccacgaagccttcaaaacatgtccaacattgggccggttctcaccacctctgctgctgccactctcatcgctcacctgcattttcggtggcttccccaactgtgctcctgcttcacttttgccccctactgtctactctcagcactgcagccagagtgatccctctgaaacataaaccaagtcctattgctcagagccctcagtggcttgctttttttttttgttcagagtaaacaaatgtcagaaccctcatagtgggggacaaggctctgacctgattcggagtctgttccctttcagaccccatttcctactcttcttctgttatttactcagagccagaaacgtggaccttcctgcatttcctccatgacagcaggcagggtcccatcacagggcctttgcacaggcttttcctcctgccgctaccccagctgtctgcatgggtaactttcttaccttcttccagtctcaacgcagatgtccacctctgcagtgagaccagccatgaacaccctatttaccatggcagccttcctgctgatcctcttcactcgggtctatatttttttggtcataacatgtcactttctaacatgctgtataatttacttactgtgctgataatttatcatctggcttctactgcaaaaacataagcccaggtatttctatatgttttctcctctgctgtattctaagtgcctagaacagtgcctggcccatagtaggtcctcagtgtggatctgttaaatgaatgagtgaatgaatgaaatgtgacattagagtttaattaaccactaagctgtaccacctccctgggtagttgcagcagcaaagaaattctacaatagatatttcaaagcaattttttaaaaaaactttagaatgcagatatgtgaggtatgagttttagagcaaatactctcattgattttacttaagccagtgttcaggttggctctcatcttcattatccagcttcgtaaattgctttgtttaaaatattatgtgtcatgtatttgtggagtaaaaagaggagcagataagaacacatgactcaacctgtttttctggcacttgctcagtgggggataattaaacacaattggcagatggttatctgacaaatcaaatattgcataatttgttgttgacattacttgaattgtctaatttacgatgtttaaaaattaaaaatttccaaattttgatccactataactcccacttagctattagtacaacttaaattctctcattaattctattctaggccccgagacaacaaaagggggtggtaggcttcgatgcattttcgaaaagaccatttgagcttatttaaatcatacaaaattatcacttggggaaaagctacaaatgaagagaaatcataccaattttgtagtaaaggtgggcgagcgtctttggggagcatggttgccttgtctttggccaggtgaaaggctttctgagagcagacatgtgcagttgtatgttagcgtgaactactgctatgcagtgataaggtctgcaggataaacctagaaagactgcaatacataacaaaaatgatacacttttatttttgtaaacaatagtccatttctcacctatgatagtgcttttcagaggaacagtttgcaggaattttacacaattgttttcacctaaaaccatgcatgaggcattcctaaaaggtgtcatctgtatttatcaaaatgtctgtcactttggttatgaatcagaaaatctgaagcagttcttttggcaaacacctcataatttgaagtaattcaacatggcatcttggatgagttcttgtttgctgactatattatttgtatatcagaagcagggtatgcggtgatatgtttctattcatgctcctgactcattgctagactttaggaaaccactttatggggtattcgaagttcaaatccagcctctcatttaggttaatgaggtagttgtacttaagtgtttacctggggtatactaggccagaagcagactaagggctcgtggccccctccacttaattctttctattataccacactctccacctctctgattccatgcaggcttaaagctcttccctttttcattgtattctttttgtttgtttgtttttttgagacagagtctcactctgttgcccaggctggagtgcagtggcgtgatctcggctcactgcaacctccgcctcctgggttcaactgattctcctgcctcagcctcctgagtagctgggattataggtgcccgccaccaagcccggctaatttttgtatttttagtagagacagggtttcaccatgtttgccaggctggtctcaaactcctgacctcgtgatccgtctgccttggcctcccaaagtgctgggattacaggcgtgagccaccgcacccggccttcactttattcttagtcactgtatctgattatgtgtctatatggatggctcatggcctgtctttgatctcttaaacctgttagtccatggaccacagacagcagcaggagtcatgtatatttggattacagaatagggcacaccagaaatttatttgcattaattttcacaatggctttcagaatctttatgctgtcatgattaagaaataagaatgaaaacagaagagttaaagcattcaatttaggaactgaaaaatagagatagagctaaggaaatggatgaatgaactatattctcttctggaaaagattagaagtttacataataacagtcttcatgcacttcaagaaatgtgtactgatgttattgttctcaaaagactaattgttagaagtttctaagaagcccaatgaaatgatgcctcacttatactccactgtctagggaataagagcgtacctattcataaccagataatatgggtaaagtatttttatgtcactgatgaaatccattataaaaactgctatttccacttttattaatagcagagaaaactggaactcacaaacgatattaggacttgaatcatgtttttacagttgtctcatttctgttgaaaaattctgttgaaaaactgtcattagatacccttctgttttatctttttaaaatggaaatgtgtttgaattgtttccaggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtcacacttcatttctcttaaaaacaaatggataaagctttttatagctgttggatgttctgtgtgtgtgtgtcatatttttttagataaagggtgctaagtaaacacaacttagaacacattaaaggtcaagaagattctctctcggttagaaccagcgctggtgcctcacacagtggatctctctgtgccttagttttctcagctataaagtgagattcaatgtaacttccattgaccaccttttaacaacgcagtataaataacacatgactatactgaagatgatttaagccctttgggaaacagtctgaaaattttccgtgaatgaagatagaagaactttttttataatccatttaggaattaaaccaaaattaataatttcctttacttctctaccataatagtttgaaggcttcattttttttaaaaaaaaaagagcataattaccattttaagtaaatcagtcttattctcatatacctactcctctagcttgttaatttgcccatcagtaactcctatgggaggaggaagaagccccaccttttgcagtaggaggtacctgataatagaaataggctcatgagagcacaagtgccagcattttgagatctggggactgagcatggctatgacctgcatcttgaatccctgcagtcctccgctgccagactgccaggccaacaggaagtttgaaatggaaacatgcttcccaagtagtaaaactcacacatctgctactttctaaggcagaggacttaaaaaaaaattatttatttatttatttattttttgtgctcccctgtgggatccaaggcaaaggactttttcttttctttttttttctttttttctttctttctttcttctttttttttgtggagacagagtctcgatctatcacccaggctggagtgcagtggcgcgatctcggctcactgcaacctccgtctcctgagttcaagcaattctcgtgcctcagcctcctgagtagctgggattgcaggcacacaccatgacacccagctaattttttatattttagtacagacggggtttcaccatgctgcccaggctggtctcaaactcctgagctcaggccctccgcctgccttggcctcccaaagtgttgggattaccggcatgagccacgcgtttggcctgagaggacttttgatggtaattgttattcctctccctgctgcagaccatgtttctagctcttattccatctgtgcatagcctcttgtgaggggccatgtgttgttacagaccttctgcttttgtgcaaagcttggctttatgcttgaagacaatctgataggacactgctggtataaaaatgagtagtgtgaccaaacctcagagagcaatggcaggtgccaagagaggtgcctttcttgccatgagtggatgtctttctcttcttggccagtctttcaggttttctccagtgtctaggacttatctgaaatgctgctttataattcacgaatgcaatgattattataccatgtgtttttttgtcacattaggccagtctaagctgtgcacaggaagttgctatcttagagagatgacatgacatagactgtggcaccagtttacagtgtttgaatccaggctccaacatggtcaagatatttgagactttgagcaaattatttaacctgcttgtgcctcagtttcctcatctataaaataaggataaaaatagtacctgtcagccaagcgtggtggctcacacctataatcccagcactttgggaggctgaggcgggcagatcacctgaggccaggagttcaagaccagcctggccaacatggtgaaacctcatctctactaaaaaaaaaaaaaaaaaattaggggggcacagtggcaggcacctgtaatcccagctacttgggaggctgaggcaggagaatcacttggactggggagatggaggttgcagtgagtcaagatcgcaccactgcactccaacctgggcaaaaaatgagactccatcttaaaaaaaaaaaaaaagtacctgtataataagagctttttgaggagtgtatgaggtaaaatgtaccaagcacttagaactgtgtctgacacatggtatcggctatataattcttacaaataattatatattgtttatattacaatgaatttacataagctgtataagaacaaaaggatttcctttgaaaatttgctctgtactaaaaaatgaaaataccattaattttttttagaatagcagtaataagtaaattctaattgttataaaaatattgtttaattttaaagtgcttttaaatatctcttttaatgcaggtgatttgagacagggaagatattcacaaatcatgtaatagggaaaagaacataggctttaatccgaacaattcaggttcaaatcccagatctcccttttcttagccttgttacctcatcctttctaagccttattttcctcattggtgtaacaaggaaaatatttaatccgctggattgttggaaggatttgatgagatctgtaagtggagaaaccccagcacaatgcccagcacttagctactgtgagcaacgcagtggtctcagctcggtggctgagcatggtggctcgtggctgaaatcccagcactctgggaggctgaggtgggtggattgcttgagcccaggagtttggaccagcctgtgcaacatggcaaaaccccatctctacaaaaagtacaaaaaattagccaggcgtggtggcatatgcctgtagtccgagctacctcaggaggctgaggtgaaagactcgcttgagcctgggaggtcgagactgcagtgagctgagattgcaccactctgcactccagcctgggtgacagagtgagatcctgtctcaaaaaaaagaaagaaagaaagaaaaataaagatcctttttgtgtgccaatgtaccaatatgttctaaagctttgaaggactaaattattacttcatagtgctgcctactgtcttcaactaattattctgcctgtgccattggtaaaggtaccaaggcactctgttgatcttctataacctgcagcaaacacatcttatctccctttgagaaaagccataagtttgtgttgtatgataagggatcttgttgcattggggggtcaagttatggaagctggagttcaggtgctgagatgttcactcagaaggcacattgcactttttatatttatgtcttaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcaggtatgtggttgcattgaagaggatatagtctgagtccttcaatcctaagcttttaagatggaagaattttccggaagtaaactaacctgtttacagatatcactggaaattggtataaatattagcacagtgttctcaggcatttggttgcagtatcagggagctgtattccatcaatttcacaagtgctgggacctcatacataatagtcttcaatcacatagttagtaggtagttaatatgtcaccatctatatcactctaacattgtggatactaaggttcaagtgtaagaggggttaaatttagccttttagagctgaaaccccagattaccacaaatgggcctacagagccattatagagctgttggatttccaagccctgtaggtaataggttcttttaaggcagtagaaaatacctgttgcctcttagggtatatacttctgaataattacacccaaaaaaaggcaagaaggaaaaagaaagagagaaaagattgccagctataaataaaacagtagtgtaaaaatataagtacattatatttttgcaataattgtctataactcagaaaaaaaagtaaaggttccaattgttcttggcgttttttgatgtttatattggaggagaatgggcagattgaatgtttggaaaggacattgaccccatttcaggcattcattttttgttgatttctcagtttaacaacaaacccagcacgtgcttattcatggctgtttgcttttctttccacagctctttcagctggatcaaatggtgagtttgtttttactttgcccattgagctgagacctggtgtctggtgtgataaactccagacttcccatcaagtagcctcatgctctgctcctggcttacatggggggaaaggagggtgcggtactagatactataaggatgtgtgcagctgcaagcctggctgggcttattcctttggaaatccttcatctttctctttcatgagtggggatggcttaaattttttctccctaaaagcaagatggtgactgtgtttttgacagcttcaatttgagtgaagtaaatgcttctttatctaggaaccagttgactacctaatgtatttcttgtggaaaatgtaaatgccagataccttcctctgtcatctttggggtgatacattctatttttagtggccaggagttattgtgcctttgttttctaacgttggcttttgcggatcataactaggaaggtagagaaagtagatttgctctaagaagatccattaaagcatttagaagaataataaagaaatgaacatgaggctgggcatggtggttcacgcctatagtcttagcactttgggaggccgagatggtcagattgcttgagctcaggaattcaataccagcctgggcaatatggtgagacccccatctctactaaaaatacagaaaaatagctgggtgcggtggtgcatgcctatggtcccagctactagggaggctgaggtgggaggatcgcttgagactggggtggtggaggttgtagtgagccgtgattataccactgcactccagcctgggtgacagagcgagaccctgtctcaaaaaaaaaaaaaaaaaaaaattaacagcatggtgttggattttcctaagttggatgtgtggttgatcaaacagttcagggggcttaatgttcattgtgcatgggttctgcaggccaagggcaggtttttgcaggttcctctgatgccccaaagccagtcagcccagagtagaggcctgttaattggggtttcctgggtacagcctctctactttttcttcttccatttcttccattctgagaatctggggaaactcagaagaagacaggcacacccttgtacctcttttctccacagacagcctgggctccggaaggcagccttgcattgtcacaaagtcggccctgcagtgcttggcaaccttctgaccagcctgcttctggtgtcctaaaatgggcactgacttcagaattacacagaagtgggttctgatcccattgacccactttctaaatatgggacatgcatatttcttctgtcattcggtgctggtaacattacctacttcacagatttggttctgggaataaaataaaataatatcctaaaagagccttggagctgtgcctggaagtttaatccatgattgttttatcccttccacatggcttggtttttgttcgcaggaaatagtttcccatcacacacacgcatttaacttctgtgaactcaaccatacacacttggcaagagcgtgcatatatgagagagagagagagagagagagagagatcctttaagtggacagttctatgtcttctcagtgactatgtaccttggggtgagcgtgagatggacggtgtaaacctgctgaactctagtcagtcaggttcccactgccctttcgccgttcttgcttacatatggacttgggcctagaaaaaggggcagtccccaattccctgcatgattaaactgttcagactctcagctaaaacaatatcattacatggatgatgtgcctcctccctctccttcctaggagagcaggacagatgtgctaaccaaattaggagctaaaatccacgcccccccccccttttttttttgagacggagtcctaggctggagtgcagtggcataatctcagctcactgcaacctctgcctcccaggctcaagcgatcctcccacctcaccctcctgagtagctgggactgtaggtgcccactaccacgcccagctaatttttgtatttttagtaaagacggggtttcgccatgttggccaggctggtctggaactcctggcctcaagtgatctaccacctcggcctcccaaagtgctgggattacatgtgccaccatgccttgcctaaaatcccatttgattgttcccaggtattataggaaatggcctgcctcatgtcaattgaaacaatgacctattagctcgtcttactctccttctagatgagtacaagatacaggcctcttccttccccaggtactttctataggccatatatgtgtttctgtccagagcacaggcccacctctcaaggttctctacctcccataactgcacttggcttcccctcaagaggggagtaagagggtggtgacaatgagacccccttcccctttagagagggacatgacttgtctcatcctgactgctcttccatggccacacacagacccagagatttaagtaattcatgtcagcttaaatattaattgtacagttatggtgtgcacaggaaatgtgctaggccctgaacgtataaggatgataaagacagagttcctgattttaaagagccattgaccttataggagaaaaacactggaaaaaatcatctccaccatagtatagtttagtctgtgcagaggagtcaaaagggagagacagtgactgaagtcagtctgagaatgctgtttcaaggcagactttccagtgaggtgcacctgatgagtaaggacaaatatgaacttaacaggtgaatggggagtggagatccaggtgaggcgacttctcgcatgagttaatgccaggatgtgtgaaactttactgtgtgttaagggaggcttgctggctcagcagcactggtgcttaaagtaaaaggggagggatgatgctggagtggggagcaggctcagatcccaaagggctccttatgaaatgttaaggaatcagcaaggagggttggggagccggggaaaatttttatctgaaataatattatagaccagcactggacctatgattctacagtaagagaaatgtcatttatctgccctgtccaatacattagccactagtcatatgtggctattagacactaaacatggctaccatggctgaggcactgaatttttattatttaaatgtcagtgttaataaccatatgtgggtagtagtgaccatattggacagtgaagctattgatggatcattccgatggctgtgtgaggatggtttatttagtaagatttattccataacatttttaaccctctgctatgcacttggcactagaatgtaggcacaaggcactaggaatatagctatgcctcagttggtcccagatcctgcctgcatggatctcttgcaatgcttgttaaaaattaaaatgcctggcccttctcagaatctggaggtgcaagctggaattctgtacttttaagtaaacccagatgattcttgtcatcactgcagtgtgagaaccactattctatgtttggccagttggagactggaggcaggatggccagttaggagactctgtgttgtggccagactgttcctaaactgtctaggagaaggagaaccataaagatccctagtgatcatgaatagctgttaggatctgaggccaccctcacagcaatggaagggatttagaaaatccccgttttcccaaagcaggaatgtatctaattccttaaaggtcgcactgtctcccttccatagatgggagctcccagcaatctggagtccatagggttgccagtcacccctcctgactccagcctactcctggcctcttggtaaagctatctcttaggggatatggggctcacaccccttcccatcagcccctgaaataaggcaatgagaatcatctccttagagacacacctttgacatgtcctatcctcagagaggttcattcagcctcttttagactcttcgtggtcagccccatagaggagggcttcttaatacctggcaagatatcagcagtaaggctgcctgtgactggaaatcctgccaggctcctctcttgcagcctggggtcccaatcactcacgtgtatgagcttatgttcgaggaacttgtaacctctgtgatatctggaaactgtcaccgtgctcccctggaaatagttacacttgagcttcttcccatttacagtgacacagaaaggcactacgcattctcacttgcctggaaatcgtcataacttaagaaggtagaaatctcaggcgtggatttgatcatatttccaccacaaacgtataaagcaaactgtctcagcaccacctgtcttgctctttccaccccttacaatagagaaaacatccattttcctacagaaggccaatccctcacagatgagttctggctcctgtggagcccccgtgactcctccagcttctgcctctcccagtgagttccatatacacatgctctaatgtcttttgtcctaaacccgtccttcccctgatctacaaatggcctcactggctgacaccaccacctttttttgccccacatcacagcttcccgtcttgaagtacagtgtctccagatctccacctcttccttcccacccatgtagcgtctccccttccacgcgatcactgggcctgctctggccaagatctaatgagatctctttagccaaatccaacaagtgcctttctcaacctactcaacttctcagtggctctcagcctggatgactgttctctcttactttcgccctctcctgtgtgggcttccatgacaccccattttctctgttttcctccaacctcatggctgctccttgtcattctccttggctgcctgttcatccccttcttttcctctaaatattggcattcttaagggccgggtctatgctgtctttttatctttccccaaattatgtcatcctttactttaaataccatctccagccaggtaggctgctgaggttctatctagcccagtcttctgagctccagactcatatccaattgcttttttcttttttagatggagtcttgctggcggctggagtgcagtggcatgatcttggctcactgcaacttccgcctcctgggttcaagcaattctcctgcctcagcctcctgagtagctgtcactacaggcacacaccaccatgtcaggctaatttttgtatttttagtagaagcgaggtttcaccatgttggtgtcttgaactcccaacatgagataatcctcctgcctcagcctcccaaagtgctgggattacagccgtgagccaccgcgcccagccgcccaattgccgtcttcatttttcaaactgaactgtcaaataacaccccttatccactaaaaagaactttcctttttggcctgtattatttctcatcttagaatataagtacgatatgcatccattcagtttcttaggccagaattctactttggagtcatttttgattcttccttttcacactcttcactccagtccatcagcaactcctgctggctacctgacatatagtagatgatccacaactgtatgttggatgaatgaatgcatgtgcctaatagagaaggggactcaatctagaatcaggttcactcatttaaaatcaagcaggccgggtgcggtggctcaacacctgtaatcccagaactttgggaggccgaagcaggtggattacttgatgtcaggagtttgagaccagcctggccgacatggcgaaaccctatacaaaaattagccaggggtggtggcacatgcctgtaatcccagctacttgggaggctgaggcaggaaaatcacttgaacctaggaggcggaggttgtagtgagccaagatcatgccactgcactccagcctgagcaaaatagtgtgactctgtctcaaaaataaaataaaatcaaaccgaggagggaatcagggctctgcacatagaacatgcagaatatctgtaagtccctttatttccttaacgagccatagtgacaggcactcggttccatccttaagcatatacagttttacctcattaggcctccttttaggcagtcggtagtcacagcaacgttaaaattcacaggcgtgacacaagtcctctcattactggataatcaaaccacatgatatgaccaaaaagccaaaatacaggataattcaagtccttactccttctcttctttagatacacatacatttaccacacacacacacacacacaaacacggaaacacacgataggaatccctcatcttgtactcttctagtctagtctgtactagtctctttactcccaagaaacaacaattttgtctttgaaatatgaatgatgcacacctccgtttctgagtgtggcatgcatctcataaaaatgggctggtgaagaaactcaccaagtctgaaggatcagcagtgagttccactgcagggcttgtatcccttcttgtaaagagatcagctactcagtcaagccaagagctcttcttcagctgtattcttccatcagtaacatttaactttagggacttgacatctcatagcagtgaaactctttctcccaagcagctatttttttctgttctaaagtccgttccccccaaatagcgagatgttgactctaaagtgaaacaaggcacactatagaccttgaccttccccaggaatgactcaaaagcagtttggtgtttgggccccccttcaaacctttcttctctcagacaaccttactattaccagcaaggaagaggtcacccatttcctttctgctgtagcagcactgcccaaaatatggtccgtgaaatgctaggcccatgagctgctccagaatatgtggaaacaatacatgccaggcatttcccctgccatatatcatttgcatactggtacttaattggtcaattcagcaactctttgtggcttcctcttgcttcctgccttctagtgattcagctacagaactatttaaataacagcagataagtcaaccaattcatcctggggagactttccagttactgaccagtaaggtggtttcccccgaggtcagctgttcctgaaagctgtatgtacttccgtctttctcgctacagctgaaaccaatgtcatgagtcccctatccttgagatcagggcagttgattcagttcagcccaagaggaattaagtaagaaggagattccaggcaacagtggatttccttttctataattttataccttcattctttattaaaatgcttttgtagcattaggatgtgtgtttgataaagatgtttctggcaaaaaccactttcttttttttttttttttttgcatatctgtccataggatagatcatggacagtattttattgtgattcagatacccgtttctctcattaggagtgaggctgagaagttttatatacatttgggagctttttgtgtttttctttctgtgaactgttcaggcatacatatacagagactgactagctgtcctccagacctgtttccttttccttctggggtttcccagcctcctggcaagtaactgtggctggtggactgaggcttgggcaatggatggtgggcccgagtggcaactcacccaagcatgattcataaaaacttcctatgagatcctcctactctttcttccccatctgctggaaagatgttgacacccagagcaacctatgaagctttctttaaaaccaatgtttgaggaaatataggcaactccactgtcttattctccatccaaataaagaagcagctcatgtctactagagaatcatagtatctgagaaccaggacagacctaagagatcatctagtccatctgtttccaaaatttgttttcagtgatgaatccttttttatatgaatccttaagcagaactgtgatatatgacagtcagcatattttctctggtttcaggtataacaggattggaacctgtggtctagacctacagcatcccactcactcatcccaaccaaggcagccccaagatgctaatggagacacttaagcccctgaagaacaggcttaaagattatcaatctgaccctgaatttgataaatatgaaaactgagacccataaatagaaataattagtagtcagtaaaaatgaggggatcagaccctcagtagacccactgaacttgggcttccttgactgttttggtaccccagagatatccctcccagggcctgggaggccctttcctggctaccctgctgtatgggttatgctgagcaagggaggcagtcataacacatgaccgttcccttacatagcataattatgctgctcattgcaacaagatatttgacaaagaatatggcctctttcaatgggtgtttcagtatgtgtacattttttaaagtgtcaattatcttttccctcctctcatcacaagcagaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttggggtaaagacctgacttacttggggtgagagaagtgtgttgttaagtgtgtcattttataaagggaactgtgatttatgctgcataaattttctcagcattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcaggtaaatcctctcccaggtgcttcatttcccaaaggttacatattttatctgtgtcctaaccgcctgcagctgtcacagatgatgtgaaaggcaagaggaacctgtagtgatcatcatgataaacctaccccacaggaaaaaagaaggcaaaccctatggtagggaatatattaatatgaaaatagggaaatgattttttcattgcatttttgaacataagctatttttaagtcagaagcaaatttttcacattggtgacattccaaatagcccctacaagcctcttttactcttcattcatttgtttattcattccatcaataaacacacattaagccatgtgagttgctaattctgacattagcatgaggctacctgccagtcgctcctctcagcatttgggaaacatcagcaaatacaacagaacccctgagcttgtaaggttatatttaaaaggagggtgaagggcaaagggaagtaaattgtagtgagtcttcacttaatgtagttgataagtccttggaaactgtgactgaagcaaaattacatataaccaaaccagttttgccgtagactaattgacataaacaagagttaagttcctatggcatatttctggtcacaaaaacatgaccaaactcctaaataaagactaaaacacttctaatattctacattgaaataaatgtgaactctatatacatttaagaaagatgaataaaaacaagataactatctacccagttcaaggccatgggtggccagagcctattctggcagctcagtaccaggcgggcacccgccctggaaaggacactattccactgcagggtacatacacacacacacccacactgagaccacgtagacacacaaatgaacctaacgtgcacatccttgggatgcggaggaaactatatgtattagtctgttctcatgctactaataaagacatacctgagactgggtaatttataaaggaaagaagtttaactgattcacagttccacatggctggggaggcctcacaatcatggtggaaggtgaatgaggagcaaagtcacatcttacgtggcggcaggcaagagagcttgtgcaggggaattcccatttgtaaaaccatcagatctcatgagacttattcactatcatgagaacatcacaggaaagacccacccccatgattcagttacctcccacttggtccctcccatgacacatggggattatgggagctacaattcaagatgagatttgggtggggacacagccaaaccatatcaccagagtaccccaggtaaggccacacagacattgagaaaatgtgcaaatttgccaggtgtgatggctcatgcctgtaatcccagcactttgggaggctgaggcgggtggatcacgaggtcaggagatcgagaccatcctggctaacacggtgaaaccccatctctactaaaaatacaaaaaattagccaggcgtgatggcgggcgcctgtagtcccagctacgtgggagtctgaggcaggagaatggcgtgaaccctggaggcggagcttgcagtgagctgagatcgcgccactgcactccagcctgggcgacagagggagactctgtctcaaaaaaaaaaaaaagaaaaagaaaagaaaatgtgcaaactccacacagacagtggcccctaccaggaatcaattcttttttttctcatcaaggttagaaggaaacaacattgggcaaaacagtgttatttgaggatctgctgtatgtaatagtttagaaggccatatgtactctgaagaaaacaaaagcttgtcagtgaacctatcattccttggtataatagtttgctagggctgtgttttagtccattttctgttgctataatagaatacatgagactcagtaatttataaagaaaagaggtttatttgggctcatggttctggaggctaggaagtccaagatccagtggcccatctgcatctggtgagggcctcatgctgcttcaactcgtggtagaaagtagaaaggcagtggggcttgagtggaaaaaagagagagacaaggagagccaactggctttatgacatcttgctttcctgagaactaacccagtctgttgagaactacattaactgcattaatcccttcatgagcctcatgacccaaatgcctctttaaagactctgccacctctcagtatcattacattggctattaaagttcaacatgaattttgacaggacaaatcacatccaaaccagggcaagcaaccataacaaactgtcacatactgggtggcttacacaacagaaatgtattttctcacagttctggaggctgaaagtccaggatcaaggggttggcaggtttggtttctcctgaggcctatctgcttagcttgcagatggccaccttcttattatcatgtgctcatatggccttttctggtgcacttgcagccctggtgtctcttcctcttctgatacggacaccagaaacatcagttcaattggattagggccccacccttacgacctcacttagtcctaattatcccttttgaggccctgtctccaaatatatcccattgagtgttagggcttcaacatacgaatttggaggacacagaaccataatacctgggaaaatgtgttccctggaattctgtgtacaaacacaaggaagaatccccttcccaaatatgcaccaggagaaaaatggatttccctcagccccaagcttcttgtggatacaacctcccacagacacactcagtccctggtatgacacttctcatcctcttttagttcaatgggtactgggaactcatctacctgcctcccttgccgtggcctctacctgtccttcatgatcactgtggactactgcacatagcttcttccctccctgtgtcctgaggaaatagctgcaaaaaaaggttggggctagaggagtctagccaagtttttaaagtctctcagtacaacagtttacctgttctcatcttttattgagatgtaaatggagcaaagctctctcttggctcttagtaaacaatctcagcctgtctctgccttgagaaactcactgtgcttctttgctaaacattttatcgccttaggaattccctaatgtccacctctttagatctcatagaaggagctgaaaggccatatatgtgccagtagggcctcagtacaaggagagctgaaatgagtgttttctacacactctcaaaaaccttgacttgggtcctaaaggaaagctgtctcgggcagttactctgaggcccaggaagaaggtgctctagagtgaggggtagctggcctctgagtccagggaggatgagtgtcatgcatgcttcgtggcggtggagactggagtggtctcgagccatcagctttctctctggcctttcctttggctcacggtgatcattcaaagactgagaataggactgggttgacccaagaagaggaaccaagctggatggagagagcagctgggcagcccttggagttctttcatttattcattcaacaaatacttattgagcatcagtcgaaggccaggcactgtactatgtgctggggatgctgtggcgaactgaacaaaaatatctgcatccccttgaagttgacattctagcagaagaagaaaaactatacatatatataaaacatatagtaataacagctaacattttctttaggccagttactgttcttagtattccatgtgtatttgctcatttaattttcatgacagtaatactataccaatagttctattagcatcctcattttacgaatgaggaaacaggcacagaggacttgagtagtttgccgaagtcatgcagtcctaagtgatggagttaggattttgacccaggcagtttggctctgaagtttttgctttaaccaccacattgctctgcctcgctggtaggcccgatggtgacaagtgctaggaaaacataaagtggggtggggattaggcattggaggtgaagaaagaaagtaaatcaccattagccactgcagagtgaaggcctctcctgtggacctttaaaatgcttgattttaggtcaaaaacacataaaacccaggaattgcctaaatctctaattacccccaaagaatgtgcttttccagtacaggaaatgccagtttgttggggtctattctttgtctccctgctggaccatagcatcatcagggataggactgccttggtcatcacttctatgactgtgctgaaatagttaaatgtgggagtggttagtcatattcaattgtttggtgcctcctggttttaaagtgcatttgaatgtcctctgtaaaaggagaaatgaaagaaaaccttaaaagcaaccatcagagggcatgccttaggggaccagcatgaagctaccagtgagtacccgaaactgctgatcagaatcacatgctgaatccataatggccacatgatggtggggcccttctgactgctgttaaggatgttgggaatcctttcctgtgacatcaaatggtgattcagtggtagaacaggtcctgacccaggttgacagctgctattgcaggtcattggggcagtagaatagaatggttaggagcttgggcttagcttgctgtttgaggcctggttccatcacttaaaggctgtgcaatttgggcaaccgatttaacttctcagagcctgaacctcctcatctatgatagaggagtctactttataagcttgctatcaggagtaactgagattgtgagtgatttaaatcataacagaaaatattccacaattgttaactgttattgttatcattatcaagcaggctaataatagttatctaatatctttaatttttttctacaatcaatcagaagtaattattgccattgtattgtttctagatacatatttgtatctatatttaagcctacactttataacaaaaccaaatctagatattggtcaggtcctcaaacccttaaaccatgaaaagccttttaatctgtaacatccttctgaaatcctttcctggtttttgaggaagtttaaaggataaagactggagagcatctttgcagaagaccctgtgtgttagtcagggttctctagagggacagaactaatggaatacatatatatgtaaaggggagtttattaagtattaactcacataatcacaaggtcccacaataggctgtctgcaggctgaggagcatggagagccagtctgagttccaaaactgaagaacttggaatctaatatttgagggcaggaagcatctagcacaagagaaagatgtaggctgggaagctaggtcactctctcttttcacatttttctgcctgcttatattctagccacactggcagctgattaaattttgaccacccagattaagggtgggtctgcctttcccagcccacagactcaaatgttaatctcctttggcaacaccctcacagacacacccaggatcaatactttgtatccttcgatccaatcaagtagacactcagtattaaccatcacaacctggtactaggagtgcaggaaatgcataccgttaaatctatgctgatgctgagtcaggctcaccagatactagccaagatgcttgtttttgaaggcacatgagtgagttaacatggagagactggagtcagaacagaaataaatgatgacgtaagtagatgaaatagtctgaacagaaaacatttcccagagtagagcatgttcctttgcaggacagtagcacacacatcaaaaaaccagaagcaacatgtttttctgttgtaaaaacaaagttaatgtcgaaaaaaaagtttgccatttgaagtttgctattggcaaacatgttgcaactgagtttttactaagagaagcttccaatttctgcataactcacatttttcttcttgaacatgttttcatgatgttatgattttgcctgtgaatctttaccttgggtgcagtttagtttgtggtaaggaaaaaaccaacaaagtttataatggttcccattgtgattttaaagtattcgtttaatgacagctttcaagcttttcaatataatcttatctcatgaaaacataaacatgagaccaagcttccaaatgaaaatatattaagagaaagaactcgatggtgcatttcttttttattttaatagactcctagaaattataattttcacagcccagtggaggaattttaattttaatggtacagtaagaaaatgtacaatataaaataaaaatgatataatagtttcttaaagtttcttatattttcttaaagttaaatgggaacaaataacatcctactgtgcttccttaaagaagcagtgtgggctgggcatggtggctcatgcctatagtcccagcactttgggattacagcactcaggaggctgaggcaggtggatcacttgaggtcacgagttcaagaccagcctggccaacatggcgaaacctcagctctactaaaaatacaaaagttagctgggcatgacaggtgcctgtaatcccagctacttgggaagctgaggtaggagaatcacttgaagttgggaggcagaggttgttgtgagctgaaatggagccactgcactccagcctgggtgacaaagcaagactttgtcaaaaaataaataaataaataaataaataaataaataaataaataaagaaaagaaaagaaaggaagcaatatgccttgctcaaaggagaaaagttccatctgaggttggggaaagtggctcacatctataatcccagcactttgggaggcggaggtgggaggatcacttgagcccaggaatttgagaccagcctgggcaacttagcaaaacccagtctctacaaaaagttttaaaaaaaattatctgggtgtggtggcacatgcctatagtccctagctactcaggaggctgaggtgggaagagagctagaacccaggagttaggggctgcagtgagctatgattgtgccactgcactccagcctgggtgacaaagagaggccctgtctcttaaaaaaaaacaaaaaaaaaaaaacaaaaagaaaaaatcattttgagaaagagcatttgtttgaacattgtaatatattttagtgtaataaaatagtccatcggtccgttcttagaagcaattgcttcattgatgggtaaggggtagtttcaaaaatgaagtttgagatcagcccctcttggttgcaaggaactgacacaccgttaggacaactgaagtaccaaggacatgttataggtagacacgcatagcaataagggaagtagactcttaaggaattccaatcatagtgcctagccgagtctcacagacactgaaaacagaatatgagcctgaggaacttcaagtccccggagtttgcacatcttttctctggcttggttgctgttgacctgcttggtgtgcatttctgttcttgtccacttctcctctccctccctgatatggtttggctgtgtccccactcaaatctcatcttgaattgtaactcccacaattcccatgtgtcgtgggaggaacctggtgggaggtgattgaattatgggggcaggtctttcctgtgctgttcttgtgataatgaatgagtctcacaagatttgatgctttcaaaaaatgggagtttgcctgcacaagctctctctttttgcctgctgccatccaagtaagatgtgacttgctcctccttgccttctgccgtgattgtgaggcttccccagccacgtggaactgtaagtccaattaaacctctttcttttgtaaattgcccagtctcgggtatgtgttttcagcagtgtgaaaacgaactaatacactccctattgtctttctcaattccattgcttctgctatggttggacatattcatgaccctattttatagcttctctttccgggcagactttcaggttgagatcctatggcttattgctcaaatctctttttagttcccaattaaaatttctgaaagaatcttatggccttagtctttttgggcaaagctttgttatctgactatatcatggctactgaccagcgtgtggggcaggtaccttttctctctgattatttcttggtgttggtaggaggattgaagaggtgccatatagttcaaaatatggtctttcctttggagacatttggaagtccagttcttctcagaaagggctgtgggaagtatggtggctcatgcctggaatcccagcactttgggaagtagtgatgggaggctcgcttgagcccaggagttcgagaccagcctgggcaatatagtgagaccttgtctctaccaaaagaaaaaaaaatgtgggggcagggggtatggagataggattaccatggcaggtatatccagcatatgttgatgtaaggattgttgatttttattcacagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtaagtatgatattttgccagtgttttcccacacactaaaattagttagaaaaataagataaaacataagttctgttatttttcttttaaaattccagtgaactctattctttttggatgaaaaatgtgagatattcgcctctcagtgtgcttctaagtatctgatttgttgttttgtgtgtttgcattccccaaattaaaaaacacataaaaccaaatcaccatggaaaataacaaaatatttcccatggctgaacttcgttcttatgaaattatgttgggtcattgtttattttgacaactttagcaacgtaacacactttagtcatacattttctaatgctatatgagaaatgccatctagtggccattgagaaaaatttaatagtacagattgaaatggtcactgctgaataaaaccagttaatttttttccagtttttctctagttttcatatagaacatttttaacatgtttgtttcataaatacctactctgttctagccagaagtatactttcagagtacagagcatcactgattaaaaattaaagcacatgatctaatgagagattgctgagaagtcttctctccaaaattgagttgctatgcaacacaaactaaagccagtcttctgtactgcattcagaaccctctgtgttattcttgggtgagacttatctgtggaactcagtgccaaaaaagcctcaagccacctccaggagacccttaacaagatgtgggagactgaaataagagggttcttgatggtgcttgtggtataaatatggaagtataattttatttaaattccaaaattaattcagccctaatgtgtgtattgcttctttgtagaaagtgtgttgacaattttatttgcaacatcaaatgatccccaatttaaagccaaattagaatccttcaataactactagcattctctgagacactgtgtaagccacttggtctttatgctatattgtgggcagggacaagagtcctgagttgattgagggcataagaaattaaagcaactggcaaagcctatcactaatattaaatgctaaaagcatgcttatgctgcaactagggaaacccaactgcctgcaagtagagtgaaataatttagctaatttgcacttgcccacacatttggcctctagcctagaggttggaaagcaagtttgctgtagaattcagactgagagctattgggttgtactcctgggccttgggccaggtcagacacacacacacacacacacacacacacacacacacacacacacgtatacacacacgtgtacacatacacgcctgctcttgctcattcactgtccaggatgagaatgaacccaaagtatgggccctatgatgtaatttgctatgtaataaagagctgagaggagcaggttatggttataacagatccctcttccacctaataagaatgtaaatttttttttttttgagatggagtctccctctgttggctaggctggagtgcagtggcatgatctcaggtcactgcaacctctgcctcccgggttcaagcaattcttgtgcctcagcctcccgagtagctggaactacaggtgcctgccaccatgcccagctaatttttgtatttttagtagagattgggttttgccatgttggctaggctggtcttgaactcctggcctcaggtgatccgcccgcatcggactcccaaagtgctgggattacagggcgtgagccaccatgtccagccagtatgtaaattttttaaagaaatgaaggtaccaggacaaactcagcctggatggattttctagaacaagtgggaacctagcaagggttcatttcctgtgcaactagtacgatgaagtcctcaaactgactctcttccaaactaggggagtttgatgaagatggaccaaggacaggcatgagcaactggagctccagctcttgacatgggtttgtggctgggtcaccatctccccagctgcagtagggatggtgattaaatttttggaatttaaataaaattatacttccataatcatactatagatactcagaggtatctaaccagagccctgttggggaaatagcctctttttttagaggtctgtgtaagccagcaggtagtagagttaacccaaaatctaagtgagcttgtcatagtcttatgctaaaagcttgtttttacaaaggtaatgcacatgataaatacatacaatggaatataattcaagcttaaaaaggaaagaaatcctgacacatgctacaacatgaatgaagcttagagatgttatgccaagtgaaacaaaccattcacataaggccaaatactgtaattccacttatgtgaaggtacctacagtagtaaaatttatgagagacagaaattaaaatgcttgttttcagggactgtggggagggagaaatgggaacttactgtttaatgagtatagagttttagttttgcaagataaagagttctgtggatggatggcggtgatggtagtacaataatgtgaatgtacttaatgccactgaaccatacacttaaaaatggctaagatggccaggcacggtggctcatgtctgcaatgccagcactttgggaggctgaggcgggaggattgcttgagccccggaggcacaggttgcagtgagccatgatcccgccactgcactccaccctgggtgacagagcaagaccgtgtctccaaaacaaatgaaataataataataataagaagaagtaattgaaaataatgaacagtaagaacagcctttatttttatttaaagtctcttagaccctgtcttcctccttcaccccctccctccatccattctgcagacattataaaagctaaaaactgcacattctgagtcccaaagaagcaacattctcatttgaaccagactgcctttcacttaaataacttatttgcttacatggggctcactaaactttgatttgaagtagcaatttttactttgttttccaatgacataaagaattacaaagaattcaagttgaagaaactttttagttgttttgtaaatggaacttcatacaagtgcttcgatcatctaggctatttgcaattaaaaattaaagtaggctaaatgtcactctctctccaggtcaataaagttcttcggaatcataacatcaagccgcactggatgtttgccttagacagtatcattcggaaggcggtacagacagccattaccatcctggttccaggtcagagatatttaattactctgcacatatttagtgcttggatattttagattactgttcatctgttatttctgatatcaccttagtactttaaaaaccataatacccttttttaaagaaatattttcaacatcaccaaatagtacatatagtctggataatggtacaccaagcaaaatatttactaagaatgaggaagacttgcttcccctgtctttaaggaatgtgtttagatgtgaagagaaaaagtatacaggtgactcagataaatacgcatttcaaaatatagatatctggaccacaaaacacattcctacatcttttacccagtggttcccaaatcttccaatgtattgagcaatttaaggaggtattgcatagctcgttgcattgagcaatttaattgtctttaaaattacagctttcaaagccccatctgaagccaaataagaatctgccaggaataaagcccaggaatctgatttttttttaaagactagtcttttagagcagtttaagattcacagcaaaattgagtggaagatacagagattttgcacataccccttagcctaacacatgcatagcctcctccattatcaaggtcccccacagagtggtatattggttacaatcagtgaatctacattgacacgttatcatcaccaagagtccatagttcacattagggttcagtcttggtgttgtacattctctaggaattctacatatataataacatgtatccaccattatagtatcataaagaatattttcacagccctgaacatcctgcttgttccatctgtaagaacttgattttaatacagctctcaggtcatgtcgatgagtagccaagtttggaaatcactggtctagacacagccccagctatgttggcagtgagatacaaaaggggtagtgttgatgaaacaaggctttttggcataagtgaggagtgtattcatactctaaggcaaaacctccaacgtgttttgatagtctacccattaataaaaaattgtaggcaaagctcttccaccctgtgtgtgtgttggggtggtgggtggatgcatggatgcatggatgagtatgtaggtaggtagaaagaaagagcagttgaccaattgttacatggatagatacagatttatatatatttatataaacaaattagaaacatgttctattgtactaatttgtacctatattatagagcattctgaaatataaatttaaaaggataagatcaatatgaaatattttcattttagttttcttttttttttttaagtagagatgaagtctcactctgttgcccaggctagtctcaaacccctgggctcaagctgtcctcccgcctcggcctcccaaagtgctgtgattacaggcgtgagctgctgcacctggccctgaaatatttttaaattaaaattatttataaatggtactacaaacttttaagttcaggccaacccttctgagttgtggaattccctctcttctcatagaacacttgggtgtttgacatgagagcgagagcatccgtgtcaatctttatgtcaaacattggtcaagattaagttatttcttatgtaagaaagaaacagaagttctgctatccctgaacatgttacttctacctggaacacacctccaccccatgtctctcctgtcctgtggcttgcacctttgcattcttcaggccaccgagagtctggacctatccccaaatctaaagtaggcttcctctgttattctctctccttggaaatggttttcacctatttgtgatgccacaatctgaaactacttttgtttctagtttaatggctgttaccctcaccagagggtaactgtttgtggtttattttattctgagcctagcatactgtccagcacagtgtctggaaaacagcggatccctgattcatatttggttgaaacaataagtaaatgagtttcacctgattataacaaattagggtggaaattttgcatggtgtagaaacttagaaaaaaattctagagagcctttgaagcacatgattagtagttggaatgtgaacctaagaaattcatgctctaaggaagtcaaacaatatttatattcagatactttatcattaggataaggctggttgtagggaatgtgctatagagaggttagatattcaaaagatctatgggatgaagggggaatagtgtatatcactgaaagggagaggtatgggccatgagttaaacacagtagcaacctaaattaaggacacctaaatgaagaaaggaaaaagagagtatattttgaaacaacttaaatagcatataaatgatctgtttacttaattaaaaaaaaacaaacttccttttagtaatgattacctaatgtaatgtggtatccagaatagaaaacgaacattagtgaaaaactgagaatctgagtgaaatctgcagtttagttaatagtttataccaatgttaatttaatcattctgaaaaacatgccatagttatgtaagatatattaggaagagctgtgtggatggtatacaggaattctttgtactatctttgcaatgtttccatgaatctaaaattcttccagaatagaaagtttaaaaagcaaaagtaactgtaggtgaaactctgttaggtttagggagaacagcagggaggttgcagagagggagctgtccttgcacgagtgtcccagggatggacactgctgtgatcaaccatgtgcagaacaaggcacattttttattaaaagtgtttgctaaagaaaggactttgttcttccaccatgaaattggtttctttgaggccactaggagtttctgatttcaactgaagttactgtttgaaaacatttatttttgaaaagtggaatttttagaagagaattacatagacagtactttttgtatttccctcaggataagataagtccatatacactgtataccaatatacaaatgatgaattatgtggacaaaatgaagtgatgtcagtcattcaacaactccatcaaattttcagatgtcctgaaagattttgttatgccattaagatataaagaaattacatgaaaaacagacggtcttcaaatgcccctgataaaaattcctttcagatgcaagatactatagttaacctgccatttcagaagacatgcgaaagaagaccacaaattttaaaaagtataccatcgctagtacaatatgcattgcttaatgacagggctatgttctgagacatgcgtccttaggcaattttgtcattctgcaaacatcctagagtggacttacacaaacctagatggcagagcctactagatgcgcaggccttatggtatggcctgttgctcccgggctacaaatttgtatggtgtgttactaaactgaatattgtaggcaattttaacacagtggtaagtgtttgtgtgtctgaacatacaaaaggtatagtaaaatatagtattacaatcttatgggaccactgtaatatatgcgatccatccttgactgaaatgttattataccgtacatgattgtacgttcatttcctagatctgtctactgagaagacccaaatcttggtttctaaatgccattcttcaataaaaggaattgggtttccttggagaagtggttgattccgggctgggggcaggggaaataaaagataagattgtagttgggcatggtgtctcacccctgtaatcctaaggcttcgtgaggccaaggcaagaggattgcttgaggccaggagtttgagaccagcctggccaaaatatcaagaccctgtctctaaaaaaataaaaataaattaggcagacatagtggtgcatgcccatagctacttgggaggctgaggtgggaggattgcttgagcccaggagatagaggctacagtgagctatgattgcactgctgtactccagcttgagcgacagagcgagaccccatgtcataaataaataaataaatacctggaacaccttgtgatgccagaaataagaaagtgtcaaaaaggatggagatttattgaaaggacactagagccaacctgaaaatgttccaaacagtccaagccagaacaatctgaacaataaaataatgatcatattggattatagattatagaataaaataagcatccgtgagtccatattaatataaataattgaataaataaatatatggacgagaaagatcacctttttgttatagtagaattgcgactgataaataaaaatgaatgaggaaaacagaaaatcaccagtaggcaaacaccacagtaataattattgcaggcaaggaccatcaatgactgctaaagtaggcaaaagaatgaggagaaacaggatatatgtggatggttttcaaactgtctccccacaagatatttactaactacaaggagaaaacagtaattttacagtgaaggaatgtggcagacaccccctcaaccaaatgatcaaggtaagcatcactagtaagaagacacatcagcatcatgtacctcctgataggatgccctgagaaggacacagcatcacactgtggtgttcttgccaaaaatgcacaacctcaacctaatcacaagaagacgtcagtgaacctcaaataaaagacattgtacaaaaacctgaccaatactcctcaaaagggtgaaggtcgtgagaaataaagaaatactagttacatactggaagagactaaggcgacatgacaactaattataatgagggatccttgatcagaaaaaggacattggtaggaaaactggtgaaattcaaataatgtccatagattagttaatagtattgtgtcaaagtcaggtgtggtgactcacatctataataccagcactttgggaggctgaggtgggaggattgcttgagcctaggagtttgagatcaccccaggcagtgtggcaaaaccgcatctctacatgaaaaatacaaaaataagtcaggcatggcagcatgtgcctgtggtcctggctactagggaggctgaggtgagaggatcaattgagcccaggaggtcaaggccacagtgagctgagattgcaccactgcactctggcctgggggacagagtgagaccctgtctcaaaaaaaaaaaaaaaaaatagtattgtatcaatgttaatttcctggttttgataatagtgccaaaggtatataaactgttaaggcaagagcaagtggctgaaggctatacaggaactctctgcactatttttgcaacttctctgttatcctaaaattatttcaaaataaaaagttaaaaaaaaagtgtttaggccgggcgcggtggctcacgcctataatcccagcactttgggaggccgaggcgggcggatcacgaggtcaggagatcaagaccatcctggctaacacagtgaaaccccatctctactaaagatacaaaaaattagccgggcgaggtagcgggcgcctgtagtcccagctacgtgggaggctgaggcaggagaatggcatgaaccccagggggtggagcctgcagtgagccgagatcgtgccactgcactccagcctgggtgaaagagcgagactccttctcaaaaaaaaaaaaaaaaaaaaaaagtgtttaatcttttttccaaaaggagcacacagaacagagagtacagtacaagtcccttaagaatttgttttttctcagactattttctcacttgtcatcaagaatcagcctttagattattggcagcattagtcctctagtacagtctgcttgtgggtgaccagatggagtaatgctgagcacagagactatgatggccgtgctaaggtaagagtattgataatgtaagcatacttcctctatcaacaataattgttaacagctgcttcaagcacttgatattaccactagttgttaactgaatcaagcatgtgctccaagttcacattaatgtgaattgaacagcattgtgtacgtacgaggagcttcatgcaagtgttatacactgcactcacaagtattatgatcttactaagcattagaaatactctgtgttaaagaagcttggtctaggccaagcgtggtggctcatgcctataatctcagcactttgggaggccaaggcaggcagatcacatgaggccaggaatttgagaccagcctggccaacatggtgaaaccccatctctactaaaaatacaaatattagccaggtatgatggcgcatgcctataatcctaactactcaggaggccgaagcagaagaatcacttgaacctgggaggcggaggttgcagtgagccaagatcatgccactgcactccagcctgggtgacagagtgagactctgtctcaaaaaaaaaaaaaagaaagaaaagaaaaagaaacttggtctagttattttccttcctctggggaagtaaccatttgggtgggaatagttttgttgttgatcccatcttgctggtttggaaacaatgcactggctccacttttccactcatgggctttaaggcccccttgagtcccagtctttctcctgacacatggctgtctcctgacagtcccctctgctttacattgttctcagagggtcctgggccatcgtttgagcttcattctttcaaatacacttccctctttctctatcaagccaaggctcccctcccccagaactctgcataggcccttcagcctccatgaatcccttagtgagtgagtaaactaccactggattcagtcactgcaaatgtactttatttaccccttagcactcttactacatgtatgtgttagggttcttcaaagaaacagaaccaataggatacatagagatatataagagaagatttataatgggaattggctcatgtgattatggaggctgagaagttctaccatataacatcagtaaactggagaaccaagaaagctggtggtataatcagtctgactccaaaggcctgagaaccaggggagccaactgaaattgaaggtctgagaaccaagagctctgatatccaagagcgggagaaggtggatgtcccagctcaagaagagagaaagagaattcaccctttctccatctttttgttctattcaggtcctcagtggactggatgatgcctgcccacattggagagggccatcttctttattaagtgcattgattcaaatgctaatctcttctggaaacaccctcacccctcacagacacatccaaaataatgttttaccagctatctggccatccttagcccagtcaagttgacatatataattaaccatctcagtgtacatgtgaattatatatataactaggtctatacctgagataatctgagatatttgtagctgtattaatttgtgcttataatttcatgttatatttcaatgtgctctcagcgctcttctgtgtatttgccctagttctcctttagattgtcatctctttgagaaaaagaaccagatgttctgtgtcatttgcatattttacaatgtttaatctgatgacatgcactcagggaaccaccatgaaagaccaaaataacaaagcactgcatgaacttacaagtttctactttctttaaattaattcagagaattttttacgtcatatatacatacgtaaaatgataatttaaagtttacagaattaagaggatatttaaatataataggattataaattttccttccctaaaagtgagattatagtcaacaggactacaaacctttcagtttagggctgggcatggtggctcacgcctgtaatcccagcactttgggaggccgaggcgggcagatcacctgaggtcaggagtttgagaccagcctgaccaatatggagaaaccccatctctacaaaaatacaaaattagccaggcatggtggcacatgcctgtaatcccagctactcggaaggctgaggcaggagaatcacttgaacccaggaggtggaggttgcagtgagccaagatcgtgccattgcactccagcctgggcaacaagagcaaaaccccgtcttaaaaaaaaaaatcagtttagaaatcatgaaataaattgaagaataattatagaaagttgtaaaaggtctaatcttgtcctctaatttaatctagaatcacactttcttaaattatttttaagttattttattgctttctaaatacaaataaccaaataaccctagtaggaatactcttccattctgccaacagtttttgaagacctaatacgtttagcccctgcaatcagcgctgggtttacaaaagtaaaacacatgattttgacttactcctaccgtactatcaataaattaagaaatgggattttggaataagagatgagatagagtagaggtgaagtttggttagccttaagagataaagcatgaggacatggagaaattggaatccttgtacactgttgttgggaatgtaaaatggtactgctactatggaaaacagtatgatggctcctcagaaattaaagatagaagaaagcacccttgtgaaccagcaatttctcttctgggtgtatattcaaaaaaactaaaagaaggatttcaaagagacatttgcacattcatattcatagcagtactagttacaattgccaagaggtggaagcaacccaagtatctagcaacagatgaatggataaacaaaatgtggtgtatacatataatggaatattattcagccttagaaaggaaggaaattctgacccatgctacaacatggatgaactttgagggcattatgctaagtaaaataagccagtcacaaaaagacaaatagtatatgattccataattttatggttttttcactcctgtagttcagcaagtgggagggagtggcacccagtggcttattctctcccattgttcgacaagtgggagggagtgttacagctgtattactcctgccgctgacagcttggcgagcaggagtgctacatccctttcactcccacagttcagtgagttctgggttcttgtcccgtgaccaagaagaataaggtacacggacattggagagtgagtaaagcagagtagaatctaattgagtgacagaaagaaagttctcagcattgagaggggacttgaaattgggtagccatctgtgatgctgagtctggggtttttatgggcttagaataggggggtgcatgctgattggtccatgggaggtcttggaaaaagcaccatttgattggttaaaagacatcattcagaaggaaccaattgagagagagtgggtaaaatggggatagatgttctcactctggttgtggactctctccagaattggcagcttgcttctcaggctttaaactgtccttggtttgaaggtcaggtttcactggagatcaatccctgtctgcctaggaatttatctgtctcctgtaactataaacgtgaggtgtctagagtagtcaaattcatagaaacagaaagtagaacggtagtttccagaaactgagaagagggagtaatggggagttgttgatgggcagagtttgagttttgcaaaatgaaaatattctggagattggtagcataacactgttagtatacttaacactactgaactgtgtactcagaaatggttaagatggtaaattttctgttatgcactttttaaaaccactatacagaattttaaaagagggataaagaaagccaggtctatgtaaactgggccttgaaaaaggacactctggtttttgttatgatcaaaagatgatgagttctctttagattgttgactttaaggtgcctaccgaacagtaatgtccaggatgttctagatgttacaggaccgggactagaggtgtagagtttgtcatccacacatctgaaatacttaaccttcgtggagttgaatgagctcatctatggagcaaaagtagaaacataaaaaagtgaaggatagaatcccaggttccagcttaaaagtgggcagttagtagataaaaaggctctgaagaagagaaatagcagccagagatttagaggaaaatactgtccacagatcaaatagggtaaatataaaaaggtacctagaggatttggctggcaggcctttggtgaccttgccaaagtgcccatatacgaatggtgggatggggtcctccattgctcccaatggactcccctcctgtacacacgggctcttaacctgtggttcatggactcgggagaggcttcagggaatctgtgcaaatatagcaaaatctaggtaaaacgaggaaatctaggcaaaatgttgcatgtatgtgttttcttctggggagagtttttatgactttcatcagatttttagtaggttccatgatccgataaatgttctatgtgccgaagcatatggagtgaaaattcaatatttctgctaccttgatttcacttaaattatgactgtaattcctttttgtggaccaagtttaaggatttaattacaatttgtaatattttttcttatgggaagatattgttgacaaaaaatagccaaactctgtaaaatatttagaagtttattctgagccaaatatgagtgactatgacctgtgacagagcttccggaggtcctgaaaacatgtacccagggcagttggggtatagcttggttgtatacttctagggagacagaagttacaggcaaagacataaagcaatatatgtaaggtagatgttcagcccagcaaggcaggacatctggcagggattgggaggtggggaagtggttggggtcccaggtcataggtagattcaaagattggcaattggttgaaagagttaagctttgactgaagagttgaagtcagcataaagaaatgcttgagttaagataagggctattgtggaagccaaggttcttattatgtagatgaagcccctaagtaacaagctacagagagaatagatggtaaaatctcttattggaccttaaaaagtgtgagactcttagttgaatctctcatggatcaggaaaagacctggaaagggaaggggattctctacagaatgcagatttcccccacaagtgatgactttgcaggaccgttccaaaatatgtcagagaaatatattttggggcaaaatactttgacttcctttatggcctgttgtttgtcatgggatgctatactagagtcaggttggaatttgttatcttattgctacaaagagtctgttttgtcagccttatgatctttattttaatggtaatgctggtcagttgtgcctaaactccaaagggaggaggtataaccaggaatatctgacctttcttcccataatggcctgaactagttttttcaggtttttttggggatccccttggcctgggggtaggtggttcttcagtcagttggggggcttagaattttatttttggtttacaatatcatccaagttttttttttttttttttttttttgagacagactcttgctctgttgcccaggttggagtacagtggcatgatctcggctcaccacaacctctgcctcctgggttcaagtgattctcctacctcagcctcccaagtagcgtgccaccatgtccggctaatttttgtatttttagtagagatggggtttcactatgttggccaggctggtctcaaactcctgacctcatgatatgcctgccttggcctcccaaagtgctgggattacaggcgtgagccactgtgcccagccacaatatcatccaagttctaaactgacatgcaggtgatctcatgttatatagtatgtttaagttggaaaattgtaacttctatggtttaaatttcaatggttagtcaacaggttagaggagaacacacactagaaatcggcccaatagtcaaagagagatagtcttactaatgtgagtatcagcctgcgtgtggcattttcagcacctgccctgtatccccttacattttggatgttacaggcagaaagcattctgcatattcacgtgtgtttatataatctctgtatagctcactttccttatctgtaagcaagttaatagttgtcagatattatgtaatctgaaaatgaactttacttgtataaacacttttaaatattcttaaaaggtttttacatctttacctttctttcagattcctagcattttccccacatatgtgcaatgtgactatgtattgatcattcttgaattaaatcattctgtttgaattagatcattctttccttctgtttgaattagatcatatcttgtgaattttgcaagttcaatagaagaacaaatctgagtctacagaaatccatcctcacttttggaaaagcagtttggaatatatatcttattgacggtggggcaggagggtagcattcatatcttaagaaattaaggcaatgagtcatattttataaacactaccactgatattatgccaaacagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaataggtaagtcctacactgacgtgggttggtttcttttcttttacttttactaaagagcatgtgtttttggtctacagaatatgattcccttatcccattcatggaaacttgattgaatgcctttctttataaaacaagagaagtttagtttagcctcttttgtcaaataccactttctgcctctaccagtttaagcctttttcagcggcatttgattacttcttcatctccaggtgccctaagatttttccaatagcttcgttgtagcctcatagactgtctaagaaacaggctcagagcagcatgtaccttccagtagatagctgaaaagaacagaaagctcatgtttttgaaagcccagtcaagtctttataggagaggaagatcactgaggtcgagggaacaaaactaattaatggtgctaaagatttgtattttagaacctaaaaaggaagataattgaccacatttatgattctattttatttttgatatgctgtaacatatctggagtataatttgcctttgataatttgctagcatagaacccacaggatcagattattaacagcaaatgtttcctgttctttgcagatgttgttggtacagttcaaggtctgaatttttatgatttatagcttcctgtgctgcctacagttgacatgtgggaaactgactttatgactctgggtttgcattaaaaacttttttttaagcgaatcaataaaagttgttcaaatatttagaaaccttaattgaaaatgctagttattcaccagggagattaaaaatatcttatttccagtcataaagtttaggtttttaaaggcaagcttgtataccaaaatgagtacaagtggtaaaagctcatcctatattcagaaacatgaaatttggttgcattgttaagtaaatccatatagacacatcttctatgatgtgcatagagcagtcttattttaataaagggagattgcctctctgactttcatatcccaattttgtcctctgaaacccagctcttgccatctctactatttagtgggaaagaacttgggtcttttctcttctgagacttcatggaaatcttggtttccctcattcctcctcttctcaagcaagagtccaaggataacaccccatcgttatggaaggtgtccatgttagtcacttatctctaggttactctctgttgcccagtcctgagtggtggtgttttttggactcctgctgtgatctctggaggaggaaagttcactcattactgttttggttgacctcctcccacccatgccttctggttagaattacgcagatagtaaaactactttgtttaccaaagagctggtatatctgcttttctggccctgaaacctcctgtctacacacctggctgtgtcaataggacctgcctctcctaatgcagcctagacacaagtccttttccttctctccttggcctatttggttagcgttgtgctcgccaccctggcgccactgtctgtctaccatgcttgggccatctgcagtccctgagggcttccggccgctttcttcacagcttcccctttctcttctgagtgtctcttggttctagctgagggcctgcttctcacatctgcccatctctgttgaaaagactagtatttacccacatttctttattacattagtatgtcacaacaacccacacatttacgctttttcctctgcatatttacatttgagtctgtgaaatctacagataatcagcctcgtttttcctttttcagtaatatctcccacggctttccatcacccacagaaaagtgagatgagggacgatgtttgcttcatgcatgatttgaagaaaggacagctgctttagtacaaaaaccaagtaattgaaataagggaccagtcctgtccatattggtccttctaattttcagttgaatattacctgaaatataaaggcatacctaccgcaaaatgaatctagaggaaatgttagtgtgttttcaggaaaggttgtagctctcatattaaaaattgtaagcttagaatatttaggatgatcactgatgaagggaaatcaggtttatcctgcttggaggatcacctgagcccaagaggttgaggctacagtgagccatgattgcaccattgcactccagcctgggtgacagagcaagaccctatctcaaaaacaaaaacaaaaacctgtctcaagaggagctgcctgtttatttaatttccccatcctacagttctggaattacccaccaatccacctcatcacccctgcccatccaaggttaaaaattgacctcatggcagatcctgccatacttttttggaacagaaaggcagacagttgccttgatttcaaaatattgccctgctaaataaacacaaaataaaaataaaattgatgtactggattgttcttaagataaatacttctaagagctggattcggagcaaatgaggtgggctgtcaatactctgcttccagtgttgaagttctggtgtttaaggtgttaaaagaaagcttcagacaaattaaatttaatggagtttaattgaaaaagaaaaaaatagtttgtgaatcaggtggcctctagaatcacagcagattcagagagattccagggatgcctcgtggccagaacaaatttatagaaaataaaagtaaagtgacgtacagaaatcagaagtgtgcagaaagagctggatttgttatgggttggcgttcaccttatttgaacactcagcagtgtatgagtggttgaagtatggctcctgggattagccaagactcagctattgttatagacgcatactcctaagttaggttttcaatcttgtctacctgttaagttatagtttgtccacgaggactcaaatatgcaagtacggagtccttctcaggccatatttcattcactttaacaaaagataaaaagaaattacatagtctagacaaacataggttaaactctagaaaacatcactgtgttccttgagaaaacagtaagaagataccatcactgtcttatacgtataaattagcaagtaggacaaaaatacataccagatcaaaaaactgccaacttaaacattcacacagagcttcctgcccatttctttggataatatttgttttgaaagagataagaagcctccctccaagaccctgtgctccctcttctagctttcagttcatgctgcttcatccacctcattgtgcaccacacttaccctgcagctgtctttgttaacttattttcctccacccaccttctctgtctacctcttattgtgttttacttttgtcccacctctgctacctactctgctgtgatcccttctctctgaggatctcatctttatgtcctgtgggaatggggtcgagcctgggggtctgggaaggtttccttcccactgagtcctggaaaggctcttttccagggactgaggtagcaaggaacagaacatcccttattaaagaccagacactgacttggcactgtacctatgctgtctcatttaatgctcacaataatcttttctggaagctttagttttcttttttacaaatgatttgaaaactgaagcctggaggcattaggtaatttatctaaggttaacacaggaagtgcagggttgaaccaggacacaagcccagatctgtcagttgcacgatgctgccttcagattatgtcaagtgaagcagaaacaaactcttgagttaaatctatcaatactcagaaaatgaaacaaatagagtttgttaagagctgtagtttatgcaacgatttatcctgataatcttaataacgatatattttaaattattatttctgaatccaacttacattaagatacttttctaaaaaattagagcacctcttttcataacttggaatgttttctttgagaaattctattggaaatggtgagtaggttaccagttggctctcagttgcatagtgaaccttctatgggtaagaactttggtatgaatatcacagtttctccttgtttctttggagactgcatcagatgccaactaggaactgaatgtaccaggaacacagctatccttttacccacttcacccccgcccccttagaaggaagaggaataatagtaacaatcacaattgtagcaacaaccgtgaacatttactgagaatttgttatatgccagatattctaggcgacctcacctatgactgtttctcaaattttcatagtttacaaaaagtgattacttttctgatttgcattgattatgaaattatgcacatttgccaactttttttaatgggggtccatacatgtaaaatataggcctgttaatatctgtatcccatatttatatctttgacatttatggtcataacaagaaatatcaggacacatctctgaagattttggcagacaatctgtggtggaggttttgaattcttgtcggcaagcacagtcttccaaagcttagcttctggacctgagggtctgtgaacctgcaacatcagtgtcatctgggagctcattataaatacagtctcagaactcacccccggggcactggaccagtatctgtatttcaataaaattaggggtgtatgtgcttattatagctcatgtctagaaggtcatcctaggcctggcacagtggcacatgcacacacctataatcccagagctttgagaggctgaggtggaaagaccactggaggccaggagttcagagaccagcttggacaacatagcaagactctgtctctacaaaaaaaaaaaaaaaaaaaattagccaggcatggtggtgcatgtctgtattcccagctgcttggaaaactgagatgggaggatcgcttgagtccaagagtttaaggatgcagtgagctataattgggccactacactcagcctaggcaacagagagagaccttgtatctaaaaaaataaaaataaaaaaaagaaggtcaccctgtgtcacctcctgtcaaacaatatatttttcttctgcagattactggaagaattggttcggaaagagaaagaattacaagcactccttcatcgagctattgaagaaaaagaccaagaaattaaacacctgaagcttaagtcccaacccataggtgaatagcagaaagttttatagtaatactgttcagccaggctgccacaaaaagccaagaaagccaacaggaagttttatttgtggctaagtcagcatttctcacttctaccatgactgcaagcaggaattcctttaaaaaaaaaaaatccagtttttaactgtagcaaactcatttcttataagtgcagtaaaaatagattattcataatcatcttttcctgagattatgtattactgaggtaaacagggctctctgtttttagtctttatttttaaagatttcacaatgagcttactagaataaataatactattttttgtcattttgcatttatattctgtgtattctagcctttttccttataatttgaagaggcttaaatagaataaagatgtagtagtaaaaaggcatagctggggagaatgttatttagcccatttagaggaaaacagaattcatagttatttgtttagatatgtggctctttcatagtggaaaaagagattatgataattatatagttctctgctaattgtattcatctttattgcatgaaaaacacaaagtctaattttggtgcacagagtttattctaagaaaccataaaattgatatgaaagtgtaacgtaggagtgtcatttcattattgcttttgctccttatttactagtaaattcacttctctgagttttattcatattatcatctatactgccaatctcaattgtttctatgaactgttctctgatagagcaaaatcttttaaagtatcaataaatgtctgttgattgtgagggtctcagatgacctctgttaggtgaaattaagaatatcttcccaaaattctgttctagaaattcctgaattgcctgtatttcatctaaattcttctggcacaaatactgaagattctgaacttaccgactggctgagagtgaatggagctgatgaagacactataagccgggtaaagaaaactgtctgtgggacaagtattctttcacttcgtttcataatgttgggtgcctgctatgtgacaggcacaggggatacactggtgagcaaatcagacccagccctgccctcctgaggcttacagaccagggtaggcacgtgataatcagctaactccacagatacaaatgtgattctacactggtaaattctatgaagaaaaaggtatcaggtgtttattagatagggcgagagaggttggggaaggttgttggagaagggaatgaaagagctgaaggctaacagaatgtgagggtataaataggccaattgtatgtatgttcaggaggggtgtgggagggagaccagggaagaaccttgtgcagtggggctgcagtgtgtacaatccaacgaggcaggcaaaagctctgtggtcctgagccccttaggaattttatgtatttgaaatgaaaaccagaaagagtgggaaaaaaataaagacaggactaaaagaaaaaatttcttgtttctaattctttgtatgttaatttttattttattttattttattttattttattttattttattttatatttttttggagacaaggtctcgctctgttaccctggctggagggcagtgatcatagctccctgcagccttgacctgctgggctcaagtgatcctcccaccttagcctcctgaatagttgggactacagacatgaaccatcatacccagctaattaaaaaaaaaatttagagatagggtctcgctatgttgcccaggctggtcttaaactcctggccccaagcgattctctcacctcagcctctcagagtactggggctacaggcatgaaccaccacgccaggcctgtttgttaaatttttaattctttttcaacattattagattccactgggcagcagctattttattgctacttaataaaatcaatctggtcgacttatttcagaaatattttctatacaaaccatattttacctgtaataatctaattcctctctgctctgtatagactttttttgattttgttttttgagacacaatctcactctgtcgcccaggctgcaatgctgtggtgcgatctcagctcactgcaatctttgcctgccaggctcgagagattccctgcctcagcctctcaagtagctgggattacaggcatatgccactaagcctggctaatttttgtacttttagtagaaacagggtttcaccatattggccagggtggtctcgaaccctggcctcaagtgatctgcccacctcagcctcccaaagtgctgagattacaagtgtgagccactgcgcccagcccctatagacttttgtaatgagcgtgaatagcatttgtttatgttcattatatgaacacacaggcatacattaaaacattgtaatatttgatagaaagaccctcttaatacaatattgttttgttttatatttaaattttaaaaataaataagaataaagatatctcttcttttgacttgataatttattaactaagtagaatttcgggccgccttagaaatctacatttaacaagttacagctgaataaatttaaacaactccagaatatacattcctctaacttaggctcaaatcctaattaaggaatagtaattgataatctactaaataatcaccctttttatttggtttaaaagtaaaagcttgaggccaggtgcagtggctcctgcctgtaatcccaatactttgggaagcataggcagattgcttgaggccacgtgttggagattaggctggtcaatatagtgagactgtctctatatataaaaaaataaataaaatttaaaaatataaaggtgcagtttaaattaagactctgcttttatggtgaattacagtcaagtgcctttgcttaaccatgaaaaaataagttcagaaattaagcataggcagtacctttccaggaacactttttatccacttgaggaaaaacaaagctatgtagcattgaacttctaaatacaagatttgcttttgaacagcagagtgattacaagtgagtctcatctgttcattagaagaccattcagaagttctgtgtcacttgtaatctttttgcatttggaagttaatatggatgcatttcttgtttttgtttttgtttttgtttttgtttttgtttttttgagacggagtctcactctgtcgcccaggctggagtgcagtgggtcaatctcagctcactgcaacctctgcctcccgggttcaagcgattctcctgcctcagcctcccaagtagctgggattacaggcatacgccaccacgcccagctaattttttgtatttttagtagagatggggtttcaccactttggccaggctggtctcgaactcctgacctcagatgatccgcctgcctcagcctcctaaagtgctagggttacaggcgtgagccactgcgcccggcctggatgcatttctttgtatttattgagtaacagggaggcctttcccctaataatcctggaagattgtgtttttagtagatttcatttttagattcatttttaattatagtcaaggtttacattatgaatagagtttgtgctttattaaagttatataaaacatcttttgtgcatattctactttctctacagtttttggctgaagattatacactattggatgttctctactatgttacacgtgatgacttaaaatgcttgagactaaggtaccacttttctttctgttgtcactatggaaagagcaccaggcaaatatcaaaaagtctgagtatcttcccaggctgggtctctaattagctttgtagttctggacagagctctctagctcttagctgctctgagtaaactgagttagttggacaatgatatttttgagggctctaataaccaatatttctatattagtaagtgaaaatcaactggaagaatttttttgaataagatgcagactaagtccatgcagatattctgaagctgccttaaacaaatgctttaattgagttcatgatggtgttatactcaataaatatttggaggaggtgctgacttgccctccaaaaacctggtataatctgatataatttcttgttaattaaggccaagcatataactttttttttttttttcgggatggagtctcactctgtcacccaggctggagtgcagtggcgtgatctcagctcactgcaagctccgcctcccaggttcacgccgttctcctgcctcagcctcccaagtagctgggactataggcgcccaccaccacgcccagctaatttttttgtatttttagtagagacggggtttcactgtgttagccaggatggtctcgatctcctgaccacgtgatctgcctgcctcggccttctaaagtgctgggattacaggcatgcgccaccgcgcccagcccaagcataaaactattatacccaccattataaagacaaatttcaaaaatgctgaaactctaaaatgatgttttgggacatagcagtttgtgggagtgaaaagggaaggaatggagggaagatgagaaaaaatatacaaaaagaatacataataactgatcagactttgggatcttcttctgaccagagcagatgaaagctaagaagtcacttttctatttcaagggcaatgtttcaaatgaaatgttcgtttcaccatgttcttgtgtctttaaacaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagaggagaaaggcgctgcactttaaatccagtatttgtttactcatgttaaaaaaaaaaaaaacagacaaaacacactgaaatttcctaactacatctatttctataatttttaaggactcttcataaggactcttaaaataatcctgaacattagaaccctaatgttcaggaagattttaatctaagcatttttatggaaatatttttaatgcagcagctattgcacttcagccaaatgtttatttcacacaaaacggatgtaacatttcatgtgatcgtgcaccactggaacaaaaccaaaatgtgaccataactgtttaggcttctgtgtgtttgtaatatgctctaataatctgagtagaaatgcgtaatttcaattactgtataaagtttatgtttttttaagtgtgcagaatctgagagcaatggtttttacttctctgtgttaattgtaatattgactctattttgtaacttaagtttctgacctgtcgtacatttgtttgagtcgtttatgtactactgaactgtaccagttgcacatgcttgaactgtagtaatgttagcttgttctaaagctatccattgtgtcatatttactctaaaaattaaagagactctcaacatactgttttgataaattctaaagaatttttattttgtgttgacaaactagataatctgctgtgttaaatttccagtcatttctccagctgtaacattaagtaaaatctgtcttctattcaagcagtcagacaactgacattcaggttgttcctcagaggaacagaggtttaagaaagagggtaagcctgggcaacaaagtgagaccccacctctacaaaaactcaaaaattcagctaggcatggtggtgtacacctgtggtcctagctacatgggaggctgaggcaagaggatcgcttgagcccgggaggtcgagattgcggtgagccatgattgtgccattgcactccagcttgggcaacagagtaagaccctgtctcaccaaaaaaaaagaaaaaaaaaaaaagaggatgaagaaaaaaaagaataaaggaaagtcagtatatttttctcaaggccccaagttatcttggataactatggtatatcttaaggggtctgcaaagaccatcttaatggagaatactgcttgctttttttttttttttttttgaacagagtcttgctctgttgctcaggctggagtgcagtggcgtgatctcagcttactgcattctccacctcccgggttcaagtgattctcacacctcagcctcctgagtagctgggattataggtgtgtaccaccacacccagctaatttatatttgtagtagagatggggtttcgccatgttgggcaggctggtctcgaactcctgccctcaagtgatccgtcctccttagcctcctaaagtgctgggatcacaggggtgagctactatgcctggccaagaatactgtatttttctgtctccttaattttcttatatttggataaacatttttatttattttaagctgagtagtatatttttatgagcctgcccatattgatcaaaggaagtctgatgctcctagatggataaatgaaatacattttcttaaatacagaggaacctgtttattaggcaggataaaaataacatagagctgtttgtatatcatgatttcactcataaacaacagtctttgacaaagcagaagacatctttattttgaaaacattctcactaatgttttctgattgattgatcgagacaggttctcactctgttgcctagactggaatgcagtggtacgatcacagctcattgcagccttgtccccttaggctcaagcaatcctgtcatgtcagcctacagagtagctgggactacagaggcacaccaccacaaccagctaatttttaaat

SEQ ID NO: 15891 - DNA, 87216 bp, Human
catgttgtgaaagtgctttgtaaacatagggtgttcaagacaactgccgaggagagaaaaacacttcaacttttcttggtagctttcctttattgaccagccaccccatattaaagtacataagtacattttttttaaagctaacagctttaccctcattgatgtaagtttatattcagacctataaaagtacttttccatctattcctcttcctctcactttggtttataacatttatccataaattacaatattctttcatatcaatatggcaatgtaatatcacattatacaaagcattgaagaaggcaccaatgtaaaattcaaagcagagaacagcccaagagctcatggcttgcactttacaaccccaagtacactcaaggcccatctatgagggacattttaagcatatcagttgcatgagttgcagctgatggggatctcacccaggccctgagttcctccaggaattaggaaaggaaggagagaggactgttcttcctttcagctcccaggctggggccccagtgccaccttacttcgggaaaaaggtgatttatgggagtgtacccattactactggaattgaaaccttccctgattcagttcttccagagatacattatgtctcacatatttctacctctcctctgattccatattatatataataactggtgaatttggtctttatttctactcttgtcaacagagaacattcacttagaatccactaagtaccagacagcattcaaagtgctattatggagaaatgtaaataacatgatatgcatgatccctgctttgcaggagtttagaaggaagcaaaccagcatttattgccaggcagtgagtattattttagcttctctgacaaggacacttcgaagtgggtcttaactttattttataaatgaggcgtctgaggctcagagaaataaatctgccaagatcacacaagtagcaagcgtctgggccagatttctccaaggcctaccgtgttctaaagtccatgctctttccactctactccattacctcccctgatgagaaaggcaggacacatactaaaaaggaaaacgaacacagatattaaatattaaaggaaaccagccaggcgtggtggctcatgcctgtaatcccagaactttgggaggccgaggtgggtggatcacaaggtcaaaagatcaagaccatcctggccaacatggtgataccctgtctctactaaaaatacaaaaattagctaggcatagtggcgtgtgcctgtagtcccagctactcgggaggctaaggcaggagaatcgcttgaactcgggagtcagaggttgcagtgagccaagatcgtgccactgcactccaacctggcaacaaagcgagactccatgtcaaaaaaaaaaaaaaaaaaagaaagaaatatatatatacatataaagggaacctacaaataaataagtactagaaactcgacagactgtcctgtgtgcaagagtggccaagtgcctggagcaaggctagcctgtgagccgattctaaagcacattaatgatacaatctggaaaaaagaaaggtggatgccagtcagaaaacaattgtgttggaacaaagaaaaattatagtctgggtgattaacacttttaagaacgaaagctacaatgcaacacccatttgtctttctggattcagagtctttgtctctgtggccctgggaagcataaaaagacttttgtctttttatggaaatttgtaagttgctgtgattttcacagacccatcttctaagcacatacaagagacctgtgttccttgttagtgtattgccaacctcattacactcagtattaaatattcctttccacatagcactcttcagtatggtgaatgggaaccatttttctcctgacatctggggttggtttcattgaggatttacaggggaaaagtgaatgcacgtggcaatgttttcaagcctttgtttggattttctgttttctaggagatatacgactaaggggtcagacgggggttcgtgctgaacgccgtggctcctacccattcattgacttccgcctacttaacagtgagtaatcaagtgtacctggaaaggaacaaacgttttcttcaaaaagaaaaaaaaaaatcctcatttccctctgaacttcgaaaccttctggggtctgccttccttcctgaatctctcttctgccaactagaacttaaccctttgtctttgagtttcctcacaagtgaagtaattctggccctgcactgcctctcagagctccactgagggtcaaatgagatcaggtcagctttaaaagtataaatctctggccaggcatggtggctcacgcctgtaatcccagcacttcgggaggccaaggtgggaggattgcttcagcccaggagttgggcaacagagtgagaccttatctctacaaaaaatcaaaaaattagctgggtatggtggcacagcctgtagtcccagctacttaattgggggctgaggtgagagaatagcttgatcccaggaggtcaaggctgcagtgagccaggattgcaccactgccttccagcatgtctcaaaaagaataaaattttttgtataaaaagtgtaagtctcaaaaactgtgatgccctatacagggaagctactattttcattttccagcacattctctctaccttcagccagagctagactaggtgagattccattttgtttttaaaaccccacagggaaacctcttctacagttgcccttagtaacctacctgttatggaattctcacttctttgtctaatataaatccttgaggtctattcttgccttcctggtaaaactcttcaccagggcaaaatccaaagcacttgctgctttctcccttgaatcttacaagttcattgacttctaccttcccctccctaaactgctcctcatcagtagttttgctcaacctttggtccacaattttcttaatcttaggtttctttgcaaacccaaaccagtgaccagtcatccctccagatttcatgccttataacgatcataatcatccttcactgtagacttgtgggggaggtggaagagcaagtggataaatttcacaatttgctccaaggttttcagtgtttggttctcatatcacttcccatctataaatttcaaagtgctagattatacccaaagaatattactttcctttgacataaataagctcagctaaagaggcaatttgatttacttcaacccctggaaattactaggagaaattagaacctgttatttctgatccttcgatccttgagaggccaatagtaggtggcatgtttgtatttctcctggcttgttaatctcccatatcaatgtgcaatgtctgttttttttagcactttcagggacacagagacttggagtaattctttccacactagagataaccttccctacccagaccctcaaaaatgctttttggaagaccgaattgagccattagaccaatgcaatatgggatacagcctgcgggagctctattggtctctctgacctttccttataccctgaatgggctgttccagctacccacggaagttacacctttgacagtctctagactgagtggatttccaggtcctaggcatgtggtttctccaagcaggacaaggatgagcaaggggttccatttcactgtttcatatagaccagaacgctccaacggcatcccattttgaaagtcggagggagaaaacaaccgaaaggcctcttttcaatagtagatgagtgttagttcatggtttctaatatgaaccacaaaggaattaggaaaataaggggatatttctgtttataattccaaagtttcattattttaaaaccttaatcccagtgttaataagcaactttactgctaatggtggttatgtttgcaggtgggacagtggaatatttaattatctacatcataggattctgcaacatttttttttttttttttttttacaatttgcctcttttacttttgtaatctgaaaaacaactgcaaaaataaataacatttaaagagaaactcattgcagataataattcagtgtcatattgttcaccacgtaagagatcatctgccagcagctgctatcctgtcttccctttgctggagatcctccaggacttctgagcacctgggctcaaccccagcctcatttccctggccctggatgctgcctgcccctctacccccatttcaccccacctggtactcacaatcctccactcatcgagtgacagtgctggccatccacccggaaattccctttagggtctcctcagcattccattccggataactctttcacccatgtctcttactctgtaacatattgcagatgcaatattaattttcctttagcatattttcctttataggtggtctccagtttttttaatgtatcaaagacaccccaaaaagactataagatcctaaagacagtcttctctttatccctaaatagactatcagatcctaaagacaatcaattgctattgatcatttactaactatagttaactgaccaattattaaagggtctcctcgaaaacattatattaaataactatgaatgtaaatcatcccctgtgtttaactgaacaacacgggtaggaatgaaggcctctaagattttcctttgtgatacgatttacctcttggtataatgcaccaaagaccccattggtgagttgaaactagaacagataacattactgtggtcgccctccacggttcctaacttagtttgcaattacaacagcttgtcaccatggagcagagatgtatgaacatctgtgttatgcacagtcacataaggtatatatggcatatctcctactacttcatatactgtctatttaattctctttaatatcattcacgtccttgttgtggtttgcctgagttgttagtgtgtgctttatgcctaaagggaaacatcttgggacatttggggattttctcgtagaacttttctttttaccagctcattcttattctacactgtaagagctgaactagtttaaagtgattctttagatcacttaccttaattttgagtcaagtttttcccagtgtgggcacagaccccaaacttcattttccttgggtgcttgcagttttgttctctctcccacagtaaaatctaatctaggatttttttaaaccatttataggaaaaaccaaatcaccatagctgtcactccccagctctgcatccctgcagccttccttccaaaatgttagtgaaacccacacaactgccatcccctttccaaagtgtcgctgggtgggtgtccctcccccacccacctcagtatatgcattgaatcactggagcacgcaagagcagaaatgtatactaaatagtgaggcccatgcatttccccattggtcccattagtcacagccccagtttgtcacaggagggcagaggacatcagaattaaaatctaaaattacttgtcttcaaccagaacaaagtttctaggcgttaaaatggataactagaacagaagtggacaaatgactgtccacacaccaaatctgtcccctcctcctgcctgttttggtaaataaaattttactgggatattgctatgcccatttgtttatatgacatctatgactgctgtcactgaaacagtggcaaagtagttgcacagaaaccgtgtggtctacaaaccgccccccacaaaccccaaaatactcaccctatggccctttacagaacaaggttgccaatccttaacttagatttttttaaacagatttaagagagctttttgacaaagccacaagcacattcagtccagtgtgtttatctttgttaatgtctttttttttttctgttcagtttccactgccatcactttactttcaagaatggactcacattgactaaatttttatgaacagaagaataaacagagagggaacctctgttattgatgcagattttaaattccaatttaaaattataatttctacttgcacattcttctggaagagattatttttgcggggaggggaagcacatgtttggggcagagggaaacacagtactaccaatttcatgtacctgttttctgcatataaggtgactcttggtttgcctggcatagtcctagtttgcacctgttgttcaggagtatttattaatagtgccatttttcattcccagagtgtcctgatttggacactaaattacaaggccaactgcttatataggttttcccaaaaaagagtatttaaatttaatgtttctcaaagatcacatgcaggaataagcttaaaagatctattgtataatattgtgactatagttaataacaaacgtatatttgaaaattgctaacagagtaggttttaaatgatctcatcacaaaaaataagtacgtgaggtaatgcataagttatttagctttacttagccattccacaatgtgtgtgtgtatatatacatatagatcttgaaatatgttgtataccataaatatgtacaattttgttaaaaataataataccatatcatatgcattccaggaataaagattagaaaatcattttcataagagattcatctagatcaatagaaatacataacactcattaaaagctaatttcgttccctgtttctattttacacaatttagaagagagtcatctctatgaacttcttgaagcttctctggataaatagcaggaaactgtggcctcagcactgtttgtgtgggacataggaaagatagatctttaaagactgttatctttacacctaagcatagagagccagaacagagagaaaagggggaaaattgtttttattccagatgatgtcctaacacagagaactggagggacggaaaagtaacggctgtattctcccaatgtcgatttcctatagatttatttcatttactaattctgtttgtaggggggaaacaaaggaggaaaaaatgtagagaagagtgttctgagacttgtggacccagaggggagagttgcagaagcaattacaaccttctgcagagcaggcggctccagcagccccgtctacagctctgtctcctgatttaatataatcagcagcctgagtagataatgactaggttgagatgttcccgtggcaaccatctcagagcaacacaaagtgatttccacaccggctcagcagaggaagtgacatacaaagaaaacgtgctcagggactgtggagcttgaggaaaagaaacagcttcagcctgaggttttagggcaccaagtatccactgctagagagaacccagagctccagaccagcccctgggctttgcagtagtaggttaattggctatttggcttttcctgactgttaatttgctaatcttgatctttaaagctctattccttcagacttgactctcctgtcagggtcatcttaactgcacaagcatgaggtcattttagtagagctacaaaaatatttccctttacttattatttcccaaatggaaccaatatatacaaacatatatattttttaacctttctatgaagaagtgacccagagactcaaatatttttttaaagctgccatctaaaacatattataccctgcagccattctttctttgacatataaaacacactctctttgacatataaaacacactctcgatgaaggactgttgaacaaaagccactcagtatgctggaaatcatctggccctaagtgatagccccatcttaaagatggagggacagtttccttccagactccatttcctatgagagaattcttggcagacagttacagccttttagtaaccttacagataccttttcctgtcacctataagaactacacaaaatgcaaagaatctgaactaaaatgtcattggatgatttgaattcagtcatgctgagaagatgctatcccacccccagccctgtgttccccaagcggagaagggaggtgtccgctgggacttgttcagacttctcctcacacttgtgagtgccaaggtaacaccctacaatttcaaagttcaatatttaccttcctctagaagaaaggcaaggcactggctgtggtagtggtgctttctggctcagctggatcttgctccatgatggtgcactcagggcttctggctgcaagctcccagcacttcagctgcggaagtgccagggcagcaggatggttaaccactgaaatgcccactagcttgcagaagacagagttggcgatgtcccgactctccctattactacccctcgacggagcacctcctatggtaggcattgtaccagtgctggagatacaaagatgaatgagacatggccactgcccttgagggatttacagtagcataagctactgtatctacaatttatttacaaatacattttgatgtggtgtgatacaccaaataatacatgcctgtataataacagcatacataatatgagaaatatatgcatctacgggattcagaggagttcgagaagggaataattaactctgtcttggaaattaaggaagtcttcctgggagaagttaaaacacaagcagattatggaagcaacagtgaaataaaagagggctgtatgctaaggtcaactattagggccattataaaatacgctttaagacttaagaaaccaggaaaacattgtcaacaagtttgctcaactagataaaagtgttattgaaagacaaagtattctagtgggatccaagcagagaagtcaggaaaaattatacaacatatgtctgagaaaaaacatattcaaaaagaaaccattttcaccttctacatctaaaagtgaaaacagccattgccttctgttaacctgtctgacatcatttaatggattactttttatctgaaggatgaaaaatagaaaattgagttagggagtccagtacttcctctgggttttcattcatttattcagtcaacaaacagcacctactctatgccaagaaggccatgaaacccaggtgctctgagccacaccaaccgccacaggactgagatagccttttgtatgatggctaccttctgtctcagacagcagtgggactggggtctaccagagacaccaaacaaaaatatctgaacaattccttttaagtcaacaaggaccggggagatgggggagaaacctgctatatgctatatctgggcagaaaattctgagggctagaaaggaaactatgagatattctgctaccctcaaagagcaaacaatctcattacatagacaaggaaaataaacattacaccaagtaccatacaacaaagtaaatgatctaattctaaaataagtaacaataatcagagacaagagaaggcagagattactgaagtaacctgagcagaagaaggctttatggtcttgtgctaaacactgaaagataagacagtgttgactgattaaggagttgcctataagggagactgacctacatatgaggacataacgtcattaagtaggaagaaggtccaaaaagtagcaaataaagttcattaactagagagaaaggcttggaatgccaagataaagaattcaaacttgtctcattaagaagaggatctctagagaattttgcaaaaaaggtgaaccggataaaacactgtttgagaaaattaactaacatccatatgtaggagacacagtttcaatgaatccaaagaaatgtaatcaggctgcagactgtgatggctgtagagatgatagtgtaaatccacagatttcatataaaagaagacataaaactggaggatactgaatattgggagagccagagttggtctggccatctgaaaaattggagctgagatcaacagtcagaaaagttagaggatgagttaggggaaagatggtaagctccactgggacaggttgagtttgcaggagaatcgagtggaaatgtccggaagaaagctagaaataatggactaaagtgcagaggagaggtctattttgggaattccacttgggaatcataatcattcatgagccatctggccagaacaggcgtcatgaagtcaaccaactacttttgttcaggggcccctgtatttttagtttataataagcttgattttgaaaagcattacaagactgtccatgagaaatcccacaaagaaattagtttcctttagtgagaaactctaaatttttctctgtgagaaactatttagacataagagttcaggcaccacctcactccctcatgatggattctattgagtacaaaagtgacttgtgtcagatcccagcggatttgctaactcacctgaacacagcacagagaaatggccattttctactacagcacttccttgagcgaaactctaacccactcaaagtattttcagcatagtggcttctttggatttctggagacattaaaatatagagggaagcagaagtaaattaagttttttttactgaagttacctatgagtcactgagctaaaatgacttgtttgttcaataaaattaaattcaacctcctacccagaaacaggcagagcctatctctgtgacctcattaataaaccaaatgcagggctatttttttcattgccatcccaccttcaacgtttcagaatatctaagggattcactgtggtccccattctactgtatgtatgaaaaaccagaacatggccccatccttaatatcttttgtatgttttcaaactgagatctcagggttcacacacaagatcaaaaagacctttttttctttctaactagcagaccaaattgccttggggcatctgggtcctttattacttttaagtaagctggggaagaagggcagaagttatggaggaaagtcccaagaagaaggtggccaatgccactatatctaacaacagccaccataacagctctagtctgagaggtgcttaaccccaggcacaggatgtacaaggccaggtgtgcacccctcttaggcaaggtccccaggctataggtctcttggaagcctggaagcacaggaggattgctgtgaatactaaaaataaaaatgagtcccttcacaaccaaaccacggctgcctctctgcctcttctaccatggttgccccacccagagctccaagctcactaagtcatcatcaatagaggagcccacagaaagaccatgagctttgaagttagacctgggtttgaatcctacttatactgtgagcttgaaaaagatgcccaaactacttaatgttcacatacatgcaagattttaatttgattgggttgtggtgaggagtaaatgagataaatgtgtccagaagcctgccttgcttataataggtccataataaatacagttgagttttggatgtcccttctctctctgctgagtacatccctctccagccacctcttctcctaggaagcatctgttcacccttcaagccctggccccatcattatgtcctttgtgaagccttcttcaatcctcccaaaggagtgaactcatcattctctctgcactcccactacatctcccagaaagcattatcacattgtaactgcgaagtcattgaacctgaatttctggaggtagagcccaggatattttcaaaacagcctcaggcaacctgaagcaacaagcctggctctgggccttccaggaatatttgggaaccactatatatgtcaattatggcatacaaattatatctatgctttgcacagttagactcatttaatccccataaacaccctataaagtagccactactattacagatgaggaaactgagactgaaagaggagaaataactcaaccaaggtcacccagcttgtaagccagaatttaaaccccaaatatataatcgcagagcacaagcttttaaccatagtaaagtataatcctttttatatatgaattttaatattcaaaggcaatatatgatgcagtatactccttttacaatgaacatatatatgccaattattccttttaaatattttttataaattatgaaaattttctttttatagtacatttagattatttccttttggtattaaatgacttcagtatcattgaacaaatattcctataactgaatgagaaaatatgagattaaacatctaaaaaatcagattttgcaatatttctactgtattttctaatattcctgccactctggtggaagacgccaaatgacagactgcacatttcatcgcctgaccttgtgttctttgataagaaagaaaagggcgtggtggtgacaactgaggatacttgtaagctgcccccaaagaagaaggaaatggaatcgctattgtgacaaattaaagtcagatttgtagctgccaccagttgctttaatttttctcaagggggagttggttatttcctgtcgtgcaaaccatgaatcgctgaaagaaacaatttctcaaaatgtttataacatattagataaaaagcagaatagaaaagtctatatccaaaaagaagatctcagttatgtttattaaaatatgccaaaatccgaacaagggttctttctagatgattattgttcttctggttttctatttttttcctactggaagcatgtattccttttataatcagaaaaaaatgagattttatttttaaaaatttcaatgtccgccagaaaaagaacctttatttttcttccaaaggaatatcaagatgcagaaaatgaaattgcagccataggccagaaaacattatttaacaggcctaaattggaaaattggttggaaattgtgaagttgggtgtttctcaaaagctatgtaagctactttgcttgtcattttaaagtgaaatttattccaaagagcacaaaatcaaagttcttattcacatttgaacagcactttagactttgcaaagcttttaaatgaagacactcaaaaaatcattgagcccagtttttcattttataagcaaacaaaaacaaaaaacaggccaagtgattcaagcaaagctatgaaagagttaaccagggttgggctcttcttacattctgtctttccactcaaccatataaggcttccttatataagccttaccttcaagatataaaataacttttaccacttgcaaaaagagaaaataaaacaccaggattccccttgaaggtggttggtgttggctccagagccggctgcctgggtttagattccagtagcagttgctacaggactttgatctactgacccctggtcctctgattcctccgggctagaaaagacgattcacaagtgcacatctcatgggttattgtgggaagtagtgagtaagcgtgcttagagtgctagtgtaatacctgccatggtatcaattattttattattacagatattagtattcccatttaagaagggcataggacacataacaatataaagtacttgacttatagtgaagtagagaatggcctattaacccttttcagttttccattctatagttttatcttttttctgacaggtatttactgagctccccctacaatgcctgcagcattgctttccaacatgtggttgttaataaattggtagagagactgatggctggaaaagtgaggctagggaaggttgttttgttttgtttttcacaagacattgaagcaagctgaaatcatggtgagaaggatctagttgagaaagaaccatggaatagaccagaaaaatcataactgagaataaagtgtcctgagaagatgggaggggatgactggcctgagaaaaggaggcaactctcctaacagcaggtgggaagaaggaaagaagggatgcaacgcagggggtttggtaggtttcatagcagaaaagtaaggaatttcccatctaacaacttctcgtttctccatgaagtagcaagccaggtagagaacagtagagatggggcagcccgaggggccaccagagcttggtggtcttgcttttgtggcactatatgtcagtatagcccagagagatagttctgtgctccacctggccaccagcagtcaatgtcatcaaaagcatcacagggaaattccatcagcagtgtggtcgcctggctcagccttggtcatctaagtctttaccattgttttcagctttcccctcctcagtttgggctagtatagacaagcctaccactattcccaccctcccctacatgtccacatctcccttagcaatgcacactgaaaaacaagaaaaattataaccttgtgtctgactcccctctccttcctgaactcatttgtgctctgtgggtaatatcatctataaggaaggtctagcagtggaaacaagttttccctgtccctcggtgtctgggccctggcacacccaccccatccacatgatcatccactactggtcactcatcacctgaagccagctgtgactgcagctagttcacttctaggcaggggttgggagatgtcccctccttgctttcctgtgattctggatcctataatgctaatcttttctcccaagagatgccaagaaattaggcaagtagaagcccagtatccccttccctctcctacctaccatttttcgacaattctttatgtgtaaggaaaagaattccccatctcccatcttcttttcccattctttcatttcatgttctaccacattagctttattttctgttttggagagaattcttggaaaagaccagaaagctaaaaatgtatttttagaaagtcctccttggaagacctaagatcatccctttttaaaaaaaggagaaagggtaaactagattacactattcacatttattgagcaactactgtgtaccaggccataagtgctaaaagaaataaaggatgaacaaaacattttgggaaagggctgatacagaactcactagaacaccagctaaattggcaagtgtcacgaggttctaatggagaaagcactggacattctagtgaaggaccttgtggaaaggttggcattggcatttggacaatgactggatttttgtaagtagaagtttttttaaagtgcattcaaaaaaagaccaggtatgggaaaatgctgaatacgtttaaagggtgagcacctcagattctgcggtgaatgtgtagtgctgaaagggtattgcatagttggagggacggtaatcagaattgatgtaaaattaggctgaaacccttactaaatgttaagggttggttagaaccagaccagtgatggtcttgaatgccaatttataatcttttttttttttgagacggagtcttgctgtgtcacccaggctggagcgcagtggtgtgatcttggctcactgcaagctccgcctcccgggttcacgccactctcctgcctcagcctcctgagtagctgggactccaggcgcccaccaccacgcccggctaattttttgtatttttagtagagatggggtttcaccgtgttagccaggatggtctggatctcctgaccccatgatccgcctgtctcggcctcccaaagtgctgggattacaggcgtgagccaccacgcccagctataatttaatcttttttaaatggagatttcacttagggcttgtgagtatagacaaacgcattttctttccctcatatcttatatagcaagtggttgctcctgcttaatattaaaactaagttacaaagaaagagtcagtttttcctgggtatacagtgaaaacacattccctcttcaatcccctaacccaaccttctatgcctaagatcaagagtgcttttacaatatgctttataaaaacctcaaaaactcatctcagtattcaattatatttcaaaattgttgcctggaaagcccaggatctcaatccattattggtgtacaatctataattgtatattggaattctaaaattagctggtatctattgaaagtgttctatgtgctaagcactttatatgtataacattatttattcctctcaaaaatgtgtagattctgtaaattattatcctcaagtgacacaaggggcaacagaagcactaaggaagtagagaggttcagtagctgtatgggagcatagtcaggttgcaaagcttcatggaagactctagagatcatcctctgtatctctctgcaggcagctcccatcaccctccctgctgagatggatgctcttcaggcaagcctccagacacactaagactgctgggatattcttattcattcatttattcactccattcgtatttactgagcacctatgtgtcaggcgctcttctaattgcttagctcttacagtggaaagtgaacaaagttctttcatttgaaaggcctcttctccatctaggtgcggtggctaaggcctgtaatcccagcactttgggaggctgaagcaagaggatcacttgaggccaggagttcaaaaccagtctgggcaacatagcaagactctatctctacaaaaaataaaaataaaacaattagctgggtgtgtgatgacgcgtgcctgtagtcctagctactcggggggctgatgtgggagcatttgagcccaggagttcaaggctgtgatgagctggaagataccaactctataaagtaaaagacctcttattttctctatcacaattatgcctcttgattataacaataattattcttttagaggaaatattaggtctccaaaatgtcaacagtgttcttcatatcactgccaaactatctcaacgttcacatagaaaatcatttttacaggcaaatagattataacatctcagaaggaaatgtcttcaaagataagtgctgcctaatatattaaaggacaagcaagttctagttggtcaaatggtctcttcgctgggaattgccaaacaaggataacctgttttgaaagaattatagcataatcaaaaactcctaacacaaaagctatttgaggcataacttaactcttccccagtgactcatgacttctcagaatcttagaatgtttcagagtcaattaatttaaacagcaattattaactggaacttcaaaacaatctttgtgaagagtttagctttcttattgttgcaatttccatttgctgaaccaattaaggccagtggtaccacctgagattttgaaaataaatcagtgggtttttatttcagctgtttggaaatgactaatagagtaatacaatagattaattttatctaacattaatagctggatgtataagaaacacccactctctagaaattaagacatgtcaccatagtcttatgacaagagtgagtctcttatttttgaactttctattgaacagttctcaccatcttaaatcaccctttgttatgagtttttaagtgtcttaagtagagaaggttaagaaaatgaatacttatactcctttaaatactaattaagaggccctggtaaccatttatcagtaatattaatggcatgaaaattgaaaaagtatgactcaaaggtgaattcagggcaatttaaattatatataaaaaataaaaacttaggtggaagaatttaaaaattttaaaattctgcccaaattgtggagtgcaattttatacactgggaagaaaaatgacagcaataaaaattttaaaaagatgaaaaatattttttaaaaaattgtgcaacccaattttaaatgggactgagaaatataagcaaagcatcgacaaaatagtatattgttagaaaagctatgcaaatgaaagaacattaaaatcactttgctatataaaacaatgtcaaatgacagtatcaagtgtccacatcccctgaggccaagtttcagtcatctagtccatatggagagtaatgctgtgccctcagctatttccttcttaggactaatggaaatcaaattagctcccttttcatattatgtgaataaaatataagttccacaaggaaaaggactttattttgttcattgctatatcctagtccccagaacaatgctttttttcacatagcaggatcttgacagatatttgttgaattaataaatattgaaggcatttattcaaaatgacttgttgctatggatggcgtattttatttttactaaagttaaattatatataacatgctgacaacagcagctggagagtttgccctattgtgtgaagtttttccaagaagagtttagcaaacagcatatttgtgaagattatcaatatgtggaatgggtgtgatattacatacatatcaaattatttgtatttgtgataaaacaaatatttaaagtacaatattgaggattttagtaaaaggagaatttgtcttttctaaacaaagaaaattatagggtgtgactagatcatcctttatccttaagtcatattttccaaatctttaatcctttatagcaccatttcccaaagcgtggtatgggaacacaggcgatatttttgttacagaaacaaccttttatcttttactataatcgttacatgtatattttaacatgtactagagaaaatgtaattagcacgtcaaatctgttttttattgatactaattttatataagttatatgtaagtaagggcccgggcatggtcactcacactcgtgaattagcactgtgggaggccaaggcaggaggatcgcttgagggcaggagtttgagatcagcctgggaaaagacatctcttaaaaaaattaaaaaattagtcaggcatggtggtgcacacatgtagttccagctactcaggaggctgaggtgggaagatcacttaaatccaggaggtcaaggctacagtgagctatgatacaattgctccagtgcactccaacctggagacagggcaaagatcctgtccctaaaaaaaataaataaataaagaatacatatatatatataggtaaaaatgaatttatttgattttttaaaaaagatattatgtaagtagtggtataggcagatatggtaaaaaccctactaaaggcaagagcatgactgaaattgaggaaactctgaccttagtttctacttggagcagtgagactcagagcaaatactccattcttcttgtaaaggtgttcccaggcttcagacaggaacccattacacaacagccttcccggggcgtttttacccagcagaaagacttctaaccctctcagacccaatgcctcctttttatagcacattttataatctttactaccttgatagatcctttaccctcttgaaaggaaatctacagcctacttattctcataagttaaaaaaaaatcataataaggccctagcttttaatacacaagaaatacaagaaaagcaacttatgacaaataatgttttcaataagtaaatacttgggcataatcacccttgaaggcctacggatatggtctatattgcacccacatgcagaatccctgtgaatgtgacagtccagtgcagatcgatacaggtgtattatgttggaaatgcagtcaactatcataagcagtcttgccactggtaatttcctaagaaggcgaacaacttctgggaaagtcatgtccaccactccctcctctcacccacaaccccccaaaaacaacattctttccttagtttgcatagtagttacatttctgaaaagggaatacttgtattaaaactgtacaagagaacaaccactatggaaaacagtgtggagattccttaaagaactaaaagtagaatgaccatttgatccagcaatcccactcctgggtatctacccagaggaaaagaagttattatatgaaaaagatacttgcacgtgtatgtttatagtagcaccatttgcaactgcaaaaatgtggaaccaacccaaatgcccatcaattgatgaatggataaagaaactgtggtatatataaatgatggaataccactcagccataaaaaggaatgaattaatggcatttgcagcaaactggatgggattggaggcaattattctaagtgaagttactcaggaatggaaaaccaaacatcgtatgttctcactcataagtgagagctaagctatgaggatgcaaaggcgtaagaatgccacagtggactctggggactcggggaaaggatgggaagaggttgagggataaaagattacaaattgagttcaatgtatactgctcaggagatgggtgccaaaatctcccaaatcgccactaaagaaattactcatgtaaccaaataccacctgttccccaataacctatggaaataaaaatttttttaaaaattatacaaaagaatactttgtgatctccatgaatatatacatacctactatgtacccacaaaaattaatgattttaaagaaaacaaaactttgagcttacctatcagagaaatggggttaggttctaggttcagatcattataaacaggcttttcacccatatgaatacctgaccagccattgaaaaattgaaggtgatacaggacaatcctctgttgtgtagaagagccccatatactttgcgacatcccacatccctggctcccttccattaaattctgttctggccatttctatcatttgacagccaagaatgcccccccaacatttccccaatgcctcctaggaggtaatgcctcccacattgaactcataaatcccaatagcactcaaggatttatttttattttaagctatccattactatctgacatgtagtcattaagtccctttgggctttttatttatcagtgatagcttttggttccaaagtgtcttaaacgtaagagatgatggcttctaaggctattatcagtaatattctactattattacagaagtgttattgtttatggcttgttattaaccacaaagtttctcttttggcttaaagttggtaaaaataaatattgttaaaataaatttcagaaagtttggttgctcttaagaaaaacactcaagagttaggggctcctgaaaagtctgaaattcgatataattagaaatctggttactgaaaaccagatactttaaaaattaagcctctcagggctgcaaattttaacagcacagttttaaaagcagattcttggcataatgttgagggggttttgaccaagtcatgctgagaaatttgcaactgcagcattcactggggtgaacgcaaaagagaaaaaaacacattaatgaaaactttccaggatgaaagaccttaaacttagcttaacttctgaactttttgctctgctgtgatctttctgacactttgaagaatgattctggatgggctccaaatagcacactcctcactcctcattcttaaacagtgtgaaatctgtcaacccaatcaggtcatcaagagggcagactgccacttgtcattactgagaggggtgttctctaggacactgaaaatgtcgggcaggtcttgctttttaccaagagctagggcctggcattttgagaaagacacttatttccactcattgggaaagctagcttagcacccgtgtgcaaatcaagtatgccctattcaatttaccagagtgatgctttgacatcattccccttaacagaaagctgacaatcaacaatagcccacagggctttatttgcaaagatggaaagctcaaaacagttgcctcagctcaagatggaatctaattttttaaattaattctaatgcatgagacaaagaaacaatatcagttaatgagaagcatgggaactgtttgaatgcctgttcttctacttgttacacgtgttttactgagtgtcttaatcttttggtactctctttctctgcttataaacctggaataatgataggtattattagctctggttattttgttgtgagaactgggacccccccacccctgggcaaaattaccaagtggattaagttttcctttgacttttaccccttccttactcacaccattgagctaagcactagggattataggtaaataaggcataggccctgccctcaaggaactaacagtttagtgggtgagaaagacaagtaaatatgataacgcatatatggctgaagaactgctttgctgaatataattagggtggggttgctttggagcccagcacaaaacactagccaccatggggaaaagactaggaagactttccacccaatcaccttctttctcctctctctgtccctttgtcccacctttctgctccccccaaagccaccaccccatgacttcccttctgagatagaaccccaagctttagactgttccttctgcccccttccatcagaacttatccatccagcattgcctacctaattgcaaactaattcaagctaaggcattcattgattcattaactctttctgagtgatatttgcattctgactggagctgtccttacacactctaccaatctgtattgggcatataccatgtagattcatttcaatcttttacctaaaagactgataagtggaagaaccaatccttgaacctcattctaggccaagtatccttttctcagaaatagtttcttattccatttcatcacagtctgcaggctctgcctagcttgtcagcacctgtagcagagactccgtgtacagcaataggatggtgctaagtctcatctatgtggagatgagacatataccagagagaatggagaatactgtcatggcaccatagctgctcctggaggtcccaaccccatgagggcactgcttagttatccagccacactacttgcccactagaagggcagctggaagtcccaggagagggcagagatttcctccaaccacacccctccccactccccacccgaaggccactgtttttggctcttgctgctatggaaggacaggagtgagctcccgctcttgacaggaaactctccaggagcagaagctgtaacttcctcatctttgcatcatcagcacccagcccagtgtctgagccaaagtaaaccctcagttaatgtttggagaaggggaaggaaaggaagggaagggtgagctgttgagacaatcgaggatagttcttctctttggccattctaaaagtactcagctaaatttattctaaaatgctaggtctccaccttctgcttctctctgtcccctccttcagacacagcaattaaactcttcattctgagcaatccagtgttaacctaggatgagagaaggcaagagaaacctcagtgccaacagtgcacatccttttttgtgcatttctatgccccctcactttcatcccctgccagttgcatctccacaggtcccacctgagtgggtttctctgtggctttagcacggtatgtgtatattcatattttttccaatataggtgtatgtaagcttgttctcagagctctatagtttccatagtcgtaagaataaaaacatttttctgaccgaccactccatccctgccatgatgctttacctcatctggaagggtgtgcaggacccagtccattaccagaaaggatacagtctcatagagcgcaactctcaagcccatatgggattcagagggtggcgccaaaaacttcttacatttcctctcagactacctttcactggtacagaaacctcctccgatgggtgcttgaatgtctcttctctcttgatctcccttcctcattccttttctactgctctgtctcctcacctctctacctgaccacaccccctacatatataccaggtgccatcttgcctctatgccatgtggaaagaaaggcttctgactccatcaagtgtgagcggcaaagtagagcatcactttcttgagagcagagcacccgctagacaaatgatctttctttttcttgctcatattttttgctttatacagtattttaatttctaggcacttttatactaaaaccttccttacctgccacagctgaagtggaaacataagtagtgaaggggataaagagccaatcccatcaccttcctctgggtagttgaggacagaaacactcacttaaatcttcttgtatgagtccgttttcatgctactgataaagacatacccgagactgggtaatttataaagaaaaagaggtttaatggactcagttctacatggctggggagacctcacaatcatggtgggagatgaaaggcatgtcttacatggcagtggcaaaagagaagtgagagccaagtgaaaggggttcccccttatcagaccatcagatctcatgagacttatttattaccatgagaacagtatggggaaaaccaccccatgattcaattatctcccaccgggtccctcccacaacatgtgggaattatgggagctacaattcaagatgagatttgggtgaggacacagccaaaccatatccattctgtatattcaggtaccacaatgccttgcacagagcaggtgttcaatggatatttattggtggaggcttcccagtgttcatcagactacaaaaaacaaatagccaattcattcctcacctgcttccagttcatttgacaactaccaaaaaatattatatattatagccattcctaattaaaacattatgcaaaattatcaatgtaggtagagatatttagaaaacacataaaagacatatgtgttttctagagggaaggtaagaagaaaacaatgcccatgggccatgttaagcagcaaggaaaggttttggattatgccctgacaccatgactctatcaacagatgtcccttcaggtaaaatttcaggagactataaggcttggctccaaagggttaaacacaaggcctgtatgcatccctgtgcatcctggcaggtttttttttttttttttttttttttgagccgcctgtttgcccaagtaactcccactctttcccttccccacaagctgctgctccactctatgtacacaacaaaaatatttgtcttttccaaagctgggggcactaaccaatgtctgtgaatttctttgtataataacataataatcaaatcacattaagtcagtgtcaagtgagacatgtgttttcaattttaaaacccacaagtgattatttattccttaatacttcatttgtacatttagtgagagaaataggaaagtcacacatacatagaatcgcttccaacctttgctatgaagttatttctctaggggttttctagttattttacaagttgtctttcactattagcattacagtatttctcactctcttgttcactgataccaagtttaattttcagcctttacaactttattgatttttaaacactcgtatttatgaattacacggttagaaagaatgaataagaaatgtcctcttattggttttgttttactatactttttatgtggtaaataactcataatatgagatctaccatcttagcaaatttttaagtatatagtacagtcttgttaactgtaagtacaatgttgtacagccgacctctacaattttttcatcttgcatgactgaaactccataccccttgaacagtgatttcccatttccacttcccccagcccctagcaaccaccattctactttctgcatctatgagtttggctactttactataccttttttttaaagtaccaaaactttaaatcctttgggtgctgatacatcattttggatccctataccccagagaaaatagggtcctctgctagactgccttatgtctccactctttgccctttcctgtaaagagcaggatataatgagcagagcatcatcttcaaggtcagaaagacccaggttccatccctgctctgttacttatccattgcatgactttgggtaaattattaaacctttccaaactcatttcttcatctgtaagatgtacctattttaatatcaacttcacaatacctacttttatgaaaatcaattggatcacaaatgtaaattacctagtaggtgctcaatattttgattccatcaccccagctgcaaaccctagcctcgtatggattgaatacatggaataggagacccagtgtgtttgttctagatgaaatacatgagatatgtctttgggaaccattcagacatgcaggtggacactgcagtagtcatctaaaacaattctttcttctctctgaactagttcaatgtgaaaatatatagctttccatgccctgttaatgtcttaatgaaacctgcttccttaagagtgtcctgcaccaagaatacagacatgattagtcctaaggtgccactacaatccatagagcgccgtgggcactaagagagaaatctcaatgcacaggtaaatttctcaagttctctgaggaactaaggatatttacacttaaagagttatattccaaccacatataaaaaacacataattaaatcacagaatccactccagtgaaatataattcaagcagcctttgtaacctataaagaaaaaggaattagcttccagtgctttccctttctaaagaataaagcataaagcagcatggcacatgtatacatatgtaactaacctgcacattgtgcacatgtaccctaaaacttaaagtataataataataatattaataataataaaacaagaaggggctgccaaaaaaaaaaagcataaaggttttctttctggaagtttttagagatcaaagtttctatctaggcctctaccaatgagtaaagttagtactaatctaccatcattctaaagatgcacttataatcatttaggaaaatccaacaaattcagaaaagaaatagaggttcaagttcttctacacaggggatcatccctgttatctgatgtgttagatgagtgaatcttgcttgttctggacaattacttcaattcaacaattacatggtagcacctatcatgagccagataatgtactacaatagacagaagaacagcttacacttcaataaatagtcatctcattccttcattccttctttcagtaaacaccttttcggtaagctaggcaccataataataataggtaagacatggtcctagcctaacagggtttacagcagcgtgcagcatctgccacatagcaagtgagctaagttactgcaatactaggaggagagctgaatgcctctgaccaggagcccaggaggaaatacttgaggtgggctgccgaaggacagatggcatttcaacaggtggggagaatattcaattgagaaggaatgtgggaatccagatagaaacagaaaactctgggggatgtggcataaaaacagcaaaagcagagatctgtttatctgcagggtacttttgggagataaaaatggaaaagtaagttggcctcatattgtggagggccacgaatgtcagaataaataatataaattaaggagacattgtgggggccattgaaggacttggagcagggggctgacatggtaggagttgtgcctgaggaacgaatccgttggtggtaggtgagatagattgaaagggatgactaaaggccctcagaggggttaatccaatatcctgggacagggagtaaactagcagagacactgaaaggagagaagcagttgtagtacgttatggcacacatctggaacttttgcagtcaaatttgacagtccaaacatatctcccagataaaagaccacacttgctttaaatgtatgctgagaactacagagttaatgcagcagtttttaacctctggagacttagaatcaactcaaagtttggtcacttcaatttgctcaccacaaaccgttgccctcaaaactctggatttgctgtaacatttcaaactctgagaagcggagggttcaataaaaccacattgcgcctggcatgtatttcttctttaggactgaggaaacttgatctgcttcttactaattcatttaaatttcattcaaactgggattttgaaaaacgtttcgattgcccagagaagcttaagagcttacttttaaagccttttttcccctccttacaaaaaggaaacaatagttttccaaccaaccctgaaccccggatgtcagagattcaacccattcgttgggatggagtttatggtaggcaaaaaaaaaaaaaaaaaaaaaaattgactaaaaccagcagattttgccaaaaatccgtgtgttgcatggttaaggagacaagcatttgctcctcttgaacacctacaagcgatgcagcaggggtgcagacagtcagctaggaaggagctcattctattccatgactcaaatcagccatgttggttttcccttcactgtcaagaacataaaggaaaaatggcaattgaaaaaaaaaataagcatgttaaaaaggagagtgagagaaacaatttcactctgccttaaagaagactttcctattcctccccctgctcctcccacttggtggcaatgttgaaacaaagctcttcttctagtgacagccatcaagaagtcgtgagtattttttgtacacagaagagctaatgacataaggctttaatacattctattcaagacctgagtttggagaacttaaaataacttttgagttcctttaagctcaaacagattttccaacttcaaattaaattttaagatgatggtttgctttattttggtttaggttttttctccctttcttacttttttcctctttttggtggttttattattgttgtagatgttttgttgtatgtgtttttgttttctaatagttacaactcatcttcttttctattaaaaactaagcctagcaaatgccctaaatgttaagaaatttgtttttatcttaaattgctcagaatttcaaagtcatttataatgactttgtcttaaaaatatgtccacccatgtgaggaaatctccacacttgatgatgttaagggccaaataatatatttggttgtcatcagtttctacccatcattttctgaccactgagaatagacacagtaagaaataaacaaatatggcctcttatgaccactggtgatttctgaaagactgggggagtcatagtattttattttaaaaggttttctggcagctattttatgaataaatgaaactttaatgtctagagatgctaaactgtgaaagggatgatttgaatactgaagtcattacaaccaagtctaagttattaaatttgctaaaagcacgtgaaagtgaatcgaagtgtttaatacattgaagggagcactggtctcatccagagaatgacatccttagcacctcgtcaaagtccgtactgtaagttctggaaatgactcaatattgttttctacacacaacctctttaaatttttttaatttcttaaagtagtctatataaaaattatttttacagggcaactgcatcttaggctaggttacttcaatcttaaaatcctcatgtatgctttcaagaaaactgtcatcctagacaacactaaccttttaattttacagggatcctgaaccctgaactagtagaatgtgtgaaagagtgaaagagctgtgctgtaaatctgctacttctgcttcaggacactgtcaaactaattaacagtttctcctgttttttaaagctgcatattgaaaactagaatttcaccctgctttctccagagttccgcattcttgaacttagatgagagcacacacatcaggaaagtaatttaattccatcaacatgtatttcacacctacaacctgcaggactttgtggaaattcaaagaaaatttaacagaaatctggtctccaaaaccttacagcataataagaaagtcagatatgtgaataagagtgaactttgcaaccacacgaggcacaactgagtgttacagcaaaagtcaaaacaagcaaaggacaaagagggtgactagggtcaataataattgtacattgaaaaaataactaaaagagtataactggattctttgtaacagaaaggatgaatggttgaaggtatggataccccattttccatgatgtcatattacacattgcatgcccgttatcaaaacacctcatgtaccccataaatatgtatatacctactatgtacccacaaaaattaaaaataaaacaattataagaagtgaaaataaaataaataatgaaaaaaaaaaaaagcaaaggacagtggcagtggcaagagggcctggaccctggaactccattttgaggttgactcagaaaatgattacaatgtgtatgtataagttttagcatctccacttaacaaattggcttattgttcaaaaagagcatttaacagtgatatttctgtaaatgaagagaatttattccaatttaatcaacaaattttttactgtttccattacatgtaagattattatacactagataccaggggtcagaaaggttgattaaatggtttctgactttggggtgtaatagttgttcaccaataactgtagtacaagacatatgaaaaatcctgtaacagttgggtgtagtggtacatatgtataatcccagctaccctggaggctgaggcaggaggactgtttttagggcaggagtttgaggttgtagtacactatgattgcacacctgtgaacagccaccacactccagcctgggcagcatagcaagactgtcacttaaaaaaaaaattcctataaaaggaagataaacaaagcctatgaatagccactaaccaagcaagaaattttattagaattactagctcaataattatcaaagtagggcttaataacacattattaagaggttcagttggactgatgctcgaaagtgctaatattaggtttatgtagttggatctccacgggtgcttaacagtcagctctgctcacttaaacacaaaggctttctttgttctcagtatcaccctagctacttctgcaccagttagtcactactcgacttctggaaacagttgacatagacctatttcagggaaccagatatacagttgacagaaacagccttataatatggatatatttacagctttcttaaatctcagatatttattctagatttaaggtttctcctggtaccaaaattaatcagcccctatacagagactattccataaagaaggtactcaaaaatgaaaataatttttattaacatatttttgcatttaagccaaccccaacttgtaaaatttaacaattactgtaccagcagtgccaatacaaactttgtattcctaaaattagcaccaaagtagtgcaaaaatgtgttaatatgtagatatctgtgatatttacaaaagaaaagtgaaaagaaaatgaatttcacagttcgggtcaatgctcacatggattaggcaatgaaacattctggaacacctttttataactattccaaatgagaatttggaaaccataaaacaataaaatccaaacaaaggtgcattaggataactgtaaatgcctttaagtaatgatttgtaaaattgtataagggtcttaaataaacctagcattttattaccaggcacactgttaacattccccagatttttacaagaggaatttagcgagctatctgtaagatttagcttagctaatcatttacgtttctacccagaaatacatatcaatacattatcaaagtaaatatggtagctatgcactgggagtccttttggaaacaaatatatcagatctttatcaataattgattaacacatttaaatacttcaaaaaccaggaccttgtactattatacagagggtgctttattcagattgttatatgaatttttttcctcccatcttcagcttcttatatcttcgtttttctttatctcacaaaacacaaattgctccctaaataacactcgataagttattaatgttagtttaaataaacttattttttcttggattgttgcacgttcttcccctttagaaagctaccttgaggattttttttctggttagctttatgtatgtcctcaaataagaaagttaagtgctattgttttcgcaaatggctatgtagcattggttctgaatcatttgcttgttaattaaaggataacccagatagaagttaaacggagtagtcatggcctgccttgctattttagaaaatattggccaccagttaacactgcaacttgtcagatatctacttgcccatctgagagggcaggtttgaaagtacacaaataaagaatacacatcatgatgaccaattcattcaaaaactttgaacatttttagggggaaagacattatatgctacatgttttaacctacaaggcatcatagaaaattaactatgaaaagatttgttggctagctttatttaattactggatttttttgttgttttttattatactttaagttttagggtacatgtgcacgatgtgcaggtttgttacatatgtatacatgtgccatgttggtgtgctgcacccattaactcatcatttaacattaggcatatctcctaatgctatccctcccccttcccccgacgccacaacaggccccagtgtgtgatgttcgccctcctgtgtccatgtgttctcattgttcaattcccacctatgagtgagaacatgcagtgtttggtcttttgtccttgcaatagtttgctgagaatgatggtttccagcttcatccatgtccctacaaaggacatgaactcatcactttttatggctgcatagtattccgtggtgtatatgtgccacattttcttaatccagtctatcattgttggacatttgggttggttccaagtctttgctattgtgaatagtgcctcagtaaacatacgtgtgcatgtgtctttagagcagcatgatttataatcctttgggtatatacccggtaatgggatggctgggtcaaatggtatttctagttctagatccttgaggaatcgccacactgacttccacaatggttgaactagtttacagtcccaccaacagtgtaaaagtgttcctatttctccacatcctctccagtacctgttgtttcctgactttttaactatcgccattctaactggtgtgagatggtatctcattgtggttttgatttgcatttctctgatggccagtgatgacgagcattttttcacgtgtcttttggctgcataaatgtcttcttttgagaagtgtctgttcatatccttcgcccacttgttgatggggttgtttgtttttttcttgtaaatttgttggagttcattgtagattctggatattagccctttgtcagatgagtagattgcaaaaattttctcccattctgtaggttgcctgttcactctgatggtagtttcttttgttgtgcagaagctctttagtttaattagatcccattggtcaattttggcttttgttgccattgcttttggtgttttagacatgaagttcttgcccatgcctatgtcctgaatggtaatgcctaggttttcttctagggtttttatggttttaggtctaacatttaagtctttaatccatcttgaattgatttttgtataaggtgtaaggaagggatccagtttcagctttctacatatggctagccagttttcccagtagcatttattaaatagggaatcgtttccccatttcttgtttttgtcaggtttgtcaaagaccagagagttgtagatacgcagcattatttctgagggctctgttctgttccattggtctgtatctctgttttggtaccagtaccatgctgttttggttactgtagccttgcagtatagtttgaagtcaggtagcatgatgcctccagctttgttcttttggcttaggattgacttggtaatgcaggctcttttttggttccatatgaactttaaagtagttttttccaattctatgaagaaagtcattggtagcttgatggcaatggcattgaatctataaattaccttggcagtatggccattttcacgatattgattcctcctacccttgagcatggaatgttcttccattgtttgtatcctcttttatttcattgagcagtggtttgtagttctccttgaagaggtccttcacatcccttgtaagttggattcctaggtattttgttctctttgaagcaattgtgaatgggagttcactcatgatttggctgtttgtctgttattggtgtataagaatgcttgtgatttttgctcattgattttgtatcctgagactttgctgaagttgcctatcagcttaaggagactttgggctgagacaatggggttttctagatatacaatcatgtcgtctgcaaacagggacaatttgacttcctcttttcctgattgaataccctttatttccttctcctgcctgattgtcctggccagaacttccaacactatgttgaataggagtggtgagagagggcatccctgtattgtgccagttttcaaagggaatgcttccagtttttgcccattcagtatgatattagctgtgggtttgtcatagatagctcttattattttgagatacgtcccatcagtacctaatttattgagagtttttagcatgaagggttgttgaattttgtcaaaggccttttctgcgtctattgagataatcatgtagtttttgtctttggttctgtttatatgctggattacctttattgatttgcgtatgttgaaccagccttgcatcccagggatgaagcccacttgatcatggtggataagctttttgatgtgctgctggattgggtttgccagtattttattgaggatacttgcattgatgttcatcaggaatattggtctaaaattctccttttttgttgtgtctctgccaggctttggtatcaggatgatgctggcctcataaaatgagttagggaggattccctctttttctattgattggaatagtttcagaaggaatggtaccagctcctccttgtacctgtggtagaatttggctgtgaatccatctggtcctggactttttttggtttgtaagctattaattattgcctcaatttcagatcctgttattggtctattcagagattcaacttcttcctggtttagtcttgagagggtgtatgtgtcgaggaatttatccatttcttctagattttctagtttatttgcgtacaggtgtttagtattctctgatggtagtttgtatttctgtgggatcggtgctgatatcccctttatcattttttgattgcgtctatttgattcttctctcttattcgtcttgcgagcagtctatcaattttgttgatcttttcaaaaaaccagcttctggattcattgattttttgaagggttttttgtatctgtttccttcagttctgctctgatcttagttatttcttgccttctgctagcttttgcgtgtgtttgctcttgcttctctagttcttttaattgtgatgttagggtatcagttttagatctttcctgctttctcttgtgggcatttagtgctataaatttccctctacacactgctttgactgtgtcccagagattctggtatgttgtgtctttgttctcactggtttcaaagaacatctttatttctgccttcatttcgttatgtacccagtagtcattcaggagcaggttgttcagtttccatgtagttgagcagtttggagtgagtttcttaatcctgagttctagtttgattgcactgtggtctgagagacagtttgttataatttctgttcttttacatttgctgaggagtgctttacttccaagtatgtggtgaattttggaataggtgtggtgtggtgctgagaagaatgtatattctgttgatttggggtggagagttctgtagatgtctattaggtcctcttggtgcagagctgagttcagttcctggatatccttgttaactttctgtctcgctgatctaatgttgacagtggggtgttaaagtctcccattattattgtgtgggagcctaagtctctttgtaggtcactaaggacttgctttatgaatctgggtgctcctgtattgggtgcatatatatttaggatagttagctcttcttgttgaattgatccctttaccattatgtaatggctttctttgtctcttttgatctttgctggtttaaagtcttttttatcagagactaggattgcaacccctgcctttttttgttttccattttcttggtagatcttcctccatccctttattttgagcctatgtgtgtctctgcacatgagatgggtttcctgaatacagcacactgataggtcttgactctttatccaatttgccagtctgtgtcttttaattggagcatttagcctatttacatttaaggttaatattgttatgtgtgaatttgatcctgtcattatgatgttagctggttattttgcccgttagttgatgcagtttcttcctaccctcaatgatctttacaatttggcatgtttttgcagtggctggtactggttgttcctttccatgtttagtgcttccttcaggagctcttttagggcaggcctggtggtgacaaaatctctcagcatttgcttgtctgtaaagtatttaattactggggttttttaaacaccatctgagtttatgtttcaaagactggcccaatatggtagctcacacttataatcccagtatttatggtaggcctaggcaggaggatcacttaagcccaggatcatcagccctggcaacacagtgatacccccatgtctattatattttttttatttaaaaaaaaaatgcaagacaggctagagtcaggggaatgaggcactagccttacttaaaatttaggggaataccaaataacttggtgatcacagtgtatcatatcttaatgtaatatttttaaaaatcaaaattaaaaccaaaaaaagtcatgagaaacaatatatcaaaaatttaaataaagatccaaagaggtctgcattctgtcatgttgctgaactaatgttactattattcatttgactctaggtgaagaaaaataggtaaggaatcatgctgttttcttctttgttgtaaagataaaaacagatctaaacttaatatctccagctcatggcatcattagtttagtaatattttagtcaaagttagtgaatagtaaccattatttcctatcatctacacttaggatatgtcacttaatttcaatgtcattatcttaactatgaatcttcctaaagtactacactacttggaaaactaaagggaagtttaagaagtaatccatcatttcaatttgctacatttgtggcatatttccatcattcagggctattttacttgcttctgagtttattatataaatataggtatactctcagctacataagacattttcttttagtattttgagatgggggaattttaaagaatatgaaaaaaaggaaaagatcatctatattttcttttagattttccttatacgtaacataggaataatttatttattgaataattgatttcattctatatagagctatcactacatttctttactttcctatgtagcaaaactccttaaaagagtggtctacacttgatattgtttcaaacttcttcttcacattttttctcttcttaaattttttatcataaaataacttcaatttatcaaaaatctgcaagaatactcatatactctttctccatatgcaccatttgttatattttgcaatctttgccttactgcacacatttttgcttaacactttattgtacatatgctactttatcactaaatatttcagcatgtattttctaagaatgaaggcattcttttgtaaccccacttcaattatcagacattcaaataatgtgtttggggtatttctggacaatcactgtgatgtcaacattcaagttttgaaaggcacatgtgaaatgagtattaaaatatttataaatactgtctcatgcataaatccatatccaaaattgtgctaataatgtcatttatgacattttttctgatacagaatccagttaagggtcatgcattgcatttagtgcactgtctctggtattcattattatgaaacaatacctaaggctgtctttgtctttcatgatattgacattttttaagagagcacaggctgattgttttgtgaagtgtccttcaacaattttttctaatgtttcctctttattagaatcagatgtgcatttggggcaggaacacaatatgtgtgaggttgtatcctcagtgcattacattaggaagagcatgatgtcagtttctggtggcattaactagggttacttagggaagatgatgccccctccacatttttccactaaaaactacccatttttttcttctccaattaataagtcttctgtgggtaaatgctttgatattgggtaattaccccattgctttttaaacattcatttaataattttagtatccattaatgattctggcctgaatcagtcattaccatatcggctgcaaaatggtaattttccagctctattatttcttctacatttatcagttggcacattctacaaggaagagatttcacttttccttattcatttacttatttaccttatcacctgtatgaactcattggttcttacttcagccaatggtttataatccattctttcgttattcattttgagactcaaatttcccgtattttctcagagagatcccttgatgttgtcacttctgtcatttttaaatgattccatcattttttgagctcccccttattctctagtataacaaggtgctacagttcatctgatacattttccatccctgccctagaattggccatttcaccaagataaatctggttcctattagcaaaaagtcctatttaaaaaccagaatctgggtgctagaagtgctcgttgctacttctaggcacttctagagtgttgctgcttctaggcacacaatacaatgtgctcaagtactgtgaatagttcatggccaactctcagtcttcatggtacctgacccattagcagcatttaattttaatgatcgcatcttcctcccagcaatacaatcttcatgaagcttctaggaaatgatgctctcttggctttcctctgtccttatggaatacttcccagtcctctttaattttccctacttttctctaaacccatctaaagtcaaggtagagtctagaactcaggactttttgatccttttctcatctgtatctatacttactccctaggtaatgtcatctgacaactttcaagtttttatctcaagcccagtcttctccctcaagctctggattttatatccatttatttctacttagcaccttcacctgaatctctgatagatgtctaaatacaacatgtgtaaaattgaaccactccagacctggtccacctatagcctgcccttgaattatgcctttgcaagcataatgcagcctaaataacaaactgattttggtcactcactgccatcagggagcacccattgtttcctctgcctctgccatctgttgtgatttttgagttccacagaggaaagggggagatgggagaaggtaggacagaagcccaaattactttacatatgagccgtacatttcctactagactgttaaactgactctacattcaaaattggcagcagacgtcactaatgtggccttagagtgattcatataatttcagctgagataagaaatatcttgacagacattcaaataatgtgtttggggtatttctggacaatcactgtgatgtcaacactcaagttttgaaaggcacatgtgaaatgagtattaaaatatctctactggcaagattagatttttatggcaaccagtaagagagaatacaccattagaaagtaaacactctctgcttcttctcaggggcatccaggtcactttttgtgcaagattattgattcctttgccaattatgttcctggaatattagaaaccatttcctcatgtgtaaactggtgtatttacaaccctcctaattcaggtggaaaaattcatcatacaagtaacagtgtgggatgagaacttggcctaaatgtttgagtctcaattctgctgtagtagaaaaagaataactgctcatttcaaatgcaggcagaagtgtgtgaatttcacttagcataccagcatcattaacaagaaaatgaaattcttaattcatatatttcatggccttccaaaattacattctgaaacaccttgacattttagtaaatgtaatatataagaaatactagttaggccgggtgcagtggctctctcctataatcccagcactttgggaggctcaagacgagcctgggcaacatggcaaaaacttgtctccacaaaaaatataaatattagctaggcatggtggcacatgcctgtagtagcatctactcaggagggtgaggcgggaggatcgcttgagcccaggaggcagaggttgaagtgagccaagattgcaccactgcactccagactggatgacagtgtgagacccagtctcaaaaaataaataagtaaaaattaaaaaaaaaacaaatatcaggtatgttcatgaaacatttcaaatgtagagttcaatagaccatatttttaaaagtatagaaagcatcttttaaatttctcttcttttaatgcatttatttttacagagtggagaaaattggctctcttttaaatatataaatttcttgacttgatgactttccacaggtacaacatactcaggggagattggcaccaagaaaaaggtgaaaagactattaagctttcaaagatacttccatgcatcaaggctgcttcgtggaattataccacaagcccctctgcacctgctggatgaagactaccttggacaagcaagggtaagctgactgccccatctcctcacagcaggccagtggccaagagcatgtgcctcagctgatagcactggtgttggagtcctactctgcctctgaggagctctgtgaccctgagctcattattccatacatctggacttgttcctctaatagaaaatgaaattaacagaaacatcccccttatgaggtgcacgaagtaaaccatgtttatgtgctgaatatacccatgcctaacacatactagccattttcatttttataaaggtacaaaacatatttgcacgatactaagtaaagcaaaattttggactggcagattactaatgagggaataactaatttttttaatttattaaattagctcatcgtaacagctacactaaaaataacccaatcactatcaactcttaattctactttaggctattgatgcactgcattttccttttcataatttttaattcatttgaataaattttaataactctacaattactttagtaatacattgatctgactgagggtggaaattaatgtgtgaccatctgaaaaaagtgttcaggttatgtctaccccaaactgccaaaggaatttaaatttcagcaataaatgccccagtttaaacagaagtcgaagatagattttacagcttgcatgctaagtgatattatactatttatatactattatgaaatatataccactggcaaagcacagtgcctcatgcctgtaaatcccagtactttgagaggctgaggcagcaggattgcttaagctcaggaggttgaggctgcagtgaggtatgatgatgctactgtactccagcctggggtacagagtgagaccaggtctcaaaaagaaagaaggaaagaaaagaaaagaaagaaggaaaggaaagaaagaaggaaaggaaaaagaaggaaaggaaagggagagaggagggtgggagggagggagggaaggaaggaaggcaggcaggcaggcaggcaggcaggcaactaatatatgccgttagaaaatgaacagcaagtaatgtcaaaagagctaattcccaatattaggcctccaaaaggataaaaaaatcattcctaacagcttaaggtctgagattgggaaatttttgaatgtttgcttgtttgttgagaggagaacaagccttaacttccccagccctggaatgtcactgacagagcactcttggcggtgtctctcctctaagcagccacctctcaagaaaggtggtgtgagatgtggaaaggacagagggctggaagtccagctatcacaggccaagtcctagggctgtctttaatattgtgtgagttaggtaaaagtctcacgcaatctaaacctcaaaaataacctaatatcccttcatttttctgacgtgttgtgacggtctttttgtgtcacgctgaggcatttggattttattgtaggacatagggaaaccattcatttgcactagatggtagtatgctaggattttcaactttttaattgtttaatccactatatcccaaagtaaatgtttgagtctccagtgtgattcatttgcgtgctgttttttgtttgccttttcagcatatgctctccaaagtgggaatgtgggattttgacattttcttgtttgatcgcttgacaaatggtaagttacccaaaagaattctcactaaaatatacaccataaagtgggattaatttcatgaaaaacaaaatttatttttaaacactgctattcctttttccttctttccccattttcataaacctacagctactgaagaaggaccggggtaagggaaaatcaactcagatgaaaaataaggactgaatttgaccttagaatcttaggacagtttccttgtgaccttgatcatcccagaggaatttagaaaccacagattagattcttttcttgcagaatattttggccacatccagaagtaaggagttcattgttagttgatgaaaactagaaacaaaagcacatctgatcagccctgacttttacagggcagggtgcttatgcagttttattaagtgagctaaatctgccctgttgcgggtattgctcaaatgtgtttgacatcatcagaagaaaacaattgccgaggaaagaatataaaagcttaggctgcagccaaagggaaaagcaaacatcttcactggtgtcacttcttaagtttttgtgcctataaagaccttccttaagaaaataataaaaaacctattatatttttatctggccattaaacaaatgctgatgagctttgagagccaatgaaagacatcacatttaatgctgatgttgataggtctcttttaagtcattatatatggttttctcatcattctattacttggcaaacaatatgcagttgagagaaatatagcctaagaccacgaaatggacctttacagtgtggaaagaaaactagatcatggagagaagaatcccataattttgcatgtcattttgttcaaatcaactgagaaacgggtactggtaaactaagttacctgtgaacaaaagaacttgttcaatggtatttgtttaaaagagaatataatcatgaccctcatagacatatgaaatgaccacatgacagagattttctttaactcaattaattagagatccagtaagatgctacaactagttcaaaggagaagtcaaagagcctcacaagtatatgaagtatataccacacatatctaagaaatgctgaaattgatttataagtagccgcaaaatcgacagggggaaataaattgtatttccacctaactgatttcatttcctgtatgttttcttccagtagtttcatagtttcaggtctcatgtgtaagtcttaaattcatttagtgttgatttttgtatatggtgagagatgagggtctaatttaattcttctgcatgtggatatcccactttcccagcaccacttattgaagagactatcctttccccaatgtgtttttggtgcctttgtcaaacattagttggctgcagaagcatgaatttatttctgggttctctattctgttccattggcctcattgcctgtgcttttaaaattcaaaatcattattcctaaataaacagtatttcttgaatgcttacaagtcattacagcttcaattttgcatctctgccgacttgaattctaaaatagctcatagtcagatctcctcttgagtgattttccataggaagaagaataggctgtgactatcaagcaatatggtggtttagatacacctgtaaatggaatagtcaattggaagtgacttaaggaacatttcaagtggccataagctctgtctttaaaaaaatacacatatacacatgtgtgtgtgtgtgtgtgtgtgtgtgtgtatgtgtatgtatccctgacacctcagtaggcagattctttctaactcttaatgtcttcattgtctttggtgaagggagaaggtctgagctaattttacttgtacaataagaaaaaacctaggatcagatcatagtaataatatgctctatccttgaataatttcacttctaaaggggaaaaaaatattctatcacagaaactttattacagagactttaggtcttattgtcaatcttgatattttagtggtgatcaaaattagttaaaggaagtgactgttttcctgcaggaaacagcctggtaacactgttgtgccacctcttcaatacccatggactcattcaccatttcaagttagatatggtgaccttacaccgatttttaggtaagtcctttttttcacatttctagccccattctcttgaataatagcaatgcataatactctttaatataaagtggtaagatccataggatgatagatgcagacctccaattaatcttaaatggtctcatcttacttttaaaatatggcttgttcatcctaaatcatttaaaaattgtttacttgattacagttgatcccaaacacttgggggttaagggggtgctaaccccctgtgtagtcaaaaaatctgtgtatagcttttgactctcaaaaacctaactactaatagcttactactgttgactggaagccttaccaataataaacagttaattaacacatactttttatgttctttgtattatgtattgtattcttataataaagtaagatagagaaaagaaaatgttcttttaaaaattacagggaatcctagcactttgggaggcgggcgtatcacaaggtcaggagttcgagaccagcctggccagcacagtgaaaccctgtctctactaaaaatacaaatcacaaggtcaggagttcgagaccagcctggccagcacagtgaaaccctgtctctactaaaaatacaaaaaaaaaaaattagccaggcttgttggcaggtgcctgtaatcccagctacttgggaggctgaggcagggagaatcacttgaacccgggaggtggaggttgcagtgagccgagattgcgccactgcactccagcctgggcgacagtgcaagactctgtcttaaaaataaataaataaataaataaatgacagggaagagaaaatgtatttcctattcatcaagtggatgtggatcatcataaagctcttcatccttgtcatcttcacactgagtaggctgaggaagaagaggaagaggaggggttggtcttcctgtctcagggtggccaaggcagaaagaatctgagtacaagtggactcacgtggtttaaacccatgttctcaagggtcaagtgtagttatgtttataataaattgtatataaagaaaaccatcaggaacataccgttttcaaagaagatactggtctgctgacatattaacaaacctccagcagcatgcgcctcaaataattttaatcaggacatgagttgttgaaaattttcaataggctttttaaaaaataataataactaccatttatgtagtgcccactatgagcagagtacttttggcaagttatttctaaccatttaaacaaatctgcaagtaggatattattatcaccatttgtcccatagtttaggagaggtacaaagaggtttcattacttgcccaaggccaacagctagtaagtggcagaatatgagcccaagcctagctctgtcgacttgggagtccaccatctttccactgaactccatcattactctgtatcaaaaggcagcctcagttcttatttaaatgtgtgcatattcttatttatctgccagtgaatttttcaggggacatttctaatcaccaaatgactttcctctgccatttacatgtttctggcttctttttgacttgccacatggctgtactttgattttggaggctgacttaatgccatcagaagaaaataacaggcgtgacaataataatgggagccacaaccaggtttctatggtgcttacatctgctggaagctcttccaaggacctgcatatattaataaacacatttaatccttactccactttgagctcagagctattgctatccccattttacagaggaggaaactgagggaacttgcagttaagtaacttgcccaatacagacattaaagtgatagagggtttaaatataattgtcaaatatacctgctgaataaaaagtatgtgcaacacaacagaaatatttgaaaccagccacaacatggctaatttccagaaatccaaataacctcaagctgattgtatttcaattgattgagcaaagaaatggccatgcatagggccaaataattttgatttgtctgaaaagggagatacagatatagatactttggacacgtgtatctacccagaaaatatataaagaatacaaagacttgacaacagaattaacactgtaatccagagccagattcatagcaatgggctgagagaatctggccacacttgcaaatcaggacagtctatacacactgaatatattgcatcctaagcatcgccttggttatgagctgaagcaggttagcgtcttccataaaaagcaaaccaaaatcgccttgcctgtgtctctacttggttccaagagtactctaagccttacattagactgcaggagcatgaaagatgatactctaacttgaataaggtagaaataaatccaagaagtccacagttggatcaaggcaataccctgaatctctgccctaagaggcccggatttgctttcattggtatttgttattcaagtgttaaaccagtctttggatatcagtattctgatgctacttgggctctttgaaggaaacctcatttgtggcatattatttataaacagcagaaactcaattaaactatagtgtgagataaagttgtgcttttcctacatatttatttttcctatgaatgacagcctttatgaatgtcagaaaggggggatttatgaaggaggtgagaaatcccaacgcttcacaaatccttttggcctttctcccctctgctgtccatctctgctctctgctaaaaacagcctagcagaactgccaagcttgcaaaccacgtttatttttaaagcatctctatgctgcacattttggaggcactgatatttttaagcaaaaagcacccacagtaagtctaagctagtataccactcctatttgggttttagttgattgagttatctgtttacctcccagtcatggttcaagaagattaccacagccaaaacccgtatcacaatgctgttcacgcagccgacgtcacccaggccatgcactgctacctgaaagagccaaaggtaagacaagacccagctgcctcctcagccacctggaaatgccaaggaaactacctgctaggcccaagttacccaacatatctgagtaactatgttatgtgtcattaacaatgtgaacacaaattattgatattaaggttccagtatcagctctgaaaatcttacaatgttcacgaaaaaggatgagactcatctgaggttttctttcatattttgtatatttttgaggctgtatttggacaaaaaaaaaaaaaaaaacttcctctctatggcaatctacatcttagataccttcaacagtccatagaactagctccgtgccttagatctttgccacaaacagcaccagcattgaactttgttgggaaaagtctcctactgcatgagttttgatcaacaaatggaatcaaagctcctcaagtctgatgttctatttcctactgaaccaactggatatcccgattcagggcccaagaaaacttgtgaatgtcaaagacctcttagcaagcatgttctgatgcaataaaccaacccaaagttaaaaattaaaaacattgtaataatgctcaatactcaacattcaggcagtccttagactgaaagtctgttggtacaaggtacaggatgagttttcttaaggtttctggaaaattatattctaagactgttgagttcaatctgtttttaacatccccctacatatgcggatgctttgacagcaacaactaaatattcagatgtcaaacaggcactctcagggcaaagctgggtgggtgcctcatccctgcaacatatcccaaggacattaatggctctgttttttaatttccaagtagtctaaacattgtactatgtcatacagttgtatttttaaagttagtattggattcccgtgtctctgcttattttcctagctaaccagaaaatcacagattctcatacattctcccactatttattacacattgaaaaaaatgcagatcttgcaagtcggcccacttctttcaaagtggcaaagatatattagacagttgaaatacacaaatgatttttaagtaggtccatcatgtgaccaacttttttcttcatttacacatttctctaggagcaaggctgatttcaggccctgtcttctacctatccacccaacagcactgttgccaaccagcaatgccatcacaacaacaaaacaaaacagagtggaataggaagaaggggataccagaataatctacacaatttgagtttacccaatattttccacacagtcctttcctttttgcctgtgatttcatgtgactatcacctcatttaatgcttcaaagggtaaaggtctggctgataggcttaaacaatgccatgatgattcattgtgtttgatttagccaaaatgattatgagcctatttgtgaaaatacaccaatcaatctcccaatttgtttttttaacagcttgccagcttcctcacgcctctggacatcatgcttggactgctggctgcagcagcacacgatgtggaccacccaggggtgaaccagccatttttgataaaaactaaccaccatcttgcaaacctatatcaggtaagggagcccaacctggagccagccacagtatggtcaatcgccttaggcccggtgctcaagcctgaatcttgcccatggagaaagccttgttttagggtcctagaagttcaaagacgaatgaaacacaatctctgccctcaaaaatttgttcaaactcagatgctcaaaatgagcaaaatccaagcaaacttaatcccagtttgaaagaggtttgaggaattagctcatgtcgatacaattgttttttaaaatctctaaagagtaaatacttgtgctgttctttgtatccaaagaccttactagaataaagtgagccgctgtttttcttttcccatcagtaaatttattctctaattctctggccttgtccctgtaaggaaagagaagagagaatgatccaagtgtgtgtgtgtgtgtgtgtgtgtgtgtgtgtgtgtgtgtgtgtgtgttttcagaaacagggtcttgctttctcacccaggctggagtgcaatagtgcaatcatagctcactgcagcctggaattcctgagctcaaacaatccctccacctcagcctccctagtagctcagactacaggcacgtgccgccacacctgactaattctgtttttcatagggacaaggtctcactatgttgcccaggctagtctcgaactcctggcctcaagtgatcatcccacctcagcctaccaaaacactaggattactggcatgagccacctgggactacaggcatgagctaccatgcccgaccgagaaggatctctttgattatgactagggagaaattggggtataggtctagggaccacattcaggatactacctatatcagtcacctgttcaactggtcttaggatctcttggaggctatagatccatgtcttttaagatttagggacaaagttgaaggcaaagcaatatcacatagtaccatacagatatcttcagtgtcctatagctggctagaaaaaaagctgaaacttttcttagccaaattggtgcttgtcaatactgaaaataaaaattgtttaaaaggacttgaaaataataggaaacttcaattttgtcaaaaaattgtgatccctttatttttggctatataccatcactattaactatactaaggaacatcaaaaagatgaaaaaaatttcttttaaaaagttcagttcaacaaactgtttaactaacctttattcaacacttactatgacccaaacactgtgccaaatgcctttgatgtagtatattattaatcttcacaatagcccagtgaggtgagtactattatcatacctattttccacagaaagaagaattgatacttgggaaatttaagtgtttttcctgaaaataaacagataattaatagaactggaattagaactcaactttttggtttccagagccaaagtgcctaagaactatgcatcctgcctctgaaattcatattgatcacctaccgtgtaccagaaactaacagctctcctacaatgctcctattgtagtaaggcagacaagagggttctagaaagtgatcgaggcctggcgcagtggttcacacctgtaatctcagcactttgggaggctgaggcaggcggatcacttgaggtcagtagttggacagcctggccaacacggtgaaaccccgtccctactaaaaatacaaaaattagctgggcatcgtggcacatgcttgtaatcccagctacttgggaggctgagacaggagaatcacttgaaccctggaggcagaggttgaagtgagccaagatggcgccactgcactccagcctgggcaaaagagggagactccgtctcaaagaaaaagcaaaggaaagaaaagataagtgatctaaagtgtgagaggcttgatagatactttaaagtatttagctacaaacaaatgtgatgggaagatgggggaaggagaaactgattctgcagatagttgcagcgggaaaaaaaagaacatagaaaaagaatgctataaactgggccttaaagtgtgagtaacattaatagctgagatgaaaagagggcattagagtcaggatgagctgatgtacttttgggattaaattccacaactccagaataactgaaaatggaatgtccggtggcctttagctgagtatggtcctgccatctacagctccgtctctgatcagtgtgttgtgcatatcatgattcagtgcatacgctctcttttgtagtaacttcagattagttgtacaggacatgacctggatcaagaaatctttactctgcattaagttatagatgaggaactggcagaaatcttcaagttttcagtatcaaaggaaaaaatcacgttacataatatataagctgagcaaacccattaacgacacatggtatttaaaaatctttggaaatgtagccttttagcctctcaagggcccgtttgctgagacacaaatgggctttcagggagctatttgcaaattttcataggatgtttgcatgcacattttcctagggagagggtctataagttactcttatcaaattttaaaataagttgcagattctgaaaatgttaagaaccatggtaatgaatgaaaaaaatatatgtacatatacgcacaaaaattatgcatgcgcacatgcacatttggtcaacaagaataccgtagagaggatgtgccaggaattatgtggcttggggaacaccctgtgcgtgactttgccacaatccagacttactataaatgagataaaatggaagagggcttcctctccctccttctgttggctgtgctcttttagttctaataaataagaggatcattgcataacatccagcctgttattctaccctgagataaagagagagcagggcagctggagtgaaggccaggtcagagggctccctcccatggtctgttctctgggccggactcactcgctgaactgccaaccaagttcaatatgaaggcactgaaggcacttctacttggcacctctctcatcagactggaagcagtccaggtgtccagggtggactgggaggaaaaacagcatgtgagaaatagaaccaagaatttactttctgttccttcaccctccaaccccacacatacaaatttaatggtgggcttagcaactgtgcaaagtaagcattaagttacatacaacgttggtgattataaattgtaaaggaataactttcagttcaattttaaattcaactcctttcaatagagtccaacaacatggactctatcatttactcatgacacagcatccttaaaataatgactttaaaaaattgtcccataaacatttattacactctataatgtcttgcagaagtttataatcagctttcttagtcatttatcacaagcacttagaggggggtcagcattttgaaccacttgttattcttaatgagtctgaatcacaaacatgaagttgacccagccaggaggaatattccttccacgtggtcctatgaccccaccccgtcctcaaacaaacatctgcaaagactaacataagctcacaatttctacagtatgaaaggtgtttttggaaagtagtgctaaaattataaaaggagcctcaaatttgactttctgttccataaagtttctgccatccccaatctgaaccccagccttccctgcagacagcaattggcatccccgctcccttctctcagctatcttaggcagatgcagaacaaacaagagaaagacatcttcaaacaggcattaaacaaggcagtgctatcgtttcttcaagggccaaggtcttgtttagggctcaaggagcttctattccactgagacctcctaggctggggctctcatagtgttaccaaggagaccattggcttgttagggaagaactcagcagcctccattatctcctaaagtcttgcaccttgtttcatgagcaattaaaaatgaaaacacagacaatgttcctgttgtttttctttctgtatcctccggatttaaaatgttcaattaactctggttcctggtaccccagattcagtttatcatcatcatttgaagtattttaatcaaagaaagtgtccaacaaatagaggaaaaaaacagtttaaatctgccttgtatgatagcaactctgctctgccagattctgtttgccaaataccctcttgacttaatttgaaaacctgtgttggtggtgtattaaagaccaggtgtgctattagcaaacaaagggattgttttgtttttagggtgaaaaatacttgataattcaggcacaaagggaaacgaaggttttgccttagaagttggaagggttttgtttttttcaaattaaagttctaataggttttgttgtcacaaaggtagatgcttactccttcaactttaagatgaagattactcttaaaactgcaagtaggaagggtttgagccactagaacacattgtcatcaggataatgtgaaattactgaaccgatacttcttaaagatagacagacatggtacctgatgtggtattctagaaccggttagggtttcaaaggatattaaatggtatcctctcaccacatgtttagatctccatgaccatttctgatgcttttcttctttttctcagtctacctttggttgatacgagtcactgagcctctgtgaaagatgagtctgtaggagtagagctgctttttgctagggaggatacagcattcttatctctggcaagtcactaagaaaccccagtgtatgcaagcctgctcgccaccctttgcctctcccctaggttcagggcacaccagcatcatcctctcatccacctactctcagccttgcctggtttcagccctttttccactatgaagacagaaagagtttcctgaaactcaaatctgaccacatcgattcctgcttaaaaccctaccatgcctcaggattgagtccaaatgacttaacacaatttaccatccccgttctgatctgacccctgccagtccttccagcctcacttcccaccattcccctcccaggcttctatgcattgaggctgaacttccagtttcccaaacatatcactcaattctttatccattcagcagatacatacggagtgctgaatacatgctaggtgcaggagtatagaagatgaacaaaacaaataaaaaagtctgcttttttctaagggaaacagaaaataagtaaaatatgtcctctattagaaagtgataattcatagataaaaacaaaacaagataaagatataaagtatccctcttgcttacagatcttcacacccatgctcttccttctgcctatttgaataaaatgtagtattccatggtatattttactcaaatataatatacaatagagtatgttgtctgtactctctaattcctctcttacttgctcatccttttgatctaaatttggacatatttccctcctgaaagtcttctttttctctaaaaatccatcttacaagcccctcctatgagattttccagtactctcttacttcccttatcacagtatgtgtcactcgaatcgctattgcctgattagatgtccacttcccagacagatagtacatttttggtcacctaactcattcactgtgatatcctcaataccgagaacagttctgatgtccagggaatatttaatagcttctcctgcttattattgcagtcttactaagaatacacagagagtacaccatgcagaaggagtagcaatgattaaaaattcttggaatgatcttctcattgcatcttggaattgacaaatgcaagctgatacatgttatttcttgagtcctttacctaatcttggttgtctgcaaatgagtagtgggagggaacccattgcagtaataattttaaaatttctttggattttacctaagtctaaggatttcactacacaagatcctaaatctggcttctatcagatattgaccaaaaattcaaataggactctttttcttttaacagttcttttaacttttgtagctactgaactttggggtttggggtatcaattactcagtacccattcaacaaatatttacctatttaagtggcactgtgccccataccatggcacaaagatgaatacaatacgctccctgccctcaatagcagtcacgtagggccacagttttcacacagggtatgtgtgcccatggggatatgtgaagactttccaaggggtacacaggcataaatagtgttaacagaatccatttttaggtccttaaactgacttgcctggaatgtgcttgcggggcagtgaagccagttccacttttccacttaactttcacagtcaccctgtttccactttacaaaagacagacacatgtctgactcattctaagttatatttcatactgacctaggtataaaaatagcaagcaactatattagtccatactcaacgctgctataaggacacatctgagactgggtaatttaaaaaggagagaggtttaattgactcacagttctgcagggctggggaggcctcaggaagcttacaatcatagcagaaggggaagcaaacacgtccttcttcacatggtgacaggaaggagaagtgctgagcaaaagggaaaaaaaacccttataaaaccatcagatgtaatgagaactcatgcactatcatgagaacagcatgggggaccacccccatgattcagttacctcccatcaggcccctcccatcacatgtagggcttatgggaactacaattcaagttgagaattggataggaacacagccacatatcattctgcccccagcccctcccaaatctcatgtcctcacatttcaaaacacagtcatgcctttccaacattccccaaagttttaactcattccagcattaacccaaaagtccaagtccatagtctcatctgagataaagcaagtcccttttacctaggagcctgtaaaataaaagcaagttagttacttcctagatacaatggggtcacaggcattgggtaaatacacccattccaaatgggagaaattggccaaaacaaaagggttacaggccccatgcaagtccaaaatccaatagggcagtcattaaaccttcaagttccaaaatgatctcctttgactctgtgtctcacatctaggtcacacctgatgctgggctcccatgccttgggcagctccattcctgtggccttgcagggtacaacccccttcccagctgctttcatgggatggcattgagtgtctgtggcttttccaggtacacaggtgcaagctataggtggatctaccattctggggtctggaagacagtggccctcttctcacagctccactagacagtgtaccagtggggactctgtgtgggagctccaatcctacatttctcttctgcactgccctagcagaggttttccatgagggttctgcccctacagaaactcatgcctggacatacaggcatttctgtacatcctttgaaatctaggtggaggttctcaaacctcaattcttgacttctgtgcacccacaaactcaacaccatgtggaagtcactaaggcttggggttgcaccttctgaagcaatggcctgagctacactttggccccttttagccacggctggagctgaaacagctgggatgcagggcgccatgtcccaaggctgcacagagctgggggccctaggccctggcccaggaaaccatttttacctccctaggcctccaggcctgtgatggttcgggctgccatggaggtcttagacatgccttggagacatttaccccattgtcttggtgattaacatttggcttgttacttatgcaaatttctgcagctggcttgaatttctccccagaaaatgggtttttcttttctattacatcatcagcctacacattttccaaacttttttgctctgcttccctttgaatgctttgccatttaggaatttcttctatcagataccctaaatcatctctctcaagttcaaagttccactgatctctagaacaggggcaaaatgccaccagtctctttgctaaagcatagcaagagtcacttttattccagttcccaacaagttcttcatctccatatgagagcacctaagcctagactttattgtccatatcactatcagcattttgggcaaagccatacaacaagtctctaggaagttccaaactttcccacatttcctgtcttcttctgagccctccaaactgttctaacatctgcctgttccccagttccaaagtcacttccacattttcaggtatctgtatggcagcacccaaatctcagtactgtattagtccattctcatgttgctataaggacataccccagactgggtaatttataaaggaaagaggtttaattgactcacagttctacagtgctggggaggcctcaggaaacttaccatcatagcagaaggagaggcaaacacatccttcttcacatggtggcaggaaggagaagtgccaagccaaggggataaagccccttataaagccatcagatctcatgagaactcactcactatcatgagaacaggttgggggaccaccaccatgattcaattacctctcaccgggtccctcctgtcacatgtatggattataggaactacaattcaagatgagatttggatggggacacagccaaaccatatcaagagcaattaaaaatattaaaggaagtctcctgtaactgagatatgataactcccccatccatctcataaacagacacacggccaataaattattattcttgagcataattattctttccaaatttgcaataaacatgtgttttgaccaatgagtttctggtaaggattatactataaactcaagctggaaaagtatttagtacttagagcctgatgttaggaaatttttttaaaatcaaatttcaatttagactttcattgcagagaaatatgataggatgacaataaaagattttcacatataaaattatattacattaaaataaaaatctacagagaaatagaatgaaaatacaaactctagagggaaaagaatttaatatttctgacttaaataataagttaaattattcatgtggatttttttcaatgggtgctgaatgggcattaaatgccattgttattaggttcccttagacacatttaatacccagaagagtgatatagtaagtttatattaaactaccaacattcactaatacactggacattacatcttttgtaaccacttatatttatgatttttgaaagtttagatatcaactctgaaaagtgtgaggaaagtatagtttttcaaaattcactgaatgagcagaccactgacatgtgggagcaaggccagtgaacaaagttgttataaggtgttgtagacactaggatagaagtttcctgtgggtgtagaaggtctggaagaggaagctgtcagttctgttgagagaaccaagaaaggctttccaagcagatcaatgatttgtctcagaaataagtagataaggtcgtgtgtgtgtgtatgtgtgtttccaactttattaaggagattctcctcactcttttttggagttatgtaatcctttattatcatttcctatgcccaaaccaagccttattataaatcaagacattgaaaaggccctctctcattagctctttcaggatgacatgggagacaaattaactttaaatcaacttggtgtatttgtgatttaaacaagatagaagtttattcctaaccttcataaaagttgggcagttggaagtccaaggaaggcacaatagctccacaaaacattagagacccaggattcttttagttctacaatctgtcatctcttggtagggcacttgtcctcctcacccaaggtatctgctggaggtcaaaccattcctgctgcattccagtgagaagatagaatggggaaaagcaaaagaaacctctctcagatgactccacctttggtttaaacaaccttcctggaaatcccacgcaacacttctgctaacatttagtagatcagaacttcatcaaatgatcccacctagttataaaggaggctgagaaatgctgtctttcttctgaatagccataagcccatttaaaaactgaggttctgtgagtaaggaagaaaggaaatcagaaaaatgggatgaacaaacaggagtctctgtcatacgtgatgcttaatcttaaacctaaggccatcaaaatgatgacttggtgtgatccttccctttatgtaacattcttcctctaacccaccaattactacagcacttacatgaccattgtgttttccttttattgttgttactgcttaggttatttgatatccccactgtgctgccatgtgtctaatggcacctcaaactccacatgtcccacactgaactctacacctgctccactgcagctttcccgtcacgattaatgggcactccatccttctgtgctcataccagaaacaatggaatcatcctgcagacccagaaatcaaccacctctgatgctacctcccccatccacatctccatcacctcttacctggatgagtgctattgtcccaaacagccttccacttgtatattagttccttctcacattgctataaagaaatacctgcaactggataatttataaagaggtttaattggcttattgttccacaagatgtacaggaagcatgatgctggcatctgcttggcttctggggagaccttaggaaatttacagtcatggcagatggcaaagagagtaggcacctcacacggctagagcaggagcaagagagagagtgagggcaaggtgctacacacttttaaacaagcagatctcataagaactcactaccacaagaacagcatcaaggggatggtgccaaatcattcatgagaaaccacactcataatccaatcccctcccaccaggcctcacctccactattggggattacaattgaacatgagatttggctggggacacagatacaaaccatttcaacctgtttctccccttacccctaccaaagtctgttgtcaacatacaccaaaagtggccttatttcaatgtaagtcataattttactcctcccaaacccttgcagtggctccttatttctctcaaagtaaaaaccaaaatgtttgtaattgccagaaggctgtgcctggtctggtgtctcatgacctcactgacttcatgtcttcatacttcccctctctcgctgtgcattgacctcacagctgttagctcctcccttgaggcctttgctccagctgttctctttagaatgctcttccccaggcaggaatgactaactccctcctgccttcaagcttttgctcaaatctcacatttccccatgactaccttaccagccctgactatatctgaaagtggggactctcagatgcccactattctgctcttctctccatgcatttactatcttctaacatgctatccaactctttccagcatgaaagtatttattatgtttattgtttattgcctgtctctccccatctgatatggtttggctgtgtccccacccaaatctcatcttaaattctgtgtcatgggggggaacagtgggaggtaactgaatcatgggggcaggtctttcccatgcccttcttgtgataataagtctcacaagatctgatggtttcataaaggggaggtttcctgcacaagctctctctcttcacctgctaccatccatgtaagatgtgacttgctcctccttgccttccaccatgattgtaaggcttccccagccatgtggaactgtaagtccattgaacctctttctttggtaaattgcccagtcttgggtatgtctttatcagtagcatgaaaacggactaatataccatctctaccaccactagtttcttgtctgttttgttcactgatgtattccaagcacatatcacagtgcctagaacatagtaagtgctcaatatatttgttgaatgaaatcaagtaatttgttctcttacttagcaaatttatagaaactctgtgtgaggcatagatttgagtggatacaaaaggaacaaggtcggctgcctactcatacctagcttataatgtagtaaaagataaagaactctaatagacatcaatgggactgagtttaataggacacaggacttccggaatgccagagaaaaattcaaaatgagtataagactcagaagaaagcacatttgcctttgcctggaatgattgcagatggccttgtggagtatttgaagtgaactttgaaagacaggggctggtttgataagtgaacatagagaaagaggtgtttgcagataataaaccaccttggaaggtattagggttagcaaaaggaaaggacaccatcatatattaataatttaatatttatgtaagttatagtcttgctaacatgatatttatttggactataagagctttgttggaaaggagaggtaaaggtattgagttatctcaaacatttaggaacaaagtgatatttgggacaatttcataaagcattgaacgtcaagctaaggaatttgacttaatttgtcttacagggatccgttgtggggtttggaacagggaactggggcaggtggatagcatgatcataccagaggccagcaagctccttgagagcagagattttgtcttatttatccttggatccccagtgcacaccacagaacctggcatattagtgggtgattgataaatatttttgtttcaaccagtgattagggagaatgtaaaaaattttgtcaaataaacaggtcacattctggcagctgtaaggaggatgacttgaagaaaaacaatgaaaaaggatggtaaaactctgaaatagggtggcttctatgaaaggaatgattgggcacaagtgacactatgtaggaaaaaccaaaaggattcagacactgattgcagatgagggttgagagtgaacaatgagttctcccccaagacgacctaaatctactcaatcattattcaaaccacaagatttttagcaatagaaccagattcagaggtaaatgcaagaattccaatgtgggtttagaaactaacatctaattagaacaatcaaccttagttttttttgagcaacaactataggtaattttggcaaattcagtataattccaggtatttatcagcttgtaaatttcaggcttctgatgcttggatgtggtagcacagagaaaattcttgggaggcagcaagggctgtatgcagagcttaggtttgagtctgcaggcataagtgaggccttcctcagctactcactagctctgtggcctccctaagaaacctgagttttttatgacctatgaattcatgatcaaaatagtggaggggtatgtgagatttagatgagggcatggaaagtgcctggcacagagttggtgtttgataaatgttagtctctcctctctatgctgttcttcttttcttagtctctggaatccaccatggtgcccctatttccaccgcggttctggccaaaacatgctttcatgcataatgactcttccacaaaggctgtgtttgcaatcatctactctattgtcttttaatctgtaccagcttccaagctaacccaattttctagcatttccctggtgctcatctccaaatacagtttcaccagcaaatttcctaagtatccttttattctgtcttcaggaagattattaatgaagatgttaagtcaggctggcatacatcaccatgcttaaggccatcttccagacatttttgttccactacatggggatatggtgtcatttatcattagatcttgttacagctttctggcccttgaaaaactcatgggagggcactcatgtccacatctacttgaattagtcttgcaagtgaacacgtgagcgactgaattaaatgtcatcacaggattgaacatctgttacatcacactaatctatcactcttctctcctaaatcttttcaatcaaaacaaattagtctagcatgtgattttcaatcagccttctcttttgttgtgtgtagctcatgcccaaaaggaaataatagaccagttgataaaagtaacaaaatttcattactgcttcaaacatggtcaagtggtaaataaagaataatgactccttggcaattagtgaaatgaatagcaataggacagactctacagaagatggatatgagactcagtcagcctcatgaaacttacctcataacaaagccttggagataaatgagtgtgtggttttagaatcaagaatagttttagaatcaagaatagttgcagctttcctgacttgtgttttcctaatggagcattgattgtgtcactaacaagagattctccttcctcatttgctgaaaaagttgaacatcgtatgggtggctcagatacagtaggggcataatataatgggatggtttttagccgcacttctgactccatttcgtcaccaaattattttccttgcttcttttcccttactttttgtttaattgtggtaaaatacatgtaatataaaatttaccatcctaaccattttgaagtgtacaattcagtggtattaagcacattcataatgtgcaatcatcaccactacccaactctagaactcttttcatcttgtaaaactaaaccctgtgcccattaaacaataattccctgttcctccctccccttagtccctggcaaccacccattctactttctgtctctaagactgtggctactctaggtacctcatacacatgaaattatacagtgtctctcactttttattgaatgttattgtcttagtccattttctgttgcttataacagaatacctgaaactgagtaatttacaaggaagcaaaatttatttcttacagttatggaagctatgaaagtcaagatagagggggctgtaccttggtgagagtcttcttactagcggaaactctgtacggagtcctgaggcatctcatggcatcagagagggggctgagcatgcacaagtgttagctcttctctcttcctctcttataaagctaccagtttatcttccatgataacccattaatccattaatccattaatagattactccacaatccaatcacctcttaaaggccccacctctcaatactgtcacattgtggattaagtttcaacgtgtgttttggaggggacattcaaaccatagcaactatccttttatatgttttgtaagattataactactcttgaaaccaaatggagactgaataaacaaaatattgcctgaggtcaagaggagttctattctgtatctatgaagtcaatggtacagacataatgtttcctaattagaacaaaacacaattgagtataagaaatattcatcatttaaatggttaattgttcagataaaaagcatattcaaaataacaggtcaagggagagattgaatataacacaggttccctcaaggacaggaatgttaagataattgagcaaggaagcaattgtagattccaactcacagatttaatcagctaaatgccaaggtgctggtcacaaagattaccggcagagctgcctgcaaggtaatggttctcaaaccttagtgtacatatgaatttattaccacaagcctatcaaatcagaaccataatgactgcgactcaggagtctgaatgtgtcaccagctaccctggtggtttgggcttaggaggttcttatcagcgttgagaaatgatggtcagtgcagtagattagaccagagattgtgaggcttgcctccattcagtttgctagtataatcttggattatgttatgactatagtgacatggtatccattactacctatttcactgcttcactttttttttattattattatactttaagttttagggtacatgtgcacaatgtgcaggttagttacatatgtatacatgtgccatgctggtgtgctgcacccattaactcgtcacttagcattaggtatatctcctaaagctatccctcccccctcccccgaccccacaacaggccctggtgtgtgatgttccccttcctgtgtccatgtgttctcattgttcaattcccacctatgagtgagaatatgcagtgtttggttttttgttcttgcgatagtttactgagaatgatgatttccaatttcacccatgtccctacaaaggacatgaactcatcattttttatggctgcatagtattccatggtgtatatgtgccacattttcttaatccagtctatcattgttggacatttgggttggttccaagtctttgctattgtgaatagtgctgctataaacatacgtgtgcatgtgtctttatagcagcatgatttgtagtcctttgggtacatacccagtaatgggatggctgtgtcaaatggtatttctagttctagatccttgaggaatcgccacactgacttccacaagggttgaactagtttacagtcccaccaacagtgtaaaagtgttcctatttctccacaccctctccagcacctgttgtttcctgactttttaatgattgccattctaactggtgtgagatggtatctcactgtggttttgatttgcatttctctgatggccagtgatggtgagcatttattcatgtgttttttggctgcataaatgtcttcctttgagacatgtctgttcatgtccttcgcccactttttaatggggttatttttttcttgtaaatttgtttgagttcattgtagattctggatattagccctttgtcagatgagtaggttttgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtgtaaggaagggaaaaatcacaagcattcttatacaccaataacagacaaacagagagccaaatcttgagtgaactcccattcacaattgcttcaaagagaataaaatacctaggaatccaacttacaagggacgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaaactaccaatgactttcttcacagaattggaaaaaactactttaaagttcatatcgaaccaaaaagagcccgcattgccaagtcaatcctaagccaaaagaacaaagctggaggcatcatgctacctgacttcaaaatatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgctgggaaaactggctagccgtatgtagaaagctgtcactgcttcactttctttcttacatttagcgtggcctgactgagctattggaagaggggcagaggcaggagtgaatgatgctggaaatagatcctcattcaaccctgcagcagagggtgagccgcaggccctgctgttctcccatcatcatcacagccttgagactagacctcatggttgttttatcttttgggtttttttttcctggtctgcctctgggtcatcaagtacaaactggagggaaaatgctagcgtccgtggagctgtgttcagcatgaaagatcagtatctggcttccctctcatttataactcttattttctttctttctagaatatgtctgtgctggagaatcatcactggcgatctacaattggcatgcttcgagaatcaaggcttcttgctcatttgccaaaggaaatgacgtaagtgctgccgagatgaaacatactgatgtgcatgcagtaaagataagccactttctctagggcaggcttgggaccttttgcgtgaatggcagagagccccccggctgtacttcctgcctgcactgagctgtctatcagaggagatttggtgtcagttacagcaacccagaaaccaaaatctctctgtgtgctttgaaagggccttgcagagtcaatgacctacagtcaggaaaagggataataaacagctctcagttttcacacgcttcagtatcagtgctcgactttgccaaattcccgacctttagtttagcaaaattgtccttccatgtagctccaaatagtaaatatttatcaagaaggaacccaggcattctaaagctagagttcaaaaaagtatattttgtaattgctagtctcagcaaaaatagaagtcagaaattcttttctaaaatgtcttttgctaagtaattgaaatggccctagcatttttttcaccaattaatttaccttacgtctcttgcactttaaacagaaggggagacactcattttctggttcactatttgatagccatggtatgtaggctgagtcccactaaatctgaggccattgtttcattttcctggtggccccaagttagctgctaatactgtcttccaaggccaccattaattctgatctgtttaatgaacacgtgcagaacccaagaaacctaggtgaaaagagtacatagattgctgtacccttcttcaagacaagcacataacttgaggtcaaggaccaagtgctgtctcccaactgaacaagcagtatactctgggttgtggattgattcctggccctctgatttgatctcatgctgtttcctagcacccagaggaatgtgaaatttgcaggaggaatttcagttctgataaatttttactccctggaactaaataaaaccagttctcgtgcatggaataaaaacttatgcctcttactagaataataaattgcaaagattgaaagaattaaatgcaaaaagaactaaaaactagagcaaaagatcaagtgagaagaagaaaagaggaggtaaggagagagacaaggaagaaagaaggagaaggaaaggaagaatagtgaggacaggaaagaagaaaatgcaagggaaatgggaaaggactctggggtgaccagacttctcctggtcagtacctgcattcatcctgtttgttactcaatatttctttcctaaaatattcatttcacatctatggattccaatgaaaaatatatttttatgtgtctttgtggaacacagtgttataaattgtttttgccagaagaataattgttatacaataatatatgtgaaaactttattacaaaagccattatcataatcattattattccttctatcacaggtaaatgctttaatgtcatttttctgattttaaaagtagggcaggttaattgtagaaagtaaggaaaattcaggaaagtgttagtttgaactatgtgaagttgctctttttaagggccaaaaacaggagacttttagcactttcatatgtttcagcttgatatgaaagagaaaactgaaactgctagtaatcctgccatccaggtatagttcatgttaacctggctagtttattttcttttagtcttttttcaatacaaacttattttaacaaaatatgattatatttggggaacttattttacagtttacgtcctgaaattttttatttacaataaagacttttttccaaatcattaaacctgttaaattaaaatgattttgtcagccgtatggcattattgtataccactactgcctttcatttggaattcaaatggtttccaatatcccaaactttgatactctgttttctcaggaagtatttgtagataaaaattattggtcagaaaggtctgaacttttaagtttcttgtatattatccagttgttcttctaaaaggctgtatctacctgtattccaactgatggattgtaagaaaatgtaccaatgtaccatcaccaaaattgagtttatttttatctttttaaaatatttgcaaatttgacatatatgtatgtatatacacaaatatatatgtaaagtggttttcattaaattagtatgcatcctttacttacaaccaagattgaaatttttcgtatatttgctgatcattgctatttctttagagaacacatttttatatttggtctcttcctattttcctatcagtgttattcatttgttagaactctttgtatattaactacagtaaccatttgttatatgtggtaaatattacttgaagtttttagtttgccttttgattcatgaaacatttcacctaattaaaataattttattttccaattataaattcagtaagtattcatatcttcaaagaattcatataattttgagaagtataaataaaatatcaaccataatcccattatagatcttttcagtttattttctgtgaccatagagatcatgctttacatgctttgcattttgtttgtagcattaaaaagatgacatttttcaatgtcaattactatagctgtacattgtacttcataattgcacaatatgaatgtaccatggtttatttaactaatctcataaatttttgtgatttttttcccccacggaatgcttcattattgtaaataacaatagaatacgcatccttgtaacatatctttactaattatatctttactaacatgttaatgttaatttgtagatggactgttggtcagattatttatgttcatcaaatgctttttccactaattcctaaattaccctccagaaacattgtactaatttatactccctaacaaagaatgaggggaaccatttttctcgtactattgatagcattgggtattacaatctttcaataattcagcaaattacttagcagttacttttaatcctcaccaataaaaatgggagaaataatatcacattgtggttttaatttgctttctgctatactaagaatatttaatatcactttattttttgagatattttgtatttctcttgtgaattttctgttttatataattttttatgttcagaactggattaaagatgtagtatggcttaaaaacaaaaatgtttgtggtgaaactataaagcttttagaatatgatgtagggaaattttcatcagagttgggaaaagtttcttaaagaggaaaaaaaaaactagccataaataaaaagatttatagattaagctacattaaaaattaagacttcctggtggcactgtggttcatgcctgtaatcctagcactttgggaggtggagatgggaggatcacttgaggccaggagttcgagaccagcctggtcaacatagtgaaacccccatctctatttataaatttaaaaataaaattaaaatgataaaaattgagacttcatcaatagacatcataaagacagctaaaagacaaaccacagacacaatatttgcaacacgtagctgacaaaggaccagtatttaaaatatgcaaagaacctcagaaacaataagaaaaagacaacttaatagagtagacaaaaactagagtagaaacttcacaaaagaagtacaaatggccaataaagacatgaaaatatgtctagcctcattagtaaacaaaattcatattaaaactacagtgagttgcatgacatgcccatcaaactagcaaaaaatgtaaagggtaagaatgtagaacaatgagaatctcatctgctactgctgggagcaaaaatttataccatcattttgaaaataattggcattatctagtaaattgaagataaacataccctgtcatccaattattgcattcccaaatatagaccccagggagacttctgcacatgcgtaactagaggtatataagaatatttactgtggcttttttcatagtagccaaacactagaaaaaactcaagtgaccatgaaaagtagaatggataatggaatggatttcattatcaatggaattttatacagtggcatacactgtaacaaaaaaggatcaactatagcctacacatcatgaaggaatttcaaaaacataatgtttagctaaagaagtcagtcactgatacataccatataacttaaagttcaaaagcagttaaaattaagttgcgtggtttatagatgcactcacaggtggtaaaatcataagtaacaagaaaattgttaaaacaaagagcaagaaagtggttacttccaggcttgaaaggaaaggggatgtgatgagacaggcaacatgacctctggggtactggcaggcagtgttcttgacctgagtggtggttacaaggtgttcattttctatttattcattaaattatgtatgtattccctatgcattctacttaaatatatttcatttttaaaggtaaattttacaaatatttatggattgttcctttattactttttatatgtgagggaaagctccaacttgctttacctttctaagatatcccattttctctataccatttgttgactaatatatctcttgcccactggtttgtaacagtgccttaattagtttttgtgtttgaagttccagaatctcttcctggcctatgtattgtgttccgttgatggatctttccatcccatggtaccctttactattattgtcttcatttttattactattgttatgcccttttctctctccgtgcacatcttcatgtttgaactctaaaaacacaccgccaatctcatgattctacaagtcttttgtgtcctccctaaaacatgcatttctatttggctttcagattttttcacccatagaaatgtctacactaccacaactttgtttttcaaggtttcaatcactttatacagttcttggcatgcttcctgtccaaggacgcaactggtgggtgggagacttgctctcaggcagtgaaggactggcacattgtgtaataaacagaatcaaaggcagaaattagattacaagccacctgatgatgataaaatcaatcaccctcatcaaagggatttgctttgtgtgtgtttttctctttcattcttgtggatgcagacaggatattgaacagcagctgggctccttgatcttggcaacagacatcaacaggcagaatgaatttttgaccagattgaaagctcacctccacaataaagacttaagactggaggatgcacaggacaggcactttatgcttcaggtaaacgaaacaataaaagccattctttttgctgagtgaaaacactcagctgggctgggtgtggtggctcacatctgtagtcccagctacttgggaggctgaggcatggggatcacttgagtccatgagttcaaggctacagtgagctatgattgcaccactgcactccagcctgggtgacagagtgagatcctgtctctaaaaaaacacaaaacaacaacaacaaaaatccactcagggccatgatcaataattttagcacatttgagaaggagttatctccgatggtatgagttagagcagtgacctattttagtaaaggctttgaaatgcatgaaagttataagtggttcccaactaagcaaaatctgggttttaggtcaacaagttgataaagctcatttttcttgttcagtaactgatttatcacagagtaatcccgctggatgcagtaaaggtctaccgcatttggtggcttggtataaaatcagctactgcaatacccacacattttaaaagactgtttctgaaacacaaaagcatattatattaactatagtacatacaaaaattggaaaacaagtgacctccctttaccttaaacctatttaacctgctttatttccttttactacctaaacttctattttcatctgagtcttaaacatttttatctggtcttatttttaggcagcaaaaaataaaattgaactgaattgaattacattggatcaagtccattcctttctgttttactccacggcaagaagccatttgtgacatgacaaattacatcagggcagagtggatgtcacaaataaaaatgtgacctggtatccaaaccagaaccttctttcttgatcttccattttctcttgtcttccttcttttcttttggtgcaaaaaaacatagtgaatggacctagactcatctagatagatgagatggagctacacctggagattgaatggtgcagtcttttttgttccaggctttcatgctaccctttgtagctgtccaaagtgctccatctttgccaggaaataccctactcccagcagtagaactatgactccttccttatttctttccaaactaggcttctagtccctgaatgccacaaggatcaaccaggtgtctgatttgagtgactaaagccaagttgtgaatagctgaaagatttggccttgaacacttgcatttcgaaagaaagccttgctaactcaaatgcattccttaaggcagaggctggaggaggcttctctgacacttacctctacttcaacatgtactggtacccccactaaccaggaaataaatataaacaactaaatttgcaagttgatatgatccaagggtcttccagaccccaacattgctatctgttctgtgatgccaaggaattgggtcaaaccaatggacactgctggtctcttggtagcaggtggtggttaaaagagaatctgcttctctgggaattcaaggtaaccctcatagggtcatcattactgacaaaaagctggcatctcagatccagaccagtgtgaggcaagtcaagaaggccctaatttagctgtgcaaacaaagcattcctgggtttgatacgacttcattccctgactggcagtctgagcttacacatgcagacataaatgccaacacacataatttaagtgatgtatggggtttgtcagtgtggctactgtgagagtgaggtccagatgacctcacttgagcctggccagggaccatgcaacctccctgcatgcaggaggtggagctacagaaggagccaggccatggctttccttggcctgcccacccaagtctcttccagcaagctccatgtccttggactgtggctcttctctcctcactgctataaagccagcattctcaatgcaggctttgtatcatggtgaataagtgcagtttcctgaagaggcatgtcagggaggtactctgtaaatatgggcctggtactgtgagcagactgaacagcttgatagcctctttggcttggggtgcttttgcaactgaaagaacatcctctcacaatttctccccgccctgtcatttctcagatcgccttgaagtgtgctgacatttgcaatccttgtagaatctgggagatgagcaagcagtggagtgaaagggtctgtgaagaattctacaggcaaggttagtagtgatccaacagctgagatttcattgccctgtcttcttttaggcatttatcctaataaaacaggaaatggctgatctatcatgacatttgttctctcatcaactcttgttatcctaacctttctcttttactctcttggaactcatccaaccctttttcggaaaaagttaaaaataaataacattgacgtattgacttactacagaaacaggtagtaatgaggcaaaataaaaatgagcaaaagtgggacattgattataaatggctctcctctgtggatataagaatgtgtgggatagtttgattttgactttgaccttcattttaatgagctgagtgcagcctaaaggctaaatgtcatttgaggtcaatgttttccactctgacagaaggacttagactccttttgtattccttctccttgctttcttaaaaaaaaaaaaataatgaaattggacacagctgaccaaaaagtgagttcttcctttcaaatatagtttcaacagtgaggtagaaggattttgctgtgaaaagacaaatggccctgaattagggtataatttttaaaagattaacctcattcagaaataaagcaatgaattagcaagcaggatcttgatgttgggtggggtatcaacctttaaatacagccttgtttcttcaggctgggtttcaatgtgcaggatgtttgttcaggcatcaacagtgccctcatgctagtgacagaatcaggtttgagaggctgagaacaaataaagcttgaagtgtcccacataccagctctgtggggaggtcaaatagcaacagtgagccttttggagaaggcaccattgaaagatgtgtcaatgacatcgtgatggccccaaagacagaagaattgattgagctcatgtggggccagaagtctctactcactgtatctttctctcagaataaaagtgctcatgtaactcctacaattctgtatataatttcacttgaattgagtaaaagtggttagaaatcaaaatctcagctctagttgcccctaaataaaatctccaaggaaggtaagacaaaaggaaacatgatgaaattggagctagggggctttaaattagatataatcaatattttctttactgtttgatatgttgaatattgaaatagcatagtgagagaggggctaagatctctgtccttgcaaatcaaacaatgaaacagaggaaagagtctactctagcccacttggttttgactcaatcatgcccagcatgattaaagtacacaagtcagcatcgactgcagtgtaaaccttttattttctcatcttgcaccttatttggattctgagcaccttggggcaggaccatgtcacttatgtagatagtaaggcccatagtgccagtaaatcaaagttgtcaactaagtacagtaaatggtatcaaccaagaaatgtaacctataagatctcttttcttgggcctggtgcagtggctcatgcctgtaatcccagcactttgggaggcttaggcaggtggatcacctgaggtcaggaacttgaaaccagcctggccaaatggtgaaactcagtctctaatcaaaatacaaaaatcagccgggcgtggcggcacaacctgtagtcccagctactcgggaggctgaagcaaaagaattgcttgaacccaggaggcggaggttgcagtgagccaagatggtgccactacactccagcctgggcaacagagcaagactccgtctccaaaaaaaaaaaaaaaaaaacccttttctcaaaactgcttattgtcctagtaatatatgcatgcattataagatggaaaaacctagaacatttgtaacactgatctctaaaggcaggcttccatgtaccttcctctggcatgtttcctggcagaggaagaatagaaagtatatctagtcctttttatttaatagccttatggtctagtagaaattctgcttgttttaagagaagattataggctgggcatggtggctcacgcctgtaatcccaagactttgggaggccaaggcgggcggatcatgaggtcaggagatagagatcatcccggctaacacggtgaaaccccgtctctactaaaaatacaaaaaaaaattagccgggcatggtggcgggcacctgtagtcccagttacttgggaggctgaggcaggagaatggcatgaacccgggaggcagagcttgcagtgagccaaggtcacgccactgcactccagcctgggtgacagagcgagactctgtctcaaaaaaaaaaaaaaaaagaaaaagaaaaaaaaaagagtagattccctggtcatccaaactgcctgtcctccctactgaattattatttttttaattctataaggatgacttgtgtcattttgatttatctttcagtttaagatttggactcatctcagctcattccagcctgctcctggcaggcaggcttccacagactactaactgtcctggacaaagtacctttaatgtgattcatgatgttaagcaaaggaaaacccttaaaatcaaggttgaggacacagggggaaaggaaaacaagaccccatgaattagaaaaactgtttcattctcagaacagagattaggactccaaataccatatatctccctcctctccccgaaaaaaccttaaaaaattagactttgtcctcttgtaactacagattgatatcatctcaacctagtttcctagaacattttattgaacatctgcttccagccttgtctaatcctcaacaaaactgattatcctatgtgcaaagccccattggagatattatgaagaatgcaaagaactacaggtagtctatgctttgtactctcaaagtactaattagtatagtttccagaggaaagaaactatgcaaatttcccctttatattctctacattggttagcaaagtgtctgaaacataaacgtgttgaataagtgaatgaataaatgatctaattggaaaacctctaatgatagtggtcacaggagaagatccagtaccttgaaaggtagaatctgagctcagttttgagtgatgtgcattgttctatactttccaatatggtaacaagacacatgtgactggttaaatttaaattaaaagttaataaataaaaaatagagttcctcagtcttgatcatatttcaaggggctgccacagtgggcaacgtagagaacatctccatcattgcagcaaatcccattagagagcgctggtctagatagaatggaatggaaaccactgaggccgggatgcaccctgccttgtagaccagctcagtctcatagaagataagaacgagaggattgtggaggcccctgggcaccaggctacagtagagaacatgacaatgggagttatctcagaaagtgcatttagggcaatatatacagttgaagtggaagaagaattggaggaagaaaactagctaagaagcaacaactaagaataaattatcaacacaccagaccaggttaaagcagagtgaaagggggcaaaaaaagttcttctaagagggagaaacaggatgtgaaacaagatttaagaggaagaaacaagcagggacccttgcagggtccccagccaggctcagatgagatggagggtgaagggaagggagaagtcaaagacaactcctccaaagtgtcacacttgactgaaaaatcactattaacagaattacggaggtgaggagtgaaactggctgtaggagagtttgtcttaatattatatggtgttctggcctgccctcagaaggctatgatcatctggagttgaagagttagggtggccagactgccctgaaccactcaggttaagcccgaatgatttcctcacttcagccttgaggattaccaggcacaagagaccccaggaggcagactacagtcttaaaatgacagaactgcagcctctgtagggcttcagctcaatggttaagtgcagacactttgaagccaaacttcctatgctggaatccaggctccccactttactagtggtgtgacctactagcaacatactgggtcagcatttaaccctccctgtgtctcagtttcttcatctgtaaaatggggattataataaggttgttatttggattaaattaattaacatatgcctgggaggggggctcacacctgtaatcccaatgctttgggaggctgaagcaggaggattgcttgaagccaggagtttgagaccagcctaggcaacgtagagatcctatctctatttaaaaaaaaaatgaacaaaacaatattagccaagagtggtggtacatgcctgtagtcccagctactcaggaggctgaagcaggaggatcccttgagctcaagcgttcaagggtgcagtgagctatgatgacaccactgcactctagcctgggtgacagagtaagagcctgcctcttacaaaaaacaatgacaattttttattaacatatgtaaaatgcttagaacgtgcctggcacacggtagtcactatataaatgttgtgtttttatctcttctactttagcagagtagattcataactgaaccttccactcattaaccagattgttttttccaacacaaaaattactcaatttgttatgctcaggaaggactgatgaagtatttcaataaagttttgtacaatacatttctcctttgatcttctattaggttggtgcaaatgtaattgtgggttttgccacggaaagtaagggcaaaaaaaacacaattacatttgcaccagcctgatagctgaccaaggcattaaaaaaaaacattttgagctgggtgcagaggctcacacctgcaatcccaacagtttggaagatggaggcaggaggatagcttgagctcagaagattaagactagtctggacaacatagcgagacctcatctctactaaaaataaaaatttaaaaatatacattagccgggcatggtggtgcatgcctgtagtccaagctacttgggaggctaaagcagaagggttgtttgagcctaggagtttgaggctgcagtgagccaagatcatgccactgcactcaagcctgggtgacagaatgagactctgtctcaaaaagaaaaaaagaaataccattctgacctttatactttttttcaccttcagttgcattaggtaaaattctaaggaatcagaatgggagattctgattaattttgtggttacagagtgaggtgctactcagatgagatctttctagtccttctacctcatttcctacctacttactgttcctggttgtcctcaggtgaaacaagactagggtcaggcagcgtgaaagtagaggagggagaaggaaggacaaaacctgttttcttaacctgtcacttaaagccataacttttatttcatgtgaggaaatttctcatttgttttcttgtttttgtaggtcttgttcaaaagtttattctagtcccagagcacacctactagcaataagccattatgaacggtcattggcactgtggtattttaaatttttacggaaactactgaagtaaggcagagcaagtcggtgctgaagggtccctaagggataacaagtcaggaaacagtaattcccagaataacttcttccgacgaggtcattaaaattattaatactcattttataagttctagattaccaatgtgtttttttctttctttctttcttcttaggtgaacttgaacagaaatttgaactggaaatcagtcctctttgtaatcaacagaaagattccatccctagtatacaaattggtgagttgaattcagtgttaattccaaataaatacctttggcacatctcacaaaagtgacaaagaaaagatctaaacacagctttcaaaagatcagcactggaggtttaatcaacatccttttgaatggctgagtccaaattaatactttaatcatgactaatctactagctaattatctattgagaacttatgaaacctaggatcgaagctttgttataggcccttaactaacttgtattattttaatttggtagtttagaatagaatcaaaaccaaaaagagtagaagaaaagtaacaggaatcaactattcatactctctgcagggcttgaaggtgggaatcagcagaatctgcctttaggacccttccaatctgggtcgctacccctcatccctaatgctcgctcccaagaacccaatctctaggcctagagcttgtgagccatgctatcccgccgcatcctgggattcccagtttcactagtccttccttcaaaacttattttcaggttattctcctaaaaccacactctctttcaagtgtcactggtgggaaactgttgaagtatgatgccaatgcatccaaaataattattgctttatctaattaagttatgcattagaccaagaagcaaatcaaactgtggaaattttaggcactttagcggaggaaatatttttgcttcggtaagactttctatcacaccttaagacactccatcacgtccacccacctttaaagcaagtctttcttttccttgcagttcccttccattgaatccgaactcagaactttaactcttttccttataaactctgaccctgacatgtaccagttcatgttttatacctgttcctatagacttcagacagctgaacgcattcacagtgctacagacctttgcaaggctcaaagtttaatgctttgacattggtagggaagggggtatctgaaaacataagctgaaaattaagaaaaccagggtaagttagaattacataatatcactgaaggtcaaatctaatccaccgtcccacagtggagtcataaaatcatcctcaggaaataaggacaaaataaatctagctataaagatttcaatggaatatacaactattaaaataggtatgttcgattattgagcatttttttttttcaaattgtccttaatattgttatgtagttttcacaatcaaaccaattcctccaccccaaagctgggagctggggatggtggcatagaaaaaatacaacccagaaaagataatacagagttgctgggtggcttgcaagggaatatcagcaacagaaatgcagcctcagcctcctgggaggcaattctctcctatcaattgccttagccatggaggttctgcagacgtgattcaaaattagatgctaaccaaagtcctaatcctgaggctccctgtgttaagctccagctggaaagaaatttaccaggcaactgtcaatgacattttgaaccccccaaacaaaaggactcacgtggttcagcacacaacctggatttgtgagacagacctgatttcagagattctgtcctgttgttgtcatgagaacacacttattttgtcagatcatatgtcctgattttcagctcaggaaaatgtggttaccatagatacctcttttaaaaaggggctgggggttgagtgaatagggaaatcctatggatgctacaccagcacaccaataataaagagaaagggaaggtgattataaaacaatccttagtacatagatctttctctgcctttgctccacatctgccagctcgtagaggttgagggttgggaagtggggtggcagggacagatcaggctaagccagaaaaatccaaagagataaatggaacttggtggatgctacaggctctagcccccaagacaacaatttttccagtgggtcttcagtaatgcagctatttcctctgtccttattcctctctgactgaaatgttcccctgtttttcctgcctcaatccaaaatgagaattttctgagatctactctcaggcttagatctgatttttctttttaagtaatttatatctacccaagtggaactagggcttaatatctcctccccaactccacgcttccctctctctaccaaattctacattttaaaaggaagatattagccaggcggggtgactcatgcctataatcccagcactttgggaggttgaggcgggcaaatcccttgaggccaggaattcaagaccagcctggacaacaaggcaaaaccccatctccacaaaaaatacaaaaaaataaaattagctgggtgtggtggcatgtgcctgtagtcccagctactcagaaggctgaggcaggaggatcacctgagcccaaggggtcaaggctgcagtgagccatgatcatgctactgcactccagcctgggcgacagggtgagaccccatctgttaaaaaattaattaattaaaacaaaaaaaggtattaaatcaaatgaagctctaattggtgaaatctatagaaggctaaagagaaagaggttttccttcaatccttgtctactctgaggctaccattcctccctactcccccttcctccccgcaaccccccgtcaccccaccatccctccaggaggacaacagcccagcaatgtcagctcatcccttgagaaaagggaggttggcagaacacactgatggaacaggtttccaaatctgataatgtggaagccttccttaatttgaaaaactgcctcttggtgtctattcagactttaaaatcagtttcctacctagcataagaagtctttatatctgaaagtataaatacagatatagtgccagggtcacttaagaaaatgaggcttttctttttttcgagttggattttaaaatgttggatatttaacttttttatactgagataaacttgataaatattcacactttgaacttcagaatagtataattttgcaaagcgtctttttagatatctaatatctcatctctttgaaggtgaatgatattagaaattaaatatggagattgtggaggaggtaaagaaaattcaagaacagcaagcaaaacgtgaaatcctcatctgctgacaccctgtacaaccttaccaaaattccaaatacagacatcaagtcactggtttaactttccccctccagttcaggttctctactatgatctcacaatctttaaatcatatttcacataagatgagacaatgcagaaatgtacaataacagtgtgtattgctgcatccctcttccatctctatggcattctcaaaggccaagtgtctgctgtttgtccaacagaaagataatcaaacctatccttgtaattcacatgcctgtaaacatacaggattagtgttggaaatttttgttaggctgaaaaacatttgcctttctccccacagctacacatcaaggaaatacaacaaaacctaaataagtccaagtttgtgatgattccaacagttcttagactgaaagctatcttttcataataaacaagtcatgtttattatgaaaagcacattaacgcggcaaaacgcgattagaaagtaacaaatcttaaatatgtaagagaacagacatgcaaacaaagaagtctcatatcaaacaatcttatctagtcattaaagctggactttcatacaggtaaaaatctgtattgaaaatgagtgaactttaaacttagttatttaacataactgaaagcaagacagaactgtaaaatgatcatcttgaaaaagatatcccacagggtaagggtatgaattatgcagctgatctaaattcgtgaggtgtccttttctggtgtcatttgccctctccatcccttctccgcctgccttctttagctccagcatacacttttttttttttttttttttttttacttatatgtctttctccctctgcaagtaatagccagtattcactgggagtttactatgtgccaagagttttctaagcattgtacatacattaagtcatttaattgtcataacaaccctacgagtttagtattctctttagcgtctttttgcaagtgaggaaactgaggcacaaagccattcagggacaagcccaaagtgacacatcttatgctcctaggctgagggtagccaccattatcttgcttgcccttctggccccagagctggaaatttttattaggctgaaaacatttgccatttctcctcactggtacacatcaaggaaatacaataaaacctaagtaaggccgggcacagtggctcaggcccgtaatcccagcactttgggaggccgaggcgggcggatcacttgaggtcgggagttcaaggccaacctggccaacatggggaaaccccatctctactaaagatacaaaaattagccgggcgtggtgggtccccagtcatgctcgggagggagtaaggagcgggtttcaccacgctgtgatgctgagccttgacttgcctgttctaggtttcatgagctacatcgtggagccgctcttccgggaatgggcccatttcacgggtaacagcaccctgtcggagaacatgctgggccacctcgcacacaacaaggcccagtggaagagcctgttgcccaggcagcacagaagcaggggcagcagtggcagcgggcctgaccacgaccacgcaggccaagggactgagagcgaggagcaggaaggcgacagcccctaggggccggcccaacttagacgcggctctcctccggcagggcccccagagggcagaagcagcgtggaggggccctcacgcagcagcccagccactttctgagtgttgtcctggggctctttggaacgccatcttcctcccacttacctgcctcccctccttttcgcaaatgtacagaagccatttgtcacctcagcattcgctgccgaaatgagcaactccattcagtaacgtgggagctgatcccacgggcaggctctccctgctccaggagaagactaggaggaagaatgaggtgctcctgccgtgtccgccttgttccgggtcgcactggaacaggcagcaattcctaagtccggagcgtttgagcgtttgctatctgactgctgatctgcgtgacagaaacaccagcatatttgcaacgccaaggatattggtcttaagtgcaagagcacaaatgagagtgtgagagaaagtaccttctattttaataataatattattataaaaataataaatctttttaacttttatattttatgcactagacaatggatctgcaactttggactaaggtcattcaatgtacccaaacttgaacagggggttcattgttttgctattgactttattatgccactttggggcagagacttggcatcttcgcagtttaagaaaccacgtttcctatccaatccgaagggaaggtgctgtacagttcattcctttgcaccattagccaatctgtcttttatggattctgtgacatgtttatattcacccatgtacattttctgtaaataccaaacgctactgattcccatgccaaaatacatgagtattatgggattgctacctgtataaacaatggcactgtgaaaatactgttagttttaatacaagagaatgcatttgtaaatatggtatagagtttattaatatactattgtttgcagataaaggccttaactttaaacatctttcatcttctgaaagctgcccaacttaaatcctcatagatgtctttctcaactgccttcccatgttcatctgtatgttttccagctaaggtcacaaaccaaaactgaataaagtctttgaggaaacattttggaaacttcacatgcattccgcttgagaccatagtgtttaatctatggcaccaagcatcgtttcctcagattaatgagacccttcaacaagcctgaatcagtcacttttcaacacagcgatgttttaacaagccagctgctaagcttgtgtttatgtgactcttgttacagatcatggcggtgcgtcagcctcacaggagacatagcaggtctcagaaaccttctatgaccctgtcatctaaccatcagggaattccctgctcccatgccacacatttgtctattatggctatagtaccaaagtacttttggtgtttggttggtgtgcatttctttagtgtcgatagtaactggatttttctttttccttaatctcatgtgaacaactacccaactgtttagctgaagttcatattatttaagtaaagaaaatatttcagttttataacagactttaccttcctggcaggtcattgtagttaattatgtctctagcttggagtgtcaccttggaatttcgttgccattttttctcagacacctggccgtaaaatcagtttgttacagcattcttctctaggctgctaaacgctgtgcattgaaccttttctttagaagtttcagcgtaactaatgttagatgaaaattgttgatgcccctttctttttactttaaacaatgtggtagtgggagaatgactgtttctgccactatcaacctgatcctcatgctgatagaatgacagctagcacttatttcctaagtgcaactgttttagagatttttctcctaacatgcaaaggaaatactgattggcctataataagttcctatagggagactgaggcttgcagaattaaggttcaggggaaattttggaaagttggttgt

SEQ ID NO: 15892 - DNA, 18722 bp, Human
agagggaggagagagacgcagcgagccgggcggccagtgggcaggggtgcccaggctgcaggctcaggagtgcccggcggctgcactttccccaagtggacgcatgtgtggtgtctgggcgcgcccgggtgtgtctccagccctctcccgccaagtctcgccgagtgggtaatcatgtgtgtgccgaggggcggagcccccgcaagggttgtgtttttgccactgggcgtgtccatgtgtatggtttggtgtctctgggtgtgtttgtgtgggctgccttggtgtgcagtcagacatgtctgtgcgtgtctcgcttccctggggctggtgggtccagggtcccacacgacctaggacacaaggagggggagggttgtgtccgcaggttccttgcagaggggtgtgcatgaggccaagggcagtgtcatcagttcagtgcatgatgctgggaggtgatgtgcgtcaccaggtcagtgcatgcctgtgtgtctccacaggagggtttgatctgtgtcggagcgtatggtgtacagatccatgagtggctcgtgctgcgacacatggagatgtcctatgttgtgtgttgctctgagagtcaccgtgcacattccacactggcatttgctgtatctcacgtcagggtccatatccctgttgggggcctcttccttctcagcccccagcacccaccctgagtgccaaccaccccaagtgtcttgtgtttgtgtagctgtgtgttatgttgtgtcggaggatacacccccctcccccgatgctggtgttgtgtgggtggcggtagacctcagtgtcagtagtatcagtgagtggtgacatctggtgttttatgggacatgtggtcgtttgtggaaggttgggtgtgttggaaaacattgtgtctatgtgttttgcgttactgtgtgctggtgtattactccgtgtatgttgttgtgtggccacgcatgttggaatataacgtgttgggttgtgtggaggtattgtatgtcatgtttgggtgtggctcatggctcagaggtgatggtgtatgttgcgtttgtttttttgtttttgcttgttttagagataggatcttgctatgttgcccaggctggtctcaaacccctgggctccagcaatcctcccacctcaacctcccaaactgctgggattacaggcatgagccactgcacccagccgtatgttgcatttgggcactggggtctatgaaggtccaaccccatccccttcccccagggcatcatcctggatgttgtcctgtgtggccagaatataccagaatcatcttgcttcaggcatgtgcttcttgggtttctccgtgtgtcgctgtaccttgtaggtctctgcatgcatccactcagcttgtcctctgaccatacatttgaatcgcaccacacatcagagcatgctgaatcagtgcgtgttttgaatcatcactgcgagcacttgtgttcgagtcaacaggcgccacaatgtatgtgcaattctctagctctgggtgattgggggctactataggtatgtccctaaatgttgtgtgtctacacgtattgggtttcgttccaagggtgtgtagtgtttaggaaactgggactgcacagtgtttgtgtcggtgtgtggtgtgtggcatcagggcgtcactactttaatatatattgtgtgtttgtgtaacacctggtgtatgttgtgtttgtgtggccacagttgtgcatcgtcctatttgtggtgtttgggtgtggctctttgtgtcagagaaagttgtgacaactttgagtgtaatatttgtgcctgtgtgtggacggtgtttgggtggctgtgtgtgccacgggatactgcctgcttgctaagtgctggtgtgtgtcacaccatgtgtgtggtgtctgggtgtggctgtgggtttcagagcttgctgggagttgtgagtcactctgtgtaggttgtgttgtgtgccctggtgtgttagtctccgtcttgggctgtggagtgtccttcggtgtctgggtgtggtgagtagaggtgtgtgtcacaaagtacagaccattgtgtgtgacaaagcccatcgtgtgtctgtgtgtgtctttatccacgtggatggacgtctctttcttgctctgccccaagacacaccctagcccctccttattctcaaaagggggagctggggagcctccccctaccctggggcctcccctgcccctccccgccctgcctggccgtcaccactccccagagggcacagggctctgctgtgcctcagagcaaaagtcccagagccagcagagcaggctgacgacctgcaagccacagtggctgccctgtgcgtgctgcgaggtgggggaccctgggcaggaagctggctgagccccaagaccccgggggccatgggcggggatctggtgcttggcctgggggccttgagacgccgaaagcgcttgctggagcaggagaagtctctggccggctgggcactggtgctggcaggaactggcattggactcatggtgctgcatgcagagatgctgtggttcggggggtgctcggtgagtggggcatggtggctgggagctgggactcctaggtctgagggaggaggggctgggggtcaggactcttgggtctgagggagggggggctgggggtcaggactcctgggtctgagggaggaggggctgagggtcaggactcctgggtctgagggaggagggactggggacttggactcctgggtctgagggaggagggactgagggcctggactcctgggtctgagggaggaggggctgggggtcaggactcctgggtctgagggaggaggggctggggtctggactcctgggtctgagggaggaggggctgggggtcaggactcctggatctgagggaggagaggttgggggcctagactcttgggtctgagggaggaggggctttggctgggactcctgggtgctcccaggagacagttgctggggtccttctctgcaaaaggaagggaatatttgtttcagtgtttcagtctttgaagatgttgccattagacggccagaggtccaggacccctggaggccagagggtggctgatcagacactcaagccccccaagagccaataaggggagaggtagccccaggtttggtgaagggagagtggaggaaagacaaagttcttccagtaggcggcagctctttggtccttgtctaacctctaatgtttacccagtgccttagatgcaaaggacagaaaaaactgccttgggggtggggatgggaaatgggaaacaaacctctcccccgacctgcctccccacaccaaccccaacccagtctccactgttaacaagctcaatttctccccaaatctgcatgctgattagtcagggaaatagtggagaggtaggcttacagtggcctggactcctaggtaccaggagaggagggggctgggtcctggattcctgagtcttaaggagaagggggttttgattgcttttggggaagaggggctgactccgaagatgagtggtgagtagggaagaaaggggaaagtggggtcagggcaggtctcagcaggctcccgtcacattccagccctggtcaggccagtgatggggcagatcaaggacaagggttggaataagtggcttgaggggagaacagacttgctcaacaggaaaggaggggctggagacctctctggcagaagggttgtggaactgggctggtagggccagatgcggacactgatatgaagattgggtagattcctgagggtctgatgttccgacttggatctggagggggtggtgggcagctctgaagtgaccaggagccacatggagggtcaggcatgcagcttcctctggcaggcggcgggcactgagggggtggggccgccgaagtccatgccaacaggaagcatggccggggcctgcccgccgctcccacgccgaagcaccgcacccagaagccgaggtgggaacacagtgaccctggcagatgggaagagacggggtccatcctaccccacttcacccctctgctttctcacccctcatttcttccttccctccaccatggccaggccactgcctctatcagtgggaccttggggaagctgttacaaccctctgaacctcagtttccccatctgtaaattggggtgagggttaaaatacatgaccctaagggtcaccctccaccctttttattttatgtagagatgggaccttgctttgttgcctaggctggtcttgaactcctggactcaggcaatcctcctgcctcaaagtgctgggattacaggcctgagccacagctcctcagtccccttttgaggactctcttaataacatccaccgcccctcaccacctccatctcaatctaatgagctcatttctgcaaaggacccagacacctgctccccagggggaggggctggcagagaggcaggtgcaaaaccctagggagtccaagggaactggatagagatatccaaaagcaccaggtggggtggaggaggagggatggggagaggtaccgagagagacagagacacagagatacatggagagaaaaagagagatggagacaaaaatgcagaaagatagagaagtacagctaaagagaaagacaaatagggctatcaagctactgagaaatccaccagtgagagatacacacacagcgttagaaaagacaatagagggccgggcgcggtggctcacgcctgtaatcccagcactttgggaggccgaggtgggcggatcacaaggtcaggacatcgagaccatcctggctaacacggtgaaaccccatctctactaaaaacacaaaaaattagccaggcatggcggcgtgtgcctgtagtcccagctactcaggaggctgaggcaggagaatggtgtgaacccaggaggcggagcttgcaatgagccaagatcgtgccactgcactccagcctgggtgacagagcaagactccgtctcaaaaaaaaaagagacaatagaaacaaagaccctcaaaacacatagaaagacagcaacaaccatccctagagacagggaaattcagagaacagagtacaggcccaagtgcagacaggtccgggatttgggggaagaggaaatggaaaagtagagaggaccaccagagaagcaaattgcagtgtgaggagggagcttgttgtctagtggtgtgggcagttaagacagactgaagaaagaggcagggaaccagggagccatagaaggtgggggagggctggtgacaacagcactattgttctgatagggggttggggagcaggcccctggggcaggaaactggccctcttcccctgctcagaggcgggatgctggcccagccaggggagctggcagccctcttaggagaaacaggtgcaatgctttgtaaggacgcccaggtggtcccctccccctgcaaatacccgccaggcagggaccaacccctcttaggaaatccaacagtcccagtcccctctaaatccctctctccagaattctagattcctccaaggttgtgccacacaaagagaggaaaaaaaaaaaaaggaacaatttctccgtggtttctggaggccctgtgcttccggccagatctgccctgggcttagagccagaagagaggggtggcagtggggagctgcaggggggcagaaccgagggggctgtctcagagctgaggctgggtctcagggactcagccctccggatgagagcagagaagggtgtgactcagtctttgaggattgaatggtagtttctacattcttccagatctggggttggggttgattgaagttggtttctagggcaacaccaggtgggtaggaagggaaggggagggggcactctctagaggctagatgtctttttctagacaccacacacacacacacacacacacacacacacacacacacacctgaagaactatttttgatgtgaaatgggacaggaataagaaggaatgtgagtttcaaggtcccccttcatgggtatgggtcttgggagaagagctgaggaagagggtagacaccagcatctggacagggttgtcctgttggggagaaagagagcattcctggggaccagatgatggtgtttttttgtttgtttgtttgcttgcttgcttgtttcgagacggagactcgctctgttgcccaggctggagtgcagtggcgcgatctctcagctcactgcaacttccacctcctgggttcaagattctggttcctcagcctcccaagtagctgggattacacacccagctaattttttgtttttttagtagagactgggtttcaccatgttggccagggggtctcaaactcccgaccttcggtgatccacctgcctcagcctcccagagtgttgggattacaggtgtgagccaccgcactgggcccagatgatggttttgagacttctccagaaccgacacatcaagagggactgatttgcaggggaaggaggctaggaaaattgggaatcaaaaaaaaaaaatggtggttttgaaggaaaggtggagggccaggtggagggagacctgggatctcacaccgctttttccgtcccccctgacagtgggcgctctacctgttcctggttaaatgcacgatcagcatttccaccttcttactcctctgcctcatcgtggcctttcatgccaaagaggtccaggtagggcaggccccgcccctaagccttgctccctccaaccccctcagcgccctgtcagctcacactttccaccctcctcctcctcctgatctgagtaatgaagttcttctgccctaggtgctgcgtccacaccctcacctacccagatgggatgaaccatgagcagacaggcagagcctcccccaccagctccgccttcccctgtagtccccagcccccccttgcacactcacggatgctgagagtgcccttgcagccctgcttccgcccccaggcctctgtccactctgctcccaggcactcagcttcccagatctctgtgctccgacatggcatccccaatccagtcctcaagcaacctaaggtcctagggctgcccactcctttttttttttttttttttttttttttttgagacaaggtcttgctctgttgcccaggctagagtggagtggcacgatctctgctcactgcaacctccacctcctgggttcaaacaattctcatgcctcagcctcccaagtagctgtgactacaggcagatgccaccacgcccagctaatttttttgtattttagtagaaacggggtttcactatgttgtccaggctggtctccaactactgagctcaagcagtctgcccaccttgtcctcccaaagtgctaggattacgggcttgagccactgcacctggtccggtcccaggggtgcccactcctaatcaccctatctctgtgccaataacctccctcttgccccagacccaggagctctccccatccataccccaccttgggtctcacccagacacatcccatcccctattgtcccattgccccagatcctgttgctccattccctttcccctcttccccctctcctatcataactttgcatgtaaaatggggattattggccatgtgtggcaattctatgagcagtgcctggcacataagaggtgctcagtaaacagtgcacattatcatcttatcatagagtagctaagtagcctgtagcccagtgcgccattgcccatggaagggacctgggcctcagcttccacatctataaaatgggggcaataataatatcaatctcactgggttgtgggcatttactaagtcacaatatgtaaacgggatagagcagtacctggcgtatccacggtgcccagtacatgctgattttgttattgttattgttttgtttattttgagatggagtctcgctctgtcacccaggctagagtgcagtggcatgacctcagctcactgcaacctctgcctcctgggttcaagtgattctcctacctcagactccccagaagctgggactataggtgtgcgccaccatgcccggcttatttttgtatttttcagtagagatggagtttcaccatgttggccaggcttgtctcaaactcttgacctcaagtgatccacccaccgcagcctcccaaagtgctgggattacaggcgtaagccatcgcgcccggcccatggctttgttattgctgatattattattacagttattacgcgtgtcaaccgaaaggggagtaggagcgagctccaggcatgtggaatgcaagctctagggaggcaggggggtctgttgggttcactgtgtatccttagcacatagaacaatgtcaggcacacagtcggcgctcagtcagtgttcaaaggctggaagtgggctgaaactagtggggtgggtggtggggaaggaggaaaaagtggaaagatgtcttcctcaagtcctgtcccgctccctccctatccctctcccgccctgcactccctccctcctggccaggcggcacaccccacttatctcagggcgcaggcaggcgcgggccgccgcctgacctgcgcctgacctgctcctgacccctcccttcttggccccctaccggcagctgttcatgaccgacaacgggctgcgggactggcgcgtggcgctgaccgggcggcaggcggcgcagatcgtgctggagctggtggtgtgtgggctgcacccggcgcccgtgcggggcccgccgtgcgtgcaggatttaggggcgccgctgacctccccgcagccctggccgggattcctgggccaaggggaagcgctgctgtccctggccatgctgctgcgtctctacctggtgccccgcgccgtgctcctgcgcagcggcgtcctgctcaacgcttcctaccgcagcatcggcgctctcaatcaagtccgcttccgccactggttcgtggccaagctttacatgaacacgcaccctggccgcctgctgctcggcctcacgcttggcctctggctgaccaccgcctgggtgctgtccgtggccgagaggtgagggtgatggaggcataaatgcgcaggggggaaccccggacagccacggcggccgtcctgtgccgcggtgcaggttgaggccccctaggaccaagcagtggagaaagttcacactttgaccccttctcctcttgctggctgaaatttgcccacactcccatcaactggggtgagaggaaccaacagacaagcccccagccaatcctccacctgcagccttcagtctccccaaacgcacacacagaccctagaaagcccctcccttccggctgcctgacctctgcctcaggtttacaggccatctgttcggtctccgaacctatctctgggacctgcctaaagggttgcctctgccttggaggaaggagacatattttcccaattagcacggaatgcactgtaggtaggtgctttttgtgatcctaggaaggggatgatttggaactgctctggaaaataattccaagcagggaattggaactagatcctggttgccagctagatactgtgtaacccgatgccgcgcctcaatttctatccctttcagagaaaaacgaggttgggagtgatctcagccagtggtcctcaaagtgtgatttcaagaccagcagcatcacctgggaacttgcaaatgaaaactctcaggtcccttccagacctactgaatcctggagggtagggccagcaatccactttagcaagccttccaggtgattctatggcccaaccaaggttgagaacctctggtctagtgtatgtggcaaagatccttcagggcaggaggagaatgagaagatctggctttagatctctcctctctgagcctcagtttcctcatctgaaaaatgcatgtcacgttccaccatctgtagtctccctggcagttcttgttttttgatctggagtctcaattatccaggctagcgtgcagtggcacaatctctgctccctgcaacctctgcctcccggcttcaagcaattctcatgcctcagcctccctagtggctgggattacggatgtgcaccaccatgcctgactagtttttgtatttttagtagagaccacgttaccgtgttgcccaggctggttttgaactcttgatttcaagtgatcctcctgcctaagcctcccaaagtgctgggattaccatgcccgccctctgtcatgagtttaaactccttcaccttccaggatcttagttttcacaattgggaaattggtcagaatcaggattaatgaatgatccccccaccatgtttctcaattgaatgatgggagaatggggaggaagtcaaagttccacattccaaggcagaagtcctgaaactagaatgtacttcggaatgagggggtggggtttgtgaacagtacagattccatcttcgctcctagaaactccaacccggtgggtctggggtgtcaggggccctcatgaatgaagctttccctgctggtcctgcggcaaggggcctgtggacaaagttagacaaatctcaatgtttcaaccccttccatggctggacttaaatgtctcctctgtgaagtgagaggaaaggaaggccgagtcccaccaagcctttttagagtcctttttggtcctgatagggccacttctggaccacacagcatctttgtggaaattagaaaaatataccccttcctctgggtggatgtagccaccagtcagggtctgactgggttttggccccctctagactctccaccctcaaccacacgctctgaatgctacagtagcccgggtagcctagctgagaccataccggcattgggattggccagacccagtctcaaatcccagagtggcttagcaacttgcccaggtcacacagcagagaggaggccatgcaggctttccaaagctcagaacttaatggctttttgtccaggtgattcttaggactatgggtgtatactgggaggggaagggagggaaccagagggaaggggacgggagggtatagagggaaggggagtgaatatcatggaaacctctatggtggggttttagaactaacctacccttccccataggcaggctgttaatgccactgggcacctttcagacacactttggctgatccccatcacattcctgaccatcggctatggtgacgtggtgccgggcaccatgtggggcaagatcgtctgcctgtgcactggagtcatggtgagtacagctgccttggggacatgatccctatcccaaactggtcatcctctggccccaggaagccatgattaaatgggttcaacacaggctctcagggacagctcctgagaaacttgagtgtctggggcccccagagccccattctctcttcaagaacaagatactcacctgtaatcccaatattttgggaggccaaggtgggaggatcacttgagcccaagagtttgagggtacagtgagctatgatcatactgctgcactccagcctgggtggcagagtgagaccctgtctcttaaaaaataaaataaaaaatcagacctaggaatccagcccctaagtccttgctctctctagaacctagggccccagcccttatcctcctcagggacccaggctcctgacttcgcagccccattttcttccagaactgggaaatcgtctcccagcctccatcaagggtgtagagtccagttatcaagtgcatacctgtggggccaggctacctgggtccgaatcctgcggctgccacttcctggctggggagctcaggcgagccacgtgatctctcggggcctcactttcctcatctataaaatggggatgctgatgctcctcatgggcttgctgagatgattaaatgggtccaactacgtaaagtgcttccaacagtgcccagcccacaggaggtgctcagtaaacaggtctaggggtggccaggcatccagccaccccacaccagctcctgttgccctcaaggatgaggcagaggctctgtagcctgagtcagcctcttcctgaaccctgacatccacctccttccctccatagacccagtcactcaggtcctcccacccagccctggccccctctagagactagcacctaatgccttggccttcacctccctacaagatcgggttcccctcaccctcggggacctaagccaccagcacctagcccagatgtgggcctaggaaggacatattcatcccccaatccctaggtgcacaggtgaaggatgtggtgacctccactcccccagtggtgagtctttggagcaagggaagaggggcagagactcagttagggacctgcagcaccgctcaggacctcctccctcatttgacaaaaggagaaacagaaacctagagagatagggtgatgtgcacttgagctcacagcctgctcctggaagaaaggctccatggcatggttgggccataaaagcttacttttccggagcacatactctgtgccagtctctgccctacacacttgccaggggtaattcatgaaatccacctagtaaccctgtgaggccatttcacagatgagacactgaaatactgagagattaaataacttgctcagagctgggcttggaacccaggcagtcccctggagccagcgtttgtgactggaagttgttctgagtgatcaagagctgaaactatagggttggggatgcttcctaggaagattccttctaacttggggacaggtgagcagatgccacaagcagctaggaattgccaaggccttgaagggccaggagcattgggagaaggaagggaggagaatgagtgttcggaggaaggtgctcagggagggcaggcagcatggagccagggctgagttgtccaggtgggaggcatagaccttggaaggccttgggagccaggctgagacgttcaggccagtggaagcctgggagattagaggggaccaagggggttaggggaggatgagtgggaggctggagacggtccaggagagagaagacagggctggagctaggaagaagttgtgggagtgggagaaggatggtcgccctccacagtgcaatggctgaccacatgagcactgaggacccagaggcctgcccctggctcagaacccagccttcctctcactcctccaatcctatccttcattcaagaggccaccctgagggtgtgaatgctatgcatcaaatttgggctcggacgtatgcgatttatgattctagctccaccactctgagctgggaccttggctctcctctctgagcctctttgcttgtctgctaactggggatggtcgtgcctaccgtctgtggctgttgggcgggttcaaggagggagtcggtggcacagcctcatgccacggtgcctgctgtgcccacagggtgtctgctgcacagccctgctggtggccgtggtggcccggaagctggagtttaacaaggcagagaagcacgtgcacaacttcatgatggatatccagtataccaaagaggtgagatgggcatatggcacccatgggacacccctcttccaagaagcaggagtccaggcgcccctgcttcccctaggacccaagagtcccagccctagccctgccttcccagaaccgtaagggtctatctccacggacactgtgccacccacccccagatgaaggagtccgctgcccgagtgctacaagaagcctggatgttctacaaacatactcgcaggaaggagtctcatgctgcccgcaggcatcagcgcaagctgctggccgccatcaacgcgtgagggccgctttgtatgcacacgtgtccatgtgcacccatgtccaagtcacctctctgcacggctgtgtgtgtgcatgtccatgcctgtccaggtcaggacacccaggtgtggtctcactcaacatccaggtctcacctggatctgaccgtgcatgactctatgtgtctgtgctggtttgtctccgcatatctcggtgtgtctgcggacctgggtacctgggtttctactggggatgggggctcgtggggaggcagggtgcatcccctcccactctttcagctcttcgacaactttgtttctttgttttgtttcttcatgtgcctctcctcccttcattcctcccctgagctacagctacattcagggaccaggcttgtaaaactgactccccacttcttcccacaggttccgccaggtgcggctgaaacaccggaagctccgggaacaagtgaactccatggtggacatctccaaggtactaggatcccgtgggaggaggtcttgaagaagggggaggttggggccacagggagggaaatctggccctagaacagggaaccttggcaggggcctggcacacacagcctgtcagtaaaggtctgtggttgaatgaaggaaggaaggaatgaatgatgcaacacagagcttcttacattcatgaaaggcacagatcccttacaaactgaaaaaaaaaaaattgcacaaagaaccccagtgtttggtttcaaattatctttattgttaagttacttacatgtggacggatataaaattccttccaactacagctcatacaataaaaccaaagcaaatttacaaaccaagcccatagacggcaaaaccaatacaattaaaatgaacaacactgacaaggacacaggtgacattgtttccgtaaaactcaatctctgctgctcttgtggaggggtactcagggcaacagggacgtccatgcaagtttgcctggccaaggcgtgactcagctacccgcccccttcttctgctgagaccatttgatttcgccagtgcttagggacaatgatgtcacaacacccccttggcctggctcacagcatcttctgcttatctggtggcctttgctttttctcgttagcccacgacagttcaaacagtggcccctggcagcaatgccatggtaagcacggtcacagatgcaggccccaaaaccgcatggcaggtctcagtgacgaggcagtggcccagatctgcaggaattggcaggtggtaatttctgaaggttatcaagccaaaaacacagaattcaagaatttccatagaaaatccacaaaccctcagggatcaactagtgaatcctagccagagaatgcagtaaaagactatgtggatttggaagtcaggcatcatccatgctagaaatatttaatgagcacctgctatgttctaggtcttatttcaggagctgctttgggcatgtcatttaactgttccatgcctgtttcctcagctgtaagacaggaacaggattcccactccctgtggcttttgggaggattttaaaccatatagggaaacacctgggcaggtagctgggaagtggtaggtggtcaatacatggtaacagttattgtcgagggtaatcctcagaggaccataaggatgtggtcaatattggttccattgccttacgctatggagtaggtgggggtcgaccccagccccgacacctctgatcctctcctcccacccagatgcacatgatcctgtatgacctgcagcagaatctgagcagctcacaccgggccctggagaaacagattgacacgctggcggggaagctggatgccctgactgagctgcttagcactgccctggggccgaggcagcttccagaacccagccagcagtccaagtagctggtgagggggctgggacttgggcaggaaggcatcctggaggaagggttcctgtggccagcaccctatgtggctaagggggcgggggatggctgggagacaaggccgccttttctcatcagctctggcactgtctggaggaaaggactcagttcggggctggactggcagtgaaggaagatggtgtaccctctccccttcactgacccttgatggccttctccctctttgcttggtctctctctctctctctgcctgtcctgggcacattgtctggctgtccatccaatgtctctgtctaaatgccctcctgccccctggcctcggggcccggaaacacctgccccctgtctcccacttctgcccaccggtttctgtctgcacctcggtgtgtcccactctcactctccctcttcctggcctgcctctccatcagtctctctgtctctccaggacccacgaggaggaaccaggctactttccccagtactgaggtggtggacatcgtctctgccactcctgacccagccctgaacaaagcacctcaagtgcaaggaccaaagggggccctggcttggagtgggttggcttgctgatggctgctggaggggacgctggctaaagtgggtaggccttggcccacctgaggccccaggtgggaacatggtcacccccactctgcataccctcatcaaaaacactctcactatgctgctatggacgacctccagctctcagttacaagtgcaggcgactggaggcaggactcctgggtccctgggaaagagggtactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaagtgtaactcaccagcctctgctcttatctttgtaataaatgttaaagccagaagttgccatttctctctaaacatatctacactcctaactggcagaccgtccagtggaagactgttgccttgtctgaacctgtctcagaggccttctcctgtaagtgccctcccaactctgtaggctgggcagtcctcagcaacagtcccctgcccagatctgaggcaaagagcaacagctttgaactcagacagatcagggtccaaatcctggttctaccatccactggtggtgtgatcttgggtaagtggcttcacctctgaacagtttacctcacctgtgaaatgggactgcctccccatggaactgctgtgaagattaaaacatggagtagcccagaggcatttagtaggaaccaaatatgtgagagagaatcttttttttttttttttgagatggagtcttgctctgtcacccaggctggagtacagtggcgcgatttcggctcactgcaacctccgcctccagagttcaagcgattctcctgccttagtccccaagtagctgggattacaggcacctgccaccacgcctggctaatttttgtatttttagtagagatggggtttcactatgttgcagatgctggtcttgaactcctgggctcaagcaatctgcccgcctcagcctcccaaagtgctgggattacaagcgtgagccactgtccctggccaagaatcatttttattattgtttttgattttcacacacaatgcgtggctgccctttttctgattttttgttgcttttctccctctattcatgccttaccagaatctagatgacaactcactcatcaagagactaacagaggccccaaacctccccaaaccacccacatacccgtttcacatccgctcaagagaggatgtgaaagggaagggggcaaaggaggggggctggcacttccagaggccctactgtgtgcccagctctgtttataagtcaccataaccactctcctgaccctcgttaccccactgcacagatgtagaaaccgaggtttcaagaggagccaggcctcccctcaggcccccagccggaagctaggaatccgggctggagagcccagattcacacccatcccgccccactgcaaggtgagtcagaggcagagtggccttgggccacaaaccgaggactgacttcccgccgcaacttcattccagcttgagaggctgattcattcttgcttccctcctcttgaggggaagatcaggctgcgagtcatccttttctgttgagctatctttggatttcccttaaagtccacagccagcctcgccccttcatccctgagagctaaattggagcctccgccacccactgccacgaactgcccttcctctggaggccagcccacctggggagtaaaggcggggactcaagaaaggaactggatgagacctccagatattgctgacacccttcccctgcaagaagctctcctggcagtgttgccaaagcccctgccaaactcattcttctgggacctctctttccttgcctccactcccttttagctggcaaacactccttcctacgcctcctgtaggcctcggctaatatgtcccctcctccaggaggccctgtctgatactcctatagcctcataaacctatccctatcacgataataatattgggtctggccaggcatggtggctcacgcctgtaattccagcactttgggaggccgaggcaggcagatcacctgaggccaggagttcgagaccagcctggccaaaatggtgaaaccctgtctatactgaaaatacaaaaattagccaggcgtggtggtgtgtgcctgtaatcccagctactcgggagtctgaggcaggagatcacttgaacccaggaggcggagtttgccgtgagccgagatcgtgccactgcactccagcctgggtgacagagcaagactccatctcaaacaacaacaacaacgacaacgacaacaaattagccaggtgtgggggcacacacctgtggtcccagct

SEQ ID NO: 15893 - DNA, 26841 bp, Human
cctgtaatcccaatatttgggaggctgaggtgggaggatagcttgagcccaagagtttgagaccagtctgggcaatgtggcaaaactccgtctctacaaagattacaaaatttagcagggcatggcagtgcatgcctgtagtcccagccactcaggaggctgaagtgggaggttcatttgagcttcagaggtgaaggctgcagtaagccttgtgatcacgccactgcacttcagcactggagacataatgagacccagcctcaaaacaaacaaacaaataaataaaaccacaacataccacaacacatctaccagaatgactaaaaaatagtgacaatgccaaatggtagtcaggatgtggagaaactgggattacaggggtgagccactgcgcccagccggaaatgcccaaaagttatcctgtatggtgtaaaaggggagtaaccctcagttctgagggaaatccctgcccctttcctagggatacagaaaactcatgaataatccatcctttgtttagcatacagtcaagaagtaactataagtatacttgactgagtatacttatagtatgggctcgctgctctgtctatggagtagtcattcttttattcctttaattctctaataaacttgattttagtcggaggtggtggctcatgcctgtaatcccaccactttgggaggccaaggcaggcagattgctggaattcaggaattcgagaccagcctggccaccatggaaaaaccctatctctacaaaaaatacaaaaattagctgggcttggtggctcacacctgtggttccagctactaggaaggctgaggtgggaagtcacttgaacccgggaggcagagtgcaccacggcactccagcctaggtgacagagcaagactctaaaaaaagaaaatccaaaaacccttactttcagttaaaaaattttgttttcaattcatctactgactccctggtatctacaacttaactagtctagtgaacttggggaagttactcctttttttttttttaagacagaatcttgctctattgcccaggctggagtgcagtggcacgatcctgactcactgcaacctccacctcttgggttcaagcgattctactgcttcagtctcccgagtagctggaattataggcacatgccaccacacccggctaatctttatatttttagtagagttggggtttcaccattttggccagggtggtctcagactcctggtctcaagtgatccgcccaccttggcctctcaaagtgctgggattacaggcgtcagccactgctcctggcctctagttacttcttaaactctctgaaccttgttttttttaaatcctctaaataaggataacagttcataattcctaacttttgttatgaaaattaaaggagttaatatatattatgtggagaaatgtaaattctagttcaaaaaatagaagaaataatgtaaatactgatttatttatctggtgagaaatgcaaggacatttttgtttggtggtgggtattaaaaggctaaggtatttatattccactggatacatttggaagaatgattaacagtgttatttcaaaatttcaacattgagaacacactaggacttacatctttttcaactcatcatgatgaaaaattttgtcagcgaaatgtgttaggattgttttataaaaatctttcacgtcgatgagcaaatatcttagaagactactgctgaggagaaatgttatttatccagagagttgccttaattaggagaccctacatagcgcccagtagaaatgtaataaaggcatttcacttattcccttcctcagccctgccgtgaacaaaattgaatgaaatcaaccacgctccgagttctcgcctagacgcagcctgtagtagccaggtttcaccactaggtggcacacgccaaaggctccggcgggggcgagccgcccgagcacgcctctcggtggccccgtggtatctctcggcttccgttgagcaccaagcaagatggcagcttccgagacggttaggctacggcttcaatttgattacccgccgccagctaccccgcactgtacggccttctggcttctggtcgacttgaacagatgccgagtcgtcacagatctcattagtctcatccgccagcgcttcggcttcagttctggggccttcctaggcctctacctggagggggggctcttgccccccgccgagagcgcgcgccttgtgagagacaacgactgcctcaggtgcgcggcgcagggagcgggacggccgggtgggcggcgggcgggggacgcgcctgcgcacgcccgggcctgaagccgctagacctggtagtggaggggatgggggatggggaaggggacgagggttggaggggggtggggctgtaaaaatgcacgttcgcgaaccccggagatcctgattggtgtagtcaactttggggctcaggaatctgcattttattattattttttattattatttttttttttttgagacggagtcctgctttgtcacccaggctggagtacagtggcgcgatctcggttcactgcaacctccacctcccgggttcaagcaattttcctgcctcagcctcccgagtagctgggactacaggcgtccgccaccacgcccggctaatttttgtatttttagtagagatggggtttcaccatattggtcaaggtggtctcgaactcctgacctcagttgatccgcttgcatcggcctctcaaagtgctgggattgcaggcgtgcaccaccgcatcctgcccctattatttttatttttgagactgagtctcattctgtcacccaggctggagtgcagtggcgcgatctcagctcactgcagcctccacctcccgggttcaatcgatcctcccacctcagcctcccgagtagctgggcttacaggcgggcgccaccatgcccggctaattttttgtttgtttgtttgtatttttagtagagacggggtttcaccgtgttggccaggctggtcttgaactcctgacgttaagtgatcctcccggcttcccaaagtgctgggattacaggcgtgagcctccgcgcctggctggaatctgcagtgtaacgagcatccttcccgggatgcttctgatgacaggagaatcaaacttggaaaatccctgatgcctaagggcagggccaggctttctttcagccttgatttagcacatccgcgcttagctaggcactgtgcgactctgttgcgtgcccatggtgcagatgtgccggagacccggccttacccatggcggccttcagggtcaggtgcaggaagctgacaaaggggaatcgttgtgttttcttcataacctgctgttgtccagccttagttctcatgtgcccagtgtcccctgagacttctggtggcgtatcattttgtgtctcacccagacattttgggattctctcaaataagtgtcttgagtccttttgggctgtaaattgggaaacacaaaataatcttaaatatgcttttggaagttaaaaaaatgataatgagatgagtatccaggagcaattgtagtgtgaattgctgaaatgtggttgagttgccacagtaagatgatggtatctgatcattccagtttggattcatatcttggactgatttattcagacttttttttttcttttttaaataaagagactgggtttcccatgcccaggctggagtgcagtggtacgatcatagcttgctgtaaccttgacttcctgggcacaggcaatcctcccacctcagcctcccgagtagttgggacttcaggccaggcaaccacgcctggctaatttttgtatttgttgtagagacagggtttcgccatgttgcccaggctggtctcgaatccctgggctcaagctgtcctctcacctcagccccccaaagcactgggattacaggcgtaagccactgtgccagccttccttcccccaccccctttaagcttcagctacagtgaattaattccagagttgtgaaccaggctattttctcttgctgccctttgtcgttgaatattccttaccctcaagcatgtcagattccgtaagatttcttcagaacatcagggaatttaatttggaacagtaactgcatctttaaatcaggatattatgatttattgaataatgttcaactgtttcaaatgacaatttgaaataatccaaatttcaaagagttttttttccccctttttattgactgtgaaataggtctctattctctctgcaattcaaggattatttaaatgttacaattctaaggattgtgtcccatcctattaagtttactttctgaactgtctcttgcctaatgagttaataacttgtgctaactataattatactttaatgaatcatgtgggcattacattcttcataatgaagttaacaatgacaaaaacaaaccatgaaaactgttataagtaataattacaacacgatgacaggcaaatctttcctaaatgcttcaaatgcacagctgcatgtggcaaaaaatacctctctagtggcttcagtggcaaatgggcagaccgtagaaaaagatgaatctggaaagttcgtctttgtttttgttgttttatgtccacaatcattgtttttccctggcaaattcacttttcttcagagctacggaagaacacatagtctctattctcaaagtacccaatattgttggactgggacccaaataatgagtctcatgcttttgtatattaccttctgtgatacagacaattagactgaatagttagaccaagttatatggtaagtgcagaagctggttgagaaaagggagatcagcatggaacaaaatggttagggaattgagcagtaccttgaagaatgggtgggaaatgttggatgatcaaagcacagttatagagacaaaagctggctggacttggtaaaaagatgagtctgaccagccaaagcattctgttgggatcattggcagtactgagaaggctaatgaggaaaagtggaactaggttgtgggaatcctgagaaacagcctttgaggctttggatgcaccacacacttgtgttccactgctgtttcctcatagcccattctcttaagccccaggaatctggcttcatctgcccccaggtttctgacagcgagttcctaaaggtggtctctaactgtcctgggaggaggaggaggtgcttctattggcttggagccccctgtgttagtttgctggggctgctataacaaaataccacagactgtatggcttaaaaaatggaaatttatttcttactcttctggagactacaagtccaagatcagggtgttggcagatttggtttttttattttattttaattaattaattaatttatttatttttcttgagacagagtctcactctgttgcccaggctggagtgcagtggcacgatcttggctcactgcaacatctgcctcccaggttcaagcgattctcctgcctcagcctcccgagtagctaggattacaggcacccgccaccatgccaggctaatttttttgtatttttagtagagatggggtttcaccatgttggccaggctggtctcgaacttgtgacctcaagtgatttgccctcctcagcttcccaaagtgctgggattacaggagtgagcaactgtgtctggcggtttttaattttttttaattaatttttaaattttttttaatcgtgcagccctcagaattacagtagattcagagagactcccttattttttgagacagggtctcactccattgcccaggctggagtgcagtggcgcaaccttggcttatacagcctcgaactcctgagctcaagggctcctcctgcctcagccttttgagtagctgggactacaggtgcagttttttatttttagtagagaggtctcactaagttgcccaggctggtctcaaactcctgggctcaagtagtcctcccgccttggcctcccaaagtgttgggactacaagcctgagccactgcccccggcctgagaaactcccttttgaagaatcaattctgtaaggaaacagtgcattctgtcttccctgacccttttaactctggcaattaatacttgatgaaggctgggcgccatgtctcatgcctataatccagcactttgggaggctgaggcaggcagattgcctgagctcaggagttcgagaccagcctcgacaacatggtgaaaccccatgtctacagaaaaatacaacaaaattagctgggcatggtggcacatgcctgtagtcccagctgcttgaggggctgaggtgggaggatcatttaagcctgggaagtaaaggcttcggtgagttgagatggtgccactgcgctgcagcctgggcgacagagtgagaccctacctcaaaaaacaaacaaacaaacgaacaaaaaaacacattgattaaatgttagagatgggccaggcatgttggcttatgcctgtgataccaacactttgggaggccgaggtgggaggatcacttgagtccaggagtttgtgagcagcctgggcaacacagggagacccttattctaccaaaaaaaccccaaaaaacaaacaaaaaaaattagctaggctcagtgatggatgcctgtagtcccagctagttgggaggcttaggtgagaggatcacttgagcctcagaagttgaggctgcagtgagccatgatcgtgtcactccactccagactgggcagcagagcaagaccgcatctcaaacaaaacaaaatattagagacgagttctcatttcatattgctgtagttagtggctccttggatagtccaagataaaaagtttcctactacttttatcatatactttttcccacacctcactctccagaagtatccttggttaagtttggggtatggggtatatcttagagccagatttctatacatgtgcaaccatatgtacttatacttttaaactacaaatatcataacatactgttctgcaccttgcttttttacctatcatgggctatctcagtatataaagtgtgtgatgtatgtcattcttttctgtttgctacatagtgctttagtgaatattcttgtattttttttgtacttggaaaattattcagttggatttattcttagaagaaatactcattggtctaagagaaggtacatataaaaattgataagtactgtcaaattagcttccagaaaagttgtacagacttgtacaacttttaaaaattcaccaacttacccatgataggactaacaacattcattgtactaataaaaattagagctaacatttggatatcacttgttctgagtcaggcatgctctctctgcataataagtcactgagtactgtaattattgtcattatccccatttttatagatgagaaaggctgaggtaatgattttaaaaaaaattacagtggcagaaatagcatttgaacccaggcattcacgttggccttggcaggcaatgggtagggagcatcaggttggacagatgggcatgtcagtgtttctgcataacagaatcctagacagtaaattgtagattttaagggtggacttagattttgataataccactcagtttgccttgcaaagagttagaatgaaaagtggggatagctgggcatggtggctcacgcctgtaatgctaacacttttgggaggccgaggcgggcgaatcagctgaggtcagttcgagaccagcctgaccaacgtggcaaaaccccatctctactaaaaatacaaaaagttagccaggcgtggtggcaggcacctggaatcccagctacttgggaggctgaggcaggagaatcgcttgaacccaaggggaggaggttgcagagagcccagatcatgccactgcagtccagcctgggcgacagagcaaaattccatctcgaaaaaagaaaagtggggatctgttttttggaatcaactctttcgtcactagtgacctaggtaattcacttctacttgtgaaaggacaaatgcatgcacttttgtttgtaaaaggatagctctattctttgtctgtgatccaggtaaagaaatagagaatattgccagggaaggtgcacctgacaggaatggtaactaagcagacccaggagaaccatttctttttctctggatggtattttgcctctcaatcttaatattttctttttttttttcttcccagatgagggctcactgtgttgcccaggctagttttgaactcctgggttcaagtgatcttccctctgcctcctgagtagctgggattacaggcatgtgccaccacaccagtttataatcttaatattttaaaaactgaaattattctcttggggaacagtaggtagtggggctgcaggaatcacaggtcataccttcaagccaaatagctgtagatgcatggtctttttttttttattttttggagacagagtctctatctgtcgccaggctggagtgcggtggcgtgatcttggcttactgcaccctctgcctcctgggttcaagcgattcttctgcctcagcttcccgagtagctgggactacaggcgcatgccaccatgcccagctaatttttgtatttttagtagagactgggtttcaccatgttggccaggctggtctcgatctcttgaccttgtgatctgcccacctcagcctcccaaagtgctgagattattacaggcatgagccaccgcgcccggccaatgcatggtcttaagaatggatgagacgatgctaagagctgttttggaaggcgtgagggtgttgccagcttccaggaaaggaaggggttctcatcaactggatgttacatgtgctgttttccagggccttaataaaccacagtgactgaacagagacttgcaaccattttcaacatttgacagaaagtttggtcctatttggtcatctcagaattgaagcttggatcattgctacaagtgaaaacaaattgatcagaaatgtcaagaaaaaaatctgatattgtagcgcttccatggtagttcttagattcacaggatgccaaactggcttttgccagattaagaattatttccttgctattagatgccaagctgggaacagaggggaatgtgtttttataatttaaaatccctggtcactcagcattttatttgtctctttctcctactcctgatatcagtaactcttattttatcttgatttgtttgtctgtatagttagttttctgacaaataattgaggatttttttcaactaccgcattgaggtaaatccacaggattactatgccttaaaaaatttaaagaatgcttgtcacatatgctcctatcattcaccagttgttctttattttcaaatatgattgtctacatctttccctggccactgaaaaaacttgatgaaatatatagctgaatgtaaatgccttgtaagtataatgtgtgttttcagcagtggcgcaattacagctcactgcagcctggacctcctgggctctagtgatcctcctacctcaggtagctgggccacaggcatgcaccaaccatacttacctaatgtttgtatttttttttttttttttttttgagacggagtcttgctctgttgcccaggctggagtacagtggtgtgacctcggctcactgcaagctccacctcccaggttcacgccattctcctgcctcagcctcccgagtagctgggactacaggcgcccgccaccacgcctggctaattttttgtatttttagtagagacggggtttcactgtgttagccaggatggtcttgatctcctgaccttgtgatccgcccaccttgacctcccaaagtgctgggattacaggcgtgagccaccgtgcccagcctgatgtttgtattttgtagagacagggtctccctatgttgcccaggctggtcttaaactcctgggctcaagccaccctaccaccttagcctcccagagttttgggattataggcatgagccactgtgcctggccaacaggcatttttgagtactcacaatttgcttaacattgaggacagtctcaagacttccatcatcatcagactgcacatactaggattagctgttgcctgttgatggaggaacaaaattgctttcctatagtgaaattttggatgaagtagggttattcagagaaacataaccagtaagacacacacacacacacacacacacaaatactcactcacagacatgggatttattgtaaggaattggctcataggattgtggagattgagaagtcctaagttcacttagtaagctatagaccaaggagagccaatggtatatttctagttcaagttcgagtttgaaggcaggagaagaccgatgtcccagcttgaagagtcaggcagagaaatgaattctcccttactcagtctttttgttctattcaggccttcagtgggttggatgaggcccacccacattggaaacggcaatgtactttactcagtctagcaatttaaatgttaatctcatccagaaacaaccttgcacatactcccagcataattttttttccactgaggcaatatatttgtaaatacgtattacatcgttataaaaagaatcccaggatttttcttcctatgtgttttcgtcttgcttcttcgtggtctatgatgccagccgaggttgtcagtacagtgaaaccaaactggtgggatgggagcaggttattctgccatttttctagatctttgagttgcacgtcaaatctgaggctgattattccatacttgtttagcctgcctgtgaggttcacaacagttttcccagctctatgatcatcagtggtttcagatttgccagtgtaaccatgcttcatcattatagttagaaactggacgatggggctgggtgcgatggctcatgcctgtaatctcagcactttgagaggccaaggtaggcagatcacttgagcacttgaggccaggagttcaagatcagcctggccaacatggcaaaaccccatctctactaaaaatacaaaaattagcgaggcatagtggcaggcgcctgtaattccagctatttgggaggctgaggcacgagaatctcttgaacctgggagggagaggttgtagtgaactgagaaatgcaccagtgcactttggcctgggtgacggagttgggactccgtctcaaaaaaaaaaaaagaaaagaaaaataaaaataaaaaaaagaaaacggacagttactttggagctcggcctaataagaacctggcatttaccttgcttttcagctttgttgatgctcttgagagcatcagccaagacattcatgtgcaccactgtggtggtatggaaagagccagcgtaattttaaccagatatctggacgtccaatagcccggacaaattgatacataaaattaagcttcacagagtgttgtggaattgtacagatggctgtcactaccctagagaacataaattgtttagtattcacctaaattaaaacaggagtaaaatcttattaaagaaagaagcccacattctgaaacaaaatggataatcagcattatcaccttttagggtaggtgacatgcatattgtagaaagattgtgagtttgaagttagacaaactgaagtttgaattgcgtttctgctacttatcagctctagatttggggcaagtaacttgtctgagctgtaattttgcgatctgtaaaattaaaaatacctactttgtgttggtgtttagattagagaaaaacgtattaaaaatgtttaggatgcagtagctattcaataaataaaactagccatttgaaagttgactgtgagtaatgctacataggccattttgccagaaagagtcttttgtctttaagtgatgtgacattttttcattgactgatggtagttacattttgtagagtcatctcagtatataactatgtcctggagatgtgtttataaattgctcactctagctttctctcttgttcttttgacagagttaaattagaagagagaggagttgctgagaattctgtagtcatcagtaatggtgacattaatttatctcttagaaaagcaaagaagcgggcatttcagttagaggagggtgaagaaactgaaccagattgcaaatattcaaagaagcattggaagagtcgagagaacaataacaataatgagaaggtcttggatctggaaccaaaagctgtcacagatcagactgtcagcaaaaaaaacaagagaaaaaataaagcaacctgtggcacagtgggtgatgataacgaagaggccaaaagaaaatcaccaaagaaaaaggagaaatgtgaatataaaaaaaaggctaagaatcccaagtctccgaaagtacaggcagtgaaagactgggccaatcagagatgtagttctccaaaaggttctgctagaaacagccttgttaaagccaaaaggaaaggtagtgtaagcgtttgctcaaaagagagtcccagttcctcctcggagtctgagtcttgtgatgaatctatcagtgatggtcccagcaaagtcactttggaggccagaaattcctcagagaaattaccaactgagttatcaaaggaagaaccctctaccaaaaatacaactgcagacaaactggctataaaacttggctttagccttacccccagcaagggcaagacctctggaacaacatcttccagttcagactctagtgcagagtcagacgaccaatgcttgatgtcatcgagcaccccggagtgtgctgcgggtttcttaaagacagtaggcctttttgcaggaagaggtcgtccaggcccagggctgtcatcacagactgcaggtgctgctggatggaggcgttctggctcaaatggtggtggacaggctcctggtgcttctcccagtgtgtctctccctgctagtttaggaagaggatggggtagagaagagaaccttttttcttggaagggagctaagggacggggcatgcgggggagaggtcgaggacgagggcatcctgtttcctgtgttgtaaatagaagcactgacaaccagaggcaacagcaattaaatgacgtggtaaaaaattcatctactattatccaggtaagtattattttttgtaagttatctcctccctttccccttagaatgtgtgtggagttcatgtcatggattcacattttctcaccagtgatgatgtcacatgactaacactgtttttcagaatccagtagagacacccaagaaggactatagtctgttaccactgttagcagctgcccctcaagttggagaaaagattgcatttaaggtatatttcaaaagaacagtcacagcaaaaaaggttcattccccttccaaataaacttacttagaaaatcaggttaaatgtgtttgtaaaagcccttcccactggaaccccagtgttgttacgggttcccggtagggctcccagactggtcggggtggacacgccaacatggcatgatggaggagctgtgggaatgggagaggataagagggcttatgtatttgtgggttttttcttcttttttagcttttggagctaacatccagttactctcctgatgtctctgactacaaggtaaggatgtttatttaaaagtaagttgtcagtgtattattaaaactaaagtcatatttaatactacttgtatggataatacagatttgtttttttactaaataaaaatgccagaaagtagaaaatgaaaacattaatcgaaatgtcaactctttaatagtatcactgggaagtctccctgtgttatttgccttatacttgggaagaatagagtaggagaatgatgagcttaatttttacttttttaaaaaaaatatattaattttttgtttttaaatagcgacaggatcttgctatgttgcccaggttggtctcaaactccttggctcaagcaatccccccatcttggcttcccaaagtgttgggattacaggtgtgagccactatgcccagccagtttaatttttttagttacttttttctaattagtttagaccaacttatttgggtattcattccttcatgattctaaactttgaaagaaaataataaatagttctcagcaagaagatttgattattttcatcatgggaatctattttacatatttgtgaattacttctggttgttatgatctagtatgatttcttctgcattatcaggtaaccacaggtaattcataaatattatccgtggaatttacttacttaatatctgtatgagtctttatattggcatgtgaggtttttcatagttcagtaaaagcttgactcagtcagagggatcacagaattacatgtttctttttcacccaccaacattttgttgaaaatcttgttaaagtgcattctttcttttttttgatgtactatatggaatgtaagaccattttttaaggtaataattggtagtgttaatatagtaacatagataaaatacaagggaatttgatttaatctggattgatgccttggaagacttaaaatctttatagaaacctttcctcaaggctgggcttggtggctcccacctgtaatcccagcactttgggaggccaaggtgggtggatcacgagatcaggagattgagaccatcctggctaacacagtgaaaccccgtctctagtaaaaatacaaaaaaaaaaattagcggggcatggtggcgggtgcctgtagtcccagctactcaggaggctgaggcaggagaatggcgtgaacccgggaggcagagcttgcagttagctgagatcacaccactgcactccagcctgggtaacagagcgagactccatctcaaaaaaaaaaaaaaaaaaaatctttcctcaaaagcaggctggaagaatcagttaatgaagggatctggtgggttagttctaggtcgttggtgttttgttttttatcttcttaggcacttactatctcctatggatgaggtgatcatgtaatttatcacctgaatcaggatacttgtgagtcaaagggatgctattaatagttatgctggaaagatgtacagacctgtcttgaacaaaccagggtgttttgtcaccctaccatagaaaacatttaattgtgtgatatatgaggaaatggaaatgaatattgtattgatacatcccacaacctctataaattgtaattctagatgatactgatttttaaaaattgcttattaatggccaggcacagtggctcatgcctgtaatcccagcactttgggaggccaaggtaggtgaatcacttgaggtcaggagttcgagaccagcctggccaacatggcaaaaccccatctctactaaaaatataaaaatgagcctggcatggtggcgtgcacctgtagccccagctactcaggagactgaggcacaagaatcacttgaacgcagtaggtgggggttgcagtgagctgagatcatgccactgcactccagcctgggtgacaaaacgagactcttaaaaaaaattgcatattaaattggtattagttgtcatagttattaatgttggaaggtgttttgcctactttagttggcaaaattttttgaagatttttgaaattgctttcaaaaacattttaagaatgaaaattggtcctacttttttgctttgacctcaaacgcagttatccagcttgatcatctgctttattcattaaccttgtctccaaaaattaaattggttcaattctgtactaaaaaatgtagtctcccaagcccctgattccctgttgagtctggttttaaaaaaaactgttgactgtgctcagaaattccaggtagaggcaggaggaactggttgcttggcctctcagtatatacccccggaggctaccatgtgtctccccatcgcccacgtgcatgggcagtgcatcctcttgatgcattagaaaatcagctcccacagctggagacctgggagaaggagaattgggatcttaacagtgataaagtgccttctggtttctcctggggggttgtgatcactgttttagaagggttctaaaagcatcaggaaccgaggctgcaccattaggatatatctagtctctcctgatgaatgctgtgatggtcagtgctcacttgaatatatcagcctggtgtgatttttttctccttttcccttattcagtcacttttggttccctggtgtaatctttactttcatcgagttatttaagatagtgtctgccatttatgatttaaatgttttattttgcctctaaagatatttctgtatattcacataaagtgtttatcagtccacctgtttttattttctctatatgtggatttatttctaaatttttcaactgagataaaattcacataacataaaattcaacattttaaccattttaaagtctacaattcagtggtttttagtatattcacagtgttttacatgttgattttgacttggacttttatttttgaaaggaaggaagaatattaagccacaatccagagacccagcaagtagatatagaaattctttcatccttacctggtgagtcttttagaaaataatttgaaaatgtaggctctatctacagtggtttataaatagcttttatacacaggagatgttctcttccttggcctccatataactggcgctccccacttctttcagcacactttagccctgggggctcataagagatgttggatatattccaaagctgttgggctagttcttattactgtaattatataatttcataaaagattatatgaactgatgaaaatcgattataaaaagaattattcctaggaagcctaagttgaatgctgactcaggaaatgctatgaaattatggatgagtgggtcagctataaaagattgggaggaattttgtaaaaactgaggaagattctgcacttagattgccttgcaaatttttgcaatcttgccttatttaagaaaaacccaggctgggcacggtggctcacacctgtaatccctgcactttgggaggccaaggttggtggatcacttgaggtcaggagtttgagaccatcctggccaacatggtgaaaccctgtctctactaaaaatacaaaaattagccgggcgtcatggcacacgcctgtaatcccacctactggaaaggttgaggcaggagaatcgcttgaacccgggaggtggaggttgcagtgagccgagatagtgcaactgccttccagactgagtgacagagcaagacttagtctcaaaaaatattttaaaaacccccaaactgtaaattgtggaaattgcagacaatacaatggtatggtttattaaaaaaagagctctattcagtgaactcataagacctactcagctctatttcaaaagattgtcaaatgaatatacttttgtatattaagtcaaaacaaaatgtctgaagtgtgtgtatacatacactttcacatatcattttaaatggttgctggatttatctctgatgaaccccacctggtactggaactgaatgcgtggaataagagggcttttataatatgtagcttaacttggggtgtactgtaggggtccctggccagagggcaggggagattccttttcctttagaagatcctaaagcaattaattgttttccttttttttttgacagagtctcactctatcgcccaggctggagtgtggtggcacaatcttggctcactgcagcctccgcctcccaggttcaagtgattctcatgcctcagcttgcagagtagttgggactacaggcacacaccaccatgtccagctaatttttgtatttttagtagagatggattttgacatgttggccaggttggtcttgaattcttggcctcaagcaatccacctgccttggcctcccaaagtgctgagactacaggtgtgagccactgtgcccagcctgttttctgtttgtttgtttgtttgtttgtttgtttatttttgagacggagtgttgctgtcgcccaggctggagtgcagtggcgctatcttggctcactgcaagctctgcctcccaggttcgcaccatcctcctgcctcagcctcccgagtagctggaactacaggcgctggccgccatgcccggctaattttttgtatttttagtagagacggggttttaccatgttagccaggatggtctcgatctcctgacctcgtgatccacccaccttggcctcccaaagtgttgaggttacaggcatgaaccaccgcacctggccttctgtttatttttagataagggattgaataaaagattcagctaacagaaatcagtcgaaagagtttttgaacaaagttcgtttatgatattaagtaaatgtttatatataacttacactgggttcctacctttcttttttttttgagatggagtctcactctgttgtccaggctggagtgcagtgggcgatctcggctcagtgcaagctccgcctcccgggttcacgccattctcctgcctcagcctcccgagcagctgggactacaggcacccgccaccacacctggctaattttttgtatttttagtagagatggggtttcactgtgttagccaggacggtctcgatctcctgacctcgtgatcctcccacctcagcctcccaaagtgctgggattacaggcatgagccaccgtgcctggccaggtttccaacctttcttctgatgagatttcatttatagaaatcccctttcttaggaacggtggacagaaaagtttgtccactgtcaaattctgtgcatacagcctgatcagtgcttgtcaggtgattaatagtgatgacatccacttagaacttttcttctttagggcatcaagaaatggcttcgggggcgaaggtgggaggatcacttgagcccaggagttcaagaccagcctgggcagcatagtgagactctgtcgtaaaaaaaaaaaacaaaacatagctgagtgtggtggtacatgcttgtagtcctcgctacttgagaggctgaggtgggaggatcacttgagcccaggaggtcgaggctgcagtgagtcatgattgcgtcactgcactccaggctgagtgagcaagaccctgtctcaaaagcaaaaaagaaagaaagaaatggatttatctgttctctaatagcaatgtcacttgtccttgatgtggtggttctgatatacatatatttcagttaccctggtttagttaagtaatactagtcccccagcaacattgcatatgttaactgtaagtgcatgaagtactgctagctctttagtccacatatcactatataacataaataacagatacgcgtcatgatccattaccagtcaagtcagtactttcagagtccgtcagtgactggtcactgtgcatctgttattcagttcacatacagagcagagcatgcagttgtggtgcctccttgtctctcacttataaacctgcatgacattttacaacacgtataatcgaagtagggaattggcccacaaagataaaggcacagcaaagaaacaaaagtggtaatgctgaaagtgccatccaaactgagtttaaggagagtctgtagaagaaatagctcactgtaggaatgttgacactgccagtgaggtgaacttattgacataaatgaggaaagtggttgtggcaaaaaggatgaaaatgtccccaaagtgacaccagcaaaaacaaagattttacaaagtaaaaaacaaattctttgagctatttcacgacattagaagttcaaaggataaaatgtagaaagcagtttcaaacttagaaaagagtataacagttgcacaaagcatagagaagatgcttgctctgtattgtaagttacagggcaagaacacaagcactgttcaaactccccctgataagtttcttacaaagaaataaaacgtgtagaaggaaagagaaaaagaaagttagttcttagtgttcctaatgtaattacagtgtactcataagtacaatatatttattttactattttttaatttccctatgtagtaaaggtttttaatgttttggcaaaattttttaaaactcgtaagacgataataatttttcctattgattattaagattgttttgcgtggtttcagcttgcacagtcatttttccaatcccattttaccatagaaagcaaggactgaggccgggtgtggtggctcacgcctgtaatcccagcgctttgggaggccgaggcgggcagatcacttgaggccagaagtttgagaccaacctggccaacatggtgaaaccctgtctcaactaaaaatacaaaaattagctgggcatagtggtgcatgcctgtaatcccagctactcaggaggctgaggcacaagaatcacttgaacccaggaggtagaggttgtagtgagtcgagattgcgccactacactacagcctgggcgataaagcaggactctgtcttaaaaaaaaaagggggactgcctgtgttaccaagtagtaggaagcatatgtgatttctaaggacagagcagcatttcatattaccttcccttgttgaaacacataaattaattaattttggggattatcttgtggtgccatattcaattctggtagtactaatgacagttcatcaagcttatgaaggaaagattttctctgataaatggctgagaagtccccctggtccagagtttttctcaggatcccccagtattgagcaccctgtgctttcctgtacatacccagccttcacattaattgacagtttgtttgtggttgttttcttaatgatataaattccccatagaggaacatttttaactattgaaaaatgacttactctctttcctccctatcttcttgtttcagccttgagagaacctgggaaatttgatttagtttatcacaatgaaaatggagccgaggtagtggagtacgctgtgacacaggagagcaaggtaggtgtgcttctcttcttgcgttgcttggccattcgttctctcttgaccaattacctgtggtttggaaggtgacattgcactacaggccctggggggaatctgaccttcttatggtgtggcaataccagtgccaaatcagggcgccatcttggccctcatagagcctatgtgacaagatgcacaaataacaaacttttctttaagagtgtacagttgtttaaaattatagctatataaggattccagtaggaaagggtagcatatttagaaactttattggcatacacgttcagagaagtgcatataactacatggcttgaacaactttcacatgaacatacccatgtaaccagacccagatcaggaaatagaacataacacccactcccagaagcctctattatgtccccttgctgtcaccactatcccccaagtgttaccacagttccaacttttgtttttttgagagagtctcactgtgttgcccaggctgaaatgcagtggcatgatcttggctcactgcaacctccacctctcaggttcgagcgattctcatgcctcagcctctggagtagctagaattacaggcgcttgccacctcacccagctaatttttatatttttggtagagacggggttttaccatgttggccaggctggtcttgaactgctgacctcaagtgatctgcccacttaggcctcccaaagtgttggattacaggccaccgtgcctgggtgagccaccatgcctggcccgagagttccaacttataatagcacaacagtttgaagagtgacataaaatgatgatctcatcctctgactttctttaaatccttaaattgccattttgggaagtatatggtttataccttttttttttttttttttttttgagacagagtctagctctgtcacccaggctggagtgcagtggcgtgatctccgctcactgcaagctccgcctcccgggttcacaccattctcttgcctcagcctcccgagtagctgggattacaggcgcctgccaccacgcctggctaattttttgtatttttttaactagagacagggtttccccgcgttggccacgatggtctcaatctcctgacctcgtgatctgcacgcctcggcctcccaaagtgctaggattacacgtgtgagccaccgcgcccggccgatttatacctttttaagcagccagacctaccagagttgctggcagtggctagctcattaggttatggtggcattaaatggaagttagatttaagaaaatgctctcttttaaggtgtttatacttgaaatgttatagatattattctgtaagtttcaatattgcaaacatattttttctgaagtgtgaacttgtagaaaccctagccagactgtgttttaccttgtctttaaggtagatgacacttttagggatttattccagaaacacatttttagtgtttgtggtaggatcagcagatttggcctggtctcctgtatttctttatttgcaatagttttttttggttgaaattggaaaccgcattggaaaattaaaccttggaggcttttctctctatgccctaaacagagacttgaagtagaatagaaagcctgtaattaggctgggcaccgtggctcatgcctgtaatcacagcactttgggaggctgaggcgggccgatcccttgagtccaggagttcaagaccagcctgggcaacatggcgagaccccgtctctacaaaaaaatacaaaaattaaccgggagtggtgacacatgcctgtagtcccagccacctttgggggtggtgggggcgaggcaggaggatcgcttgagcccaggaggtggaaggtgcagtgagtcctgaatgccactgcattccagcctggactatagacgtgataccctatctcaaaaacaaaaagcctgtaattaccttttttgacactagatggccctcattattcattcataggaccaagccttagagtttttctcttggtgggctgtgaaatagttcctgtttttaggtagtgtaggataagaactacagagcggcgcaaaagggcatcagcagcctaatgatacccatctggaccatgtctagttgccagaaggtctccaggccacctgtccacagggcaaatcaaatgcaggggttgggggagctactccctcccgcaacccctgcatctcctgctcttaatcaaagaaagatgaaatatgtttaatgtaaaatttagcttcattctaagtaaatgagttatttatttatttatttatttattttcccagcacagagtttcactctgtcacccaggctggagtgcagtggcgcgatctccgctcactgcaacctccacctactgggttcaagcgattctcctgactcagccttccgagtagctgggactacaggcatgcgtcaccatgcccggctaatttttgtatttttgcagagacacaggttggccaggctggtcttgaactcctgactttagatgatccgactgccttggcctcccagagtgctaggattataggcgtgagctaccatgcctggcctctttttttttgttttgttttttaattaaaaaaaataatagagatggggtctcactaggtttcccaggctgatcttgaactcctgggctcaagcatttctccccctcggccttccaaattgctgggattacaggtgtgagccacagcgcctggcctaaagagttactatactgcaattgaactcagtttattggaacccaaattattcccgttcttcaatcattctacacagacggaaaatttacgtggctgaattaaccggtatgacctcaaaatgaagtgcctaaactgggtattttgtctttttcctcagatcactgtattttggaaagagttgattgacccaagactgattattgaatctccaagtaacacatcaagtacagaacctgcctgagtatgacctctccaccttatagtttatgaatgtcttgtttgtgaaagtgactataacccaaacttttttttttttttaaagaggatttggaagttgtatggatttttttgttatcttcactttactgcataggaaacaatctacctcatcatttaaaatgacatgggtgtcggttttgtagatctttggtttttttgtcaggtttaatttcagttaacaaaatgtaaaacatgacattccctgcagatattgttgtataccagtatggtttcttctctttctttaaatgtttttggccatcaagtagcagtcgtcagtaggagtttataataccaagaatgtgctgcgtatcttgtctcaataagttttaagtaacatttaaaaatattaaagcatgttatttgacctaattttttagcatttgagttgttccattaaatggagcatcttgtaaatttcaagtattttatacttgcaattgttaagagttaacaggtagttggatttgtcgcagacaatgagttaaggaatcctttcacgtttttcccaactttaaaattaaggattctcaggtccctgtgtagagcagtgaaaataagatgtgcgtatgtgtgtgtatgcctggagaattggtgtttcacttcagtgagaggattggctgtgagcttcagaccaggaaatgtgtcatcttgccaggcacctggctgagtgtgctggagtgaggatcttgaacagaaacttccttttctgttattattcactacgaagctaaaatggccaaatatataccgtgaaaattggtttcatttaacaaaagatcagatccctccttcagctgtacacatttttaaataaaatcatattgaactaaacatctctaccgagttatcatgttgagtattgcaaattattgtcttattttacaataacgtgagagattacaattttctgtaataagaaggtttgctttgactgatgagtctgatgttgcaaagtttggttcagtggagttcatctgatctgggagccactgtgccagtggagatgctggccagttttactttgcatgacatgaatgtgtttcaaaatgtgcatttattgatttgtaatgagaagtattactcccgaaaggatgagagtaatgtgaacggtgggatcttggcactggggttctgtgtagcacagttgccttccagggtttggaaaacaaattaagataactagtgaacattgaccaaaggaaaattttgacctcagggtgtgtttttctcagattattatcagtttatgagtcactcctttcctctgttgtgtttgtcagactatgaatagagtccccaagaaggattatgaagtcaatttagggggaccatgaccagcattttgaaaaataaaatacaatagaatagaaaaacaaaaagtgcattacatccagcgatgcttttctttttttgagaccaagtctcactctttcgcccaggctggagtgcagtggcatgatctctctcggctcactgcaacctctgcctcccaggttcaagtgattctcctgcctcagcctccccagtagcggggattgcaggcgcccgccaccacgccccggctaatttttgtatttttagtagagacggggtttcaccatgttggcctggctgatctcaaactcctgacctcgggtgatccacccgccttggcctctcaaagtgctgggattacaggcatgagccaccacgcccagccactatttttccgttgtcttgaagtgcttaagttctccaactccaaccatatcactgatacagttggtctcttctttgctgtcctcctgttgggcactgcggtggtaacttaattacctgctaactttcctttttagctacttccaagtctggatttgttgggtcattcactttctgctccctcaactgttccgaagggatgacatcacaaaaactctttttcacaggcaaaagaactagcccactcaacacgtggataccatttggttctaattttccacttctttatacttaacagcagctgttgcaaactttttccttaagtcttcttcccccaatgtcagcttgacaaccttttgcagttcacaaaccaagacaggcaggaacatgtacctctcctttgtgcccttcgcttcattgtaatgaatgcactgatgtgtttttctccccacttgactgttcacagctcttgcttgcaagacctgctatgtcagtgtaggtctaatcaggagggagaaaccacatagtgatccaaacaggaagagtttaatataaagaattcctgattctcactgggatcggagtgatgaggaactggctagtaagaagtaaagagaactcaaaatacaggaatagcagatacaagaaccagctactacccgggggctgagatatacacccaaggaagagcccccagactctgccctcaggctgtgagcagactcctttgggaaggcatggctctacctcactgaaggacatgaggagtcaccacgatactgcaccagcagaacttgctggaaacctgtcatcttctaaatcttgacacatttaattaagcgatattttaaaattgcatttgttaatattgccaaatatgtgatcttatcaggaaagtcttaagtattgggaagttgtcagctcacgatggcagatacaagttttccaaaattctaatttttgcttgaaagctcagtttttcattggcaacaaatactgtttgttcttgaattaagtggctcactttattgtcaagaaaatgtgggccgggcacagtggctcacgcctgtaattccagcactttggaagaccagcctggccaacatggcaaaaccacatctctactaaaaa

SEQ ID NO: 15894 - DNA, 26760 bp, Human
atggaatttgataaagtatggccctcctattcatcctcattggtctaacaagcccttctaaaccaaccagcctggaaagtgaattccacattctggcatgaatcactaggccacctcacccatgataaataggtcagaggggatttcacagtgtttcctggaaactgctccactcctccctttggaggcagcattttatggtaggaaactcctggctttggaaagcagatgggctgtgtgccaatgtccattcttagacacactatttagtttctctaagcctcagttttctcatctgtaatttttttttttttttggtgaaatgagattctatgcatagctttcatttcctatcccctcattcttctgtcttcctcctctctgtgcaaacaagatgtgggacaggcccatggtggctcatgcctgtaattttggcactttgagaggctgaggtgggagggttgcttgaggtcagaagttcaaaatgagcccaggcaacgtacagagaccttgtctctacaaaacaatgttttcaaaaattagctgggtgtggtggcacgtgcttgtattcccagctacttgggaggagtgccgcaccctagacaacagagcaaaaccttgtcaagaaaaagaaagaaagaaaaaaaaagaaaagagaagagaaaagaaaagaaagaaagggaatacataaaaggtaaatggtaaaaggttttaggggaaaaggagtctgcagaacaagaattagggggaccaggagtgagtgacaatggggaggtcagcgatcctgagctacagtcccagtcctgctttgcataaattgagactctcattcctaaaatggactggcagtcttgcaggggtttataaggattataagagataaccatgtgacttatctagcacacaaaaggtacccccccataaatagtagctattacaaggtaatctaagacatttaccttttcctcattttgctactcactctgtccccaaagcaaactccaactaactccttccaaaacaccatccttctctttgccaccatcccccctcttttgaacacttctactctcctgtccacccatatgtcctgcagtcaagccagaggagggaaaacagagcaaaagaaaatattaaaggaagtaagtttaaatcaataactttgagaaaaatatttaagttccaatattgtgtgtgtgagtgtgcgcgcgcgcgacagagagaaagagagcgagcgagcgagggagagagacagagagagaaggagagagaaagcctttgttaaactgggtaactccaaatcccaggaaagtagaaatgggaatttttataaaagcatgatacatcagtagaatggaaagaaatcaccaggtttaaatttgagtgtgtgactacggcctccagtcttccgggattgtatgtccgcatgtccgagtccgggaagaggaaagaggaaggattaaaaaaaagaaaaaagaagaagaaaaaaagcactgtggtttaacagttcctttttatttttttaaaggttggcccacaatataaccagcgctgctagcggggacggtggggacacctctggtctcagatgagtgctgggaaggaggggacttgctccgagcgcaagtttgtgcggaagcgcggctggacctgggctctgaatccgggggtccggggttctgcacccaggcgtcagcttcctcatccgcagagtggcccccagaagcctccgggtggtcgcgaggatgctctaaatcccgggggctaaggccgagcccggcgtcccgcgcccagcccgcgggagctcttggggatcggagcgcggccgaccttcgccagctcatgggcgactgggactgcggtgcccgcaggctcccgggagtacctcgcgaggcccgcccagtcctcgccgcccgcccccccgcaccccacgtgacttcctgacggcttcagggactgctcctctcgagctaggtttcgtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggtagggaacggcctgctgggtgcagagggcagcctggcctgatgggtggtgcagaggggccaccgggggcctctctgccacactctggacgccctggggagatgggcctgaattcgaggccggggcatctccaatgtcagagtagaaaggggatgggagattatatagtcccttcccatcatccatgaagacaggttaggttgcttgccataatcctgtcattgtctgatggtgtttatttttatttttttgagacagggtctcgtccctctcacccaagctggagtgcagtggcggaatcacagctcactgcagcctcgacttcccgggcttaagggatcctcctacctcagcctcaagagtagctgggaccacagcctcccaagtagctgggaccacaggctcgctaattttttgtagagatgaggtttcgccatgttgcccaggctggtctcgaattcctgagctcaagcgatctgcccacctcgacctcctaaagtgctaggaggtctttaaaggcgtgcaccactgcgccccaccatctgatggtgtttagtagagggttttgaatgtcaactatgaacgttggaggttacctctgttccctcacgaagtcctggtggcacccaggaggtggatatgatttagtttcattttactgttgaggatactgaggtccagagaaatgaacttagcctgacctaatgcagtaaatagccacgcaggcattgtgacccgggttggttcgatttcatagtttgcatttcttcccatggaccagcctcgtatccaggtccgtagagtccggagcaccaaacagtccaggaagcttgaggtcatgtaagcaaaagcctttggtgggccggagagttcctgtgatcaggaagggttgttattagaggcctaagagggagggtgggcagcgtcccagtaatcactggatcagagccacagggagagccaacactcttgcaccatagtgtcctccgtcctggccgtgtgactttgagcatggggtttggcccctggacctgggtcctcaccagtatagtgaggctgtgggactaggtggattcctaagggcctttcaggtctgcaatgtttttaggtggtttggggatcataccttccccttgtggcctcaaagcagaggctgaaatcaaaccaccttttgttacatcagcctaagatccaaagcatggcctgatttcatttcattctcacagcaccttcagggagaacaagacccgtcttcgtgttgtcagaggagacagtagcctgagcaaggtcagagttgggggtctgcatccagctttgtgtagcatataaacttggctttttttttcttttcttttagagacagggtcttgctatgttgcctaggatgttcttgaacttccggcctcaagggatcctcccatctcagcctcctgagtagctgggactacaggtgtgccaccgtgcctggctctaaacttggcttttttttttcttcttttagagacaggatcttactctgtcacccaggctggagtacagtggggtgatcatagctcactgtaatctcaaactcctgggctcaggtgatccacttgcctcagcctcctgagtaggtagtactacaaatgtgagccaccacacctggctaagttttaaaaaattcttttgtaaagatgggatctcactatgttgctcaggctggtcttgaactcctggcctcaatccttctcccatcttagcctcctgagtagctggaactacaggtgtgctaccacggggcctggctataaaatcagaattttttttttttttttgagttggagtcttgttctgtcgccaggctggagtgcagtggtgcggtctcggctcactgcaacctccacctcccgagttcaagcgattctcctgcctcaacctcccgagcagctgggactacaggcctgcgccaccatgcccagctaatttttgtatttttagtagagactgagtttcaccatgttggccaggctggtctcgaattcctgcccttgtgatccacccgcctcggcctcccaaagtgctgggattacaagcgtgagccaccacgcccggcccatatatatatattttttaatcttttcttttagagacaggttttcactcagtcacccaggctggactacagtagcatgatcatagctcactataaccttaaaccctggactcaggtgatcctcctgcctcagcctcctgagtagctaggactacaagcacgcaccaccacacccagctaatattttaaaacattttttgtagagacgggatctcactatgttgtccaggctggtcttgaactcccaacctcaagggatcctcccacttcagcctcctgaagtgctgggattacaggcgtgagccaggagcctggcctaaactctgctgtttaatcctaacaacaggccttcctctgccaacacctacccccctgtcctgacttgctgagtcctataacaggtctgctttttgagccctgctactgctgctcatcactgttggcagagccagtctcagctgggcaatgcccttagcctcaggggctgggttgccttggccactggtgggggcggacttgagactctggtgcctcccatgtggaagacccaagtctctagtctgtgaagggatcctcaggatttcaaaaagtcctttgcctttgattaggggattattgctgctaccaaagtttttgggtcactttcctttggtctggagtcgtgtgggcaccattcatgatgagggtactgccgcatgtgtttgattaatggtgtatcaaatctttcaaaatatagggctcagggtgtagtgctatgagcagctcttgaaagtgaagcagttggcagccttggggtgttctgaggtctcttcttgctctgaggccagcaaggccggatgtatgtaggcctggtctttggcccacaccttatcttggccactgttagaggccaggtcgaagggcagtgtcacagaggtcaagtttgaaacatcatgagcagcttgggcttttcggattgagttagtgtggccttggtccctgcctccaacccctacatgtgactgtcactgggttgttcaaatctagattcaagatcaggttccgcccagaatatcttgggtggagttgaagagtctgggaagtggaagagagagccagagtatgttgagcctgctagttacgggaaggaaattttttttttctagaaatctccagcatgctcagtttgggcatgtgtctatgattttaatatcgggatcttagctgtgccagttactagtagtgtagctggggcaagtcacttaattgttctgtgcctcagtgtccttgtctgtaaaggctgggtaattcctacctcatagtgttgttcttagctttaagtaagttaatacaggtaaagcactagaacagtgcctggcatacagtaagtgcataataaatactggctgctgctgttatggtggtggtgattttccttcccatttctgtgcagtattcatctgagcagggaggtaggagactcagatattgattatgaaaattaattgaaatcagatgaggatattagcttccttcatatacagtttgcctttgtttctggaggtggctaggactgagcagatttgcacctgggcttcagcccctgtgagctacttcatcttttttttttttttttttgagacagggtctcactttgtcacccaggctggagtgcagtgatgccatctcagctcactgcaggctcaacctcctggattcaagcgatcctcctgcctcagccccctaagtagctgggactacaggtgtgcaccaccacacctggctaatttttgtatttttagtagagacagggttttgccatgttgcccaagctggtctcgaactcctgagcgcaaatgatccacctgcctgggcctcctaaagtgctaggattacaggcatgagccactgcgcctggctggctgattcatcttattcccagcccttggtggtcccagtctgcagtgagccttggactctgatttctgtctccctgccctgtgaggctgacaaaggctcccagccttgttctgggattggcagatgcctctggagagaacatcctagatatcaggcttatctctctgggcccccttcccccttctcctggaccttgacttcttaatcctctgcttgattggctctccagcatcttttagcagatctccccgctgccccattatttggactgctttcctggctgtttgcagtgggaggattggtctgagtggccccacctgccattaccgaagcagctgtcccagctcgttctgttcctgtgtgagcttggccacctttctgtcctccttgcttgagtttcattggctgtaaaatgggtaattagagaaaaactcataataatataagctggcatttagtatgtttttcctaagatccaggcattgggctgagtacttacattgtttcaattaatcctcccaatagccctgtgagctggggacagttgtatctattttgtgtccaagaaaactgaggtgaaggacacagttgcacagctgggagttgggactggaaccctggtctgtactgtcctctgaaaaggatgaagggaagtagtaagtattagaatgcttcaaaaagctccaagcaggcaagactcgggtgacaggacttggggtggcaagacttgggtggagtggaagaggaaggaatctatcctgtgggatagttccagggatggcttctggtggggctgggctgaagaggtgcattctcaacctcatttgttttccctgcaggccaccctgaggcacaaactaactgtcatgtacagtcagatcaacggggcgtcgagagcactggatgatgtgagaaacaggcagcaggatgtgcgggtgagtggcagggctctccaaggccagccctgccctgtggcttcgctcagcttccacgcgggatgggcgtggctctgaccatgacaaggctggtgttgggtgcactcacagtgtcaggatgaaacatcaaccttgcaaagcatgcagacagctgtgtgtctgagagagatcctttgcaaacccaaaccaaaaattacctataagcccaactgtgggggaaatcattataaattaggattaaaaagtagtaattcagaaaaatggttatgatataaagtgggagaaaaagaggaagcaaaagtatatagctcatagggttgcatctatttacaaaaaggaagtatattagtttcatagggctactgtgacaaattgccagaaacttggtggcttacaacaacagaaatgtattctggcagagttctggaggccagaagtccaaaatcaagatgttggcgtggccacactcccgaagtctctaggggagaacccttctttgcttcttacagtttctggtggctcaggcattccttggcttttgactgcatcactctgatctctgcctctgtcttcacatacctgtctcttcttcccttagtgtcttccatctccaataagaacccttgtcattggatttagggagcacctaggtaatctatgatgatcgaatctcaagatctttaattgcatctgcaaagacctctttcctaagtaagattacagtcacaggttctggtatatggacatgtcttttgggggcccagcattcaacccattacagagagcatggaaagaaactgaaagggaatattatagaaggatcatagtggaagtgttggagtggtaaattaggaatggttttgttccccctgtttttcagattttcgatacgtttaagttgcttttaaatggaaagatcagatttttaccctttttcagagctgcagcaccagttttattgcagcagttatggtttcattagatgagatctaggttagaataccagctctgtcacatactagtttatgttgctttggtcatgttgacagatctttgaaccttcgtttcccaatttgcacaatggaatcacaagttctttctgaagatgactgtgagacaaatgaaagaatgcacgtgaaagtacctgtatttgttagagggcaggctatactgctgtaacaaagatacaccagaattcagaggcttaaatatgattgaagtttattttaccaactgacagtccaaacccacacatgagtaacccagactaagggttcatgtgatcattcagggattaagggttctcccttcttattaccctactattccacaaggtattgtcccagcctctttggttgaagctgggttaccattacatctttgttctagcctgtgacaaagggacaaaaaggaggtggaggacaacaagcaattttcctttacacaagtgacacagtgttgcacatatcactcctgggcatgggtcactggaaggagttttgtcacatcgcctagtctagctgcaggggaggctgggaaatgtagtctgagtagccacacgcccagatgaaactccagggatgttctcttaccaaaaggaaaaaagggaaaatgaacactgggggacacttgtagtcacattagaagttgcacagtgaaagattggcaaagaaggctgggcgcaatggctcacgcctgtaatcccagcactttgggaggccgagacgcatggatcacctgaggtcagcagttcaagaccagcctggccaacatggcgaaaccccatctctactaaaaatacaaaaaattagccgggcgtagtggtgcatgcctatagttccagctactcaggaggctgaggtaggataattacttgaacccgggaggcagaggttgcagtgagccgaggtcatgtcattgcacttcagcctgggtgacaagagtgaaacttcatctcaaaaaaaaaaaaatattggcgaagaaatacttgaattcctcttttccagtctactgtccttcttgtgtgtttttctctttgttatgtttgattctgagctattgtcttagtctgttttctgctgctataacggaataccacagactgggtatttgcaaagaagagaagtttatttggctcaaaggttctggagcctgagaggtccaagagcatgcttccagcatctggtgaggatcatccatagcggaaggatggaaggcaggagagcgggacaggaagaaggaggtcaaacccctgtgataagaatatgaatccattcatgagggcagagccctcgtgatctaatcacctcagtggcaattaaatctcagcatgagctttggaggagacattcaaaccatagcagctattgaggctacccaagatgtgaaacaaaattgcagctactaaagcagtgctgtccagcagaaatacagtaggagtgcagatgtcattttaagttaatttgaatagtacatgagatttattgtattttatttatctatcttttttaggacaggtctcactctatcacccaggctggagtgcagtggaacaatcatagctcactgcagctttgaactcctgggctcaagtaatcttcctgactgagcctactccccttcaccacccccactctccaggaatacagtccatctaatttttttatttttatttttgtagagaaacagtctgtctatgttgcccaggctggtcttgaactcctggcctcaagcgatcctcctgcctcggtctcccaaggtgctgggattatgagcatgaatcactgcacttgactgagattaattttaatattatagtttatttaatttggtatatcttaaatattattctttcaacatatcatcaatttaaaagttttaagatattttacattcctttttttggtgtgaaacccttgaaagccagtatgtattttacactcatggcaagtctcagtttggactaaccacatttcaagtgctcagtagccacatgtagcaagtggctatgttattggaaagtacaatcctagagcatgatattctctagaaattttccagagctgcatcctgactttttgttttgttttattttattttatttttttgagatagcgtctcgctgtgtctcccaggctggagtgcagtggcacgatctcggctcactgtaacctctgcctcctgggttcaagcgattctcctccctcagcctcctgagtagctgggactacaggtgcgcgctgccacaaccagctaatttttgtatttttagtagagatggggtttcaccatgttggccagaatggtcttgatctcttgctgacttttatttttaaaaattgcccatgaaccacctttagcttaagaaataaaatatcatcgatgcagcccctcccatctgtttctcccttattctatccctcttcctctcttccagaagtaaccactctcctgaatttatttattcattcccatgcgtttctttgtgcatatagccattctgtttgtttctaagctttattgaaagagcatcatatggtggatcttcttctgcaagttgtttttctctcatggagatttatccaggcatagctccagtttattaattttcataactgtttaatattccatcctatgaatagctcccagtctttgcttcaagtcttcttctgatggatgttcaggttgattccaggtttttgctacttcagacaatgctgcctgtgaacattcttatgcatgtctcaggggcaggtggctgcaattttttgtagcacatattcctaggactggagttgccgagtcatagcctatgagcacctccaaatttattagatattgccaagttgctccccacagtggtttgttctcccacaaagtacaggtaagagttcctggaactccacatctcacccatgcttggggctgcagccttagcacttttgcccctttgacgggcatcctcttaccttggccctctcagatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggaggtaggtcgccacaaggcattgttgaatgttttttttttttttttgcctgatgtcatgctgttgatgatagggccctcaaggagcgggagactggaagaggtcactggaagcatccctgagacacacgctgtattagttttctgagctgggcaacaacttaccacaaatgtaggggcttcaaaaaacacatatttattctctcagagtttctctggctcaggaatctggacatggctttatgggtggcctgcatagggtctcaccaggctacagtctgcgagggatggccaggctgtttcctttggagctcagggttgtcttccaggctcatgtggttgttggcagaatttagttccttatggttgtaggactgaggccccccgcaatttcctgctggctgtctctcagattgatagctgacttcttcaaggccagcatgagaatttctcctctagaaagatgcaatccctcttttaaggtcttttacctgattaagtcaggcccaccccagataattgccctttgatgaactcaaaatcaattgatttgagatgctaattacaccagcaatattccaccccctttgccacatgacataacctaatcacaggagtgatatcctatttcattcaccgtcctgccgatactgaaggggagggcatactatagggtatgtacatcagtcggggtcgggggcttgagggccatcttagaacgttgcctgccactcacactccacctcttcctcccatccttcctccagcagctcctggaagtgtgtgttagtagtcccttttgcattgctataaaggagtacctaagactgagttatttatttattttatgtatttattttgagatggagtttcactcttgttgctcaggctggagtgtagtggtgtgatcttgctcactgaaacctctgcccccaggctcaagtgatcctcctgcctcagcctcctgagtagctgggattacaggcgcacgccaccatgcccagctaattttgtatttttagtagagacgagatttcaccatgttggccaggctggtctcgaactcctgacctcaggtgatccacccacctcggcctcccaaagtgctgagattacaggtgtgagccactgcgcccaaccagactgagtaatttataaagaaaagaggtttatttggctcacagttctacaggttgtacaagcatggcaccagcatctgtttggcttttagttaggcctttggtgaggaaggaagcttttactcatggcagaaggtgaagctgggagcaggcatgtcacagggttagagagggaacaagagacagaggaggaagtgccagcctccgttaaacaaccagtttgtgcaagaactcacctgttaccatggggagggcaccaagcggtgcatggggaatccacccccacgacacgaacacctcccaccctgccccacctccaacactgggaatcacattccaacatgagatttggaggggacaaacatccagactgtatcaaagtatctgtctaaagcatgggccccctgctgtttctggcctcatgtcccttaacatggcctgcagggtcctaggtgactgggccccgcctgtgccagcagtctcatctcatatcatccatccctggctcatgccctatgcactcactgttccccagacacagtgggtgtgggtgggatgccatgctgggcattcttgcctagtgagtcgtatccttccagggccttggatcccattgccatgccgtatcggtgttcccaagcatgccacactgtttctacagtaacattgggtgatgttgtttcagatgtgcattttttcatggctgttttgactgtaagcccatctcttattacccccattcatcctcctgccaatctgaccagcacatagcagagtgcttggcatatagtggtgtgccccattgattgagtgacctgcagctatacctgaaagacccagattccttgttcagatcagggggtggggagacagtgcaggagtgaatgggaaccttgtctctgtgcactgaggcctgatgcgtgcctagtctggatggcgttaagtttcatcccaagtgttcattcctgtctgttggagcagctgccccgagctctcgaaggatctgagtgcacatctaggcttcttgatactgtacaaccctatttttctcaaagtttgggacttccaggaagaccctcccttcccataagatattccctggctgcaatccacatcccttgagatgtccctgtctgttaccagaatgtgtgattagagctgttcccctaggattggggtggtcctgagtttcctgtgcttttccacctttagctggaaaagtggaaagaacattgtcctgggggatcggaagatctcagtcccagctgtgtctgtgcccctagctggtggagttcctgccatgtctagacctcagtttccccatctgtaagatgagtgacctctggggtcccttccagctccagattactgtgtcttcaagtgtcatttaaactcctggtgacctctggcctgtaatttgagaaggccaattggacttagcactcttgggcataggggagagcctcctggggttggtgaggactgagcccaggtccccgtttcaccagagctgcctgcactaaccccctggcatgttccagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagctcacccccagttcaggtgaccttagcagccccctatgctgccccctgtggaaccctgcaacccgatgggtcccctaaatgttttgggatgggagattggggcgtgatcccgagcactggggcctgagtttcagggctcctgaaacatccgccctctgtctggaggctggtggggagtctgcttcatcctgacattttaggatctttcctaaagcatttttggggacttgatgttaatgcttggactttctggacagataggctcttttggcctgtgatcttgaggccaacttggatgggttttgaataagctagggcttgttattgtgtttggtgggggaatggcccgtttgggggagaaatctagaattcctctttgacacccccttttcatcaccccatatccaatccattgccaaatttcacttctttcaatctcctgactcagtctgctgatcctagcactgcttgcctgttctccattgccatcacctgtcgccccatgactgtagcagcttcctaaaccctctgcatctgccgctgcagccagagagggattttcatgatgcagagctcatgtcctgggacctattctgctttgccctctcactaggcttcctattactccctgatgcagaccaaacccttgaccctggtctagatgccaggtcaagccctgttggtctctctccagccccaaggcgccccccactctcctctggtgcatctctctgcattcagttcctcaaatatgcaaaacttcctgctacagggcctttgtgtttgctcttccccactctccagaaggcttgaactccaccgtcttcactaattaactcctctcacccttcaaagatcagcaaaacattacatttatagccagcctcccctgccactgctcccactcctcagactgggcccagggtccttgtcatcctcttgggactcttgcatgggtagtatcgcattcttccttgggatccccgtatatctccctcattaggttgtgatctctatgaggtcaggggctgcggcttatttatttatttattcaggatcttgctctgtcgcccaggccggaatgcaatggcgtgattatagttcactgtaacctcaaactcctgggattaagtgatccctctgcctcagcctcccgactagctaggactatagatacacaccatcatgcccggctaattaaaaaaaaatttttttttttttgagacggagtctcgctctgtcacccaggctggagtgcaatggcccaatctctgctcactgcaacctctgccacccaggttcaagcatttctcctgcctcagcctcctgagtagctgggattacaggcatgtgccaccacacctggctaatttttgtatttttaatagagacatggtttcactactttggtcaggctagtcttgaactctcgacctcaagtaatctgcctgcctcagcctcccaaaatgctgggattacaggcgtgagccaccgggcccagcctaaaaaattttttttgtagagccagggtctcgctaagttgtccagactgatcttgagctcctggcttcaagtgatgctcctgccttggcctcccaaatcattgggattacaggcttgagccactgtgcctggcctgtctgatttttcttcaacgctatttccctagtgcctagcacagagcctggcccatagtaaatctctgttgtgtagtccaagattgggcttgaatctcagcttggcctgccgagtgtccttgcagaagggcttctgaaatcggtggcggtgcagccccattgtggaagtgctgcgtgggggcaaagctataggtggctggtatgtgggaggaggggagagaaagaatagtgggaaatgaacaagtgttgacccagcctccgctacatgaccttgatctcattcaggagtcacatcaaccatgagcaaggtgaagtcatccccattgtgtgctcgaagaaaccaaagctcagagaagtctcagaggccacagagctgggtgctggtggaaaaaagacttggcccttgctacattttaaaaagtcagagaaaaaagggaatacaccaaactggttcttagatcaccttgtttgtagctcttgtaagcgatgggatggggaaggtcggaggaaatggctgtctgtgtaaaccctctgcctgcccaccgacccatggcaaagctggctgctagggtcagtgagaggagccgcacacactgagcccttcttctctgacacaggtgaccctggagagcatgacccagcgtccacacacaaatccacacgccctgtgaagaaggtctccagtaagtagccccacccctgtctccatggcaacagcatggctgtggcctccccaggctctggccaagtcacttccggcccatcccgagtcactgtggggcctggacctcagtgggaaagaagttggtggcagtccccaccgcggggggctgtagggctgtggcagaagctcccctgtccatcagcattgcacgtttgggctgcctggaacagcaagatgcctgaggctggcttgttttgagaaatatttactatacccaagtccttgggcagagccttgggcaaggagactgatggcggtccaggaagggtggaggctaaacctccttggcatctcagcagtgttaagtctctgggttgtaatgggcttctgctattaccatgtttctcaactgtttttttttttttggtttctcactgttaccctcctcctgctcatccccagaaccatttgagaaaatttttttcctaattacaacccatgaaattttaataccacccatctactgcataactgtttatgtttgtgcttttacacataaaaagagtaatcttttttactccccctcccccaaggatccatttttgccctcctaggggtactatccccctcattgggcaggcacctgccattgacatgggggttgaggagaagagtggtcctgttctgcaaatgtggacaatagtgatatcgaggccacaggatgattctgagtgatgaggggacactgattgtgagagctctttatgagccatataccactgagatgtccatataccactgagatgtccatataccactgagatgtccatataccgctgacatgtccatataccgctgagatgttcatatactgctgacatgtccatataccgctgagatgtccatatactgctgacatgtccatataccgctgacatgttcatatatcgctgagatgtccatataccgctgacatgcccatataccgctgacatgttcatataccactgacatgtccatataccactgaaatgttagctgtcattgcttccctgaaaagttggtgtgaacccaggagggctggctgcacactgctggtgttggggggatgagagagccagggcttgctctttgttgttgttgcttgtgcttagtgttcaggtcacctgtagcaggcagagtgtggtatcggtccccgaatggaacagagtcagggctgggatgcctggtgcagatggaggagggagcccttagctgggccggaaaacctcgaagggtactttgtgtgaaaagaggagtgaaagaggaagtggaaaggtactgttgacctgtgtccttccccagtcaccttcctctgaaagctcctcccttagtatgaatgaggtagggatgccggccagcaggcaggtgtgttccccagtgaggtgaggtcctcatgtcacagcagaatgacaccctggagaataaagttcgggaatgaatcaaggctcctctaggctgaaatggggaaataggggagggggtatggagtagtcccagtgcagagagatgtctaagggtaggtgatgagggaggtgcctgtgccctagattgatgtcacagcctgggcctcccaagatgctggtccacagggagtgggtgggaaagtggcagaaggggaggaaatgggagagtgagcgactgtgagtgatgtgacttcgaagtaggagaagcggtagcaagggggctttgtggtgtgatgggggtctgggggagggagagggtaataggagagagcagggcttatctgtaatgtcaggtgtcctgcaggtgggcagggatatgatttcaaaaacgcccctttttgttccagtgttgtggaaggtggcaaagaaggaagctgggatcttctagcccacttgagtggactttggactcacctggagggcttgtacatcacagattgctgggtctcacccccagcctttatgattcagtggctctggcttggggcccaagaatttgcatttactattttttaagagacagagtctcgctcttttgcctaggctggagtgcagtggtgcgaacagaactcattgcagcctcgaactcctgggctcaagtgatcctcctaccttagcctcttgaggagttaggactgtaggcatgtgccactaagccaggctaattaaaacaatttttttttttttgtagagacaggatattgatatgttgtccaggctgatcttgaactcctggcctcaagcaatcctcctacctcagcctcccaaattgctgggattacaggagtaagctacagtgcctgaccaataatttgcatttcttaggggttctctggtgatgtcactgcagctggcttgggcaccagactttgagaacgactattttagccaaactcagttcctgtaggtagacactccagatatttttaaaagacttggcaagcatttttttttttttttgagacagggtctcattttgttgctgaggctggagtgcagtggcaagaacacagctcactgcagcctcatcctcctgggctcaagcaattcttctgcctcacctcccaagtagctgggactacaggtgtgtgccactaggcctggctagttttttctttttttttttttttgtaattttgtagagatggggtttccccatgttgcccatgctagtttctaacgcttgagatcaagtggttcctgcaccttggcctcccaaattgctgggattccaggcatgagccaccatgcgcccagcccttggcaagcattttttttttttctgattccctatttggtttttgtgttttttcctttatggaaatataatttacctgcagtaaatctcttttttccctgcagtaaatcttaaatgtgcagttagatctattttgacaaatgcatacatgtgttaccattgttcaaatcaagataaagaatttccctttctccagaaaattccttcatgctccttattagtcagtccccgcccccacgaccgctcatgctggtttctatcactatagattcattttgcctgctgactccttctgtttttcaaattaaaacatccttttatttgtctgggtcaaattcatgcacatgaatgttattattttgaaaatgtcattgtgttgtgccttaaaagaaattaaatctgaaaactttcttttgcagaagaggaaaagaaatccaagaaacctcgtaagttatgcatttctgcaactgttcgtttcttgagactgcccgagcacagaactaaatgctggtagtgagagtcgacctctctcatcagggttctgtgatgggttctatatgattccattctgtaatggcagcaggcctgaggctggaggggaggacaagcataagtgagatgaataaggtgactttagccttgtctgttttcccctgtgttgtcctgctgttcaggcgtgtgtttgtagaagtggctcttaatcagtgtggaagggagtagaggccatcccgttgctctgtatcatatttccctttccttacccccagcccctgtccctgccttacccagcaagcttcccacgtttggagccccggaacagttagtggatttaaaacaagctggcttggagggtaagttatcatgggcaaggagctttggggtgtccactctgagtttgttctgcaaatcactctctgtttcctctcccagctgcagccaaagccaccagctcacatccgaactcaacatctctcaaggccaaggtgctggagaccttcctggccaagtccagacctgagctcctggagtgtgagtagcttcggggctggtgcgcggttccactggttctgtctctcctgcgccgctctgtgcagctctctgtgaggccagctggccggctatatcagccactccccttcacttgtcctctactttgttgctcccttattttctcccagtcatcagtgcctttctttacttttcctaactagctcagatttcacaatcggtcctttgactctccctcttgccgtctagtctggcccaattgagctcacctttctctgtgggtcggcgcctgcatgtcctctgcagagaaggcagggcgattgcggtcaccggccttcaccgggcgtcccgttgccggcatgcctgccctgcatctcctgtctcctccccaccactctccagagccaccattcccaagacttcccactggccatagctccatccttctccctgtcccgcccaccttctgcttcacgaaaaagacagacactgtagaaggggctccccctgctctgttattgacatcgcatctgcatctactgtgcccccttcctcgcctcctggcccctttcccaagaccccctggccctgggctctggagtctgctccccacacgctctctggaatcttctgctctctcttaggcctttccattcccatctcttcaccctcagcatctctacctaggcttgcctatctgtagcacgtttacatctctccaaatcacaaaaacaaacctagcaaaactgtctcagctgcagctctgtttcctgcctccctttcacccgaatgcttgttaaaaatacaaattactagctgggtgcggtggctcatgcctgtaatcccagcactttgggagcccgaggcaggtggatcacctgaggtcaggagttcaagaccagcctggccaacatggcaaaaccccatctctactaaaaatacaaaaaattagccgggcgtggtggcacatgcctataatcccagctacttgggaggctgaggcacgagaatcacttgaacttgggaggtggaggttgcagtgagccgagattgtgccactgcactccagtctgggcaacagagcgagactctgtcttaaaaaacaaacaaacaaacaaaaaaccccaaaaaccaaattcctgggccctgttctagccctacaagatcagactcaggcaagcacggaaagctgtatgtttagctcatttcctccatgatccttttgaggacagttggggaaaagcagctctgcagattttctacattggtggctctcaactgtggctgcgtgttggaatcctggggagctttttaaaatccccgatgcccaggctgtcccccagactggttcattcagaatgttggtgtttggctgcccagggttgcaatgtggggccgaggtgggagcctgaagtctaatcctcgtgccactgcattctgacctctgtcctgcccttgacccaggcagctctgaggtcatcagtgtactccgtgtcacaaaatccagggacgcctttcagcttttatttagcttcacctgtcagtggcattcctcctccttctgacactctctccccttgccgcttgagctgctatacccccctgggtttccatccacccctcctttgcaagctcgtccaacctggaagtgggtggagttccgttgtcaaggccaggcctagggccctcccactttccgtcttcttgtttcttctgcacccacgtgcaacactccaggcagcacctgccagtggtacccacttccatgtggaggccaaagccaatcactgaaaaatatagcccttcctttatcataagcagctgcagcaggcttggtggggatctgtgggtcccttgctttttcagggctggccttcttgtagccctccgctgtccctgccccccaagagaggcccagaccagccctgggctgcagctaactcttgcccaagctgctagcggcggtgctgagccacgtctttcaggagctgctgtgcactctgtggcagccgcataaacagggaaagtaaaattctatcaacttagggccttttccacccccagcttattcattttgccttgggggaaactcgggctccagtgaaaagtgtcatgccctgagccacctagcaaatgagtgcctcgcttggctccctgctgcccaccagttaaagtctagcctcctaagcccttccctttctagccccaacatgtttcccttctcctgctgcatctgtgttcccagccacccagcttccccgatcccagcacatgcgaatccccttggcactccgtggcttcactctcactgttccctctgtctggaacagcttttctctctctgttctcctctgtctagttctcatcttctgttacttggctccaattccagcctgccagtgaaatgttccccaactgtagcatcagttgccttgtctctgtgtccctacagtgtgtgcttacccttttggcagagtgtgagtctcatggtgttgttactgatggacttgccttgcttgttggagtgtgaactccatgaggcccggcaccttgtctctctggttcatggttgtgcatcttgtgccagaatctggtgtcagtcaggtgcctggtaaatggttttggatggatgaatggacagacatacggatgactgatagatgatagatggctggctggctggacagaatggatggatgaatggatggatagatgagctgatgaataatggatgggtggatagatgggtggatggataaatggacagatggatagataagtggatagattaatgaatgaatgaatggataaatggaaaggcagaaggatggatagataagtggatagatggatgaatggaagaatggatagataggtagatagatgggtatatggatacatgggtagatggatagatggatggatggatacatggatggattgatggatacatggatagacagatagatggatgaatagacagacagatggatagatgagtggatggatggaccaatgggtagatgggtgcatggatggataaaactagtgaataaatagtaccactttggcaaaggtctaaaagagcactttgggccccttgtaattaattccttggggtgatgttttctcagattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattccccaagaggtcccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagctactgtaggttctgtcttgggccacttggatctgaaggctgcccctttgctctctggggtagccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacctcatggggaacaggaacattcctgttcatccctggccacaggctgcagacccagcactggcccttgcgtgagtcagagcctggggctggccctagccccttctactgacttcctcatttaagccaattatataagctcacattgatcagggagggagggaaagagctaaagagggtcacacaagtggctattttccctgcagtgtttctgtgtggtgaaaataacccagtccactaaggggcgggagtgaatggatggctggattttccccaagctccttatagcctaatgttgtcaggatgtgagtatgaggaatttagcctcttatagtgaaatgagtccaactctgggctttgcttagaggagagctcctgtcaggcttcctataatatgaaaagaagtcaccattggggaactagagaccccagaccttttcatatggatatttgagaatgtaatgcatctcaggcctcgtgctggaactctagggcactctaggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacac

SEQ ID NO: 15895 - DNA, 4523 bp, Human
  misc_feature (1)...(4523): n = A,T,C or G
tactgatgacagagctggaaattctatggtaagaaagccaggctaggctcaggggcttacacctataatcccaaaactaggaggccaaggtgggaggatcgctgagcaagaacccatctttacaaaaacactaaaaaaaaaaaaaaaaaaaaaaaaaattaggccaggcacagtggctcacgcctgtaatcctagcactttaggaggccgaggcaggcagatcacctgggtcaggagttcaagactagcctggctaacatggtaaaaccccatctctaccaaaaatacaaaaattagctggacatgatagcaggcacctgtaatcccagctactcaggaggctgaggcaggaaattcgtcaaaacctgggaggtggaggttgctgtgagccgagatcacgccattgcactccagcctgggtgacggagctagactccatctcaaaaaaaaaaaaaaaaaattagccagttatggtggcacatgcttgtggtcccagctactcaggaggctaagccaggaggatccactcgagcccaggaggtagaggctgcagtgagcctgttcatgcccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcagcctcctgagtagctaggactacaggcacatgccaccatggctggctaatttttgtatttttagtagagacggggtttcaccatgttggccaagctggtcttgaactcttgacctcaagtgacctgcccacctctgcctcccaaagtgttgggattataggtgtgagccactgcacccagcctcattttcatttttgaatcccaagctctaccaaatccaactgatgtttgttaaactaaatttaaaccattaggcatgagaaatcttaggaaaagcaaaattctaccatttctacagtagagatctccttagaaaacttgatcttccactaggtattcaattcaacaaggggtgtccttagtttctctgaagttatccattaaaaacagtatatgtagctgggcgcggtggctcatgcctataatcccagcactttgggaggccgaggcgggcagattacgaggtcaggagattgagaccatcctggctaacacagtgaaactctgtctctactaaaaatacaaaaaattagccaggcgtggtggcgggcgcctgtagtcccagttactcaggggactgaggcagaagaatggcgtgaacccgggaggcagagcttgcagtgagccaagatagcgccactgcactccagcctgggcgacagagcaagactccgtctcaaaagaaaaaaaaaaaacaagcctttcgttgcctgatcgccgccatcatgggtcgtatgcgtgctcctgagaagggcctgtcccagtcggctttaccctatcgacgcagcttccccacttggttgaagttgacatctgacgacgtgaaggagcagatttacaaactggccaagaagggccttactccttcacagatcggtgtaatcgtgagagaatcacatggtgttgcacaagtacgttttgtgacaggcaataaaattttaagaattcttaagtctaagggacttgctcctgatcttcctgaagatctctaccatttaattaagaaagcagttgctgttcaaagcatcttgagaggaacagaaaggataaggatgctaaattccatctgattctgatagagagccagattcaccgtttggctcaatattataagaccaagcgagtcctccctcccagttggaaatatgaatcatctacagcctctgccctggtcgcataaatttgtctgtgtactcaagcaataaaatgattgtttaactaaaataaaacaaaaacaaaaacaaaaaaaccatatatgtaaatggttcaaaatagctaaacattatcatcataagacaacctattgtttagccaggacctactacgtgacttgccctttacatagattattattaatcttcagaattctgcaaggtaagaataatatctattctacaaataaataaaaactcgaagtgacatcatagcttgttctgggtcatgaagctgagattttaattaggactctaagcctttcaactatatgcagccctgtttcatgaacatgttccatatattacagacattcatctttaatagagtcttatgcaactaagatattggtcagcctgacaaaataatacatttttaaagtctaaccttcaaatgtccttcgcctgtgaggaattcagagtaaccagcatcagtagccagcaaacctacaaattgcatgcttggacgttgttgtataaaggcttcaacggctttatctgtcacgtgctttctcccagaaacatccagagaaacaaggttaggtaggatgtctttttgttctagtaagcgaagagctatgtctgatgtaaactgtttatcatctgagatatcaagatgattcagatgtttgagttcccgaactacatccagtatctgggtagttgtcatttttaaacatttcaagtggtgcatggttagagacttgagtcggtctttgcaggccagtagagcagtgatgtctgtgattgaggtgttagaaatatccaagctctctaatcttggcaatgaggcaacttcagccaggtcttcattgtaaaagagaacattcgtgatgcttaaagctcgaaggccagaaagccggctgaagcagcgctcgtaaggatcctcgagggagagagttaatgaattcagcaccaggcactggagattctgctggatccatttgttactgccaagcccactgataatgtctgtaatcgtgatatcagcattcacacctgtggcatcaagttccactaacttgtggtggcagaaagctttccggaaagcaacagcagagatctttgctttgcgaatgcaggctcgctttaagcgcatctggttgcccctaaaaatacccacagttccatcattcaatagacctgtggaaaaacaagcagcgttttaaattcaaaaaacagttaaagaatagccaaaatttccatcacactttacatttccaaagcgctcccatgtaacagtatctcgtctgataatcacaattcatttaggtgagattattattgtttacaacttgtagatgagtaaactggggctcagagagtggctttccaagatcacagggctagcaagtggcagaatcaggactgtggcagacattattgatatccactaacatctagttcttaccttaccagacaactacatttcccagcccatccctggagttagctggagccatgtgcctagttctggccaatgcactatatgttgaagcacctgagagccagtgcatgattttccatgctgtcttttcctgctatgacaaacgaggagacttcacgttctagagagtatagttatatgaggagaaaccctccatcagtttggaccctagggtgaccatgaagcagaatcctctatggacttgcagagtttatgtaccacaagtgaggtataaaccttgtgttaaggtatttgatttgttaccaatacatttctagcctatcctttaaattcaccttaacatattattatacaaacacatatacacataatatatttagcatgcacttaatgccttgtaattcattaataaaccactagccagatctcaaaccttattaaagcgatctaggcctgggaaacatagcaagaccccatctctgcaaaataactgaaaacgagttgggcacagtggtcatgcctatagtcctagctactagggaggctgagatggaaggatcatttgagcccaggagtttgtggttatagtgaattatgattgca
